United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 3

SEQ ID NO: 6290 - DNA, 768 bp, Artificial Sequence
  chemically treated genomic DNA (Homo sapiens) CpG-island No: 6290
taaacatcaacgcaatcaaactattcacctaaaaactctttactaaacgacgaaaaaatacgttacaattctctacgcaaaacgcatacgcgaaaaatccgaaaaatataatcgaaaaaaaacgaaacatcaaaaaaaatctcgcgaacataaacgattcgacgcgaaaaacgaaaaataaaaaaacgacttaaaacaaacgcgcgcgcgcaatacaaaaaccaaccccccgcgactaaaatactcaaaatacccaaaaacgaaataataacctcgcgcgtacgctatacccgcgacaacgccgaatcctaatatataaattattattaacaccgcacgacgcgtacgcaataaaaacgacgaaaaaatttacgaccgaaacccaccccctactccaatcgctatcgaaaaccgcgcgaataactaaacaacgacctaatacgctcgcttaacgaacgacgaaatcaaacgaacgtaaacgcccccgaaataaaaaccgaaacaaaaattattattactaaaaaactaccgcaaccgccgcgaacctccgaacaaacgccaaaacgaaaaaaacgctacgcgataaataaatataactaaataacccgacgaaatacgaaaccgctacccaaaaaccccaacgataaacccgatcctcttccccgcgaccaaacccctttcccgcgtccccgccacaaatcccttctacatccctttcccgaaccccgaaatctctaaacacccacgcccgcttcccacaacgccctc

SEQ ID NO: 6291 - DNA, 768 bp, Artificial Sequence
  chemically treated genomic DNA (Homo sapiens) CpG-island No: 6291
tagatattaacgtaattaggttgtttatttagggattttttgttaggcggcggagaggtacgttatagttttttacgtaaaacgtatgcgcgaaagattcgggaagtgtgatcggaaaggggcggagtattagggagagtttcgcggatataggcggttcggcgcggaaagcgggaggtggaggggcggtttggggtaagcgcgcgcgcgtagtgtagaagttagtttttcgcggttgaggtatttaaggtgtttaaaggcggggtagtgatttcgcgcgtgcgttgtgttcgcggtagcgtcgggttttagtgtgtgggttgttgttggtatcgtacggcgcgtgcgtagtgaggacggcggagggatttgcggtcgggatttattttttgttttagtcgttatcggaggtcgcgcgggtggttgagtagcggtttggtgcgttcgtttagcgggcgacggaattagacggacgtggacgttttcggagtggaagtcgaagtaggagttgttgttgttgaggggttgtcgtagtcgtcgcgagttttcggatagacgttagagcgaggagggcgttacgcggtgagtgagtgtgattgagtggttcgacggggtgcggggtcgttatttagaagttttagcggtgggttcggttttttttttcgcggttaggtttttttttcgcgttttcgttataggttttttttgtatttttttttcggatttcgaaatttttgggtatttacgttcgttttttatagcgttttt

SEQ ID NO: 6292 - DNA, 768 bp, Artificial Sequence
  chemically treated genomic DNA (Homo sapiens) CpG-island No: 6292
aaaaacgctataaaaaacgaacgtaaatacccaaaaatttcgaaatccgaaaaaaaaatacaaaaaaaacctataacgaaaacgcgaaaaaaaaacctaaccgcgaaaaaaaaaaccgaacccaccgctaaaacttctaaataacgaccccgcaccccgtcgaaccactcaatcacactcactcaccgcgtaacgccctcctcgctctaacgtctatccgaaaactcgcgacgactacgacaacccctcaacaacaacaactcctacttcgacttccactccgaaaacgtccacgtccgtctaattccgtcgcccgctaaacgaacgcaccaaaccgctactcaaccacccgcgcgacctccgataacgactaaaacaaaaaataaatcccgaccgcaaatccctccgccgtcctcactacgcacgcgccgtacgataccaacaacaacccacacactaaaacccgacgctaccgcgaacacaacgcacgcgcgaaatcactaccccgcctttaaacaccttaaatacctcaaccgcgaaaaactaacttctacactacgcgcgcgcgcttaccccaaaccgcccctccacctcccgctttccgcgccgaaccgcctatatccgcgaaactctccctaatactccgcccctttccgatcacacttcccgaatctttcgcgcatacgttttacgtaaaaaactataacgtacctctccgccgcctaacaaaaaatccctaaataaacaacctaattacgttaatatcta

SEQ ID NO: 6293 - DNA, 994 bp, Artificial Sequence
  chemically treated genomic DNA (Homo sapiens) CpG-island No: 6293
ttacgtttcgttttttatcgggtcggttgcggttgtagtagtaagtttcgtgtcgtcgcggtcgtcgcggaagttaggtagcgtttcgaggtagaagacgacgatggagacgaggatgattagtacggagattacggcgagtacgcgcgcggtttgagagttttcgggaaattcgaaaagtagttatagttggcgggcgaaggcgcggcggggtagggggcgttcgggcggtatcgggtagttttcgttttcgcgtaggcgtgttagggtcgtcgcgtttagttcgtagaaggttattttttttaggaagacgtcgagcggtacgtgcgtcggtcgtcgtagtcgtttatcggattggtagtagtagagtacggcgtcgaagttgggtcggtgtcggtcgaagaaatattcgcggcgcgcgtcgtcgtagaagcggtcgcggcgcgttgggttttttagtagagtgttcgggaagcggtttagcgtgcgcgttcgcgtttcgaagcgtagttcggttacgttgagtattagtcgttcgtagtagtcgtacggcggcgggtatcgcggttttatggcgcgcgtagtttcggcgattcgcgaatcgacgtgtggtttcgacgttcggtttcggtgcggtttcgtttcggtcgtttcggtcgtcgtcgtcgtcgttttagttcggtgttcggtgttcggtgttcgcgcgtaaaaatagttcggtagggcggttagggcgcgagggagggggtattgtgatttcggcggggcggagggcgatagggcgatcgcgcgttttttgtcgggacgttcgttttgttttgtttcgtcgtcgtcgtcgttcgcgtttgttttgcgtttttttcgtttcggggtttttttttttttcgtttttttgtcgtcgggattttgttttgcgtttttttaagttttcgtgtgcgtgtgtttcgttagaattaggttttagttgtagtcgttttttttttttttttttttt

SEQ ID NO: 6294 - DNA, 994 bp, Artificial Sequence
  chemically treated genomic DNA (Homo sapiens) CpG-island No: 6294
aaaaaaaaaaaaaaaaaaaaacgactacaactaaaacctaattctaacgaaacacacgcacacgaaaacttaaaaaaacgcaaaacaaaatcccgacgacaaaaaaacgaaaaaaaaaaaaaccccgaaacgaaaaaaacgcaaaacaaacgcgaacgacgacgacgacgaaacaaaacaaaacgaacgtcccgacaaaaaacgcgcgatcgccctatcgccctccgccccgccgaaatcacaataccccctccctcgcgccctaaccgccctaccgaactatttttacgcgcgaacaccgaacaccgaacaccgaactaaaacgacgacgacgacgaccgaaacgaccgaaacgaaaccgcaccgaaaccgaacgtcgaaaccacacgtcgattcgcgaatcgccgaaactacgcgcgccataaaaccgcgatacccgccgccgtacgactactacgaacgactaatactcaacgtaaccgaactacgcttcgaaacgcgaacgcgcacgctaaaccgcttcccgaacactctactaaaaaacccaacgcgccgcgaccgcttctacgacgacgcgcgccgcgaatatttcttcgaccgacaccgacccaacttcgacgccgtactctactactaccaatccgataaacgactacgacgaccgacgcacgtaccgctcgacgtcttcctaaaaaaaataaccttctacgaactaaacgcgacgaccctaacacgcctacgcgaaaacgaaaactacccgataccgcccgaacgccccctaccccgccgcgccttcgcccgccaactataactacttttcgaatttcccgaaaactctcaaaccgcgcgcgtactcgccgtaatctccgtactaatcatcctcgtctccatcgtcgtcttctacctcgaaacgctacctaacttccgcgacgaccgcgacgacacgaaacttactactacaaccgcaaccgacccgataaaaaacgaaacgtaa

SEQ ID NO: 6295 - DNA, 994 bp, Artificial Sequence
  chemically treated genomic DNA (Homo sapiens) CpG-island No: 6295
agaaagagaaaagaaaagaggcgattgtaattgaagtttgattttgacgaaatatacgtatacggaaatttggagagacgtaggataggatttcggcggtagaaggacggagagaaaggggatttcgggacgggaaaggcgtagagtaggcgcgggcggcggcggcggcggggtagggtagggcgggcgtttcggtagagggcgcgcggtcgttttgtcgtttttcgtttcgtcggggttatagtgttttttttttcgcgttttagtcgttttgtcgggttatttttacgcgcggatatcggatatcggatatcgggttggggcggcggcggcggcggtcgaggcggtcgaggcggggtcgtatcggggtcgggcgtcggggttatacgtcggttcgcgggtcgtcggggttgcgcgcgttatggagtcgcggtgttcgtcgtcgtgcggttgttgcgagcggttggtgtttaacgtggtcgggttgcgtttcgagacgcgggcgcgtacgttgggtcgtttttcggatattttgttaggggatttagcgcgtcgcggtcgtttttacgacgacgcgcgtcgcgagtattttttcgatcggtatcggtttagtttcgacgtcgtgttttattattattagttcggtgggcggttgcggcggtcggcgtacgtgtcgttcgacgtttttttggaagaggtggttttttacgggttgggcgcggcggttttggtacgtttgcgcgaggacgagggttgttcggtgtcgttcgagcgttttttgtttcgtcgcgttttcgttcgttagttgtggttgtttttcgagtttttcgagagtttttaggtcgcgcgcgtgttcgtcgtagttttcgtgttggttattttcgtttttatcgtcgttttttgtttcgagacgttgtttgattttcgcgacgatcgcgacggtacggggtttgttgttgtagtcgtagtcggttcggtgagaggcggggcgtgg

SEQ ID NO: 6296 - DNA, 994 bp, Artificial Sequence
  chemically treated genomic DNA (Homo sapiens) CpG-island No: 6296
ccacgccccgcctctcaccgaaccgactacgactacaacaacaaaccccgtaccgtcgcgatcgtcgcgaaaatcaaacaacgtctcgaaacaaaaaacgacgataaaaacgaaaataaccaacacgaaaactacgacgaacacgcgcgcgacctaaaaactctcgaaaaactcgaaaaacaaccacaactaacgaacgaaaacgcgacgaaacaaaaaacgctcgaacgacaccgaacaaccctcgtcctcgcgcaaacgtaccaaaaccgccgcgcccaacccgtaaaaaaccacctcttccaaaaaaacgtcgaacgacacgtacgccgaccgccgcaaccgcccaccgaactaataataataaaacacgacgtcgaaactaaaccgataccgatcgaaaaaatactcgcgacgcgcgtcgtcgtaaaaacgaccgcgacgcgctaaatcccctaacaaaatatccgaaaaacgacccaacgtacgcgcccgcgtctcgaaacgcaacccgaccacgttaaacaccaaccgctcgcaacaaccgcacgacgacgaacaccgcgactccataacgcgcgcaaccccgacgacccgcgaaccgacgtataaccccgacgcccgaccccgatacgaccccgcctcgaccgcctcgaccgccgccgccgccgccccaacccgatatccgatatccgatatccgcgcgtaaaaataacccgacaaaacgactaaaacgcgaaaaaaaaaacactataaccccgacgaaacgaaaaacgacaaaacgaccgcgcgccctctaccgaaacgcccgccctaccctaccccgccgccgccgccgcccgcgcctactctacgcctttcccgtcccgaaatcccctttctctccgtccttctaccgccgaaatcctatcctacgtctctccaaatttccgtatacgtatatttcgtcaaaatcaaacttcaattacaatcgcctcttttcttttctctttct

SEQ ID NO: 6297 - DNA, 516 bp, Artificial Sequence
  chemically treated genomic DNA (Homo sapiens) CpG-island No: 6297
gtttcggtcgtttttttcggattgtgcgttcggttttatttcgtcgttttttttgtttttttgcgtttcggggtttttgatattcggggtttttgcgtttcgttttcgtttcgtagacgtgtttcgggcggttgagtttttcgagcggttttagcgtagcggggagttgtcgtcgtagaagttgtaggttttttagcgagttttgtagagtcgtttttgtttcgttattcgagaggtgaggggcgcgcggcgtaggggcgcgagttggtggtcgtcgtttttttttttttttttttgtttgtttcgagttcggagattacgtttttcggtagttttcgaggcggttcgttttggggtgttaacgttttagtttaggggtttttcgggagttgtagttttttcggttttttgttgcgggggcggggcggatttttgcgtggtagcgggagagggtttagaggtttgaatttttgcgtttagggttggaggagttggcgattttttgatgtcgttgtt

SEQ ID NO: 6298 - DNA, 516 bp, Artificial Sequence
  chemically treated genomic DNA (Homo sapiens) CpG-island No: 6298
aacaacgacatcaaaaaatcgccaactcctccaaccctaaacgcaaaaattcaaacctctaaaccctctcccgctaccacgcaaaaatccgccccgcccccgcaacaaaaaaccgaaaaaactacaactcccgaaaaacccctaaactaaaacgttaacaccccaaaacgaaccgcctcgaaaactaccgaaaaacgtaatctccgaactcgaaacaaacaaaaaaaaaaaaaaaaaaacgacgaccaccaactcgcgcccctacgccgcgcgcccctcacctctcgaataacgaaacaaaaacgactctacaaaactcgctaaaaaacctacaacttctacgacgacaactccccgctacgctaaaaccgctcgaaaaactcaaccgcccgaaacacgtctacgaaacgaaaacgaaacgcaaaaaccccgaatatcaaaaaccccgaaacgcaaaaaaacaaaaaaaacgacgaaataaaaccgaacgcacaatccgaaaaaaacgaccgaaac

SEQ ID NO: 6299 - DNA, 516 bp, Artificial Sequence
  chemically treated genomic DNA (Homo sapiens) CpG-island No: 6299
ggtagcggtattagggagtcgttagtttttttagttttagacgtaggagtttaggtttttagattttttttcgttattacgtaaggattcgtttcgttttcgtaatagaaggtcgagaaaattataattttcgaagaatttttgagttgaagcgttggtattttaaggcgggtcgtttcgggagttgtcgggaggcgtagttttcgggttcgggataagtaggaggaggaggaggaggacgacggttattagttcgcgtttttgcgtcgcgcgttttttatttttcggatagcggagtagaagcggttttgtagaattcgttggagggtttgtagtttttgcggcggtagtttttcgttgcgttggagtcgttcgaggagtttaatcgttcgggatacgtttgcggggcgggggcggggcgtagaaatttcgagtgttagagatttcgagacgtagagaagtaaggagagcggcggagtgaggtcgagcgtatagttcggggaggacggtcgaagt

SEQ ID NO: 6300 - DNA, 516 bp, Artificial Sequence
  chemically treated genomic DNA (Homo sapiens) CpG-island No: 6300
acttcgaccgtcctccccgaactatacgctcgacctcactccgccgctctccttacttctctacgtctcgaaatctctaacactcgaaatttctacgccccgcccccgccccgcaaacgtatcccgaacgattaaactcctcgaacgactccaacgcaacgaaaaactaccgccgcaaaaactacaaaccctccaacgaattctacaaaaccgcttctactccgctatccgaaaaataaaaaacgcgcgacgcaaaaacgcgaactaataaccgtcgtcctcctcctcctcctcctacttatcccgaacccgaaaactacgcctcccgacaactcccgaaacgacccgccttaaaataccaacgcttcaactcaaaaattcttcgaaaattataattttctcgaccttctattacgaaaacgaaacgaatccttacgtaataacgaaaaaaaatctaaaaacctaaactcctacgtctaaaactaaaaaaactaacgactccctaataccgctacc

SEQ ID NO: 6301 - DNA, 646 bp, Artificial Sequence
  chemically treated genomic DNA (Homo sapiens) CpG-island No: 6301
cggtttttgtgtgggcggggcggagcgaattattagtttcgttcgtcgggggaattttgtaggtcgtattattgtttgcgtgggagtcgcgggtgggggtgtcgcgtgtagttttcgaggcgggcgtaggggtgtagaatgaggtgttttcgtttatcgggcgtttattttattttttaaatatagcgcgttttttcggaagtagttttcgttttgaaatttaatttttagttttatttcgttgttcgtttagttttcgtgtttcgtgcggcgcgagggttagtgcgcgttattgtcgggagtcggggtcgcgattcgcgttttacgtcgcgcgttattcgttttaggtgatattatttttttgtcgggtttcgtttttcgttttagtcgttttacgtcgcgtgtttattggtcgacgcgttttatgtttcgtttttcgtttttcgttcgcgcgatttttttcggtcggtgtggaggcggggtttagtcgtcggtcggcgtcgacgtttttttttattggtcgtttttcgtcgtttgttagttttttgttaaaggggttacgatcgttcgggagtcgtggggggggagggggagggaggaggaatttttttggggggaaggtgggatttggggggcgttggtgggt

SEQ ID NO: 6302 - DNA, 646 bp, Artificial Sequence
  chemically treated genomic DNA (Homo sapiens) CpG-island No: 6302
acccaccaacgccccccaaatcccaccttccccccaaaaaaattcctcctccctccccctccccccccacgactcccgaacgatcgtaacccctttaacaaaaaactaacaaacgacgaaaaacgaccaataaaaaaaaacgtcgacgccgaccgacgactaaaccccgcctccacaccgaccgaaaaaaatcgcgcgaacgaaaaacgaaaaacgaaacataaaacgcgtcgaccaataaacacgcgacgtaaaacgactaaaacgaaaaacgaaacccgacaaaaaaataatatcacctaaaacgaataacgcgcgacgtaaaacgcgaatcgcgaccccgactcccgacaataacgcgcactaaccctcgcgccgcacgaaacacgaaaactaaacgaacaacgaaataaaactaaaaattaaatttcaaaacgaaaactacttccgaaaaaacgcgctatatttaaaaaataaaataaacgcccgataaacgaaaacacctcattctacacccctacgcccgcctcgaaaactacacgcgacacccccacccgcgactcccacgcaaacaataatacgacctacaaaattcccccgacgaacgaaactaataattcgctccgccccgcccacacaaaaaccg

SEQ ID NO: 6303 - DNA, 646 bp, Artificial Sequence
  chemically treated genomic DNA (Homo sapiens) CpG-island No: 6303
gtttattagcgttttttaaattttattttttttttaaaaaaattttttttttttttttttttttttttacggttttcgggcggtcgtggtttttttaataggagattgatagacggcgaagagcggttaatgggagagagcgtcggcgtcggtcggcgattagatttcgtttttatatcggtcgggaggggtcgcgcgggcggagagcgagaggcggggtataaggcgcgtcgattaataggtacgcggcgtgaggcggttggggcgggaggcggagttcggtagggggatgatgttatttggagcgagtagcgcgcggcgtggaacgcgagtcgcgatttcggttttcggtagtggcgcgtattagttttcgcgtcgtacgggatacgagggttgggcgggtagcgggatgaggttaaaggttggattttaaggcgggggttgttttcggaaagacgcgttgtgtttggaaggtggagtgagcgttcggtgggcgagggtattttattttgtatttttgcgttcgtttcgggaattgtacgcggtatttttattcgcgatttttacgtagatagtagtgcggtttgtagggttttttcggcggacgaggttaatggttcgtttcgtttcgtttatatagaggtcg

SEQ ID NO: 6304 - DNA, 646 bp, Artificial Sequence
  chemically treated genomic DNA (Homo sapiens) CpG-island No: 6304
cgacctctatataaacgaaacgaaacgaaccattaacctcgtccgccgaaaaaaccctacaaaccgcactactatctacgtaaaaatcgcgaataaaaataccgcgtacaattcccgaaacgaacgcaaaaatacaaaataaaataccctcgcccaccgaacgctcactccaccttccaaacacaacgcgtctttccgaaaacaacccccgccttaaaatccaacctttaacctcatcccgctacccgcccaaccctcgtatcccgtacgacgcgaaaactaatacgcgccactaccgaaaaccgaaatcgcgactcgcgttccacgccgcgcgctactcgctccaaataacatcatccccctaccgaactccgcctcccgccccaaccgcctcacgccgcgtacctattaatcgacgcgccttataccccgcctctcgctctccgcccgcgcgacccctcccgaccgatataaaaacgaaatctaatcgccgaccgacgccgacgctctctcccattaaccgctcttcgccgtctatcaatctcctattaaaaaaaccacgaccgcccgaaaaccgtaaaaaaaaaaaaaaaaaaaaaaaaaatttttttaaaaaaaaaataaaatttaaaaaacgctaataaac

SEQ ID NO: 6305 - DNA, 655 bp, Artificial Sequence
  chemically treated genomic DNA (Homo sapiens) CpG-island No: 6305
cgtagagagcggagtcgggagcgagataaggagcgagaacggcgacgttttcgttttcgggatcggcggaggcgtttacggagtcgcgataaggaggagcggaggcgttttagggagcggagtaaggataaggatcgggatcggaagcggcgaagtagtcggagtcgggagcgggttcggcgggagcgggagcgtaaggaggagttgcgtggcggcggtggcgatatggcggagtttttcgaggcgggtgacgcgttttttgatgatgggtttttaggggagttcgggtttgacggttttgacggtttagaggaaaagggtcgggatcgtgatcgggagcgacggcggagttatcggagcgagcgcgagcggcgtcgggatcgggatcgtgatcgtgatcgtgatcgcgagtataaacggggggagcggggtagtgagcggggtagggatgaggttcgaggtgggggcggtggttaggataacgggttggagggtttgggtaacgatagtcgagatatgtatatggagtttgagggcggcgacggttatttggtttcggagaatgggtatttgatggaggttgcgtcggagtgaagaggtcgttttttttatttgttgtgtttggacgcgtttttgtttagttttttgttgttat

SEQ ID NO: 6306 - DNA, 655 bp, Artificial Sequence
  chemically treated genomic DNA (Homo sapiens) CpG-island No: 6306
ataacaacaaaaaactaaacaaaaacgcgtccaaacacaacaaataaaaaaaacgacctcttcactccgacgcaacctccatcaaatacccattctccgaaaccaaataaccgtcgccgccctcaaactccatatacatatctcgactatcgttacccaaaccctccaacccgttatcctaaccaccgcccccacctcgaacctcatccctaccccgctcactaccccgctccccccgtttatactcgcgatcacgatcacgatcacgatcccgatcccgacgccgctcgcgctcgctccgataactccgccgtcgctcccgatcacgatcccgacccttttcctctaaaccgtcaaaaccgtcaaacccgaactcccctaaaaacccatcatcaaaaaacgcgtcacccgcctcgaaaaactccgccatatcgccaccgccgccacgcaactcctccttacgctcccgctcccgccgaacccgctcccgactccgactacttcgccgcttccgatcccgatccttatccttactccgctccctaaaacgcctccgctcctccttatcgcgactccgtaaacgcctccgccgatcccgaaaacgaaaacgtcgccgttctcgctccttatctcgctcccgactccgctctctacg

SEQ ID NO: 6307 - DNA, 655 bp, Artificial Sequence
  chemically treated genomic DNA (Homo sapiens) CpG-island No: 6307
atgatagtaaggggttgggtaggaacgcgtttaaatatagtagatggagaggacgatttttttatttcggcgtagtttttattaaatatttatttttcggagttaggtagtcgtcgtcgtttttagattttatgtatatgtttcggttgtcgttgtttagattttttagttcgttgttttggttatcgtttttatttcgggttttatttttgtttcgtttattgtttcgtttttttcgtttgtgttcgcggttacggttacggttacgatttcggtttcggcgtcgttcgcgttcgtttcggtggtttcgtcgtcgttttcggttacgatttcggttttttttttttggatcgttagggtcgttaggttcgagtttttttggaggtttattattagggggcgcgttattcgtttcggagggtttcgttatgtcgttatcgtcgttacgtagtttttttttgcgttttcgttttcgtcgggttcgttttcgatttcggttgtttcgtcgttttcggtttcggtttttgtttttgtttcgttttttggagcgttttcgtttttttttgtcgcgatttcgtgagcgttttcgtcggtttcgggagcgggagcgtcgtcgttttcgttttttgtttcgttttcggtttcgttttttgcg

SEQ ID NO: 6308 - DNA, 655 bp, Artificial Sequence
  chemically treated genomic DNA (Homo sapiens) CpG-island No: 6308
cgcaaaaaacgaaaccgaaaacgaaacaaaaaacgaaaacgacgacgctcccgctcccgaaaccgacgaaaacgctcacgaaatcgcgacaaaaaaaaacgaaaacgctccaaaaaacgaaacaaaaacaaaaaccgaaaccgaaaacgacgaaacaaccgaaatcgaaaacgaacccgacgaaaacgaaaacgcaaaaaaaaactacgtaacgacgataacgacataacgaaaccctccgaaacgaataacgcgccccctaataataaacctccaaaaaaactcgaacctaacgaccctaacgatccaaaaaaaaaaaaccgaaatcgtaaccgaaaacgacgacgaaaccaccgaaacgaacgcgaacgacgccgaaaccgaaatcgtaaccgtaaccgtaaccgcgaacacaaacgaaaaaaacgaaacaataaacgaaacaaaaataaaacccgaaataaaaacgataaccaaaacaacgaactaaaaaatctaaacaacgacaaccgaaacatatacataaaatctaaaaacgacgacgactacctaactccgaaaaataaatatttaataaaaactacgccgaaataaaaaaatcgtcctctccatctactatatttaaacgcgttcctacccaaccccttactatcat

SEQ ID NO: 6309 - DNA, 738 bp, Artificial Sequence
  chemically treated genomic DNA (Homo sapiens) CpG-island No: 6309
atcgtgtaggttttcgacgttaatgataacgttttcgtttttatttaaattttttatattttgttcgttcgcgagaataatagtttcgttttgtatatcggtagtgttagcgttatagatagagattcgggtattaacgtttaggttatttattcgttgttgtcgttttaggattcgtatttgtttttcgtttttttggtttttattaacgtagataacggttatttgttcgtttttaggtcgttggattacgaggttttgtaggcgttcgagtttcgcgtgggcgttttagatcgcggtttttcggttttgagtagcgaggcgttggtgcgcgtgttggtgttggatattaacgataattcgtttttcgtgttgtattcgttgtagaatggtttcgcgttttgtatcgagttggtgtttcgggcggtcgagtcgggttatttggtgattaaggtggtggcggtggacggcgattcgggttagaacgtttggttgtcgtattagttgtttaaggttacggagtttgggttgttcggcgtgtgggcgtataatggcgaggtgcgtatcgttaggttgttgagcgagcgcgacgtagttaagtataggttcgtggtgtttgttaaggataatggcgagttttcgcgttcggttatcgttacgttgtacgtgtttttggtggatggttttttttagttttatttgtttttttttgaggcggtttcggtttaggtttaggtt

SEQ ID NO: 6310 - DNA, 738 bp, Artificial Sequence
  chemically treated genomic DNA (Homo sapiens) CpG-island No: 6310
aacctaaacctaaaccgaaaccgcctcaaaaaaaaacaaataaaactaaaaaaaaccatccaccaaaaacacgtacaacgtaacgataaccgaacgcgaaaactcgccattatccttaacaaacaccacgaacctatacttaactacgtcgcgctcgctcaacaacctaacgatacgcacctcgccattatacgcccacacgccgaacaacccaaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccattctacaacgaatacaacacgaaaaacgaattatcgttaatatccaacaccaacacgcgcaccaacgcctcgctactcaaaaccgaaaaaccgcgatctaaaacgcccacgcgaaactcgaacgcctacaaaacctcgtaatccaacgacctaaaaacgaacaaataaccgttatctacgttaataaaaaccaaaaaaacgaaaaacaaatacgaatcctaaaacgacaacaacgaataaataacctaaacgttaatacccgaatctctatctataacgctaacactaccgatatacaaaacgaaactattattctcgcgaacgaacaaaatataaaaaatttaaataaaaacgaaaacgttatcattaacgtcgaaaacctacacgat

SEQ ID NO: 6311 - DNA, 738 bp, Artificial Sequence
  chemically treated genomic DNA (Homo sapiens) CpG-island No: 6311
ggtttgggtttgggtcggggtcgttttagggagaggtaggtagggttgggagaagttatttattaggagtacgtgtagcgtggcggtggtcgagcgcggaggttcgttattgtttttgataagtattacgagtttgtgtttggttgcgtcgcgttcgtttagtagtttggcggtgcgtatttcgttattgtgcgtttatacgtcgaatagtttaggtttcgtggttttgagtagttggtacgatagttaggcgttttggttcgagtcgtcgtttatcgttattattttggttattaggtagttcggttcggtcgttcggggtattagttcggtgtagggcgcggagttattttgtagcgggtatagtacgaagggcgagttgtcgttggtgtttagtattagtacgcgtattagcgtttcgttgtttaaagtcggagaatcgcggtttgaggcgtttacgcggaattcgaacgtttgtagggtttcgtagtttagcgatttgagggcgaataggtggtcgttgtttgcgttgatggagattagggaggcgaggggtaggtgcgggttttggggcggtagtagcgagtaggtgatttgggcgttggtgttcgagtttttgtttgtggcgttgatattgtcgatgtgtagggcggggttgttgttttcgcggacgaatagggtgtaggaggtttgggtgaaggcgggggcgttgttattgacgtcggagatttgtacggt

SEQ ID NO: 6312 - DNA, 738 bp, Artificial Sequence
  chemically treated genomic DNA (Homo sapiens) CpG-island No: 6312
accgtacaaatctccgacgtcaataacaacgcccccgccttcacccaaacctcctacaccctattcgtccgcgaaaacaacaaccccgccctacacatcgacaatatcaacgccacaaacaaaaactcgaacaccaacgcccaaatcacctactcgctactaccgccccaaaacccgcacctacccctcgcctccctaatctccatcaacgcaaacaacgaccacctattcgccctcaaatcgctaaactacgaaaccctacaaacgttcgaattccgcgtaaacgcctcaaaccgcgattctccgactttaaacaacgaaacgctaatacgcgtactaatactaaacaccaacgacaactcgcccttcgtactatacccgctacaaaataactccgcgccctacaccgaactaataccccgaacgaccgaaccgaactacctaataaccaaaataataacgataaacgacgactcgaaccaaaacgcctaactatcgtaccaactactcaaaaccacgaaacctaaactattcgacgtataaacgcacaataacgaaatacgcaccgccaaactactaaacgaacgcgacgcaaccaaacacaaactcgtaatacttatcaaaaacaataacgaacctccgcgctcgaccaccgccacgctacacgtactcctaataaataacttctcccaaccctacctacctctccctaaaacgaccccgacccaaacccaaacc

SEQ ID NO: 6313 - DNA, 805 bp, Artificial Sequence
  chemically treated genomic DNA (Homo sapiens) CpG-island No: 6313
gtatcggtagcgagggtattttggtttagacggtagcggaaatgtttggcgtatcgttggagtaggttgcggtttatttcggcgattttagtttttcggtttttgcgggttttggtggataatggggcgcgaatatttttattttcggcgtttacgtcgtttgtatgaagtttcgcgaaatgattgtttcggtagtcgggtttgattttgagtagtcgtagtttgtcgacggtaagattattaacggtattcgaagcgttacgttatatgaagttatcgtaggcggtagattgatagcggaagagagtattgaattcggaatattgagtaaagagtattagtagtcgatttttgtcgggtattttgtggaggtcggcgtgtatagcgcgacgggagaagttcgggttcggcgtatgttcgttgtgtgtgttgtaggacgtattttgaattcgaaaattgcgcgtagttaggttattggcgtaatgattatgggtatgggcgcggtattgatggaggagttggcggtggatgatcgtttgggttatttcgttaattacgatatggcggggtatgaggtgtcggtttatgcggatattttaaaataggaggtgatttttttggatgatatcgattttatatttttttcgatgaaggttaaaggtgtcggtgagttgggtttgtgcggcgtgagcgcggttatcgttaacgcggtgtataacgttatcggtattcgggtacgggattattttattattttggataagttgttcgataagttgtcggatgtggtttaaggaggaataat

SEQ ID NO: 6314 - DNA, 805 bp, Artificial Sequence
  chemically treated genomic DNA (Homo sapiens) CpG-island No: 6314
attattcctccttaaaccacatccgacaacttatcgaacaacttatccaaaataataaaataatcccgtacccgaataccgataacgttatacaccgcgttaacgataaccgcgctcacgccgcacaaacccaactcaccgacacctttaaccttcatcgaaaaaaatataaaatcgatatcatccaaaaaaatcacctcctattttaaaatatccgcataaaccgacacctcataccccgccatatcgtaattaacgaaataacccaaacgatcatccaccgccaactcctccatcaataccgcgcccatacccataatcattacgccaataacctaactacgcgcaattttcgaattcaaaatacgtcctacaacacacacaacgaacatacgccgaacccgaacttctcccgtcgcgctatacacgccgacctccacaaaatacccgacaaaaatcgactactaatactctttactcaatattccgaattcaatactctcttccgctatcaatctaccgcctacgataacttcatataacgtaacgcttcgaataccgttaataatcttaccgtcgacaaactacgactactcaaaatcaaacccgactaccgaaacaatcatttcgcgaaacttcatacaaacgacgtaaacgccgaaaataaaaatattcgcgccccattatccaccaaaacccgcaaaaaccgaaaaactaaaatcgccgaaataaaccgcaacctactccaacgatacgccaaacatttccgctaccgtctaaaccaaaataccctcgctaccgatac

SEQ ID NO: 6315 - DNA, 805 bp, Artificial Sequence
  chemically treated genomic DNA (Homo sapiens) CpG-island No: 6315
attgtttttttttaaattatattcggtagtttatcgagtagtttatttagagtgatgggataatttcgtattcgaatatcggtggcgttatatatcgcgttggcgatagtcgcgtttacgtcgtataggtttagtttatcgatatttttggtttttatcggggaggatatggggtcggtattatttaggaaaattattttttgttttgggatattcgtatgaatcggtattttatatttcgttatatcgtgattaacgaagtagtttaaacggttatttatcgttagtttttttattagtgtcgcgtttatgtttatagttattgcgttaatgatttggttgcgcgtagttttcggatttaggatgcgttttgtagtatatatagcgagtatacgtcggattcgaatttttttcgtcgcgttatgtacgtcgatttttataaaatgttcggtaaaggtcgattgttggtattttttgtttagtgtttcgaatttaatgttttttttcgttgttagtttgtcgtttgcggtggttttatgtagcgtggcgtttcgggtatcgttggtaattttgtcgtcggtaaattgcgattgtttaggattaaattcgattgtcgaggtaattatttcgcgaagttttatataggcggcgtaaacgtcggaggtggaggtattcgcgttttattgtttattagaattcgtagaaatcgggaaattggaatcgtcgaggtgaatcgtaatttgttttagcggtacgttaagtattttcgttgtcgtttgggttagaatgttttcgttgtcggtgt

SEQ ID NO: 6316 - DNA, 805 bp, Artificial Sequence
  chemically treated genomic DNA (Homo sapiens) CpG-island No: 6316
acaccgacaacgaaaacattctaacccaaacgacaacgaaaatacttaacgtaccgctaaaacaaattacgattcacctcgacgattccaatttcccgatttctacgaattctaataaacaataaaacgcgaatacctccacctccgacgtttacgccgcctatataaaacttcgcgaaataattacctcgacaatcgaatttaatcctaaacaatcgcaatttaccgacgacaaaattaccaacgatacccgaaacgccacgctacataaaaccaccgcaaacgacaaactaacaacgaaaaaaaacattaaattcgaaacactaaacaaaaaataccaacaatcgacctttaccgaacattttataaaaatcgacgtacataacgcgacgaaaaaaattcgaatccgacgtatactcgctatatatactacaaaacgcatcctaaatccgaaaactacgcgcaaccaaatcattaacgcaataactataaacataaacgcgacactaataaaaaaactaacgataaataaccgtttaaactacttcgttaatcacgatataacgaaatataaaataccgattcatacgaatatcccaaaacaaaaaataattttcctaaataataccgaccccatatcctccccgataaaaaccaaaaatatcgataaactaaacctatacgacgtaaacgcgactatcgccaacgcgatatataacgccaccgatattcgaatacgaaattatcccatcactctaaataaactactcgataaactaccgaatataatttaaaaaaaaacaat

SEQ ID NO: 6317 - DNA, 539 bp, Artificial Sequence
  chemically treated genomic DNA (Homo sapiens) CpG-island No: 6317
ttgcgtttcgtcgtagaggcgttaatgttcggtaaaggagcggtgttggtgacgttggtggagatacgcggcggcgcggcgcgttcgttcggggcgtagatggtggtgcgcgaagatggtcgttattgcggttttgtttttggcggttgcgtggaggtcgttgtcgtttttgaagcgttggagatgatgggtttaggtcgcgatcgcgaaattcgttatggcgaagttcgtcgtggtttgatatcgttttgttttgcggcggtgggattacgttgacgttttataaattacgttcggtatagttttgtcgtcgtgttggaacgttggaatagagaaaatcgtgggggtggttagattcgtagtattaagcgcgggggtgttcgtgttacggtatatcggaaggggcgggaatttaagggtgggaaggggggtacgttacgcgtcggggcgacgaaatacgacgttagaggggaggatagtaatatttagggataaggtagtgagtatattggcgtttggggtcgacgggttagaaaaaa

SEQ ID NO: 6318 - DNA, 539 bp, Artificial Sequence
  chemically treated genomic DNA (Homo sapiens) CpG-island No: 6318
ttttttctaacccgtcgaccccaaacgccaatatactcactaccttatccctaaatattactatcctcccctctaacgtcgtatttcgtcgccccgacgcgtaacgtaccccccttcccacccttaaattcccgccccttccgatataccgtaacacgaacacccccgcgcttaatactacgaatctaaccacccccacgattttctctattccaacgttccaacacgacgacaaaactataccgaacgtaatttataaaacgtcaacgtaatcccaccgccgcaaaacaaaacgatatcaaaccacgacgaacttcgccataacgaatttcgcgatcgcgacctaaacccatcatctccaacgcttcaaaaacgacaacgacctccacgcaaccgccaaaaacaaaaccgcaataacgaccatcttcgcgcaccaccatctacgccccgaacgaacgcgccgcgccgccgcgtatctccaccaacgtcaccaacaccgctcctttaccgaacattaacgcctctacgacgaaacgcaa

SEQ ID NO: 6319 - DNA, 539 bp, Artificial Sequence
  chemically treated genomic DNA (Homo sapiens) CpG-island No: 6319
ttttttttggttcgtcggttttaagcgttagtgtgtttattgttttgtttttgaatgttgttgtttttttttttggcgtcgtgtttcgtcgtttcggcgcgtggcgtgtttttttttttatttttgaattttcgtttttttcggtgtgtcgtggtacgggtattttcgcgtttggtgttgcggatttagttatttttacggttttttttgttttagcgttttagtacggcgatagagttgtgtcgagcgtagtttatggagcgttagcgtgattttatcgtcgtagggtagaacgatgttaaattacggcgaatttcgttatagcgaatttcgcgatcgcggtttgagtttattatttttagcgttttaaaagcggtagcggtttttacgtagtcgttagagataaaatcgtagtaacgattattttcgcgtattattatttgcgtttcgagcgggcgcgtcgcgtcgtcgcgtatttttattagcgttattagtatcgtttttttatcggatattagcgtttttacggcgaagcgtag

SEQ ID NO: 6320 - DNA, 539 bp, Artificial Sequence
  chemically treated genomic DNA (Homo sapiens) CpG-island No: 6320
ctacgcttcgccgtaaaaacgctaatatccgataaaaaaacgatactaataacgctaataaaaatacgcgacgacgcgacgcgcccgctcgaaacgcaaataataatacgcgaaaataatcgttactacgattttatctctaacgactacgtaaaaaccgctaccgcttttaaaacgctaaaaataataaactcaaaccgcgatcgcgaaattcgctataacgaaattcgccgtaatttaacatcgttctaccctacgacgataaaatcacgctaacgctccataaactacgctcgacacaactctatcgccgtactaaaacgctaaaacaaaaaaaaccgtaaaaataactaaatccgcaacaccaaacgcgaaaatacccgtaccacgacacaccgaaaaaaacgaaaattcaaaaataaaaaaaaaaacacgccacgcgccgaaacgacgaaacacgacgccaaaaaaaaaaacaacaacattcaaaaacaaaacaataaacacactaacgcttaaaaccgacgaaccaaaaaaaa

SEQ ID NO: 6321 - DNA, 631 bp, Artificial Sequence
  chemically treated genomic DNA (Homo sapiens) CpG-island No: 6321
atcgaatcgattacgcgcggtaggattatttgcgtagtatcggtagagtaattttcgttcgtattaacgttattattatgtaaggtaatagttttcgttagtattttcgaagcgttatggaatattttcgtcgattgttaattattggcggttagtaaggtattcggttcgtgagttttttgtacgcgttttagttttttatagaatatgtcgagggttttattttagtttacgcgtataaaacggttattatcgcgttgggaggtatcgttgagatggcgtttacgtagttagtttacgcgtattatcggataacgaatacgcgtcgcgttgtgtacgtgattcggtaattcggtaattattttcgacggatatttatttagttcgaacggttttgtcgttataaagcgattattttttatcgtcgcgcggatagttttttagtgcgattcggtaagaatgttttttttcgagatgatagcgttagtcgtcgtttgcgtcgtagtcgtacgtcgcggcgttaataatgacggttttagtatttcggcgacggttaagtcgtcgagttgtgttagaaaacgtcgacgtgatgtttgaaagagatcgttattgtttattatttttttttttt

SEQ ID NO: 6322 - DNA, 631 bp, Artificial Sequence
  chemically treated genomic DNA (Homo sapiens) CpG-island No: 6322
aaaaaaaaaaaataataaacaataacgatctctttcaaacatcacgtcgacgttttctaacacaactcgacgacttaaccgtcgccgaaatactaaaaccgtcattattaacgccgcgacgtacgactacgacgcaaacgacgactaacgctatcatctcgaaaaaaaacattcttaccgaatcgcactaaaaaactatccgcgcgacgataaaaaataatcgctttataacgacaaaaccgttcgaactaaataaatatccgtcgaaaataattaccgaattaccgaatcacgtacacaacgcgacgcgtattcgttatccgataatacgcgtaaactaactacgtaaacgccatctcaacgatacctcccaacgcgataataaccgttttatacgcgtaaactaaaataaaaccctcgacatattctataaaaaactaaaacgcgtacaaaaaactcacgaaccgaataccttactaaccgccaataattaacaatcgacgaaaatattccataacgcttcgaaaatactaacgaaaactattaccttacataataataacgttaatacgaacgaaaattactctaccgatactacgcaaataatcctaccgcgcgtaatcgattcgat

SEQ ID NO: 6323 - DNA, 631 bp, Artificial Sequence
  chemically treated genomic DNA (Homo sapiens) CpG-island No: 6323
aaggaagaaaaataatgaataataacgattttttttaggtattacgtcggcgttttttggtataattcggcggtttaatcgtcgtcgggatgttggggtcgttattgttaacgtcgcgacgtgcgattgcggcgtaagcggcgattgacgttgttatttcgaaagagggtatttttatcgggtcgtattggggggttattcgcgcgacggtgaaggatggtcgttttgtggcggtaaaatcgttcgaattggataaatattcgtcgaaaatgattgtcggattgtcggattacgtatataacgcggcgcgtattcgttattcgatggtacgcgtggattggttgcgtaagcgttattttagcgatattttttagcgcggtgataatcgttttgtgcgcgtgagttgggatgaagttttcgatatgttttatgaagaattggaacgcgtgtagaaaatttacgggtcgagtgttttgttgatcgttagtggttggtaatcgacggggatgttttataacgtttcggggatgttggcgaaagttattgttttgtatggtaatagcgttggtacgggcggagattattttatcggtgttgcgtaggtgattttgtcgcgcgtagtcggttcgat

SEQ ID NO: 6324 - DNA, 631 bp, Artificial Sequence
  chemically treated genomic DNA (Homo sapiens) CpG-island No: 6324
atcgaaccgactacgcgcgacaaaatcacctacgcaacaccgataaaataatctccgcccgtaccaacgctattaccatacaaaacaataactttcgccaacatccccgaaacgttataaaacatccccgtcgattaccaaccactaacgatcaacaaaacactcgacccgtaaattttctacacgcgttccaattcttcataaaacatatcgaaaacttcatcccaactcacgcgcacaaaacgattatcaccgcgctaaaaaatatcgctaaaataacgcttacgcaaccaatccacgcgtaccatcgaataacgaatacgcgccgcgttatatacgtaatccgacaatccgacaatcattttcgacgaatatttatccaattcgaacgattttaccgccacaaaacgaccatccttcaccgtcgcgcgaataaccccccaatacgacccgataaaaataccctctttcgaaataacaacgtcaatcgccgcttacgccgcaatcgcacgtcgcgacgttaacaataacgaccccaacatcccgacgacgattaaaccgccgaattataccaaaaaacgccgacgtaatacctaaaaaaaatcgttattattcattatttttcttcctt

SEQ ID NO: 6325 - DNA, 870 bp, Artificial Sequence
  chemically treated genomic DNA (Homo sapiens) CpG-island No: 6325
  misc_feature (555)..(555): n is either a, c, g or t
gaatggtcgtggagtattacgtattcgttcgcgttgacggtgagcgaggcgcgattgaggacgggtaggcgtacgtcgttttgttggtgtaggatgaaggttttattgacgttttgtacgttaattatttttcgtttcgtggttcgggtgtcggatgcgacgttggcgcgttttattcgatttacggggagcgtatgtgtaggtcggataaggcgtttacgtcgtattcggtatcggtttaattttgtaaaatcgatgatattagtagttgtgtatacggatgatgcgggtcgtcgagtacgcggtcggttaatttattttttattatttgtttttgttttattattagtaaacggttcgttagtaggcgggcgacgtttaaattatgggtgataattattatcgcgaggtttagttttattattaggtcgcgtagtaggtcgagtaggcgggtttgtatcgatatatttagttcgtcggtcggtttatttataaatagtagtttcggatgcgttattaggttgcgggtaatttgtaaacgttgttgtatatcgncggaaaacgtggtcggtaggtcgtcgattcgcgtggggggaatttttatttttttagttattttgggcggtggataataatggcgaaatgagtgtttcggtcgtataagcgatgcgataatgcgtttgcgaaattgtcgggtaggcgtagtggatgtgatgtttagcgttatcggtagttaaggaacggggtcgatttatttcgcgtaacgaagcgcgtggtatatatacgcggtttgggacggaggagtgtataataggaggggtttaagatcgaagaggaaaggcgtagaataaaattaacggtgaggagaga

SEQ ID NO: 6326 - DNA, 870 bp, Artificial Sequence
  chemically treated genomic DNA (Homo sapiens) CpG-island No: 6326
  misc_feature (316)..(316): n is either a, c, g or t
tctctcctcaccgttaattttattctacgcctttcctcttcgatcttaaacccctcctattatacactcctccgtcccaaaccgcgtatatataccacgcgcttcgttacgcgaaataaatcgaccccgttccttaactaccgataacgctaaacatcacatccactacgcctacccgacaatttcgcaaacgcattatcgcatcgcttatacgaccgaaacactcatttcgccattattatccaccgcccaaaataactaaaaaaataaaaattccccccacgcgaatcgacgacctaccgaccacgttttccgncgatatacaacaacgtttacaaattacccgcaacctaataacgcatccgaaactactatttataaataaaccgaccgacgaactaaatatatcgatacaaacccgcctactcgacctactacgcgacctaataataaaactaaacctcgcgataataattatcacccataatttaaacgtcgcccgcctactaacgaaccgtttactaataataaaacaaaaacaaataataaaaaataaattaaccgaccgcgtactcgacgacccgcatcatccgtatacacaactactaatatcatcgattttacaaaattaaaccgataccgaatacgacgtaaacgccttatccgacctacacatacgctccccgtaaatcgaataaaacgcgccaacgtcgcatccgacacccgaaccacgaaacgaaaaataattaacgtacaaaacgtcaataaaaccttcatcctacaccaacaaaacgacgtacgcctacccgtcctcaatcgcgcctcgctcaccgtcaacgcgaacgaatacgtaatactccacgaccattc

SEQ ID NO: 6327 - DNA, 870 bp, Artificial Sequence
  chemically treated genomic DNA (Homo sapiens) CpG-island No: 6327
  misc_feature (316)..(316): n is either a, c, g or t
tttttttttatcgttaattttgttttacgtttttttttttcggttttggattttttttgttgtatattttttcgttttaaatcgcgtgtatatattacgcgtttcgttacgcgagatgagtcgatttcgttttttggttatcgatggcgttggatattatatttattgcgtttgttcgatagtttcgtaagcgtattatcgtatcgtttatgcgatcggggtatttatttcgttattattgtttatcgtttagaatggttggaagagtggaaattttttttacgcggatcgacgatttgtcgattacgtttttcgncggtatgtagtagcgtttgtagattgttcgtaatttggtgacgtattcgaagttgttgtttatggatgaatcgatcggcgggttggatgtgtcggtgtaggttcgtttgttcgatttgttgcgcggtttggtggtggagttgaatttcgcggtggtgattgttatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagtcggtgtcggatgcggcgtaaacgttttattcggtttatatatgcgtttttcgtaggtcggataagacgcgttagcgtcgtattcgatattcgaattacgaggcgaaaaatgattaacgtataaaacgttagtaaaatttttattttgtattagtaaaacggcgtgcgtttgttcgtttttaatcgcgtttcgtttatcgttaacgcgggcgaatgcgtggtgttttacggttattt

SEQ ID NO: 6328 - DNA, 870 bp, Artificial Sequence
  chemically treated genomic DNA (Homo sapiens) CpG-island No: 6328
  misc_feature (555)..(555): n is either a, c, g or t
aaataaccgtaaaacaccacgcattcgcccgcgttaacgataaacgaaacgcgattaaaaacgaacaaacgcacgccgttttactaatacaaaataaaaattttactaacgttttatacgttaatcatttttcgcctcgtaattcgaatatcgaatacgacgctaacgcgtcttatccgacctacgaaaaacgcatatataaaccgaataaaacgtttacgccgcatccgacaccgactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaataacaatcaccaccgcgaaattcaactccaccaccaaaccgcgcaacaaatcgaacaaacgaacctacaccgacacatccaacccgccgatcgattcatccataaacaacaacttcgaatacgtcaccaaattacgaacaatctacaaacgctactacataccgncgaaaaacgtaatcgacaaatcgtcgatccgcgtaaaaaaaatttccactcttccaaccattctaaacgataaacaataataacgaaataaataccccgatcgcataaacgatacgataatacgcttacgaaactatcgaacaaacgcaataaatataatatccaacgccatcgataaccaaaaaacgaaatcgactcatctcgcgtaacgaaacgcgtaatatatacacgcgatttaaaacgaaaaaatatacaacaaaaaaaatccaaaaccgaaaaaaaaaaacgtaaaacaaaattaacgataaaaaaaaa

SEQ ID NO: 6329 - DNA, 545 bp, Artificial Sequence
  chemically treated genomic DNA (Homo sapiens) CpG-island No: 6329
atatcgatattagttgtacgtcgtggcgatacgtattagagtttaacgtttttttgatttagttcgagcgtcgtgtaatatcgtgtagttattaggaacgttatttatatatatagcgttatttttggtaggttttgtcgtcgtgtacgtcgaggtattagtattaatagtagtgcggttatttatggttttattggtatttttttgtcgttgttataattatggtggcggttcgtagttggtttcggtatttagcgttagtacgtttggcgttagttgtaaaatggtttagtcgttttttagtatatcgtttggttgtattcgtcgttatttttttggttcgttttttattatatcgatgatgcgttcgtttcgttttattattttttgatagcgttattggttaagttcgttaattcggtatagatttttcggcggttttaaagggttacgtatatcggtttataggtattatgtaatatttgttaataaatagggtataatttttatgcggagtttttagttgtagcgtgtataaagaatta

SEQ ID NO: 6330 - DNA, 545 bp, Artificial Sequence
  chemically treated genomic DNA (Homo sapiens) CpG-island No: 6330
taattctttatacacgctacaactaaaaactccgcataaaaattataccctatttattaacaaatattacataatacctataaaccgatatacgtaaccctttaaaaccgccgaaaaatctataccgaattaacgaacttaaccaataacgctatcaaaaaataataaaacgaaacgaacgcatcatcgatataataaaaaacgaaccaaaaaaataacgacgaatacaaccaaacgatatactaaaaaacgactaaaccattttacaactaacgccaaacgtactaacgctaaataccgaaaccaactacgaaccgccaccataattataacaacgacaaaaaaataccaataaaaccataaataaccgcactactattaatactaatacctcgacgtacacgacgacaaaacctaccaaaaataacgctatatatataaataacgttcctaataactacacgatattacacgacgctcgaactaaatcaaaaaaacgttaaactctaatacgtatcgccacgacgtacaactaatatcgatat

SEQ ID NO: 6331 - DNA, 545 bp, Artificial Sequence
  chemically treated genomic DNA (Homo sapiens) CpG-island No: 6331
tgattttttgtgtacgttataattggagatttcgtatgagggttatattttgtttgttggtaggtattgtatggtgtttgtgaatcggtatgcgtgattttttgaaatcgtcggaagatttatgtcggattagcgaatttagttagtggcgttattaggggatggtagggcgaggcgagcgtattatcggtgtaataaaagacgggttaaagaaatggcgacgggtgtagttaaacgatgtgttggaaaacggttggattattttatagttgacgttagacgtattaacgttgggtatcgggattaattgcgaatcgttattatggttgtggtaacggtaaggagatattaatgaagttatggatagtcgtattattgttgatgttgatatttcggcgtatacggcggtaaagtttgttaaaagtgacgttgtatgtgtggatgacgtttttggtagttgtacggtgttgtacggcgttcgggttgaattaggagaacgttgaattttggtgcgtgtcgttacgacgtgtagttggtatcggtgt

SEQ ID NO: 6332 - DNA, 545 bp, Artificial Sequence
  chemically treated genomic DNA (Homo sapiens) CpG-island No: 6332
acaccgataccaactacacgtcgtaacgacacgcaccaaaattcaacgttctcctaattcaacccgaacgccgtacaacaccgtacaactaccaaaaacgtcatccacacatacaacgtcacttttaacaaactttaccgccgtatacgccgaaatatcaacatcaacaataatacgactatccataacttcattaatatctccttaccgttaccacaaccataataacgattcgcaattaatcccgatacccaacgttaatacgtctaacgtcaactataaaataatccaaccgttttccaacacatcgtttaactacacccgtcgccatttctttaacccgtcttttattacaccgataatacgctcgcctcgccctaccatcccctaataacgccactaactaaattcgctaatccgacataaatcttccgacgatttcaaaaaatcacgcataccgattcacaaacaccatacaatacctaccaacaaacaaaatataaccctcatacgaaatctccaattataacgtacacaaaaaatca

SEQ ID NO: 6333 - DNA, 937 bp, Artificial Sequence
  chemically treated genomic DNA (Homo sapiens) CpG-island No: 6333
ttttcgtgcgatttcggtcggattttcggagattatttgcggttcgttggtgtttttggttggacgttcggcgcgaaattgtcggtgtgtatgatcgtagtggtaaataggtgcgtagttttatttacgatgataaatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaattcgttatgattatgatcgtttcgggtagatgacggcggtgtatcgcgaggaagggttgagttagtatcgcgtatacgatagtcgtggatagttaattgtcgtgaaagatacgttagggttatgaaacgcggtatgattataatatcgtcggtgatttgagcggcgtaattgttt

SEQ ID NO: 6334 - DNA, 937 bp, Artificial Sequence
  chemically treated genomic DNA (Homo sapiens) CpG-island No: 6334
aaacaattacgccgctcaaatcaccgacgatattataatcataccgcgtttcataaccctaacgtatctttcacgacaattaactatccacgactatcgtatacgcgatactaactcaacccttcctcgcgatacaccgccgtcatctacccgaaacgatcataatcataacgaattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatatttatcatcgtaaataaaactacgcacctatttaccactacgatcatacacaccgacaatttcgcgccgaacgtccaaccaaaaacaccaacgaaccgcaaataatctccgaaaatccgaccgaaatcgcacgaaaa

SEQ ID NO: 6335 - DNA, 937 bp, Artificial Sequence
  chemically treated genomic DNA (Homo sapiens) CpG-island No: 6335
gggtaattacgtcgtttaggttatcggcgatgttgtaattatatcgcgttttatggttttggcgtgttttttacggtaattaattgtttacggttgtcgtatgcgcggtattgatttagttttttttcgcggtgtatcgtcgttatttgttcgaagcggttatggttataacgggttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtatttattatcgtaagtaaagttgcgtatttgtttgttattacggttatatatatcggtagtttcgcgtcgggcgtttagttaaaggtattagcgggtcgtaggtaattttcgggaattcggtcggggtcgtacgggaa

SEQ ID NO: 6336 - DNA, 937 bp, Artificial Sequence
  chemically treated genomic DNA (Homo sapiens) CpG-island No: 6336
ttcccgtacgaccccgaccgaattcccgaaaattacctacgacccgctaatacctttaactaaacgcccgacgcgaaactaccgatatatataaccgtaataacaaacaaatacgcaactttacttacgataataaataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacccgttataaccataaccgcttcgaacaaataacgacgatacaccgcgaaaaaaaactaaatcaataccgcgcatacgacaaccgtaaacaattaattaccgtaaaaaacacgccaaaaccataaaacgcgatataattacaacatcgccgataacctaaacgacgtaattaccc

SEQ ID NO: 6337 - DNA, 825 bp, Artificial Sequence
  chemically treated genomic DNA (Homo sapiens) CpG-island No: 6337
ataattcgtataatattatcgtgttataggcgtttgattcgtagatcggtacgttttcgttcgagcgtaaaacgttgtttatcggtacgtcgttttgttatatcgaaggcgcgtatttgtatcgttacgcgggatggtattatttgatggtcgtcgagggcggtattagttacgagtacgtcgtcgtggtgttgcgttttaaaaatatcgacgggtcgtacgagttgtattcggacgtaacgatgatgattagttggtatttgtcggagaattcgttgtagaagagcggttacggttcgttgttgtagacgtatacgggtgaatggtatatggtttattttattagtcgttcgttgcgtttgttcggcgtgtcgttgttggttttcggcggacgcggttattgttcgttggggcgcgagatcggtatcgttcgtattgaatggcgcgacggttggtcgtacgtggaaggcggtaagtacgcgtagttgatcgtgaaaggttcgtaagtagtcgagtagtttgtagtcgtttcgggtaattggcgggacgatttcgacgttagttcgtttggatcggagttgtagattttgcgtattcgtacgaagatatttcggatgtttatcgagcgttcgggttttaggattttaggaagatcgttaatcgatttaattaattacggggttttatgagaaatgtttcgggaaaacggagagtttcgggattttataacggggatagatataatataaggagcgaatgaaagcgaggatattaattaaatagtacgcgggatataagaagagcgagagttagtaaaatgttttt

SEQ ID NO: 6338 - DNA, 825 bp, Artificial Sequence
  chemically treated genomic DNA (Homo sapiens) CpG-island No: 6338
aaaaacattttactaactctcgctcttcttatatcccgcgtactatttaattaatatcctcgctttcattcgctccttatattatatctatccccgttataaaatcccgaaactctccgttttcccgaaacatttctcataaaaccccgtaattaattaaatcgattaacgatcttcctaaaatcctaaaacccgaacgctcgataaacatccgaaatatcttcgtacgaatacgcaaaatctacaactccgatccaaacgaactaacgtcgaaatcgtcccgccaattacccgaaacgactacaaactactcgactacttacgaacctttcacgatcaactacgcgtacttaccgccttccacgtacgaccaaccgtcgcgccattcaatacgaacgataccgatctcgcgccccaacgaacaataaccgcgtccgccgaaaaccaacaacgacacgccgaacaaacgcaacgaacgactaataaaataaaccatataccattcacccgtatacgtctacaacaacgaaccgtaaccgctcttctacaacgaattctccgacaaataccaactaatcatcatcgttacgtccgaatacaactcgtacgacccgtcgatatttttaaaacgcaacaccacgacgacgtactcgtaactaataccgccctcgacgaccatcaaataataccatcccgcgtaacgatacaaatacgcgccttcgatataacaaaacgacgtaccgataaacaacgttttacgctcgaacgaaaacgtaccgatctacgaatcaaacgcctataacacgataatattatacgaattat

SEQ ID NO: 6339 - DNA, 825 bp, Artificial Sequence
  chemically treated genomic DNA (Homo sapiens) CpG-island No: 6339
agagatattttgttagttttcgttttttttgtgtttcgcgtgttgtttggttagtgttttcgtttttattcgttttttgtgttgtgtttgttttcgttgtgggatttcgggatttttcgttttttcgaagtattttttatggggtttcgtgattggttaagtcgattgacgatttttttaggattttaagattcgggcgttcggtgagtattcgaggtgttttcgtacgaatgcgtagggtttgtagtttcggtttaagcgaattggcgtcgaaatcgtttcgttagttgttcggaacggttgtaggttgttcggttatttgcgggttttttacggttagttgcgcgtgtttgtcgttttttacgtacggttagtcgtcgcgttatttaatgcgggcgatgtcggtttcgcgttttagcgggtagtagtcgcgttcgtcggaggttagtagcggtacgtcgggtaggcgtagcgggcggttggtgaggtaggttatgtattatttattcgtatgcgtttgtagtagcgagtcgtggtcgtttttttgtagcgggtttttcggtaggtgttagttggttattatcgttacgttcgggtgtagttcgtacggttcgtcgatatttttggaacgtagtattacgacggcgtgttcgtagttggtgtcgttttcggcggttattaggtagtattatttcgcgtggcgatataggtgcgcgttttcggtgtagtagagcggcgtgtcggtaaatagcgttttgcgttcgggcgagagcgtgtcggtttgcgggttaaacgtttgtaatacgatggtgttgtgcgggttgt

SEQ ID NO: 6340 - DNA, 825 bp, Artificial Sequence
  chemically treated genomic DNA (Homo sapiens) CpG-island No: 6340
acaacccgcacaacaccatcgtattacaaacgtttaacccgcaaaccgacacgctctcgcccgaacgcaaaacgctatttaccgacacgccgctctactacaccgaaaacgcgcacctatatcgccacgcgaaataatactacctaataaccgccgaaaacgacaccaactacgaacacgccgtcgtaatactacgttccaaaaatatcgacgaaccgtacgaactacacccgaacgtaacgataataaccaactaacacctaccgaaaaacccgctacaaaaaaacgaccacgactcgctactacaaacgcatacgaataaataatacataacctacctcaccaaccgcccgctacgcctacccgacgtaccgctactaacctccgacgaacgcgactactacccgctaaaacgcgaaaccgacatcgcccgcattaaataacgcgacgactaaccgtacgtaaaaaacgacaaacacgcgcaactaaccgtaaaaaacccgcaaataaccgaacaacctacaaccgttccgaacaactaacgaaacgatttcgacgccaattcgcttaaaccgaaactacaaaccctacgcattcgtacgaaaacacctcgaatactcaccgaacgcccgaatcttaaaatcctaaaaaaatcgtcaatcgacttaaccaatcacgaaaccccataaaaaatacttcgaaaaaacgaaaaatcccgaaatcccacaacgaaaacaaacacaacacaaaaaacgaataaaaacgaaaacactaaccaaacaacacgcgaaacacaaaaaaaacgaaaactaacaaaatatctct

SEQ ID NO: 6341 - DNA, 759 bp, Artificial Sequence
  chemically treated genomic DNA (Homo sapiens) CpG-island No: 6341
gttttttaaggacgaatcgttttttttttttcgttgtggttttgcggtaagtttgtaagttttgacgtcgtaggtcgagttttgagagtttttttgtcgcggaggttttaagagaacgcgcgagtgcgtaaagggtatttggtttaaggcggagaaattacgtttcggaattagttttttagttttttgagttcgacggcgcggttttttttcgttgcgtcggttttttgattttggcgtatttcggttcgggcgttaaagcggtgtttcgcgaaagttgtatagtttgcgacgtttttagttatttttcgtagtttaggttcggttaaggagataatatcgttgttatgggaacggaacgttacgggttttgttgggagcgtttgtagttatggcgacgcggggtattttcggttcggagagtttttgttgtttggcgtttatagtagtttttgttttatttttcgttttttttttttcgtaggttagacgcgttcggttttcggttcgttttaaaattggtttttgtatattgtattttacgagattttatttttcggaggtgaaggcgtaggaagagaagatatatttcgtttaaggatggaagggagcgtcgggttttacggttttatttatttaaagttgcgacgtgtgcgggttgtattcggcgacgatttttggttacggtgtatttttatagtttttcgggagttttgtttttatggattttagaggaaaggtttagatatggttgttgat

SEQ ID NO: 6342 - DNA, 759 bp, Artificial Sequence
  chemically treated genomic DNA (Homo sapiens) CpG-island No: 6342
atcaacaaccatatctaaacctttcctctaaaatccataaaaacaaaactcccgaaaaactataaaaatacaccgtaaccaaaaatcgtcgccgaatacaacccgcacacgtcgcaactttaaataaataaaaccgtaaaacccgacgctcccttccatccttaaacgaaatatatcttctcttcctacgccttcacctccgaaaaataaaatctcgtaaaatacaatatacaaaaaccaattttaaaacgaaccgaaaaccgaacgcgtctaacctacgaaaaaaaaaaaacgaaaaataaaacaaaaactactataaacgccaaacaacaaaaactctccgaaccgaaaataccccgcgtcgccataactacaaacgctcccaacaaaacccgtaacgttccgttcccataacaacgatattatctccttaaccgaacctaaactacgaaaaataactaaaaacgtcgcaaactatacaactttcgcgaaacaccgctttaacgcccgaaccgaaatacgccaaaatcaaaaaaccgacgcaacgaaaaaaaaccgcgccgtcgaactcaaaaaactaaaaaactaattccgaaacgtaatttctccgccttaaaccaaataccctttacgcactcgcgcgttctcttaaaacctccgcgacaaaaaaactctcaaaactcgacctacgacgtcaaaacttacaaacttaccgcaaaaccacaacgaaaaaaaaaaaacgattcgtccttaaaaaac

SEQ ID NO: 6343 - DNA, 759 bp, Artificial Sequence
  chemically treated genomic DNA (Homo sapiens) CpG-island No: 6343
gttaatagttatatttaagttttttttttggggtttataaaaataaaattttcgaggagttgtgggggtgtatcgtggttagggatcgtcgtcgaatatagttcgtatacgtcgtagttttaaataagtagggtcgtggggttcggcgtttttttttatttttggacggaatgtattttttttttttacgtttttattttcgaggggtaaggtttcgtgagatataatatgtagaggttagttttggggcgagtcggaggtcgggcgcgtttaatttgcggggaagggaaagcggagggtaaggtaagggttgttgtaggcgttagataatagggatttttcgaatcggaagtgtttcgcgtcgttatggttataggcgtttttagtagaattcgtagcgtttcgtttttatggtaacggtattgtttttttggtcggatttgggttgcggaaggtaattggggacgtcgtaggttgtgtagttttcgcgaggtatcgttttggcgttcggatcgaggtgcgttagggttaggaggtcgacgtagcgggaggaagtcgcgtcgtcgggtttagggagttgggaggttggtttcggggcgtggttttttcgttttgagttaggtgttttttgcgtattcgcgcgtttttttagagttttcgcggtagagaggtttttagagttcgatttgcggcgttagggtttatagatttgtcgtagaattatagcgggaaaagaggagcgattcgtttttgaggggt

SEQ ID NO: 6344 - DNA, 759 bp, Artificial Sequence
  chemically treated genomic DNA (Homo sapiens) CpG-island No: 6344
acccctcaaaaacgaatcgctcctcttttcccgctataattctacgacaaatctataaaccctaacgccgcaaatcgaactctaaaaacctctctaccgcgaaaactctaaaaaaacgcgcgaatacgcaaaaaacacctaactcaaaacgaaaaaaccacgccccgaaaccaacctcccaactccctaaacccgacgacgcgacttcctcccgctacgtcgacctcctaaccctaacgcacctcgatccgaacgccaaaacgatacctcgcgaaaactacacaacctacgacgtccccaattaccttccgcaacccaaatccgaccaaaaaaacaataccgttaccataaaaacgaaacgctacgaattctactaaaaacgcctataaccataacgacgcgaaacacttccgattcgaaaaatccctattatctaacgcctacaacaacccttaccttaccctccgctttcccttccccgcaaattaaacgcgcccgacctccgactcgccccaaaactaacctctacatattatatctcacgaaaccttacccctcgaaaataaaaacgtaaaaaaaaaaaatacattccgtccaaaaataaaaaaaaacgccgaaccccacgaccctacttatttaaaactacgacgtatacgaactatattcgacgacgatccctaaccacgatacacccccacaactcctcgaaaattttatttttataaaccccaaaaaaaaaacttaaatataactattaac

SEQ ID NO: 6345 - DNA, 1089 bp, Artificial Sequence
  chemically treated genomic DNA (Homo sapiens) CpG-island No: 6345
gttgcgttgtaagggacgtagggaaaagtaagtttggggtaggtttgagtttcgagttttcgattgttttttcgtggtgtttgcgattcggtagcgggagtaagtgaggttgttggattgtagttttttttttatagtggcgatgcggggtcggggtcgcgggtatgaggagatggggtgtgagtcggggtgcgttagggtagagcgtttcgtttatcgagacgggtagggcggtttcgggtattggtcgggcggggtaaggagtttttaggtcgttaggtttttttttgttggtttcgcggagttcgttcgggggaagggaaggtcggggagggtcgggttttttcgagtggtcgcgggggttgcgggataggtatttattcgggtgttattttagggttagttttcgataggtttttttgagttttttttcgttggcgtcgcgtcgtatttttagcgttttatagtgatattttatcgttcgatcgggcgggcggtcggcgttggggttcgggacggggtcggggttcgggttcgggtcgaagcggcggcggcggcggcgttggtagtttttttcggcgggagttcgtcgttcgtatcgggttagttagcgagttcggcggcggcggcggcggcggcggtggtgtaggttagtgaaggcgcgcggtggcggtagacgacgtagttgcggtaagcgggagcgcggcgggggcggtgtcggcggtcgtcgtttcgtatgggttaggggtgggttttgtgtcggaaagggtcgcgcgggagggggtggggtttcggcggggtgagaggcgaggtttcgaggaaggaaggcggggttttggcgaggagagaggcgggtcgcgtaggagaaaggcgggagtttggcggggaaagaggcgggtcgcgtgggaggaaggtaggttttggtcgggaagaataggaggaaggcgggattttggtgtgagaggcggggtttcggcggggcgagaggcggggtcgcgcggaagggaggtagggttacgttggtgttattgtgaggggtatagatggcggttagtgtgagtggtagtcgatttgagggttgaaggggga

SEQ ID NO: 6346 - DNA, 1089 bp, Artificial Sequence
  chemically treated genomic DNA (Homo sapiens) CpG-island No: 6346
tcccccttcaaccctcaaatcgactaccactcacactaaccgccatctatacccctcacaataacaccaacgtaaccctacctcccttccgcgcgaccccgcctctcgccccgccgaaaccccgcctctcacaccaaaatcccgccttcctcctattcttcccgaccaaaacctaccttcctcccacgcgacccgcctctttccccgccaaactcccgcctttctcctacgcgacccgcctctctcctcgccaaaaccccgccttccttcctcgaaacctcgcctctcaccccgccgaaaccccaccccctcccgcgcgaccctttccgacacaaaacccacccctaacccatacgaaacgacgaccgccgacaccgcccccgccgcgctcccgcttaccgcaactacgtcgtctaccgccaccgcgcgccttcactaacctacaccaccgccgccgccgccgccgccgccgaactcgctaactaacccgatacgaacgacgaactcccgccgaaaaaaactaccaacgccgccgccgccgccgcttcgacccgaacccgaaccccgaccccgtcccgaaccccaacgccgaccgcccgcccgatcgaacgataaaatatcactataaaacgctaaaaatacgacgcgacgccaacgaaaaaaaactcaaaaaaacctatcgaaaactaaccctaaaataacacccgaataaatacctatcccgcaacccccgcgaccactcgaaaaaacccgaccctccccgaccttcccttcccccgaacgaactccgcgaaaccaacaaaaaaaaacctaacgacctaaaaactccttaccccgcccgaccaatacccgaaaccgccctacccgtctcgataaacgaaacgctctaccctaacgcaccccgactcacaccccatctcctcatacccgcgaccccgaccccgcatcgccactataaaaaaaaaactacaatccaacaacctcacttactcccgctaccgaatcgcaaacaccacgaaaaaacaatcgaaaactcgaaactcaaacctaccccaaacttacttttccctacgtcccttacaacgcaac

SEQ ID NO: 6347 - DNA, 1089 bp, Artificial Sequence
  chemically treated genomic DNA (Homo sapiens) CpG-island No: 6347
tttttttttagtttttaggtcggttgttatttatattgatcgttatttgtgttttttataatgatattagcgtggttttgtttttttttcgcgcggtttcgtttttcgtttcgtcgaggtttcgttttttatattaaggtttcgttttttttttgtttttttcggttaaggtttattttttttttacgcggttcgttttttttttcgttaagttttcgttttttttttgcgcggttcgttttttttttcgttaaggtttcgtttttttttttcggggtttcgttttttatttcgtcgaggttttattttttttcgcgcggtttttttcggtatagagtttatttttagtttatgcgaagcggcggtcgtcggtatcgttttcgtcgcgttttcgtttgtcgtagttgcgtcgtttgtcgttatcgcgcgtttttattgatttatattatcgtcgtcgtcgtcgtcgtcgtcgggttcgttggttggttcggtgcgggcggcggattttcgtcggagaggattgttagcgtcgtcgtcgtcgtcgtttcggttcgggttcgggtttcgatttcgtttcgggttttagcgtcggtcgttcgttcggtcgggcgatgaagtgttattatgaggcgttgggggtgcggcgcgacgttagcgaggaggagtttaagaaggtttatcggaagttggttttgaaatggtattcgggtaagtatttgtttcgtagttttcgcggttattcggagaagttcggtttttttcgatttttttttttttcgggcggatttcgcggagttagtagagagggatttggcggtttaggagttttttgtttcgttcggttagtgttcggagtcgttttgttcgtttcggtgggcgaagcgttttgttttggcgtatttcggtttatattttatttttttatattcgcgatttcggtttcgtatcgttattgtagggggaaaattgtagtttaataattttatttgttttcgttatcgggtcgtagatattacgagggagtagtcgggaattcggaatttagatttgttttaggtttgtttttttttgcgttttttgtagcgtagt

SEQ ID NO: 6348 - DNA, 1089 bp, Artificial Sequence
  chemically treated genomic DNA (Homo sapiens) CpG-island No: 6348
actacgctacaaaaaacgcaaaaaaaaacaaacctaaaacaaatctaaattccgaattcccgactactccctcgtaatatctacgacccgataacgaaaacaaataaaattattaaactacaattttccccctacaataacgatacgaaaccgaaatcgcgaatataaaaaaataaaatataaaccgaaatacgccaaaacaaaacgcttcgcccaccgaaacgaacaaaacgactccgaacactaaccgaacgaaacaaaaaactcctaaaccgccaaatccctctctactaactccgcgaaatccgcccgaaaaaaaaaaaaatcgaaaaaaaccgaacttctccgaataaccgcgaaaactacgaaacaaatacttacccgaataccatttcaaaaccaacttccgataaaccttcttaaactcctcctcgctaacgtcgcgccgcacccccaacgcctcataataacacttcatcgcccgaccgaacgaacgaccgacgctaaaacccgaaacgaaatcgaaacccgaacccgaaccgaaacgacgacgacgacgacgctaacaatcctctccgacgaaaatccgccgcccgcaccgaaccaaccaacgaacccgacgacgacgacgacgacgacgataatataaatcaataaaaacgcgcgataacgacaaacgacgcaactacgacaaacgaaaacgcgacgaaaacgataccgacgaccgccgcttcgcataaactaaaaataaactctataccgaaaaaaaccgcgcgaaaaaaaataaaacctcgacgaaataaaaaacgaaaccccgaaaaaaaaaaacgaaaccttaacgaaaaaaaaaacgaaccgcgcaaaaaaaaaacgaaaacttaacgaaaaaaaaaacgaaccgcgtaaaaaaaaaataaaccttaaccgaaaaaaacaaaaaaaaaacgaaaccttaatataaaaaacgaaacctcgacgaaacgaaaaacgaaaccgcgcgaaaaaaaaacaaaaccacgctaatatcattataaaaaacacaaataacgatcaatataaataacaaccgacctaaaaactaaaaaaaaa

SEQ ID NO: 6349 - DNA, 662 bp, Artificial Sequence
  chemically treated genomic DNA (Homo sapiens) CpG-island No: 6349
tttcgtatttattatcgtttttatttgggtatttttcgtttgaacgtgtaaagtttttacgtcgttttttttggtgtcgttattttgtttcgtcgttcgcgtttttggtttttttttcggcgttgtcgttcgtttttattttcgatttttatggttcggcggttttaagcgtttagtttcgcggtcgttttttaggtttgtgtcgttttttttcggtttcggtggcgcggtacgcgcggtttttaggttttttttagttttgtggtgacggtggtcgaggtggagggtcggtttgaagagtggcgggattggttttatttttttcgcggtttttcggagtcgtttcgtttttttttagggattttgttgagaagggttttcgggcgtttagattttatcgtaaaggtagggttttcgtattcggggatttcgagattagtaagcgatgttgtttcgcgggcgggttggtgaatggggttgtttgggatttttggaggattatttggatatttcgggttcgtttcgttatcgtttgttttgttggaggcggggttggtggcgcgggttgtataaaatcgatttttcgcggatttgtagtttttgtttggtcgggagatatcgtgttagttgcgtgtttttattttttataattttttacgtta

SEQ ID NO: 6350 - DNA, 662 bp, Artificial Sequence
  chemically treated genomic DNA (Homo sapiens) CpG-island No: 6350
taacgtaaaaaattataaaaaataaaaacacgcaactaacacgatatctcccgaccaaacaaaaactacaaatccgcgaaaaatcgattttatacaacccgcgccaccaaccccgcctccaacaaaacaaacgataacgaaacgaacccgaaatatccaaataatcctccaaaaatcccaaacaaccccattcaccaacccgcccgcgaaacaacatcgcttactaatctcgaaatccccgaatacgaaaaccctacctttacgataaaatctaaacgcccgaaaacccttctcaacaaaatccctaaaaaaaaacgaaacgactccgaaaaaccgcgaaaaaaataaaaccaatcccgccactcttcaaaccgaccctccacctcgaccaccgtcaccacaaaactaaaaaaaacctaaaaaccgcgcgtaccgcgccaccgaaaccgaaaaaaaacgacacaaacctaaaaaacgaccgcgaaactaaacgcttaaaaccgccgaaccataaaaatcgaaaataaaaacgaacgacaacgccgaaaaaaaaaccaaaaacgcgaacgacgaaacaaaataacgacaccaaaaaaaacgacgtaaaaactttacacgttcaaacgaaaaatacccaaataaaaacgataataaatacgaaa

SEQ ID NO: 6351 - DNA, 662 bp, Artificial Sequence
  chemically treated genomic DNA (Homo sapiens) CpG-island No: 6351
taacgtgaaaagttgtgaagaatgaagatacgtaattgatacggtatttttcggttaaataggagttataaattcgcggggagtcggttttgtgtagttcgcgttattagtttcgtttttaataaaataggcgatggcggggcgggttcggagtgtttagataattttttaagagttttagataattttatttattagttcgttcgcgggatagtatcgtttattagtttcggggttttcgagtgcggaaattttatttttgcggtggggtttggacgttcgagagttttttttagtaaagtttttgaagaggagcgaggcggtttcgaggaatcgcggaggaagtgaagttagtttcgttattttttagatcggttttttatttcggttatcgttattatagagttgaaggaggtttaagagtcgcgcgtgtcgcgttatcgagatcggaaggaggcggtatagatttggaggacgatcgcggagttgagcgtttagagtcgtcgaattatagagatcggaaataggagcgagcggtagcgtcggaaaggaggttaagagcgcgggcggcgaggtaagatggcggtattagaggaaacggcgtggaggttttgtacgtttaggcgaagaatgtttaaatagaaacgataatagatgcggag

SEQ ID NO: 6352 - DNA, 662 bp, Artificial Sequence
  chemically treated genomic DNA (Homo sapiens) CpG-island No: 6352
ctccgcatctattatcgtttctatttaaacattcttcgcctaaacgtacaaaacctccacgccgtttcctctaataccgccatcttacctcgccgcccgcgctcttaacctcctttccgacgctaccgctcgctcctatttccgatctctataattcgacgactctaaacgctcaactccgcgatcgtcctccaaatctataccgcctccttccgatctcgataacgcgacacgcgcgactcttaaacctccttcaactctataataacgataaccgaaataaaaaaccgatctaaaaaataacgaaactaacttcacttcctccgcgattcctcgaaaccgcctcgctcctcttcaaaaactttactaaaaaaaactctcgaacgtccaaaccccaccgcaaaaataaaatttccgcactcgaaaaccccgaaactaataaacgatactatcccgcgaacgaactaataaataaaattatctaaaactcttaaaaaattatctaaacactccgaacccgccccgccatcgcctattttattaaaaacgaaactaataacgcgaactacacaaaaccgactccccgcgaatttataactcctatttaaccgaaaaataccgtatcaattacgtatcttcattcttcacaacttttcacgtta

SEQ ID NO: 6353 - DNA, 803 bp, Artificial Sequence
  chemically treated genomic DNA (Homo sapiens) CpG-island No: 6353
agggtatatcgtttttcgatttgattatttttgattgggtggaagcgtagagtgagtatttattgttgcgcgaaatcggcggtacggcgatttagattgaaggtatttttgagcggttgcgattggcgggaatgtcggaggcggatattcgtcgtttgatcgttacgttaaaaaatttagattcgttttacgtttaaagcgtttattgatggcgtgattatcgcgtttgatttgcgcgcgggaataatatcgttaagattacgtggtacgcgaaaatttagggtatggattcggtgttgggttattgttgcgatttcggagtttatcgtttggttggtgaaagatgtttcgtagtttatttttatcgtttcggcgcgatcggataaaatatttattattcgtaaatggacgttgttatttggcgtggatgtcgcgattcgtacgttgtagttgcgtttggaagtcgataacgtcgacgaggcgttaaaatcgggtatgaacgtttggttgtaatttaatatcgttagcgaatcgatgttgtttatttcgttataagcgttgattgatatcggtagcgaatagcgggtgattatcgttgatgtcgacgggcgttttgtatcgaaacgcgttgttgttttttaggtatcgtaaggcgttatcgtattacgttttggtttggcggaaggtgaaaaggtggtttttagcggtttgtttttgattgatttcgaagttaatatttttggcgtattggagcggatgcgttttgaaagtgttatttatgcgtattgagggaataattaatg

SEQ ID NO: 6354 - DNA, 803 bp, Artificial Sequence
  chemically treated genomic DNA (Homo sapiens) CpG-island No: 6354
cattaattattccctcaatacgcataaataacactttcaaaacgcatccgctccaatacgccaaaaatattaacttcgaaatcaatcaaaaacaaaccgctaaaaaccaccttttcaccttccgccaaaccaaaacgtaatacgataacgccttacgatacctaaaaaacaacaacgcgtttcgatacaaaacgcccgtcgacatcaacgataatcacccgctattcgctaccgatatcaatcaacgcttataacgaaataaacaacatcgattcgctaacgatattaaattacaaccaaacgttcatacccgattttaacgcctcgtcgacgttatcgacttccaaacgcaactacaacgtacgaatcgcgacatccacgccaaataacaacgtccatttacgaataataaatattttatccgatcgcgccgaaacgataaaaataaactacgaaacatctttcaccaaccaaacgataaactccgaaatcgcaacaataacccaacaccgaatccataccctaaattttcgcgtaccacgtaatcttaacgatattattcccgcgcgcaaatcaaacgcgataatcacgccatcaataaacgctttaaacgtaaaacgaatctaaattttttaacgtaacgatcaaacgacgaatatccgcctccgacattcccgccaatcgcaaccgctcaaaaataccttcaatctaaatcgccgtaccgccgatttcgcgcaacaataaatactcactctacgcttccacccaatcaaaaataatcaaatcgaaaaacgatataccct

SEQ ID NO: 6355 - DNA, 803 bp, Artificial Sequence
  chemically treated genomic DNA (Homo sapiens) CpG-island No: 6355
tattggttatttttttaatgcgtatgggtagtatttttagagcgtattcgttttagtgcgttagaaatattggtttcggaattaattaggaataggtcgttggaaattatttttttatttttcgttagattagagcgtaatgcggtgacgttttgcgatgtttggaaaatagtaacgcgtttcggtataaagcgttcgtcggtattaacggtaattattcgttgttcgttgtcggtattaattagcgtttgtgacggaatgagtagtatcggttcgttggcggtgttgagttgtaattaggcgtttatgttcggttttagcgtttcgtcggcgttgtcgatttttagacgtagttgtagcgtgcgggtcgcggtatttacgttaggtagtagcgtttatttgcggatggtgagtgttttattcggtcgcgtcggaacggtgagggtaaattgcgaggtattttttattagttaggcgatagatttcgggatcgtagtagtgatttaatatcgggtttatattttgaattttcgcgtattacgtaattttggcgatattattttcgcgcgtagattaaacgcggtgattacgttattaatgggcgttttgagcgtaaagcgagtttggattttttagcgtggcgattaggcggcgaatattcgttttcggtattttcgttagtcgtagtcgtttaagaatgtttttagtttgggtcgtcgtatcgtcggtttcgcgtagtagtaaatatttattttgcgtttttatttagttaggaatggttaggtcgagaagcggtgtgtttt

SEQ ID NO: 6356 - DNA, 803 bp, Artificial Sequence
  chemically treated genomic DNA (Homo sapiens) CpG-island No: 6356
aaaacacaccgcttctcgacctaaccattcctaactaaataaaaacgcaaaataaatatttactactacgcgaaaccgacgatacgacgacccaaactaaaaacattcttaaacgactacgactaacgaaaataccgaaaacgaatattcgccgcctaatcgccacgctaaaaaatccaaactcgctttacgctcaaaacgcccattaataacgtaatcaccgcgtttaatctacgcgcgaaaataatatcgccaaaattacgtaatacgcgaaaattcaaaatataaacccgatattaaatcactactacgatcccgaaatctatcgcctaactaataaaaaatacctcgcaatttaccctcaccgttccgacgcgaccgaataaaacactcaccatccgcaaataaacgctactacctaacgtaaataccgcgacccgcacgctacaactacgtctaaaaatcgacaacgccgacgaaacgctaaaaccgaacataaacgcctaattacaactcaacaccgccaacgaaccgatactactcattccgtcacaaacgctaattaataccgacaacgaacaacgaataattaccgttaataccgacgaacgctttataccgaaacgcgttactattttccaaacatcgcaaaacgtcaccgcattacgctctaatctaacgaaaaataaaaaaataatttccaacgacctattcctaattaattccgaaaccaatatttctaacgcactaaaacgaatacgctctaaaaatactacccatacgcattaaaaaaataaccaata

SEQ ID NO: 6357 - DNA, 519 bp, Artificial Sequence
  chemically treated genomic DNA (Homo sapiens) CpG-island No: 6357
tgcgtcgaaaaatggttaggtcgttggtattaatattattggttttttcgaggtttgtatgttcggcgggatggcgatgaaatggcgttggcgtaagcgtatggaagttgtaggtaaattaacggataaattaaatttggtgtgcggttcggtataaatttgttggtataaattcgttcgttattgggatgtggagttgcgtgagatttttatgcgtttcggttagttgtttatggattcgaaacgtatgattgaagtttgtgacgaaaatattatcggcgtggtgtcgattttcggcgtgatttatattggtaattatgagtttttataatcgttgtacgatgcgttggataaattttaggtcgatatcggtatcgatatcgatatgtatatcgacgttgttagcggtggttttttggtatcgtcgtcgttcggatatcgttgggattttcgtttgcgcgtgtgaatcgattatgttatttagtagttaatcgttttgtgttttaaagaaagtaattt

SEQ ID NO: 6358 - DNA, 519 bp, Artificial Sequence
  chemically treated genomic DNA (Homo sapiens) CpG-island No: 6358
aaattactttctttaaaacacaaaacgattaactactaaataacataatcgattcacacgcgcaaacgaaaatcccaacgatatccgaacgacgacgataccaaaaaaccaccgctaacaacgtcgatatacatatcgatatcgataccgatatcgacctaaaatttatccaacgcatcgtacaacgattataaaaactcataattaccaatataaatcacgccgaaaatcgacaccacgccgataatattttcgtcacaaacttcaatcatacgtttcgaatccataaacaactaaccgaaacgcataaaaatctcacgcaactccacatcccaataacgaacgaatttataccaacaaatttataccgaaccgcacaccaaatttaatttatccgttaatttacctacaacttccatacgcttacgccaacgccatttcatcgccatcccgccgaacatacaaacctcgaaaaaaccaataatattaataccaacgacctaaccatttttcgacgca

SEQ ID NO: 6359 - DNA, 519 bp, Artificial Sequence
  chemically treated genomic DNA (Homo sapiens) CpG-island No: 6359
aaattgttttttttagagtatagggcgattaattattgagtagtatgatcgatttatacgcgtaagcgaaagttttagcgatattcgggcgacgacggtgttaggaagttatcgttggtagcgtcgatgtgtatgtcgatgtcgatatcggtatcggtttggaatttatttagcgtatcgtgtagcggttgtgggaatttatagttattagtgtaggttacgtcgaaagtcggtattacgtcgatggtgttttcgttataggttttaattatgcgtttcgggtttataaataattgatcggggcgtatagggattttacgtagttttatattttagtagcgggcgaatttatgttagtagatttgtatcggatcgtatattaggtttggtttattcgttggtttgtttgtagtttttatacgtttgcgttaacgttattttatcgttatttcgtcgagtatataggtttcggaagaattaatggtgttggtgttaacggtttgattatttttcggcgta

SEQ ID NO: 6360 - DNA, 519 bp, Artificial Sequence
  chemically treated genomic DNA (Homo sapiens) CpG-island No: 6360
tacgccgaaaaataatcaaaccgttaacaccaacaccattaattcttccgaaacctatatactcgacgaaataacgataaaataacgttaacgcaaacgtataaaaactacaaacaaaccaacgaataaaccaaacctaatatacgatccgatacaaatctactaacataaattcgcccgctactaaaatataaaactacgtaaaatccctatacgccccgatcaattatttataaacccgaaacgcataattaaaacctataacgaaaacaccatcgacgtaataccgactttcgacgtaacctacactaataactataaattcccacaaccgctacacgatacgctaaataaattccaaaccgataccgatatcgacatcgacatacacatcgacgctaccaacgataacttcctaacaccgtcgtcgcccgaatatcgctaaaactttcgcttacgcgtataaatcgatcatactactcaataattaatcgccctatactctaaaaaaaacaattt

SEQ ID NO: 6361 - DNA, 502 bp, Artificial Sequence
  chemically treated genomic DNA (Homo sapiens) CpG-island No: 6361
tcgattcgaagaatggcgtagcggtaatgaaagcgttcgtcgtgattcgtgtgggtgacgtgtttttcgttttcgtattgtttattttttataacgaattgggtattttgaattttcgcgaaatggtggaattggtattagcgtattttgttgacggtaataatatgttgatgtgggcgacgttgatgttgttgggcggtgcgggcggtaaatttgcgtagttgtcgttgtagatatggtttgtcgacgcgatggcgggtttcgacgtttgttttcgcgttgatttacgtcgtaaattatggtaatcggcggtggttatttgatcgttcgtatatatcgttgtttttgatgacgacggaggtttgtatttggggggtattgtcgggtaggttttttgttttttggcgggttttgtcggtttggtatagatcgacgataaaagcggttttggtttattttattatgaagtagatatggtttattgttttttgggtttcggcgt

SEQ ID NO: 6362 - DNA, 502 bp, Artificial Sequence
  chemically treated genomic DNA (Homo sapiens) CpG-island No: 6362
acgccgaaacccaaaaaacaataaaccatatctacttcataataaaataaaccaaaaccgcttttatcgtcgatctataccaaaccgacaaaacccgccaaaaaacaaaaaacctacccgacaataccccccaaatacaaacctccgtcgtcatcaaaaacaacgatatatacgaacgatcaaataaccaccgccgattaccataatttacgacgtaaatcaacgcgaaaacaaacgtcgaaacccgccatcgcgtcgacaaaccatatctacaacgacaactacgcaaatttaccgcccgcaccgcccaacaacatcaacgtcgcccacatcaacatattattaccgtcaacaaaatacgctaataccaattccaccatttcgcgaaaattcaaaatacccaattcgttataaaaaataaacaatacgaaaacgaaaaacacgtcacccacacgaatcacgacgaacgctttcattaccgctacgccattcttcgaatcga

SEQ ID NO: 6363 - DNA, 502 bp, Artificial Sequence
  chemically treated genomic DNA (Homo sapiens) CpG-island No: 6363
gcgtcgaagtttaaggaataataaattatatttgttttatggtaaagtaagttagaatcgtttttatcgtcggtttgtattaggtcggtaaaattcgttaggaagtaggggatttgttcgataatattttttagatgtagattttcgtcgttattaggaatagcggtgtgtacgggcgattaggtagttatcgtcggttattatggtttacggcgtggattagcgcggagataggcgtcggggttcgttatcgcgtcggtaagttatgtttgtaacggtaattgcgtagatttatcgttcgtatcgtttagtagtattagcgtcgtttatattagtatgttattgtcgttagtaaagtgcgttggtgttagttttattatttcgcggaagtttagggtgtttagttcgttgtaaagaatgaatagtgcgaaagcgaggaatacgttatttatacgggttacgacgaacgtttttattgtcgttgcgttatttttcggatcgg

SEQ ID NO: 6364 - DNA, 502 bp, Artificial Sequence
  chemically treated genomic DNA (Homo sapiens) CpG-island No: 6364
ccgatccgaaaaataacgcaacgacaataaaaacgttcgtcgtaacccgtataaataacgtattcctcgctttcgcactattcattctttacaacgaactaaacaccctaaacttccgcgaaataataaaactaacaccaacgcactttactaacgacaataacatactaatataaacgacgctaatactactaaacgatacgaacgataaatctacgcaattaccgttacaaacataacttaccgacgcgataacgaaccccgacgcctatctccgcgctaatccacgccgtaaaccataataaccgacgataactacctaatcgcccgtacacaccgctattcctaataacgacgaaaatctacatctaaaaaatattatcgaacaaatcccctacttcctaacgaattttaccgacctaatacaaaccgacgataaaaacgattctaacttactttaccataaaacaaatataatttattattccttaaacttcgacgc

SEQ ID NO: 6365 - DNA, 515 bp, Artificial Sequence
  chemically treated genomic DNA (Homo sapiens) CpG-island No: 6365
tcgagcgtgtttaggcgttggttatcgtggcgtcgttattttgttttagtgttcgtgacgagtggtcggggataaaatcggacgtgttggcgggattttagtagtaatttagtgatgatttttagcgtatagtggagcggtttttggcgttataaattatggggattgaaacggcgcgttaggatgcgcgggcgttgaagaaaatcgttttggcgttatcgatgtcggaggttgacgtgtttaatggcgggttggaaattttgaaaacggtcgattttcgttagtcgttgtaaaacgtgtttatgtcgtttttgcgattgtatggttatttcgacggtttggtgtcgcgtaaagtggtgtcgatgttggataaattttggttttatagcgaattatatattttcgttaaagcggtttatgcgttatttatttcgtattcggtcgagttttgttatttgttggtggcgttgaagtagaaggtgtaaggggtttttgaaatggcgagatagaattat

SEQ ID NO: 6366 - DNA, 515 bp, Artificial Sequence
  chemically treated genomic DNA (Homo sapiens) CpG-island No: 6366
ataattctatctcgccatttcaaaaaccccttacaccttctacttcaacgccaccaacaaataacaaaactcgaccgaatacgaaataaataacgcataaaccgctttaacgaaaatatataattcgctataaaaccaaaatttatccaacatcgacaccactttacgcgacaccaaaccgtcgaaataaccatacaatcgcaaaaacgacataaacacgttttacaacgactaacgaaaatcgaccgttttcaaaatttccaacccgccattaaacacgtcaacctccgacatcgataacgccaaaacgattttcttcaacgcccgcgcatcctaacgcgccgtttcaatccccataatttataacgccaaaaaccgctccactatacgctaaaaatcatcactaaattactactaaaatcccgccaacacgtccgattttatccccgaccactcgtcacgaacactaaaacaaaataacgacgccacgataaccaacgcctaaacacgctcga

SEQ ID NO: 6367 - DNA, 515 bp, Artificial Sequence
  chemically treated genomic DNA (Homo sapiens) CpG-island No: 6367
atagttttgtttcgttattttaaaagttttttatattttttgttttaacgttattagtaggtgataaaattcggtcggatgcgaaataaatggcgtatgggtcgttttggcgaagatatatgattcgttgtgaggttaaagtttatttagtatcggtattattttgcgcggtattagatcgtcgagatagttatataatcgtaaaaacggtatggatacgttttgtagcggttgacggagatcgatcgtttttaggatttttagttcgttattaagtacgttaattttcggtatcggtaacgttagaacggttttttttaacgttcgcgtattttggcgcgtcgttttagtttttatggtttgtaacgttaggaatcgttttattgtacgttgaaaattattattgagttgttgttgaaatttcgttagtacgttcggttttattttcggttattcgttacgagtattaaaataaggtgacgacgttacggtgattagcgtttgaatacgttcgg

SEQ ID NO: 6368 - DNA, 515 bp, Artificial Sequence
  chemically treated genomic DNA (Homo sapiens) CpG-island No: 6368
ccgaacgtattcaaacgctaatcaccgtaacgtcgtcaccttattttaatactcgtaacgaataaccgaaaataaaaccgaacgtactaacgaaatttcaacaacaactcaataataattttcaacgtacaataaaacgattcctaacgttacaaaccataaaaactaaaacgacgcgccaaaatacgcgaacgttaaaaaaaaccgttctaacgttaccgataccgaaaattaacgtacttaataacgaactaaaaatcctaaaaacgatcgatctccgtcaaccgctacaaaacgtatccataccgtttttacgattatataactatctcgacgatctaataccgcgcaaaataataccgatactaaataaactttaacctcacaacgaatcatatatcttcgccaaaacgacccatacgccatttatttcgcatccgaccgaattttatcacctactaataacgttaaaacaaaaaatataaaaaacttttaaaataacgaaacaaaactat

SEQ ID NO: 6369 - DNA, 797 bp, Artificial Sequence
  chemically treated genomic DNA (Homo sapiens) CpG-island No: 6369
  misc_feature (614)..(614): n is either a, c, g or t
agatcgtcgtcgtcgcgtacgtcgttaattgttacggtatttagtacggtggtgatgtcgttcgttattattagcgcgtcgtggttgtttatcgtcgagtgggtaggttagttaattttcgggcgcggggtgaagaatttatttagattatcggtatgtagtttaattagtttcggtagtagttagtcgttttcgtcgtttatcgttttcggtaggcggttttggttttcggtaaaggcgcggatttcgtcgttttgtatttttagcgaatcgtttattatttcgttttttagtattagtttaacgttattgataattatgaagaggtttttattgggtgtaggcggtcggcgacgttattacgtatagtttcgttatggaagatgtttacgatggttgcgttacgggttttggtttcgcgaattagttttattatcgcggcgttgtttttggcgtttagcgaggcggtaggttcgttaagtagtagaatggggtagtcgacgataaagtcgcgggcgatgttgacgcgttgttgttcgttatcggaaaatgtcgatggtgttaggtgtttatagcgttttcgtacgttttagcgggtgagaagacgcgcggtntttacggcgtatgttttacgtcgaacgttcgtatcgagtagcggttgtattattatttttagcgttgagatacgtcggatggacgtttagaatttggtttattttagttacgggggttttgtgggaatgaggggtgtgtatatgcgtcgtttttaagcgtattttttgtttgttaaaaatgtg

SEQ ID NO: 6370 - DNA, 797 bp, Artificial Sequence
  chemically treated genomic DNA (Homo sapiens) CpG-island No: 6370
  misc_feature (184)..(184): n is either a, c, g or t
cacatttttaacaaacaaaaaatacgcttaaaaacgacgcatatacacacccctcattcccacaaaacccccgtaactaaaataaaccaaattctaaacgtccatccgacgtatctcaacgctaaaaataataatacaaccgctactcgatacgaacgttcgacgtaaaacatacgccgtaaanaccgcgcgtcttctcacccgctaaaacgtacgaaaacgctataaacacctaacaccatcgacattttccgataacgaacaacaacgcgtcaacatcgcccgcgactttatcgtcgactaccccattctactacttaacgaacctaccgcctcgctaaacgccaaaaacaacgccgcgataataaaactaattcgcgaaaccaaaacccgtaacgcaaccatcgtaaacatcttccataacgaaactatacgtaataacgtcgccgaccgcctacacccaataaaaacctcttcataattatcaataacgttaaactaatactaaaaaacgaaataataaacgattcgctaaaaatacaaaacgacgaaatccgcgcctttaccgaaaaccaaaaccgcctaccgaaaacgataaacgacgaaaacgactaactactaccgaaactaattaaactacataccgataatctaaataaattcttcaccccgcgcccgaaaattaactaacctacccactcgacgataaacaaccacgacgcgctaataataacgaacgacatcaccaccgtactaaataccgtaacaattaacgacgtacgcgacgacgacgatct

SEQ ID NO: 6371 - DNA, 797 bp, Artificial Sequence
  chemically treated genomic DNA (Homo sapiens) CpG-island No: 6371
  misc_feature (184)..(184): n is either a, c, g or t
tatatttttagtagataaggagtgcgtttagagacgacgtatatatatattttttatttttataaaattttcgtggttggggtgaattaggttttgggcgtttattcggcgtattttagcgttggaagtggtgatgtagtcgttgttcgatacgggcgttcggcgtgaagtatgcgtcgtaaangtcgcgcgtttttttattcgttagaacgtgcgggaacgttgtgggtatttggtattatcgatatttttcggtggcgaatagtagcgcgttaatatcgttcgcggttttatcgtcgattattttattttgttgtttgacgaatttatcgtttcgttggacgttaaaaatagcgtcgcggtggtggaattgattcgcgaagttaaaattcgtggcgtagttatcgtaggtattttttatgacgaagttgtacgtaatgacgtcgtcgatcgtttgtatttaatgggagtttttttatgattattaataacgttaagttggtgttggaaaacgaggtggtaagcggttcgttggaggtgtagaacggcgaaattcgcgtttttgtcgaaagttagagtcgtttgtcggaggcgatggacggcgaaggcggttggttgttgtcggggttgattgagttgtatatcgataatttggataaattttttatttcgcgttcgaaagttgattggtttgtttattcggcgatgagtagttacgacgcgttgatggtggcgagcggtattattatcgtattggatgtcgtggtaattggcgacgtgcgcgacggcggcgattt

SEQ ID NO: 6372 - DNA, 797 bp, Artificial Sequence
  chemically treated genomic DNA (Homo sapiens) CpG-island No: 6372
  misc_feature (614)..(614): n is either a, c, g or t
aaatcgccgccgtcgcgcacgtcgccaattaccacgacatccaatacgataataataccgctcgccaccatcaacgcgtcgtaactactcatcgccgaataaacaaaccaatcaactttcgaacgcgaaataaaaaatttatccaaattatcgatatacaactcaatcaaccccgacaacaaccaaccgccttcgccgtccatcgcctccgacaaacgactctaactttcgacaaaaacgcgaatttcgccgttctacacctccaacgaaccgcttaccacctcgttttccaacaccaacttaacgttattaataatcataaaaaaactcccattaaatacaaacgatcgacgacgtcattacgtacaacttcgtcataaaaaatacctacgataactacgccacgaattttaacttcgcgaatcaattccaccaccgcgacgctatttttaacgtccaacgaaacgataaattcgtcaaacaacaaaataaaataatcgacgataaaaccgcgaacgatattaacgcgctactattcgccaccgaaaaatatcgataataccaaatacccacaacgttcccgcacgttctaacgaataaaaaaacgcgcgacntttacgacgcatacttcacgccgaacgcccgtatcgaacaacgactacatcaccacttccaacgctaaaatacgccgaataaacgcccaaaacctaattcaccccaaccacgaaaattttataaaaataaaaaatatatatatacgtcgtctctaaacgcactccttatctactaaaaatata

SEQ ID NO: 6373 - DNA, 557 bp, Artificial Sequence
  chemically treated genomic DNA (Homo sapiens) CpG-island No: 6373
  misc_feature (302)..(302): n is either a, c, g or t
attttttcgaggtttatatatggtattttattttaattttttcggataggtaagattttcgatgtgtagggaaattttacgaagagtgttatacgcgaagtcgttttatagtgttagttaaaaagggggaagttttatgcgtagtacggttcggagagacgttttttcgagttatcgttgcgtattcggtaagtgcgttaaattgttgacgcgatgagttgtcggcgtgatttgattatcggtaagacgaagtaagttgttttcgcgaaggtaagtggtgcgtttaagagttttttgttcgncgatggttgtaatattatcggtgtcgcggtattcgtttaggtgaaggcgataaagtcgtttttttgatcgtgtttcgtggcgatggcgtaatttttatcgtaacgtaaaacggttacggtaaacgtatcgtagtggcggaatatttaattaagtcgcgtgcgacgaaaggggttatttttattaaggttatcgaacgtaacggtttagttgttggcgcggtataggtagatgattgcgattagattatgatgatt

SEQ ID NO: 6374 - DNA, 557 bp, Artificial Sequence
  chemically treated genomic DNA (Homo sapiens) CpG-island No: 6374
  misc_feature (256)..(256): n is either a, c, g or t
aatcatcataatctaatcgcaatcatctacctataccgcgccaacaactaaaccgttacgttcgataaccttaataaaaataacccctttcgtcgcacgcgacttaattaaatattccgccactacgatacgtttaccgtaaccgttttacgttacgataaaaattacgccatcgccacgaaacacgatcaaaaaaacgactttatcgccttcacctaaacgaataccgcgacaccgataatattacaaccatcgncgaacaaaaaactcttaaacgcaccacttaccttcgcgaaaacaacttacttcgtcttaccgataatcaaatcacgccgacaactcatcgcgtcaacaatttaacgcacttaccgaatacgcaacgataactcgaaaaaacgtctctccgaaccgtactacgcataaaacttccccctttttaactaacactataaaacgacttcgcgtataacactcttcgtaaaatttccctacacatcgaaaatcttacctatccgaaaaaattaaaataaaataccatatataaacctcgaaaaaat

SEQ ID NO: 6375 - DNA, 557 bp, Artificial Sequence
  chemically treated genomic DNA (Homo sapiens) CpG-island No: 6375
  misc_feature (256)..(256): n is either a, c, g or t
gattattatgatttggtcgtagttatttatttgtatcgcgttaataattaaatcgttacgttcggtaattttgatggagataatttttttcgtcgtacgcgatttggttgggtatttcgttattgcggtacgtttatcgtaatcgttttgcgttgcggtgaggattgcgttatcgttacgaggtacgattagagagacgattttatcgtttttatttaagcgaatatcgcgatatcggtggtgttgtagttatcgncggatagaagatttttaagcgtattatttattttcgcgggaatagtttatttcgttttgtcggtggttaggttacgtcgatagtttatcgcgttaatagtttgacgtatttatcgggtacgtaacggtgattcgagaggacgttttttcggatcgtattgcgtatgaaatttttttttttttaattggtattgtgaagcgatttcgcgtgtgatatttttcgtaggatttttttgtatatcggaagttttgtttgttcgagagggttaaggtgggatattatatgtaagtttcggggagat

SEQ ID NO: 6376 - DNA, 557 bp, Artificial Sequence
  chemically treated genomic DNA (Homo sapiens) CpG-island No: 6376
  misc_feature (302)..(302): n is either a, c, g or t
atctccccgaaacttacatataatatcccaccttaaccctctcgaacaaacaaaacttccgatatacaaaaaaatcctacgaaaaatatcacacgcgaaatcgcttcacaataccaattaaaaaaaaaaaaatttcatacgcaatacgatccgaaaaaacgtcctctcgaatcaccgttacgtacccgataaatacgtcaaactattaacgcgataaactatcgacgtaacctaaccaccgacaaaacgaaataaactattcccgcgaaaataaataatacgcttaaaaatcttctatccgncgataactacaacaccaccgatatcgcgatattcgcttaaataaaaacgataaaatcgtctctctaatcgtacctcgtaacgataacgcaatcctcaccgcaacgcaaaacgattacgataaacgtaccgcaataacgaaatacccaaccaaatcgcgtacgacgaaaaaaattatctccatcaaaattaccgaacgtaacgatttaattattaacgcgatacaaataaataactacgaccaaatcataataatc

SEQ ID NO: 6377 - DNA, 964 bp, Artificial Sequence
  chemically treated genomic DNA (Homo sapiens) CpG-island No: 6377
gtgtagcgacgtttggcgtattttggtcggttttggatttatcgggatattgttcggagtgatgattatatggttaaaataatcgttttgttttaaggaggatagtatagttattttcgttagcgttattagtaggtcgttattagagcggtcgtgatacgttagtagtttacgttgtgtaattagcgtttgaatcgcgttatagaagttttttagttgcgcgatatcgcgtatatttgtcggtttgtcgttaagttgacgataaatttgcgttagcgtcgttgcgtttagcgcgttattgtttttgtttaaattaattagtagtagtgcgttattttcggtagaaagttgcggcgtgatggtgtgacgtatattttttacgcgggtaaatgtagaaattattagcgatagcggcgacgttatttcgcgtttttcgttatttttttgttagcgggtttttatcgatatggagtttttatttatcgggatcgttaggtttagcgtcggataaagtttttcgtttacggttttaacggttttatataggttcgtatttttattagggtggtttgtcgtcgttatttagttggcggaaagtttgatgcgtttgatatcgttaatttgtgttgcggcgatgttggttaacgttttatcgatcgttagacgggtagaggcggcgaaattagtagcgtaatcggcgcgcgttttgtaattggcgatcgtttatcggagagtttgttagtttgcggttgtgatcgtttagatatgatcgtatatgttaggtttattagtgatgtttttatttgcggttcgttgcgcgttaatgttattagatagtttttcgtttagtcgtagatgtattacgtttatcgcgttgtaggggatttttttcggttattttgtgatgatttattttttgtgttttaaagatattaatttcggtttattttttagtattaatggt

SEQ ID NO: 6378 - DNA, 964 bp, Artificial Sequence
  chemically treated genomic DNA (Homo sapiens) CpG-island No: 6378
accattaatactaaaaaataaaccgaaattaatatctttaaaacacaaaaaataaatcatcacaaaataaccgaaaaaaatcccctacaacgcgataaacgtaatacatctacgactaaacgaaaaactatctaataacattaacgcgcaacgaaccgcaaataaaaacatcactaataaacctaacatatacgatcatatctaaacgatcacaaccgcaaactaacaaactctccgataaacgatcgccaattacaaaacgcgcgccgattacgctactaatttcgccgcctctacccgtctaacgatcgataaaacgttaaccaacatcgccgcaacacaaattaacgatatcaaacgcatcaaactttccgccaactaaataacgacgacaaaccaccctaataaaaatacgaacctatataaaaccgttaaaaccgtaaacgaaaaactttatccgacgctaaacctaacgatcccgataaataaaaactccatatcgataaaaacccgctaacaaaaaaataacgaaaaacgcgaaataacgtcgccgctatcgctaataatttctacatttacccgcgtaaaaaatatacgtcacaccatcacgccgcaactttctaccgaaaataacgcactactactaattaatttaaacaaaaacaataacgcgctaaacgcaacgacgctaacgcaaatttatcgtcaacttaacgacaaaccgacaaatatacgcgatatcgcgcaactaaaaaacttctataacgcgattcaaacgctaattacacaacgtaaactactaacgtatcacgaccgctctaataacgacctactaataacgctaacgaaaataactatactatcctccttaaaacaaaacgattattttaaccatataatcatcactccgaacaatatcccgataaatccaaaaccgaccaaaatacgccaaacgtcgctacac

SEQ ID NO: 6379 - DNA, 964 bp, Artificial Sequence
  chemically treated genomic DNA (Homo sapiens) CpG-island No: 6379
attattgatgttgaagggtgaatcggagttgatatttttagagtataggggatgagttattatagggtggtcgggaaggattttttgtagcgcggtgaacgtggtgtatttgcgattgggcgaaaaattatttggtgatattggcgcgtagcgagtcgtagatagaggtattattggtgggtttagtatgtgcggttatatttggacgattatagtcgtagattggtaggtttttcggtgaacgatcgttagttgtagagcgcgcgtcggttgcgttgttgatttcgtcgtttttgttcgtttggcggtcggtgaagcgttaattaatatcgtcgtaatataaattggcgatattaaacgtattaaatttttcgttaattggatggcggcggtaggttattttggtgaagatgcgggtttgtatgaagtcgttaaagtcgtgggcgaagagttttgttcggcgttgggtttgacgatttcggtgggtaaagattttatgtcgatgaaaattcgttggtaggaaggtaacgaagagcgcgaaatgacgtcgtcgttgtcgttggtgatttttgtatttgttcgcgtggaagatgtacgttatattattacgtcgtagttttttatcgaagataacgtattgttgttgattgatttgggtaaaggtaataacgcgttgggcgtaacggcgttggcgtaggtttatcgttagtttggcgataaatcggtagatgtacgcgatgtcgcgtaattgaaaggtttttatgacgcgatttaggcgttggttgtatagcgtaagttgttggcgtattacgatcgttttgatggcggtttgttggtaacgttggcggaaatggttgtgttgttttttttaggatagggcggttattttggttatatgattattatttcgggtagtatttcggtaaatttaaaatcggttaaagtacgttagacgtcgttgtat

SEQ ID NO: 6380 - DNA, 964 bp, Artificial Sequence
  chemically treated genomic DNA (Homo sapiens) CpG-island No: 6380
atacaacgacgtctaacgtactttaaccgattttaaatttaccgaaatactacccgaaataataatcatataaccaaaataaccgccctatcctaaaaaaaacaacacaaccatttccgccaacgttaccaacaaaccgccatcaaaacgatcgtaatacgccaacaacttacgctatacaaccaacgcctaaatcgcgtcataaaaacctttcaattacgcgacatcgcgtacatctaccgatttatcgccaaactaacgataaacctacgccaacgccgttacgcccaacgcgttattacctttacccaaatcaatcaacaacaatacgttatcttcgataaaaaactacgacgtaataatataacgtacatcttccacgcgaacaaatacaaaaatcaccaacgacaacgacgacgtcatttcgcgctcttcgttaccttcctaccaacgaattttcatcgacataaaatctttacccaccgaaatcgtcaaacccaacgccgaacaaaactcttcgcccacgactttaacgacttcatacaaacccgcatcttcaccaaaataacctaccgccgccatccaattaacgaaaaatttaatacgtttaatatcgccaatttatattacgacgatattaattaacgcttcaccgaccgccaaacgaacaaaaacgacgaaatcaacaacgcaaccgacgcgcgctctacaactaacgatcgttcaccgaaaaacctaccaatctacgactataatcgtccaaatataaccgcacatactaaacccaccaataatacctctatctacgactcgctacgcgccaatatcaccaaataatttttcgcccaatcgcaaatacaccacgttcaccgcgctacaaaaaatccttcccgaccaccctataataactcatcccctatactctaaaaatatcaactccgattcacccttcaacatcaataat

SEQ ID NO: 6381 - DNA, 804 bp, Artificial Sequence
  chemically treated genomic DNA (Homo sapiens) CpG-island No: 6381
  misc_feature (657)..(657): n is either a, c, g or t
  misc_feature (718)..(718): n is either a, c, g or t
  misc_feature (720)..(720): n is either a, c, g or t
  misc_feature (728)..(728): n is either a, c, g or t
ttttagcgttcgttattgcggtattttatgtttgcgtaacgttattaaatgatttgtcgttatttaaatgtttaagtagttgttttgtcgtggtatcgcgcggtttttttagtggcgtataatattagttattaattacgttttttaattaggttagagtttcggtaatatttttattatgtagtatatcgataatcgttagtacgcgttcgtttttcggtagcgtttttatacgttcggtgagatatttcgtcgtatgtggattatgcgcgatattaaaaataacgcgtggcgattcgtttataatttggaaacgtttcggtaaaattgcgttggtaatttcgtcgcgaatggtatttttattgatttttagttcgttggtacgtagtgtcgttagcgttgttgcggtattcggttgcgggataagcggtaacggtagattttttagcgtgtcgtgagtatcgttaaacgtttagttatgatcggtgacggaatagttttatttaacgtttcgacgttgtaatagtgcgatttttttttttgcgttatattagtaatggtagaaggtattttcggtttatcgataattgtcgggtttttcgttgcgggaagatgtttgcgtttttcgcgataattttttgcgattggattattcgncggatgattattatattggtcgtagtaggttttatcgggatgcgcgaagagaagcgttagngngatttgtnggtcgggtataaatttttgaatgatgcgttttttatttatgagtcgtcgtttgtgaaaaattttcgtgtatcgtga

SEQ ID NO: 6382 - DNA, 804 bp, Artificial Sequence
  chemically treated genomic DNA (Homo sapiens) CpG-island No: 6382
  misc_feature (77)..(77): n is either a, c, g or t
  misc_feature (85)..(85): n is either a, c, g or t
  misc_feature (87)..(87): n is either a, c, g or t
  misc_feature (148)..(148): n is either a, c, g or t
tcacgatacacgaaaatttttcacaaacgacgactcataaataaaaaacgcatcattcaaaaatttatacccgaccnacaaatcncnctaacgcttctcttcgcgcatcccgataaaacctactacgaccaatataataatcatccgncgaataatccaatcgcaaaaaattatcgcgaaaaacgcaaacatcttcccgcaacgaaaaacccgacaattatcgataaaccgaaaataccttctaccattactaatataacgcaaaaaaaaaaatcgcactattacaacgtcgaaacgttaaataaaactattccgtcaccgatcataactaaacgtttaacgatactcacgacacgctaaaaaatctaccgttaccgcttatcccgcaaccgaataccgcaacaacgctaacgacactacgtaccaacgaactaaaaatcaataaaaataccattcgcgacgaaattaccaacgcaattttaccgaaacgtttccaaattataaacgaatcgccacgcgttatttttaatatcgcgcataatccacatacgacgaaatatctcaccgaacgtataaaaacgctaccgaaaaacgaacgcgtactaacgattatcgatatactacataataaaaatattaccgaaactctaacctaattaaaaaacgtaattaataactaatattatacgccactaaaaaaaccgcgcgataccacgacaaaacaactacttaaacatttaaataacgacaaatcatttaataacgttacgcaaacataaaataccgcaataacgaacgctaaaa

SEQ ID NO: 6383 - DNA, 804 bp, Artificial Sequence
  chemically treated genomic DNA (Homo sapiens) CpG-island No: 6383
  misc_feature (77)..(77): n is either a, c, g or t
  misc_feature (85)..(85): n is either a, c, g or t
  misc_feature (87)..(87): n is either a, c, g or t
  misc_feature (148)..(148): n is either a, c, g or t
ttacgatatacgaaagttttttataggcggcgatttatggataaagaacgtattatttaggaatttgtgttcggttngtaggttntnttggcgttttttttcgcgtatttcggtgaggtttgttgcgattagtatggtggttattcgncgggtggtttagtcgtaaaggattgtcgcgagaaacgtaggtattttttcgtagcgaaaaattcggtaattgtcggtgagtcggaagtgttttttattattgttgatgtggcgtagagaaaaaggtcgtattgttataacgtcggggcgttgagtggaattatttcgttatcgattatgattgggcgtttagcgatgtttacggtacgttggaaaatttgtcgttgtcgtttgtttcgtaatcgaatgtcgtaatagcgttggcggtattgcgtgttagcgggttggaagttagtgaaaatgttattcgcgacgggattgttagcgtaattttgtcgggacgtttttagattgtgagcgagtcgttacgcgttatttttgatgtcgcgtataatttatatgcggcggaatattttatcgggcgtatgaaagcgttatcgaaaaacgggcgcgtgttggcggttatcggtatgttatatgataaagatattgtcggaattttggtttggttgaaaagcgtggttgatgattggtattgtgcgttattggaagggtcgcgcggtgttacggtagaataattgtttgagtatttgggtaacggtaaattatttgatagcgttgcgtaggtatgggatgtcgtaatggcggacgttaaag

SEQ ID NO: 6384 - DNA, 804 bp, Artificial Sequence
  chemically treated genomic DNA (Homo sapiens) CpG-island No: 6384
  misc_feature (657)..(657): n is either a, c, g or t
  misc_feature (718)..(718): n is either a, c, g or t
  misc_feature (720)..(720): n is either a, c, g or t
  misc_feature (728)..(728): n is either a, c, g or t
ctttaacgtccgccattacgacatcccatacctacgcaacgctatcaaataatttaccgttacccaaatactcaaacaattattctaccgtaacaccgcgcgacccttccaataacgcacaataccaatcatcaaccacgcttttcaaccaaaccaaaattccgacaatatctttatcatataacataccgataaccgccaacacgcgcccgtttttcgataacgctttcatacgcccgataaaatattccgccgcatataaattatacgcgacatcaaaaataacgcgtaacgactcgctcacaatctaaaaacgtcccgacaaaattacgctaacaatcccgtcgcgaataacattttcactaacttccaacccgctaacacgcaataccgccaacgctattacgacattcgattacgaaacaaacgacaacgacaaattttccaacgtaccgtaaacatcgctaaacgcccaatcataatcgataacgaaataattccactcaacgccccgacgttataacaatacgacctttttctctacgccacatcaacaataataaaaaacacttccgactcaccgacaattaccgaatttttcgctacgaaaaaatacctacgtttctcgcgacaatcctttacgactaaaccacccgncgaataaccaccatactaatcgcaacaaacctcaccgaaatacgcgaaaaaaaacgccaananaacctacnaaccgaacacaaattcctaaataatacgttctttatccataaatcgccgcctataaaaaactttcgtatatcgtaa

SEQ ID NO: 6385 - DNA, 716 bp, Artificial Sequence
  chemically treated genomic DNA (Homo sapiens) CpG-island No: 6385
tgtttatgtagggaaaaatttttcgttagtgtagcgattttacgtttagtaatatggcgcggtatattagttaatagaatttttttacgtatttgtataatgttttcgcgttcgttaagttgtaaggtgttaaacgatgttacgggcgagattttcgttgttattatatcgttttcggtagggtaaaaatcgtggcgtaatagcgtggtttgttgatgaatttttattttcgttagtagcggttttagtattcggcggataaaattcgtaggcggcgtcgacgggttatcggtgtcgtcgtttattttaatacgcgaaggtttatcggtaaattatagcgcgggtagtatcgtttgtagtattagcgtataattttcggcgttatcgatagtaaagcggtaatcgtcgtcgcgtacggtgtcgggtcggaaaagtagacgttgcgattttagttcgcgttttttacggttgtttcgtaaattttcgtcgtcgtttttatcgcggttagatgttggcgtaatagtttcggtttcgttcgttcggtacgaatgttggggatggtaaatggttggtcggttattatcgataggtttagcgtcgagcgtaggatttgttcgttattttcgttttgtgcgttatttagcgtaattattttttttattatttatttttttacgtatattatttgacgtagggtatagataatttttattaga

SEQ ID NO: 6386 - DNA, 716 bp, Artificial Sequence
  chemically treated genomic DNA (Homo sapiens) CpG-island No: 6386
tctaataaaaattatctataccctacgtcaaataatatacgtaaaaaaataaataataaaaaaaataattacgctaaataacgcacaaaacgaaaataacgaacaaatcctacgctcgacgctaaacctatcgataataaccgaccaaccatttaccatccccaacattcgtaccgaacgaacgaaaccgaaactattacgccaacatctaaccgcgataaaaacgacgacgaaaatttacgaaacaaccgtaaaaaacgcgaactaaaatcgcaacgtctacttttccgacccgacaccgtacgcgacgacgattaccgctttactatcgataacgccgaaaattatacgctaatactacaaacgatactacccgcgctataatttaccgataaaccttcgcgtattaaaataaacgacgacaccgataacccgtcgacgccgcctacgaattttatccgccgaatactaaaaccgctactaacgaaaataaaaattcatcaacaaaccacgctattacgccacgatttttaccctaccgaaaacgatataataacaacgaaaatctcgcccgtaacatcgtttaacaccttacaacttaacgaacgcgaaaacattatacaaatacgtaaaaaaattctattaactaatataccgcgccatattactaaacgtaaaatcgctacactaacgaaaaatttttccctacataaaca

SEQ ID NO: 6387 - DNA, 716 bp, Artificial Sequence
  chemically treated genomic DNA (Homo sapiens) CpG-island No: 6387
tttggtggaagttatttatattttgcgttaggtggtgtgcgtaaaaggataaatgatgaaaaggatgattgcgttggatggcgtatagggcgaaggtggcgggtagattttgcgttcggcgttgagtttgtcgatgataatcggttagttatttattatttttagtattcgtgtcgggcgggcgaaatcggggttgttgcgttagtatttgatcgcggtaaaggcggcgacggaaatttgcggagtaatcgtggaaggcgcgagttggggtcgtagcgtttgttttttcggttcggtatcgtgcgcggcggcgattatcgttttgttatcggtagcgtcggaagttgtacgttggtgttgtaaacggtgttgttcgcgttgtggtttgtcgatggattttcgcgtgttgaagtgagcggcggtatcgataattcgtcggcgtcgtttgcggattttattcgtcgggtgttggagtcgttgttggcgaaaataggaatttattagtaaattacgttgttacgttacggtttttattttgtcggaggcggtgtggtggtaacggaagtttcgttcgtggtatcgtttaatattttgtaatttggcgagcgcgggaatattgtgtagatgcgtggagaagttttattagttggtgtgtcgcgttatgttgttgagcgtgaaatcgttatattggcggggagtttttttttgtatgaata

SEQ ID NO: 6388 - DNA, 716 bp, Artificial Sequence
  chemically treated genomic DNA (Homo sapiens) CpG-island No: 6388
tattcatacaaaaaaaaactccccgccaatataacgatttcacgctcaacaacataacgcgacacaccaactaataaaacttctccacgcatctacacaatattcccgcgctcgccaaattacaaaatattaaacgataccacgaacgaaacttccgttaccaccacaccgcctccgacaaaataaaaaccgtaacgtaacaacgtaatttactaataaattcctattttcgccaacaacgactccaacacccgacgaataaaatccgcaaacgacgccgacgaattatcgataccgccgctcacttcaacacgcgaaaatccatcgacaaaccacaacgcgaacaacaccgtttacaacaccaacgtacaacttccgacgctaccgataacaaaacgataatcgccgccgcgcacgataccgaaccgaaaaaacaaacgctacgaccccaactcgcgccttccacgattactccgcaaatttccgtcgccgcctttaccgcgatcaaatactaacgcaacaaccccgatttcgcccgcccgacacgaatactaaaaataataaataactaaccgattatcatcgacaaactcaacgccgaacgcaaaatctacccgccaccttcgccctatacgccatccaacgcaatcatccttttcatcatttatccttttacgcacaccacctaacgcaaaatataaataacttccaccaaa

SEQ ID NO: 6389 - DNA, 648 bp, Artificial Sequence
  chemically treated genomic DNA (Homo sapiens) CpG-island No: 6389
  misc_feature (27)..(27): n is either a, c, g or t
  misc_feature (29)..(30): n is either a, c, g or t
  misc_feature (49)..(49): n is either a, c, g or t
  misc_feature (55)..(55): n is either a, c, g or t
  misc_feature (65)..(65): n is either a, c, g or t
ggaaggcgattagaggaacggggggangnnggaatttatttgacgtagngtttgngtggcgcggntaaatttgttttgattgaaattaaagttatcgattagcgttataacggtatcgttttgcggattgatcgatattagcgtcgagtttattttcggtatttgtgttagttattatgtatcgttaatttgacgaatttagatttgttgattcgtttgtagaatatcggttattttacgcggcgtcggtttttgttgagtattcgaacggtaaggacgcgtttagcgaacgttttttatatttaatgcgacggtcgattcgttcgttagtatcgtcgtcgtttgttgaggattggcgttggtgattgcggtaggtagtagcggattataggttggtagcgtttttagcgtatcggtaattttgttgttattttacgtcgattcgtttattttttatagtatatttgtcgggtcgcgatagtcgtggcgtatgtcgtagtttagtacgttattacgtatcgtttgttgcgcggtttgttgtattttgcgggtgatggtggtgtaaatgcgataatcgtttttataggtattttcgttataacggttatatattttttggcgtattatttggtttagtacggcgtagag

SEQ ID NO: 6390 - DNA, 648 bp, Artificial Sequence
  chemically treated genomic DNA (Homo sapiens) CpG-island No: 6390
  misc_feature (584)..(584): n is either a, c, g or t
  misc_feature (594)..(594): n is either a, c, g or t
  misc_feature (600)..(600): n is either a, c, g or t
  misc_feature (619)..(620): n is either a, c, g or t
  misc_feature (622)..(622): n is either a, c, g or t
ctctacgccgtactaaaccaaataatacgccaaaaaatatataaccgttataacgaaaatacctataaaaacgattatcgcatttacaccaccatcacccgcaaaatacaacaaaccgcgcaacaaacgatacgtaataacgtactaaactacgacatacgccacgactatcgcgacccgacaaatatactataaaaaataaacgaatcgacgtaaaataacaacaaaattaccgatacgctaaaaacgctaccaacctataatccgctactacctaccgcaatcaccaacgccaatcctcaacaaacgacgacgatactaacgaacgaatcgaccgtcgcattaaatataaaaaacgttcgctaaacgcgtccttaccgttcgaatactcaacaaaaaccgacgccgcgtaaaataaccgatattctacaaacgaatcaacaaatctaaattcgtcaaattaacgatacataataactaacacaaataccgaaaataaactcgacgctaatatcgatcaatccgcaaaacgataccgttataacgctaatcgataactttaatttcaatcaaaacaaatttanccgcgccacncaaacnctacgtcaaataaattccnncntccccccgttcctctaatcgccttcc

SEQ ID NO: 6391 - DNA, 648 bp, Artificial Sequence
  chemically treated genomic DNA (Homo sapiens) CpG-island No: 6391
  misc_feature (584)..(584): n is either a, c, g or t
  misc_feature (594)..(594): n is either a, c, g or t
  misc_feature (600)..(600): n is either a, c, g or t
  misc_feature (619)..(620): n is either a, c, g or t
  misc_feature (622)..(622): n is either a, c, g or t
ttttgcgtcgtattgagttaaatggtgcgttaggagatgtataatcgttatggcgaaagtgtttatgaagacggttatcgtatttatattattattattcgtaaagtgtagtaggtcgcgtagtaggcggtacgtaataacgtgttggattacgatatgcgttacggttatcgcggttcggtaaatgtgttgtggaaagtgggcgagtcggcgtgggataataataagattatcgatacgttgaaggcgttgttaatttatggttcgttgttgtttgtcgtagttattagcgttaatttttagtaagcgacggcgatgttggcggacgggtcgatcgtcgtattgagtatggaaggcgttcgttgggcgcgtttttatcgttcggatatttagtaaggatcgacgtcgcgtaaagtgatcgatgttttgtaaacgggttagtaaatttgggttcgttaggttggcgatgtatggtggttggtataagtgtcggaagtgaattcggcgttggtgtcgattaattcgtaaaacggtgtcgttatggcgttggtcggtggttttgattttaattagagtaagtttantcgcgttatntaggtnttgcgttaggtgggttttnntnttttttcgtttttttaatcgtttttt

SEQ ID NO: 6392 - DNA, 648 bp, Artificial Sequence
  chemically treated genomic DNA (Homo sapiens) CpG-island No: 6392
  misc_feature (27)..(27): n is either a, c, g or t
  misc_feature (29)..(30): n is either a, c, g or t
  misc_feature (49)..(49): n is either a, c, g or t
  misc_feature (55)..(55): n is either a, c, g or t
  misc_feature (65)..(65): n is either a, c, g or t
aaaaaacgattaaaaaaacgaaaaaanannaaaacccacctaacgcaanacctanataacgcgantaaacttactctaattaaaatcaaaaccaccgaccaacgccataacgacaccgttttacgaattaatcgacaccaacgccgaattcacttccgacacttataccaaccaccatacatcgccaacctaacgaacccaaatttactaacccgtttacaaaacatcgatcactttacgcgacgtcgatccttactaaatatccgaacgataaaaacgcgcccaacgaacgccttccatactcaatacgacgatcgacccgtccgccaacatcgccgtcgcttactaaaaattaacgctaataactacgacaaacaacaacgaaccataaattaacaacgccttcaacgtatcgataatcttattattatcccacgccgactcgcccactttccacaacacatttaccgaaccgcgataaccgtaacgcatatcgtaatccaacacgttattacgtaccgcctactacgcgacctactacactttacgaataataataatataaatacgataaccgtcttcataaacactttcgccataacgattatacatctcctaacgcaccatttaactcaatacgacgcaaaa

SEQ ID NO: 6393 - DNA, 501 bp, Artificial Sequence
  chemically treated genomic DNA (Homo sapiens) CpG-island No: 6393
tattgtttcgtcggtgtttgatttcgggatgcgttgtatttatatttggcgtatcgttgtcgatggttaggttaacgtggcgtttttcggcgagcgttacggcgattattcgtatattatttcgtgtatcggttttattatgggaattaacggcgaatacgattaggtggcgtattacggtcgtggatcgggcgaaaattacgtcgatagttagtaggttaatattatcgatatttggcgtagtatcgtcgatgttatgttcgagaattattttttttcgtagaataacggtaatcgttagtatgttcgttggacggtattgattaatcgttacggtaacggtttgttggtggtttcgtagcgtttaattaattttagcgtttggtattatatttaggaaaatatttacgttgtttagtattgtaacgagttgtagcgtagtgatgatattattttgaatttcgattattattgtttggtttcggttttaatttttggggt

SEQ ID NO: 6394 - DNA, 501 bp, Artificial Sequence
  chemically treated genomic DNA (Homo sapiens) CpG-island No: 6394
accccaaaaattaaaaccgaaaccaaacaataataatcgaaattcaaaataatatcatcactacgctacaactcgttacaatactaaacaacgtaaatattttcctaaatataataccaaacgctaaaattaattaaacgctacgaaaccaccaacaaaccgttaccgtaacgattaatcaataccgtccaacgaacatactaacgattaccgttattctacgaaaaaaaataattctcgaacataacatcgacgatactacgccaaatatcgataatattaacctactaactatcgacgtaattttcgcccgatccacgaccgtaatacgccacctaatcgtattcgccgttaattcccataataaaaccgatacacgaaataatatacgaataatcgccgtaacgctcgccgaaaaacgccacgttaacctaaccatcgacaacgatacgccaaatataaatacaacgcatcccgaaatcaaacaccgacgaaacaata

SEQ ID NO: 6395 - DNA, 501 bp, Artificial Sequence
  chemically treated genomic DNA (Homo sapiens) CpG-island No: 6395
gttttaggagttggagtcgaggttaagtagtggtgatcgaggtttagggtgatgttattattgcgttgtagttcgttatagtgttgggtagcgtggatgtttttttgggtatagtgttaggcgttgaagttaattgggcgttgcggaattattagtagatcgttatcgtggcggttagttagtgtcgtttagcggatatgttgacggttatcgttgttttgcgggaagggatagttttcgaatatggtatcgacggtgttgcgttagatatcgatgatgttagtttgttggttgtcggcgtagttttcgttcggtttacgatcgtaatacgttatttgatcgtattcgtcgttaatttttatggtgaaatcgatgtacggaatgatgtgcggatagtcgtcgtaacgttcgtcggaaagcgttacgttaatttggttatcggtagcgatgcgttagatgtaggtgtagcgtatttcgaagttaaatatcggcggggtaata

SEQ ID NO: 6396 - DNA, 501 bp, Artificial Sequence
  chemically treated genomic DNA (Homo sapiens) CpG-island No: 6396
tattaccccgccgatatttaacttcgaaatacgctacacctacatctaacgcatcgctaccgataaccaaattaacgtaacgctttccgacgaacgttacgacgactatccgcacatcattccgtacatcgatttcaccataaaaattaacgacgaatacgatcaaataacgtattacgatcgtaaaccgaacgaaaactacgccgacaaccaacaaactaacatcatcgatatctaacgcaacaccgtcgataccatattcgaaaactatcccttcccgcaaaacaacgataaccgtcaacatatccgctaaacgacactaactaaccgccacgataacgatctactaataattccgcaacgcccaattaacttcaacgcctaacactatacccaaaaaaacatccacgctacccaacactataacgaactacaacgcaataataacatcaccctaaacctcgatcaccactacttaacctcgactccaactcctaaaac

SEQ ID NO: 6397 - DNA, 702 bp, Artificial Sequence
  chemically treated genomic DNA (Homo sapiens) CpG-island No: 6397
  misc_feature (449)..(449): n is either a, c, g or t
  misc_feature (464)..(465): n is either a, c, g or t
aatttggtaggataacggcggagcgtttgtcgagtgcgttattttttatcgtattaacgtttagtcgcgggtgtttttagaggcgttattgaggttagtatgtcgtatcgtatttacggcgggatgcgttttttggatcgttatgaaattaaagatgcgttttcgtatttgcgtttgattgttaatcgtaacgacgacgcggtttttgacgcgtggggaatacgcgtacgcggggtattggtgatcggacgttggacgtggtacgttagatatcgtgcgatcgatagttaatattttggtatgtatgtcgagagttgttagtagagaagttttcgtcggcgagttgtagcgttttgtacgattttggtattaatagacgttttacgtagattattcgatgttcgttggaggaatttcgaacggaaagagtacgtttagcggagtttagnttgtagattaacgannttttaagttgtttgttgatggagttagcgtcgtgagagtgatggtggaagtaatagcggtgttaaagttaattggcgcgtgagtgcggttttttagtttaacgttttttattattttgttttatagggtggtggtcgttttagtagcgttagttaggaaggattcgttattttcgtacggagtgtagtttttttgaatgaagttacggacgtttattttattttgttagttattttt

SEQ ID NO: 6398 - DNA, 702 bp, Artificial Sequence
  chemically treated genomic DNA (Homo sapiens) CpG-island No: 6398
  misc_feature (238)..(239): n is either a, c, g or t
  misc_feature (254)..(254): n is either a, c, g or t
aaaaataactaacaaaataaaataaacgtccgtaacttcattcaaaaaaactacactccgtacgaaaataacgaatccttcctaactaacgctactaaaacgaccaccaccctataaaacaaaataataaaaaacgttaaactaaaaaaccgcactcacgcgccaattaactttaacaccgctattacttccaccatcactctcacgacgctaactccatcaacaaacaacttaaaanntcgttaatctacaanctaaactccgctaaacgtactctttccgttcgaaattcctccaacgaacatcgaataatctacgtaaaacgtctattaataccaaaatcgtacaaaacgctacaactcgccgacgaaaacttctctactaacaactctcgacatacataccaaaatattaactatcgatcgcacgatatctaacgtaccacgtccaacgtccgatcaccaataccccgcgtacgcgtattccccacgcgtcaaaaaccgcgtcgtcgttacgattaacaatcaaacgcaaatacgaaaacgcatctttaatttcataacgatccaaaaaacgcatcccgccgtaaatacgatacgacatactaacctcaataacgcctctaaaaacacccgcgactaaacgttaatacgataaaaaataacgcactcgacaaacgctccgccgttatcctaccaaatt

SEQ ID NO: 6399 - DNA, 702 bp, Artificial Sequence
  chemically treated genomic DNA (Homo sapiens) CpG-island No: 6399
  misc_feature (238)..(239): n is either a, c, g or t
  misc_feature (254)..(254): n is either a, c, g or t
aaaggtgattggtagaatgaagtaaacgttcgtgattttatttagaaaaattatatttcgtacgagggtgacgagttttttttggttggcgttattgaagcgattattattttgtgggataaagtaatggaaggcgttaaattggaaaatcgtatttacgcgttagttgattttgatatcgttgttgtttttattattatttttacgacgttggttttattaataagtagtttgaganntcgttggtttgtagnttgggtttcgttgggcgtgtttttttcgttcggggtttttttagcggatatcggatgatttgcgtaaggcgtttattaatattaaaatcgtgtaaggcgttgtagttcgtcggcgagggtttttttgttaatagttttcgatatgtatgttagagtgttaattgtcgatcgtacgatgtttaacgtattacgtttagcgttcggttattaatatttcgcgtgcgcgtattttttacgcgttaagagtcgcgtcgtcgttgcggttggtaattaggcgtagatacgagagcgtatttttgattttatggcgatttaagaagcgtatttcgtcgtaaatacggtgcggtatattggttttaataacgtttttgggagtattcgcgattgggcgttgatgcggtagagaatggcgtattcggtaagcgtttcgtcgttgttttgttaggtt

SEQ ID NO: 6400 - DNA, 702 bp, Artificial Sequence
  chemically treated genomic DNA (Homo sapiens) CpG-island No: 6400
  misc_feature (449)..(449): n is either a, c, g or t
  misc_feature (464)..(465): n is either a, c, g or t
aacctaacaaaacaacgacgaaacgcttaccgaatacgccattctctaccgcatcaacgcccaatcgcgaatactcccaaaaacgttattaaaaccaatataccgcaccgtatttacgacgaaatacgcttcttaaatcgccataaaatcaaaaatacgctctcgtatctacgcctaattaccaaccgcaacgacgacgcgactcttaacgcgtaaaaaatacgcgcacgcgaaatattaataaccgaacgctaaacgtaatacgttaaacatcgtacgatcgacaattaacactctaacatacatatcgaaaactattaacaaaaaaaccctcgccgacgaactacaacgccttacacgattttaatattaataaacgccttacgcaaatcatccgatatccgctaaaaaaaccccgaacgaaaaaaacacgcccaacgaaacccaanctacaaaccaacganntctcaaactacttattaataaaaccaacgtcgtaaaaataataataaaaacaacaacgatatcaaaatcaactaacgcgtaaatacgattttccaatttaacgccttccattactttatcccacaaaataataatcgcttcaataacgccaaccaaaaaaaactcgtcaccctcgtacgaaatataatttttctaaataaaatcacgaacgtttacttcattctaccaatcaccttt

SEQ ID NO: 6401 - DNA, 851 bp, Artificial Sequence
  chemically treated genomic DNA (Homo sapiens) CpG-island No: 6401
cgcgtgagattagtcggattacgggggagatattatcggggagtcgggaagcgcggggtaattcgtcggggggaattggtcggtcggcggtgtatggtttaacgcgagtacgttagcggtaaaggtagttgtcgggtatggtagataattgttcggtaataggtcgttggttgggcgatatgtcgtttttttacgatgtcgtcgtttggaatcgtttggtaaagtgttatcgggatacgttattcggtgtggcgttgtatgtatggttttaggtcgaataacgataatcgagcgtttggtaatatcgtgcggtagtttattaggcgtattaggttgaggattacgttatcgtattggcggtttggtagaaaattagtttttacgatatgagtaatgaggatttgtttgttgttgttaatatcgtttaggcggtaggaaatggtgcggttcgcgatcgttggttataataggtagaaaaacgtggattgggaagtaatgttttttattggtggttgtatgcgtaacgttatatttttggttagtcggaattcgtattgaacgattttacgcgtttaattaatattgcgttttttgttaacgtttacgttgcgcgggcgataatttatcgttaacgttataatgtttcggtcgcggtgagtgatttgcgcgtcgcgttggaattggaatcgaatatagtaatatttaagtagcgtttggttacgttttgtgggattagggggatatcgtatagtcggcggaaatgttcgaatcggcggtataaaggttttcggacgaatcggttttttatcggataattgtgttacgatatcgattacgaatgaacgtatatt

SEQ ID NO: 6402 - DNA, 851 bp, Artificial Sequence
  chemically treated genomic DNA (Homo sapiens) CpG-island No: 6402
aatatacgttcattcgtaatcgatatcgtaacacaattatccgataaaaaaccgattcgtccgaaaacctttataccgccgattcgaacatttccgccgactatacgatatccccctaatcccacaaaacgtaaccaaacgctacttaaatattactatattcgattccaattccaacgcgacgcgcaaatcactcaccgcgaccgaaacattataacgttaacgataaattatcgcccgcgcaacgtaaacgttaacaaaaaacgcaatattaattaaacgcgtaaaatcgttcaatacgaattccgactaaccaaaaatataacgttacgcatacaaccaccaataaaaaacattacttcccaatccacgtttttctacctattataaccaacgatcgcgaaccgcaccatttcctaccgcctaaacgatattaacaacaacaaacaaatcctcattactcatatcgtaaaaactaattttctaccaaaccgccaatacgataacgtaatcctcaacctaatacgcctaataaactaccgcacgatattaccaaacgctcgattatcgttattcgacctaaaaccatacatacaacgccacaccgaataacgtatcccgataacactttaccaaacgattccaaacgacgacatcgtaaaaaaacgacatatcgcccaaccaacgacctattaccgaacaattatctaccatacccgacaactacctttaccgctaacgtactcgcgttaaaccatacaccgccgaccgaccaattccccccgacgaattaccccgcgcttcccgactccccgataatatctcccccgtaatccgactaatctcacgcg

SEQ ID NO: 6403 - DNA, 851 bp, Artificial Sequence
  chemically treated genomic DNA (Homo sapiens) CpG-island No: 6403
aatatgcgtttattcgtgatcgatgtcgtagtatagttgttcgataaggagtcgattcgttcgaaggtttttatgtcgtcggttcgagtattttcgtcgattgtgcgatatttttttaattttataaggcgtaattaagcgttgtttgggtgttgttatattcggttttagttttagcgcggcgcgtaaattatttatcgcggtcgggatattatgacgttggcgataaattgtcgttcgcgtaacgtaagcgttggtagaaggcgtaatattgattgagcgcgtgagatcgtttagtgcgagtttcggttgattaggaatgtaacgttgcgtatgtagttattagtagagggtattgttttttagtttacgtttttttgtttgttgtagttagcgatcgcgagtcgtattattttttgtcgtttgggcggtattggtagtagtaagtagatttttattgtttatgtcgtgaagattgattttttgttaggtcgttagtgcggtggcgtagtttttaatttgatacgtttgataggttatcgtacgatgttgttaggcgttcggttgtcgttgttcggtttgaagttatgtatataacgttatatcgggtagcgtgtttcgataatattttgttagacggttttaggcggcggtatcgtaggaaggcgatatatcgtttagttagcgatttattgtcgggtaattatttgttatgttcggtagttgtttttgtcgttggcgtgttcgcgttgagttatgtatcgtcggtcggttagtttttttcggcgaattatttcgcgtttttcgatttttcgataatgtttttttcgtaattcggttgattttacgcg

SEQ ID NO: 6404 - DNA, 851 bp, Artificial Sequence
  chemically treated genomic DNA (Homo sapiens) CpG-island No: 6404
cgcgtaaaatcaaccgaattacgaaaaaaacattatcgaaaaatcgaaaaacgcgaaataattcgccgaaaaaaactaaccgaccgacgatacataactcaacgcgaacacgccaacgacaaaaacaactaccgaacataacaaataattacccgacaataaatcgctaactaaacgatatatcgccttcctacgataccgccgcctaaaaccgtctaacaaaatattatcgaaacacgctacccgatataacgttatatacataacttcaaaccgaacaacgacaaccgaacgcctaacaacatcgtacgataacctatcaaacgtatcaaattaaaaactacgccaccgcactaacgacctaacaaaaaatcaatcttcacgacataaacaataaaaatctacttactactaccaataccgcccaaacgacaaaaaataatacgactcgcgatcgctaactacaacaaacaaaaaaacgtaaactaaaaaacaataccctctactaataactacatacgcaacgttacattcctaatcaaccgaaactcgcactaaacgatctcacgcgctcaatcaatattacgccttctaccaacgcttacgttacgcgaacgacaatttatcgccaacgtcataatatcccgaccgcgataaataatttacgcgccgcgctaaaactaaaaccgaatataacaacacccaaacaacgcttaattacgccttataaaattaaaaaaatatcgcacaatcgacgaaaatactcgaaccgacgacataaaaaccttcgaacgaatcgactccttatcgaacaactatactacgacatcgatcacgaataaacgcatatt

SEQ ID NO: 6405 - DNA, 540 bp, Artificial Sequence
  chemically treated genomic DNA (Homo sapiens) CpG-island No: 6405
gcgataggcgttggagtaggtgcgggaataggtttttgattttgtgttttgcgatgtgcgaatggcggagatggacggtatcgttacgttgaaagagattaaagcgttaaattcggtaatttcggtgttgattatgattgcgtattttagcgtcgagacggcggtagaggtattgaaaattggggcgttggattattttattaagtcgttggatttcgataatttataggcgacgttggaaaaagcgttcgcgtatacgtatagtattgatgttgaaatatttgcggtgattgttagttagttcggtatggtcggtaaaagttcggcgatgtaatatttgtttagtgaaatcgttttcgtcgcgttatcggaagttacggtattgatttacggcgatttcggtatcggaaagagttggtcgttagggcgatttacgttagtagcgtacgtagtagaaaatcgttggtaacgtttaattgtgcggtatttaacgaatttttgttggaatttgaattgttcggttacgaaaaaggagcgttt

SEQ ID NO: 6406 - DNA, 540 bp, Artificial Sequence
  chemically treated genomic DNA (Homo sapiens) CpG-island No: 6406
aaacgctcctttttcgtaaccgaacaattcaaattccaacaaaaattcgttaaataccgcacaattaaacgttaccaacgattttctactacgtacgctactaacgtaaatcgccctaacgaccaactctttccgataccgaaatcgccgtaaatcaataccgtaacttccgataacgcgacgaaaacgatttcactaaacaaatattacatcgccgaacttttaccgaccataccgaactaactaacaatcaccgcaaatatttcaacatcaatactatacgtatacgcgaacgctttttccaacgtcgcctataaattatcgaaatccaacgacttaataaaataatccaacgccccaattttcaatacctctaccgccgtctcgacgctaaaatacgcaatcataatcaacaccgaaattaccgaatttaacgctttaatctctttcaacgtaacgataccgtccatctccgccattcgcacatcgcaaaacacaaaatcaaaaacctattcccgcacctactccaacgcctatcgc

SEQ ID NO: 6407 - DNA, 540 bp, Artificial Sequence
  chemically treated genomic DNA (Homo sapiens) CpG-island No: 6407
aaacgtttttttttcgtgatcgaataatttagattttagtaaggattcgttgagtgtcgtatagttgagcgttattagcggttttttgttacgtgcgttattggcgtgaatcgttttggcgattagtttttttcggtgtcggaatcgtcgtggattagtatcgtggttttcgatggcgcgacgagggcgattttattgagtaggtgttgtatcgtcgggtttttatcgattatatcgaattggttggtagttatcgtaggtgttttagtattaatattgtgcgtatgcgcgagcgttttttttagcgtcgtttgtaggttatcgaaatttagcggtttgatgagataatttagcgttttagtttttagtgtttttatcgtcgtttcgacgttggagtacgtagttataattagtatcggaattgtcgggtttaacgttttgattttttttagcgtggcgatgtcgtttattttcgttattcgtatatcgtaaagtataagattaaaaatttgttttcgtatttgttttaacgtttgtcgt

SEQ ID NO: 6408 - DNA, 540 bp, Artificial Sequence
  chemically treated genomic DNA (Homo sapiens) CpG-island No: 6408
acgacaaacgttaaaacaaatacgaaaacaaatttttaatcttatactttacgatatacgaataacgaaaataaacgacatcgccacgctaaaaaaaatcaaaacgttaaacccgacaattccgatactaattataactacgtactccaacgtcgaaacgacgataaaaacactaaaaactaaaacgctaaattatctcatcaaaccgctaaatttcgataacctacaaacgacgctaaaaaaaacgctcgcgcatacgcacaatattaatactaaaacacctacgataactaccaaccaattcgatataatcgataaaaacccgacgatacaacacctactcaataaaatcgccctcgtcgcgccatcgaaaaccacgatactaatccacgacgattccgacaccgaaaaaaactaatcgccaaaacgattcacgccaataacgcacgtaacaaaaaaccgctaataacgctcaactatacgacactcaacgaatccttactaaaatctaaattattcgatcacgaaaaaaaaacgttt

SEQ ID NO: 6409 - DNA, 512 bp, Artificial Sequence
  chemically treated genomic DNA (Homo sapiens) CpG-island No: 6409
  misc_feature (429)..(429): n is either a, c, g or t
  misc_feature (469)..(469): n is either a, c, g or t
attgttatcgttcggttgcgtttttggttttagtagatggaaaaaagtttcgtttatgaggtacgtttttgttgcggttcgataagttcgcgtattaggtttattagtttcgtttacgggtgaatattatttagtacgtcgcgatagttttcgtcggtaaatattaaagtggtaggaaagcgaaagacgttaaagcgatcgtcgatggtttcgttttgtttaaggttagtaatcgttatttgttatgtatagtcgggaaattcgcgtagtaattcgttaattattatcggattatcgttgatttttggcgtgcgtttcgggttattgtttaataatattacgtcgtttggcgtttgcgtaagttagtcgttaagacgggatttattgattggcgttatcgcgcgttagtatcgttgttatacgtattanatgcgtgtcgtgtttatttttttttttttgtgttattcgntattggcgtaagcgacgtttattgtgtattagtacgatataat

SEQ ID NO: 6410 - DNA, 512 bp, Artificial Sequence
  chemically treated genomic DNA (Homo sapiens) CpG-island No: 6410
  misc_feature (44)..(44): n is either a, c, g or t
  misc_feature (84)..(84): n is either a, c, g or t
attatatcgtactaatacacaataaacgtcgcttacgccaatancgaataacacaaaaaaaaaaaaataaacacgacacgcatntaatacgtataacaacgatactaacgcgcgataacgccaatcaataaatcccgtcttaacgactaacttacgcaaacgccaaacgacgtaatattattaaacaataacccgaaacgcacgccaaaaatcaacgataatccgataataattaacgaattactacgcgaatttcccgactatacataacaaataacgattactaaccttaaacaaaacgaaaccatcgacgatcgctttaacgtctttcgctttcctaccactttaatatttaccgacgaaaactatcgcgacgtactaaataatattcacccgtaaacgaaactaataaacctaatacgcgaacttatcgaaccgcaacaaaaacgtacctcataaacgaaacttttttccatctactaaaaccaaaaacgcaaccgaacgataacaat

SEQ ID NO: 6411 - DNA, 512 bp, Artificial Sequence
  chemically treated genomic DNA (Homo sapiens) CpG-island No: 6411
  misc_feature (44)..(44): n is either a, c, g or t
  misc_feature (84)..(84): n is either a, c, g or t
attgtatcgtattagtatataataggcgtcgtttgcgttagtancggatgatataggaggagagggatgagtacgatacgtatntgatgcgtgtggtaacgatgttggcgcgcggtgacgttagttagtgaatttcgttttgacgattggtttacgtaagcgttagacggcgtggtgttattaagtagtgattcgaaacgtacgttagaggttagcgataattcggtaatgattggcgaattattgcgcgagtttttcgattatatatggtaggtggcgattgttgattttgagtagagcgaagttatcggcgatcgttttggcgtttttcgtttttttgttattttagtgtttatcggcggaaattatcgcggcgtgttgaatggtatttattcgtgggcggaattgataaatttgatgcgcgggtttgtcgaatcgtagtaggagcgtgttttatgagcgaaatttttttttatttgttggggttaggaacgtaatcgaacgatgatagt

SEQ ID NO: 6412 - DNA, 512 bp, Artificial Sequence
  chemically treated genomic DNA (Homo sapiens) CpG-island No: 6412
  misc_feature (429)..(429): n is either a, c, g or t
  misc_feature (469)..(469): n is either a, c, g or t
actatcatcgttcgattacgttcctaaccccaacaaataaaaaaaaatttcgctcataaaacacgctcctactacgattcgacaaacccgcgcatcaaatttatcaattccgcccacgaataaataccattcaacacgccgcgataatttccgccgataaacactaaaataacaaaaaaacgaaaaacgccaaaacgatcgccgataacttcgctctactcaaaatcaacaatcgccacctaccatatataatcgaaaaactcgcgcaataattcgccaatcattaccgaattatcgctaacctctaacgtacgtttcgaatcactacttaataacaccacgccgtctaacgcttacgtaaaccaatcgtcaaaacgaaattcactaactaacgtcaccgcgcgccaacatcgttaccacacgcatcanatacgtatcgtactcatccctctcctcctatatcatccgntactaacgcaaacgacgcctattatatactaatacgatacaat

SEQ ID NO: 6413 - DNA, 529 bp, Artificial Sequence
  chemically treated genomic DNA (Homo sapiens) CpG-island No: 6413
  misc_feature (492)..(492): n is either a, c, g or t
  misc_feature (494)..(494): n is either a, c, g or t
  misc_feature (497)..(497): n is either a, c, g or t
  misc_feature (515)..(515): n is either a, c, g or t
gtagttttcgggcgtggtgtttggacgttatttgttgaattttcgtcggagtggtaggcgttataagtcgtacgtcgtatttaggtataaatttattttatcgatttgttttgttgggcgtagagtgaagaagaggacgattcgtttgatacgtaagatgaaagttaggttttattgttgcgtgttattcgtatggataatagcgatattttgtgggattatttgttcgaagataaagttagtaaattgtattattttttgcgttggcgtattattttgtttaattgcggggcgacgttttcggcgatgcgtttaatcgttagcgcgaagtttttatggttcgttggattggatgggcgatgtagtaaaataatggcgacgtgttagttgtttgcggtggttggtacgtttttgtattggtaaagatgtggcgcgaatgtttttagaaaattaataagttagtattgttttcgtttgtagatgtcgttatangntgntattttatattttatagncgaaagcgttttga

SEQ ID NO: 6414 - DNA, 529 bp, Artificial Sequence
  chemically treated genomic DNA (Homo sapiens) CpG-island No: 6414
  misc_feature (15)..(15): n is either a, c, g or t
  misc_feature (33)..(33): n is either a, c, g or t
  misc_feature (36)..(36): n is either a, c, g or t
  misc_feature (38)..(38): n is either a, c, g or t
tcaaaacgctttcgnctataaaatataaaatancancntataacgacatctacaaacgaaaacaatactaacttattaattttctaaaaacattcgcgccacatctttaccaatacaaaaacgtaccaaccaccgcaaacaactaacacgtcgccattattttactacatcgcccatccaatccaacgaaccataaaaacttcgcgctaacgattaaacgcatcgccgaaaacgtcgccccgcaattaaacaaaataatacgccaacgcaaaaaataatacaatttactaactttatcttcgaacaaataatcccacaaaatatcgctattatccatacgaataacacgcaacaataaaacctaactttcatcttacgtatcaaacgaatcgtcctcttcttcactctacgcccaacaaaacaaatcgataaaataaatttatacctaaatacgacgtacgacttataacgcctaccactccgacgaaaattcaacaaataacgtccaaacaccacgcccgaaaactac

SEQ ID NO: 6415 - DNA, 529 bp, Artificial Sequence
  chemically treated genomic DNA (Homo sapiens) CpG-island No: 6415
  misc_feature (15)..(15): n is either a, c, g or t
  misc_feature (33)..(33): n is either a, c, g or t
  misc_feature (36)..(36): n is either a, c, g or t
  misc_feature (38)..(38): n is either a, c, g or t
ttaaggcgttttcgnttgtagggtgtgagatantantntgtagcggtatttgtaagcgagggtaatgttggtttgttaattttttgagggtattcgcgttatatttttgttagtgtaggagcgtgttagttatcgtagataattaatacgtcgttattattttgttgtatcgtttatttaatttagcgggttataaaggtttcgcgttgacgattgagcgtatcgtcgaaggcgtcgtttcgtagttgggtaaaatagtgcgttagcgtagagggtaatgtagtttgttggttttattttcgaataagtgattttatagggtatcgttgttatttatgcgggtggtacgtagtagtaaggtttggtttttattttgcgtattaggcgaatcgtttttttttttattttgcgtttagtaaggtaaatcgatgaagtaagtttgtgtttgaatgcgacgtgcggtttgtagcgtttgttatttcggcgaaaatttagtaaatggcgtttaggtattacgttcgggggttgt

SEQ ID NO: 6416 - DNA, 529 bp, Artificial Sequence
  chemically treated genomic DNA (Homo sapiens) CpG-island No: 6416
  misc_feature (492)..(492): n is either a, c, g or t
  misc_feature (494)..(494): n is either a, c, g or t
  misc_feature (497)..(497): n is either a, c, g or t
  misc_feature (515)..(515): n is either a, c, g or t
acaacccccgaacgtaatacctaaacgccatttactaaattttcgccgaaataacaaacgctacaaaccgcacgtcgcattcaaacacaaacttacttcatcgatttaccttactaaacgcaaaataaaaaaaaaaacgattcgcctaatacgcaaaataaaaaccaaaccttactactacgtaccacccgcataaataacaacgataccctataaaatcacttattcgaaaataaaaccaacaaactacattaccctctacgctaacgcactattttacccaactacgaaacgacgccttcgacgatacgctcaatcgtcaacgcgaaacctttataacccgctaaattaaataaacgatacaacaaaataataacgacgtattaattatctacgataactaacacgctcctacactaacaaaaatataacgcgaataccctcaaaaaattaacaaaccaacattaccctcgcttacaaataccgctacanantantatctcacaccctacaancgaaaacgccttaa

SEQ ID NO: 6417 - DNA, 604 bp, Artificial Sequence
  chemically treated genomic DNA (Homo sapiens) CpG-island No: 6417
ggtgcgcgaagttatttacgtagtgtttttttattacgttattcgtaatggtatggatatggggatcgttaacgtcgggtaattggcgatttacgacgatttattcgttgaattgcgcgacgcggtggaagatgtgatttttaatcgtcgcgacgatggtatcgagcgtttattggagtttgtcgagaaatatcgcggtagtaaaatcgacgatatcgttaacgtttagtaggcggagtggcgttcgtgggaagtgaataaacgtttggaatattcgttggttaaaggtattatcgagtttatcgagtaggatatcgaagaagttcgttagtaggttacgcgttcgattgaagtgattgaaggttcgttgatggacggtatgaatgtggtcggcgatttgtttggcgaagggaaaatgtttttgttataggtggttaaatcggcgcgcgttatgaaataggggtggtttatttcgaatcgtttattgaagttagtaaagagtagggtaaaattaacggtaagatggtgatcgttatcgtgaagggcgacgtttacgatatcggtaaaaatatcgttggtgtggtgttgtaatgtaataattacg

SEQ ID NO: 6418 - DNA, 604 bp, Artificial Sequence
  chemically treated genomic DNA (Homo sapiens) CpG-island No: 6418
cgtaattattacattacaacaccacaccaacgatatttttaccgatatcgtaaacgtcgcccttcacgataacgatcaccatcttaccgttaattttaccctactctttactaacttcaataaacgattcgaaataaaccacccctatttcataacgcgcgccgatttaaccacctataacaaaaacattttcccttcgccaaacaaatcgccgaccacattcataccgtccatcaacgaaccttcaatcacttcaatcgaacgcgtaacctactaacgaacttcttcgatatcctactcgataaactcgataatacctttaaccaacgaatattccaaacgtttattcacttcccacgaacgccactccgcctactaaacgttaacgatatcgtcgattttactaccgcgatatttctcgacaaactccaataaacgctcgataccatcgtcgcgacgattaaaaatcacatcttccaccgcgtcgcgcaattcaacgaataaatcgtcgtaaatcgccaattacccgacgttaacgatccccatatccataccattacgaataacgtaataaaaaaacactacgtaaataacttcgcgcacc

SEQ ID NO: 6419 - DNA, 604 bp, Artificial Sequence
  chemically treated genomic DNA (Homo sapiens) CpG-island No: 6419
cgtagttgttatattgtagtattatattaacgatatttttatcgatgtcgtggacgtcgttttttacggtggcgattattattttgtcgttggttttgttttgttttttgttggttttaataaacggttcgaggtaggttatttttgttttatgacgcgcgtcgatttgattatttgtggtaggaatatttttttttcgttaaataggtcgtcgattatatttatgtcgtttattaacgggtttttaattattttaatcgggcgcgtagtttgttggcgggttttttcggtattttgttcgataaattcggtaatgtttttgattagcgagtattttagacgtttatttattttttacgagcgttatttcgtttgttgggcgttggcggtgtcgtcggttttgttgtcgcgatatttttcggtaagttttagtaaacgttcggtgttatcgtcgcgacgattaagaattatattttttatcgcgtcgcgtagtttagcgggtaggtcgtcgtaaatcgttagttgttcggcgttgacgatttttatatttatgttattgcgaatagcgtagtagaggaatattgcgtgaatggtttcgcgtatt

SEQ ID NO: 6420 - DNA, 604 bp, Artificial Sequence
  chemically treated genomic DNA (Homo sapiens) CpG-island No: 6420
aatacgcgaaaccattcacgcaatattcctctactacgctattcgcaataacataaatataaaaatcgtcaacgccgaacaactaacgatttacgacgacctacccgctaaactacgcgacgcgataaaaaatataattcttaatcgtcgcgacgataacaccgaacgtttactaaaacttaccgaaaaatatcgcgacaacaaaaccgacgacaccgccaacgcccaacaaacgaaataacgctcgtaaaaaataaataaacgtctaaaatactcgctaatcaaaaacattaccgaatttatcgaacaaaataccgaaaaaacccgccaacaaactacgcgcccgattaaaataattaaaaacccgttaataaacgacataaatataatcgacgacctatttaacgaaaaaaaaatattcctaccacaaataatcaaatcgacgcgcgtcataaaacaaaaataacctacctcgaaccgtttattaaaaccaacaaaaaacaaaacaaaaccaacgacaaaataataatcgccaccgtaaaaaacgacgtccacgacatcgataaaaatatcgttaatataatactacaatataacaactacg

SEQ ID NO: 6421 - DNA, 565 bp, Artificial Sequence
  chemically treated genomic DNA (Homo sapiens) CpG-island No: 6421
tcgtgagttataacgttggcgattaatttttggcgaagcggtagaaacgacgttttgtgggttggatgataacgttcggtagatagattacgcgttggagtggttgtatgggcgcgattttgaacggttttagcgtggtgaacgtttcggtggattaggtggtttaaattttattatttttgagtggattaatagtatttatacgttgttttcgtagtaggtgattgagcggttggaaagcgatgtcgtgttgcgttacggtattgaagatgtggtgacgaatttcgacgtgttggaacgtatgtagttttttgaaagtttgttacgcgttgttttgtatattaaatatttgatgaatttcgaagtattggttgtcgttcgtcggatagtgtgttaggttgttgaagaaattatggttcgattggcgaaagaagttcggtaggttttttttggtgttcgcgatcggcggcgtcggttatttattttattggcgcgaaattttgattttaaagtattttgcgcgttaatttgttatattggtattcgtaatacggtaagttgtata

SEQ ID NO: 6422 - DNA, 565 bp, Artificial Sequence
  chemically treated genomic DNA (Homo sapiens) CpG-island No: 6422
tatacaacttaccgtattacgaataccaatataacaaattaacgcgcaaaatactttaaaatcaaaatttcgcgccaataaaataaataaccgacgccgccgatcgcgaacaccaaaaaaaacctaccgaacttctttcgccaatcgaaccataatttcttcaacaacctaacacactatccgacgaacgacaaccaatacttcgaaattcatcaaatatttaatatacaaaacaacgcgtaacaaactttcaaaaaactacatacgttccaacacgtcgaaattcgtcaccacatcttcaataccgtaacgcaacacgacatcgctttccaaccgctcaatcacctactacgaaaacaacgtataaatactattaatccactcaaaaataataaaatttaaaccacctaatccaccgaaacgttcaccacgctaaaaccgttcaaaatcgcgcccatacaaccactccaacgcgtaatctatctaccgaacgttatcatccaacccacaaaacgtcgtttctaccgcttcgccaaaaattaatcgccaacgttataactcacga

SEQ ID NO: 6423 - DNA, 565 bp, Artificial Sequence
  chemically treated genomic DNA (Homo sapiens) CpG-island No: 6423
tatataatttatcgtgttgcgggtgttagtgtagtaggttggcgcgtagagtattttgaaattaaagtttcgcgttagtggaataaatgatcggcgtcgtcgatcgcggatattagaaaaagtttgtcgaatttttttcgttagtcgagttataatttttttaataatttggtatattattcggcgggcggtagttagtatttcggggtttattagatgtttggtgtgtaaaatagcgcgtagtaggtttttagaaggttgtatacgttttagtacgtcgagattcgttattatatttttaatgtcgtagcgtagtacggtatcgttttttagtcgtttaattatttgttgcggaaatagcgtgtgaatattgttgatttatttaggggtggtgagatttgagttatttaatttatcggaacgtttattacgttggagtcgtttaggatcgcgtttatatagttattttagcgcgtggtttatttgtcgggcgttgttatttagtttataaagcgtcgtttttgtcgtttcgttaagaattaatcgttagcgttgtagtttacgg

SEQ ID NO: 6424 - DNA, 565 bp, Artificial Sequence
  chemically treated genomic DNA (Homo sapiens) CpG-island No: 6424
ccgtaaactacaacgctaacgattaattcttaacgaaacgacaaaaacgacgctttataaactaaataacaacgcccgacaaataaaccacgcgctaaaataactatataaacgcgatcctaaacgactccaacgtaataaacgttccgataaattaaataactcaaatctcaccacccctaaataaatcaacaatattcacacgctatttccgcaacaaataattaaacgactaaaaaacgataccgtactacgctacgacattaaaaatataataacgaatctcgacgtactaaaacgtatacaaccttctaaaaacctactacgcgctattttacacaccaaacatctaataaaccccgaaatactaactaccgcccgccgaataatataccaaattattaaaaaaattataactcgactaacgaaaaaaattcgacaaactttttctaatatccgcgatcgacgacgccgatcatttattccactaacgcgaaactttaatttcaaaatactctacgcgccaacctactacactaacacccgcaacacgataaattatata

SEQ ID NO: 6425 - DNA, 540 bp, Artificial Sequence
  chemically treated genomic DNA (Homo sapiens) CpG-island No: 6425
  misc_feature (38)..(38): n is either a, c, g or t
cgcgttggttgtggttaagcgggtggatcgtatatatntcgttattttttcgtataagtgagtatttattaatgaataatttttggatttatataagcgtatggtattgtaattatttattttcgcgttgattggtaggaatttgtcgtattattaagcgagcgtattagattggtgatttttaatatttcgtataattttagtgtaattgtttggtagtaggttgatttcgtcgttttgtggtaggcgatcgtcgggtacgagatttttgttattagcgatgaagtttacgagtatattaattttttataatagggttatgttagtgtgttggcgtattcgtagttgcgtgagcgggtagtggcggtttttttatttggtaagatttattatatgatcggttggaaagtgggttattgtgttgcgttagcgtttattagcgtcgaaattcgtaaggtatattagtatttgattttttcggtgaatatttcggtatagttggcgtttgttgatatgttacgtgtagaatttgagtattat

SEQ ID NO: 6426 - DNA, 540 bp, Artificial Sequence
  chemically treated genomic DNA (Homo sapiens) CpG-island No: 6426
  misc_feature (503)..(503): n is either a, c, g or t
ataatactcaaattctacacgtaacatatcaacaaacgccaactataccgaaatattcaccgaaaaaatcaaatactaatataccttacgaatttcgacgctaataaacgctaacgcaacacaataacccactttccaaccgatcatataataaatcttaccaaataaaaaaaccgccactacccgctcacgcaactacgaatacgccaacacactaacataaccctattataaaaaattaatatactcgtaaacttcatcgctaataacaaaaatctcgtacccgacgatcgcctaccacaaaacgacgaaatcaacctactaccaaacaattacactaaaattatacgaaatattaaaaatcaccaatctaatacgctcgcttaataatacgacaaattcctaccaatcaacgcgaaaataaataattacaataccatacgcttatataaatccaaaaattattcattaataaatactcacttatacgaaaaaataacganatatatacgatccacccgcttaaccacaaccaacgcg

SEQ ID NO: 6427 - DNA, 540 bp, Artificial Sequence
  chemically treated genomic DNA (Homo sapiens) CpG-island No: 6427
  misc_feature (503)..(503): n is either a, c, g or t
ataatgtttaggttttgtacgtagtatattagtaagcgttagttgtgtcggggtatttatcgaaaaggttagatattgatgtattttgcgaatttcggcgttgatgggcgttggcgtaatataataatttattttttagtcggttatatgataggttttgttaaatgaagaaatcgttattgttcgtttacgtagttgcggatgcgttagtatattggtatggttttgttgtgaaaagttgatgtgttcgtagattttatcgttaatgataaaaatttcgtgttcggcgatcgtttgttataaagcggcgaaattagtttgttgttagatagttgtattggggttatgcggagtgttgaggattattagtttggtgcgttcgtttaataatgcggtaaatttttgttagttaacgcgaaaatgggtggttgtagtgttatacgtttgtgtgagtttaggggttgtttattggtgggtgtttatttatgcgaaagggtggcgangtatatgcgatttattcgtttggttatagttaacgcg

SEQ ID NO: 6428 - DNA, 540 bp, Artificial Sequence
  chemically treated genomic DNA (Homo sapiens) CpG-island No: 6428
  misc_feature (38)..(38): n is either a, c, g or t
cgcgttaactataaccaaacgaataaatcgcatatacntcgccaccctttcgcataaataaacacccaccaataaacaacccctaaactcacacaaacgtataacactacaaccacccattttcgcgttaactaacaaaaatttaccgcattattaaacgaacgcaccaaactaataatcctcaacactccgcataaccccaatacaactatctaacaacaaactaatttcgccgctttataacaaacgatcgccgaacacgaaatttttatcattaacgataaaatctacgaacacatcaacttttcacaacaaaaccataccaatatactaacgcatccgcaactacgtaaacgaacaataacgatttcttcatttaacaaaacctatcatataaccgactaaaaaataaattattatattacgccaacgcccatcaacgccgaaattcgcaaaatacatcaatatctaaccttttcgataaataccccgacacaactaacgcttactaatatactacgtacaaaacctaaacattat

SEQ ID NO: 6429 - DNA, 547 bp, Artificial Sequence
  chemically treated genomic DNA (Homo sapiens) CpG-island No: 6429
  misc_feature (9)..(9): n is either a, c, g or t
  misc_feature (38)..(38): n is either a, c, g or t
  misc_feature (131)..(131): n is either a, c, g or t
  misc_feature (174)..(174): n is either a, c, g or t
  misc_feature (180)..(181): n is either a, c, g or t
agcgggcgnttgggtacggatggcgagtggatgtttgngattgttggtggttatagcgataattagggcgatagtcgttcgaatatgatcggtattcgcgtcgataattagaaattacgttatgtcgttgngttgatattaagttggttttagtacggtaattagaagtaaggngtttgnnttgatattcgtaaggcgggtattacgttttgtgttttaagaatggtgcgatcgatttcgtagttattggttttatttcgttgtgtgttacgcggtttattattgttggtggtgttcgtttgttgttggcggttattttgatttgtcggaggcgtgttgattggcgcgttattcgtaggtgtcggttgattcgataacgttttcggtacgtcgttcggataatcggaatcgttttgttcgtttttattaagttggcgtgaacgaagcgtcgtatgagatttattatcgttagggcgatattgttttttcgtttgttttttattggcgaagtttagttgcgtcgtaatttgggcgtgaatattatcgt

SEQ ID NO: 6430 - DNA, 547 bp, Artificial Sequence
  chemically treated genomic DNA (Homo sapiens) CpG-island No: 6430
  misc_feature (367)..(368): n is either a, c, g or t
  misc_feature (374)..(374): n is either a, c, g or t
  misc_feature (417)..(417): n is either a, c, g or t
  misc_feature (510)..(510): n is either a, c, g or t
  misc_feature (539)..(539): n is either a, c, g or t
acgataatattcacgcccaaattacgacgcaactaaacttcgccaataaaaaacaaacgaaaaaacaatatcgccctaacgataataaatctcatacgacgcttcgttcacgccaacttaataaaaacgaacaaaacgattccgattatccgaacgacgtaccgaaaacgttatcgaatcaaccgacacctacgaataacgcgccaatcaacacgcctccgacaaatcaaaataaccgccaacaacaaacgaacaccaccaacaataataaaccgcgtaacacacaacgaaataaaaccaataactacgaaatcgatcgcaccattcttaaaacacaaaacgtaatacccgccttacgaatatcaanncaaacnccttacttctaattaccgtactaaaaccaacttaatatcaacncaacgacataacgtaatttctaattatcgacgcgaataccgatcatattcgaacgactatcgccctaattatcgctataaccaccaacaatcncaaacatccactcgccatccgtacccaancgcccgct

SEQ ID NO: 6431 - DNA, 547 bp, Artificial Sequence
  chemically treated genomic DNA (Homo sapiens) CpG-island No: 6431
  misc_feature (367)..(368): n is either a, c, g or t
  misc_feature (374)..(374): n is either a, c, g or t
  misc_feature (417)..(417): n is either a, c, g or t
  misc_feature (510)..(510): n is either a, c, g or t
  misc_feature (539)..(539): n is either a, c, g or t
acggtaatatttacgtttaggttacggcgtagttggatttcgttagtaaagaataaacggaagaatagtatcgttttaacggtgatgaattttatgcggcgtttcgtttacgttagtttaatgagagcgagtaaagcggtttcggttattcgggcggcgtatcgggggcgttgtcgaattaatcggtatttgcgaataacgcgttaattagtacgttttcggtaaattaaaataatcgttagtagtaggcgagtattattagtaatagtgggtcgcgtagtatatagcggaatgaaattagtaattacgaagtcgatcgtattatttttagagtatagggcgtgatattcgttttgcgagtattagnntaggtnttttgtttttgattatcgtgttgaaattagtttgatgttagtntaacggtataacgtggtttttggttatcggcgcgagtgtcggttatattcgagcggttgtcgttttggttatcgttgtagttattaataattntaagtatttattcgttattcgtgtttagncgttcgtt

SEQ ID NO: 6432 - DNA, 547 bp, Artificial Sequence
  chemically treated genomic DNA (Homo sapiens) CpG-island No: 6432
  misc_feature (9)..(9): n is either a, c, g or t
  misc_feature (38)..(38): n is either a, c, g or t
  misc_feature (131)..(131): n is either a, c, g or t
  misc_feature (174)..(174): n is either a, c, g or t
  misc_feature (180)..(181): n is either a, c, g or t
aacgaacgnctaaacacgaataacgaataaatacttanaattattaataactacaacgataaccaaaacgacaaccgctcgaatataaccgacactcgcgccgataaccaaaaaccacgttataccgttanactaacatcaaactaatttcaacacgataatcaaaaacaaaanacctannctaatactcgcaaaacgaatatcacgccctatactctaaaaataatacgatcgacttcgtaattactaatttcattccgctatatactacgcgacccactattactaataatactcgcctactactaacgattattttaatttaccgaaaacgtactaattaacgcgttattcgcaaataccgattaattcgacaacgcccccgatacgccgcccgaataaccgaaaccgctttactcgctctcattaaactaacgtaaacgaaacgccgcataaaattcatcaccgttaaaacgatactattcttccgtttattctttactaacgaaatccaactacgccgtaacctaaacgtaaatattaccgt

SEQ ID NO: 6433 - DNA, 703 bp, Artificial Sequence
  chemically treated genomic DNA (Homo sapiens) CpG-island No: 6433
  misc_feature (602)..(602): n is either a, c, g or t
tatcgattcggtatttattgtaggtttgataagatgcgttaagtatcgtattaggtattgtgtattaattgtcggatgcggtatcggttgtaggtttgataagacgcgttaagcgtcgtattaggtataaatgtttaatgtttacgattatagcgaaatataggttttcgtttcgttcgttagcgtttttttaattcgcgataacgttttaatttacgcgggtttattacggtttttgatataattatttatcgtcgttatattcggttttatcgaattatcggttttggtaaatggcgttaatttattcggtgtggtatggcgaatggtacgttgttgcggcgttttttagtttttatatatcgtattagtatcggtgaggattattagtttatttgtattaatttgttcggcgagtaacgtagcggcgagatttttattaattattgttttattttttgttcggttatcggtatagtatattcgcgtcgtattgaaattatatatgttttttttgagtaaaattcgatggttcgtttcgagaatttacgcggtgcgagatttattatcgcgtaattttatattcgtttatttgtagcgtngtcgtttcgaggttttgttttttgttgattatcgtttataatttttgttgttaaggatggatttgcgttttaagtttttcgaaaggtgttatttcgtcgta

SEQ ID NO: 6434 - DNA, 703 bp, Artificial Sequence
  chemically treated genomic DNA (Homo sapiens) CpG-island No: 6434
  misc_feature (102)..(102): n is either a, c, g or t
tacgacgaaataacacctttcgaaaaacttaaaacgcaaatccatccttaacaacaaaaattataaacgataatcaacaaaaaacaaaacctcgaaacgacnacgctacaaataaacgaatataaaattacgcgataataaatctcgcaccgcgtaaattctcgaaacgaaccatcgaattttactcaaaaaaaacatatataatttcaatacgacgcgaatatactataccgataaccgaacaaaaaataaaacaataattaataaaaatctcgccgctacgttactcgccgaacaaattaatacaaataaactaataatcctcaccgatactaatacgatatataaaaactaaaaaacgccgcaacaacgtaccattcgccataccacaccgaataaattaacgccatttaccaaaaccgataattcgataaaaccgaatataacgacgataaataattatatcaaaaaccgtaataaacccgcgtaaattaaaacgttatcgcgaattaaaaaaacgctaacgaacgaaacgaaaacctatatttcgctataatcgtaaacattaaacatttatacctaatacgacgcttaacgcgtcttatcaaacctacaaccgataccgcatccgacaattaatacacaatacctaatacgatacttaacgcatcttatcaaacctacaataaataccgaatcgata

SEQ ID NO: 6435 - DNA, 703 bp, Artificial Sequence
  chemically treated genomic DNA (Homo sapiens) CpG-island No: 6435
  misc_feature (102)..(102): n is either a, c, g or t
tacgacggaatgatatttttcgggaaatttagagcgtaggtttatttttagtagtaagaattatgggcggtaattagtagaagatagagtttcgaagcggtnacgttgtagataaacggatgtaaaattgcgcggtggtgggtttcgtatcgcgtaaattttcgaagcgagttatcgagttttgtttaagaggggtatgtgtgattttagtgcggcgcgggtgtgttgtgtcgatggtcgagtagggagtgaagtagtgattgataaagatttcgtcgttgcgttgttcgtcgagtagattaatgtagatggattggtgatttttatcgatgttgatgcggtatatgaaaattggggaacgtcgtagtaacgtgttattcgttatgttatatcggatgagttagcgttatttgttaaagtcgatggttcgatggggtcgaatgtaacggcggtgagtggttatgttagaagtcgtggtaaattcgcgtggattggggcgttatcgcgaattgaagagacgttggcgggcgaagcggggatttgtatttcgttgtagtcgtaggtattagatatttgtgtttgatgcgacgtttgacgcgttttattaggtttataatcggtgtcgtattcggtaattggtgtataatgtttgatgcgatgtttgacgtattttattaggtttataatgggtatcggatcggta

SEQ ID NO: 6436 - DNA, 703 bp, Artificial Sequence
  chemically treated genomic DNA (Homo sapiens) CpG-island No: 6436
  misc_feature (602)..(602): n is either a, c, g or t
taccgatccgatacccattataaacctaataaaatacgtcaaacatcgcatcaaacattatacaccaattaccgaatacgacaccgattataaacctaataaaacgcgtcaaacgtcgcatcaaacacaaatatctaatacctacgactacaacgaaatacaaatccccgcttcgcccgccaacgtctcttcaattcgcgataacgccccaatccacgcgaatttaccacgacttctaacataaccactcaccgccgttacattcgaccccatcgaaccatcgactttaacaaataacgctaactcatccgatataacataacgaataacacgttactacgacgttccccaattttcatataccgcatcaacatcgataaaaatcaccaatccatctacattaatctactcgacgaacaacgcaacgacgaaatctttatcaatcactacttcactccctactcgaccatcgacacaacacacccgcgccgcactaaaatcacacatacccctcttaaacaaaactcgataactcgcttcgaaaatttacgcgatacgaaacccaccaccgcgcaattttacatccgtttatctacaacgtnaccgcttcgaaactctatcttctactaattaccgcccataattcttactactaaaaataaacctacgctctaaatttcccgaaaaatatcattccgtcgta

SEQ ID NO: 6437 - DNA, 590 bp, Artificial Sequence
  chemically treated genomic DNA (Homo sapiens) CpG-island No: 6437
gagattagggtttacgaagtgtggttggatgttggggtataaattcgtttacgataaaattttgtttcgtattattcgcggttatgattttgtttgttattagcgtataatttagttggtacgttagcgcgggttgaaggtgtgtttttatttaattgtcggtttgtttggcgaagggtaggttgaatgtttgtaaacgttggagcgagtggttgaaatcggcgtggacggtataaagttgtattcgttgtatattgtgaaaggtagtattatggcgaaagtttgggaagcggggcgtttgaacggtattgaattggaggattatacgtttattgtcggagaaatgattcgttatacgttatcggaagtgatttattatcgtattttcgttagcgttcgtcgttcgacgttgtttgtttcgttgtggtgcgaaaatcgatggacgggaatggtcgagttggatcgttatttgaatgaatatggcgtatagggatcggcgttgggacgttcgtggttatttttaacggagtaggtcgttgaggggaatttcgtattttttatataatttataacgtaattgttagaattgg

SEQ ID NO: 6438 - DNA, 590 bp, Artificial Sequence
  chemically treated genomic DNA (Homo sapiens) CpG-island No: 6438
ccaattctaacaattacgttataaattatataaaaaatacgaaattcccctcaacgacctactccgttaaaaataaccacgaacgtcccaacgccgatccctatacgccatattcattcaaataacgatccaactcgaccattcccgtccatcgattttcgcaccacaacgaaacaaacaacgtcgaacgacgaacgctaacgaaaatacgataataaatcacttccgataacgtataacgaatcatttctccgacaataaacgtataatcctccaattcaataccgttcaaacgccccgcttcccaaactttcgccataatactacctttcacaatatacaacgaatacaactttataccgtccacgccgatttcaaccactcgctccaacgtttacaaacattcaacctacccttcgccaaacaaaccgacaattaaataaaaacacaccttcaacccgcgctaacgtaccaactaaattatacgctaataacaaacaaaatcataaccgcgaataatacgaaacaaaattttatcgtaaacgaatttataccccaacatccaaccacacttcgtaaaccctaatctc

SEQ ID NO: 6439 - DNA, 590 bp, Artificial Sequence
  chemically treated genomic DNA (Homo sapiens) CpG-island No: 6439
ttaattttgatagttacgttataaattgtgtgagaaatgcggaattttttttaacgatttatttcgttggaggtagttacggacgttttagcgtcgatttttgtacgttatgtttatttagatagcgatttagttcgattattttcgtttatcgattttcgtattatagcggagtaagtagcgtcgggcgacgggcgttggcggaaatgcggtggtagattattttcggtggcgtatggcgaattattttttcggtagtgagcgtgtaattttttagtttaatatcgtttaaacgtttcgttttttaggttttcgttataatgttgttttttataatatgtagcggatgtagttttatgtcgtttacgtcggttttaattattcgttttagcgtttgtaaatatttagtttgtttttcgttaggtaggtcgataattaagtgggaatatatttttagttcgcgttgacgtgttagttgggttgtacgttgataataagtaaaattatggtcgcgggtgatgcgaagtaaggttttgtcgtgggcgggtttgtattttagtatttagttatatttcgtaaattttggtttt

SEQ ID NO: 6440 - DNA, 590 bp, Artificial Sequence
  chemically treated genomic DNA (Homo sapiens) CpG-island No: 6440
aaaaccaaaatttacgaaatataactaaatactaaaatacaaacccgcccacgacaaaaccttacttcgcatcacccgcgaccataattttacttattatcaacgtacaacccaactaacacgtcaacgcgaactaaaaatatattcccacttaattatcgacctacctaacgaaaaacaaactaaatatttacaaacgctaaaacgaataattaaaaccgacgtaaacgacataaaactacatccgctacatattataaaaaacaacattataacgaaaacctaaaaaacgaaacgtttaaacgatattaaactaaaaaattacacgctcactaccgaaaaaataattcgccatacgccaccgaaaataatctaccaccgcatttccgccaacgcccgtcgcccgacgctacttactccgctataatacgaaaatcgataaacgaaaataatcgaactaaatcgctatctaaataaacataacgtacaaaaatcgacgctaaaacgtccgtaactacctccaacgaaataaatcgttaaaaaaaattccgcatttctcacacaatttataacgtaactatcaaaattaa

SEQ ID NO: 6441 - DNA, 745 bp, Artificial Sequence
  chemically treated genomic DNA (Homo sapiens) CpG-island No: 6441
gacgtcgtagtagggggaaatttattacgagaatcgttcgttgtatgtaatgagcgaggtcgatcgtcgtcgtttgttgcgtatcgaatggggcgtggtgtattagtatttattcgacggtttgcgtcgttaggtgtcggtaggcggtaatatcggcgagcggttgatggcgatcggggtacgttattacggcgatattcgtgttatcgcgtagaagtggttggaagaggtggagattttcgttaatcggatcgacgatttgtcgattatttttttcggcggtatgtagtagcgtttgtagattgttcgtaatttggtgacgtattcgaagttggtgtttatggatgaatcgatcggcgggttggatgtgtcggtgtaggttcgtttgttcgatttgttgcgcggtttggtggtggagttgaattcgcggtggtgattgttatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagttcgtgtcggatgcggcgtaaacgttttattcggtttatatatgcgttttcgtaggtcggataagacgcgttagcgtcgtattcgatattcgattaacgagcgaataatgataacgtataaaacgtagtaaattttttttgtatagtaaa

SEQ ID NO: 6442 - DNA, 745 bp, Artificial Sequence
  chemically treated genomic DNA (Homo sapiens) CpG-island No: 6442
tttactatacaaaaaaaatttactacgttttatacgttatcattattcgctcgttaatcgaatatcgaatacgacgctaacgcgtcttatccgacctacgaaaacgcatatataaaccgaataaaacgtttacgccgcatccgacacgaactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaataacaatcaccaccgcgaattcaactccaccaccaaaccgcgcaacaaatcgaacaaacgaacctacaccgacacatccaacccgccgatcgattcatccataaacaccaacttcgaatacgtcaccaaattacgaacaatctacaaacgctactacataccgccgaaaaaaataatcgacaaatcgtcgatccgattaacgaaaatctccacctcttccaaccacttctacgcgataacacgaatatcgccgtaataacgtaccccgatcgccatcaaccgctcgccgatattaccgcctaccgacacctaacgacgcaaaccgtcgaataaatactaatacaccacgccccattcgatacgcaacaaacgacgacgatcgacctcgctcattacatacaacgaacgattctcgtaataaatttccccctactacgacgtc

SEQ ID NO: 6443 - DNA, 745 bp, Artificial Sequence
  chemically treated genomic DNA (Homo sapiens) CpG-island No: 6443
tttgttgtgtagagaaagtttattgcgttttgtacgttattattattcgttcgttggtcgggtgtcgaatgcgacgttggcgcgttttattcgatttacggggacgtatgtgtaggtcggataaggcgtttacgtcgtattcggtacgggtttaattttgtaaaatcgatgatattagtagttgtgtatacgaatgatgcgggtcgtcgagtacgcggtcggttaatttattttttattatttgtttttgttttattattagtaaacggttcgttagtaggcgggcgacgtttaaattatgggtgataattattatcgcgggtttagttttattattaggtcgcgtagtaggtcgagtaggcgggtttgtatcgatatatttagttcgtcggtcggtttatttataaatattagtttcggatgcgttattaggttgcgggtaatttgtaaacgttgttgtatatcgtcggaaaaggtggtcggtaggtcgtcgattcggttggcgggaatttttattttttttagttatttttgcgcggtggtacgaatatcgtcgtaatgacgtgtttcggtcgttattagtcgttcgtcgatattgtcgtttgtcgatatttggcggcgtaggtcgtcgagtggatgttgatgtattacgttttattcggtacgtagtaggcgacggcggtcggtttcgtttattgtatatagcgaacggttttcgtagtgaatttttttttgttgcggcgtt

SEQ ID NO: 6444 - DNA, 745 bp, Artificial Sequence
  chemically treated genomic DNA (Homo sapiens) CpG-island No: 6444
aacgccgcaacaaaaaaaaattcactacgaaaaccgttcgctatatacaataaacgaaaccgaccgccgtcgcctactacgtaccgaataaaacgtaatacatcaacatccactcgacgacctacgccgccaaatatcgacaaacgacaatatcgacgaacgactaataacgaccgaaacacgtcattacgacgatattcgtaccaccgcgcaaaaataactaaaaaaaataaaaattcccgccaaccgaatcgacgacctaccgaccaccttttccgacgatatacaacaacgtttacaaattacccgcaacctaataacgcatccgaaactaatatttataaataaaccgaccgacgaactaaatatatcgatacaaacccgcctactcgacctactacgcgacctaataataaaactaaacccgcgataataattatcacccataatttaaacgtcgcccgcctactaacgaaccgtttactaataataaaacaaaaacaaataataaaaaataaattaaccgaccgcgtactcgacgacccgcatcattcgtatacacaactactaatatcatcgattttacaaaattaaacccgtaccgaatacgacgtaaacgccttatccgacctacacatacgtccccgtaaatcgaataaaacgcgccaacgtcgcattcgacacccgaccaacgaacgaataataataacgtacaaaacgcaataaactttctctacacaacaaa

SEQ ID NO: 6445 - DNA, 526 bp, Artificial Sequence
  chemically treated genomic DNA (Homo sapiens) CpG-island No: 6445
gttgatcgcgcgggattatattttattatattttacgtgatgatcgttttgtgttttatagtggtatttttcgaatgtagaatcgatggatagtgttttaatacgtcgttgcgaatatagcgatacgttttttttatcggtatttcgttggtggtgcggtagattttttttagcgtcgtaatcgttagcggggcgttgttaattagttgttgagttagttcgcgggcgttatttattagtttcgtttggttaattacgcggttgattattttttaacgtagcgttttttttgcgtttattcgtttgtcggttattattattttattgacgatggtaggcggtaggattttcggtagacgtagtatatcgtcgttgttaggaacgatgtttagtttggttttcggtagggcgaagttggcgttatcggtataaataataaaatttgtcgttagcgttagtttaaagtcgtcgttaaaggtatagtcgtttatagttgcgataatcggtttgtcgagattgaaaattt

SEQ ID NO: 6446 - DNA, 526 bp, Artificial Sequence
  chemically treated genomic DNA (Homo sapiens) CpG-island No: 6446
aaattttcaatctcgacaaaccgattatcgcaactataaacgactatacctttaacgacgactttaaactaacgctaacgacaaattttattatttataccgataacgccaacttcgccctaccgaaaaccaaactaaacatcgttcctaacaacgacgatatactacgtctaccgaaaatcctaccgcctaccatcgtcaataaaataataataaccgacaaacgaataaacgcaaaaaaaacgctacgttaaaaaataatcaaccgcgtaattaaccaaacgaaactaataaataacgcccgcgaactaactcaacaactaattaacaacgccccgctaacgattacgacgctaaaaaaaatctaccgcaccaccaacgaaataccgataaaaaaaacgtatcgctatattcgcaacgacgtattaaaacactatccatcgattctacattcgaaaaataccactataaaacacaaaacgatcatcacgtaaaatataataaaatataatcccgcgcgatcaac

SEQ ID NO: 6447 - DNA, 526 bp, Artificial Sequence
  chemically treated genomic DNA (Homo sapiens) CpG-island No: 6447
aaatttttaatttcgataaatcggttatcgtagttgtgaacggttatgtttttggcggcggttttgaattggcgttggcggtagattttattgtttgtgtcgataacgttagtttcgttttgtcggaagttaaattgggtatcgtttttgatagcggcggtgtgttgcgtttgtcgaagattttgtcgtttgttatcgttaatgaaatggtgatgatcggtagacgaatgggcgtagaagaggcgttgcgttgggggatagttaatcgcgtggttagttaggcggaattgatggataacgttcgcgaattggtttagtagttggttaatagcgtttcgttggcgattgcggcgttgaaagagatttatcgtattattagcgaaatgtcggtagaagaagcgtatcgttatattcgtagcggcgtgttgaaatattatttatcggttttgtattcggaagatgttattgtagagtatagggcgattattacgtgaggtgtgataggatgtaatttcgcgcggttaat

SEQ ID NO: 6448 - DNA, 526 bp, Artificial Sequence
  chemically treated genomic DNA (Homo sapiens) CpG-island No: 6448
attaaccgcgcgaaattacatcctatcacacctcacgtaataatcgccctatactctacaataacatcttccgaatacaaaaccgataaataatatttcaacacgccgctacgaatataacgatacgcttcttctaccgacatttcgctaataatacgataaatctctttcaacgccgcaatcgccaacgaaacgctattaaccaactactaaaccaattcgcgaacgttatccatcaattccgcctaactaaccacgcgattaactatcccccaacgcaacgcctcttctacgcccattcgtctaccgatcatcaccatttcattaacgataacaaacgacaaaatcttcgacaaacgcaacacaccgccgctatcaaaaacgatacccaatttaacttccgacaaaacgaaactaacgttatcgacacaaacaataaaatctaccgccaacgccaattcaaaaccgccgccaaaaacataaccgttcacaactacgataaccgatttatcgaaattaaaaattt

SEQ ID NO: 6449 - DNA, 738 bp, Artificial Sequence
  chemically treated genomic DNA (Homo sapiens) CpG-island No: 6449
gggcgtttaatcgcgttgattaaatgttagaatattatagtcgggacgaatattacgttgtattttaagcgtgaagatttgttgtacggcggcgcgtataaaattaattaggtgttggggtaggcgttgttggcgaagcggatgggtaaaatcgaaattatcgtcgaaatcggtgtcggttagtatggcgtggcgtcggtttttgttagcgttttgttcggtttgaaatgtcgtatttatatgggtgttaaagacgttgaacgttagtcgtttaacgtttttcgtatgcgtttaatgggtgcggaagtgatttcggtgtatagcggtttcgcgacgttgaaagatgtttgtaacgaggcgttgcgcgattggttcggtagttacgaaatcgcgtattatatgttgggtatcgtagttggttcgtatttttattcgattattgtgcgtgagttttagcggatgattggcgaagaaattaaagcgtagattttggaaagagaaggtcgtttgtcggatgtcggtatcgtttgtgttggcggcggttcgaatgttatcggtatgtttgttgattttattaatgaaattaacggtcggtttgattggagttggagttaggtggtcgcggtattgaaattggcgagtacggcgcgtcgttaaaatatggtcgcgtgggtatgtatttcggtatgaaagcgtagatgatgtaaatcgaagacgggtagattgaagaattttatt

SEQ ID NO: 6450 - DNA, 738 bp, Artificial Sequence
  chemically treated genomic DNA (Homo sapiens) CpG-island No: 6450
aataaaattcttcaatctacccgtcttcgatttacatcatctacgctttcataccgaaatacatacccacgcgaccatattttaacgacgcgccgtactcgccaatttcaataccgcgaccacctaactccaactccaatcaaaccgaccgttaatttcattaataaaatcaacaaacataccgataacattcgaaccgccgccaacacaaacgataccgacatccgacaaacgaccttctctttccaaaatctacgctttaatttcttcgccaatcatccgctaaaactcacgcacaataatcgaataaaaatacgaaccaactacgatacccaacatataatacgcgatttcgtaactaccgaaccaatcgcgcaacgcctcgttacaaacatctttcaacgtcgcgaaaccgctatacaccgaaatcacttccgcacccattaaacgcatacgaaaaacgttaaacgactaacgttcaacgtctttaacacccatataaatacgacatttcaaaccgaacaaaacgctaacaaaaaccgacgccacgccatactaaccgacaccgatttcgacgataatttcgattttacccatccgcttcgccaacaacgcctaccccaacacctaattaattttatacgcgccgccgtacaacaaatcttcacgcttaaaatacaacgtaatattcgtcccgactataatattctaacatttaatcaacgcgattaaacgccc

SEQ ID NO: 6451 - DNA, 738 bp, Artificial Sequence
  chemically treated genomic DNA (Homo sapiens) CpG-island No: 6451
agtaagattttttaatttgttcgttttcggtttgtattatttgcgtttttatatcgaaatatatatttacgcgattatgttttagcggcgcgtcgtgttcgttagttttaatatcgcgattatttggttttaattttaattaggtcgatcgttggttttattgatgaaattagtaaatatgtcgatggtattcgaatcgtcgttaatataggcgatatcggtattcggtaggcgattttttttttttagaatttgcgttttggttttttcgttaattattcgttgaaatttacgtataatggtcggataaggatgcgggttagttgcggtgtttagtatatagtgcgcggtttcgtaattatcggattagtcgcgtagcgtttcgttataggtattttttagcgtcgcggaatcgttatgtatcgggattattttcgtatttattaagcgtatacgaaaaacgttaggcgattggcgtttaacgtttttggtatttatataaatacggtattttaggtcgagtagggcgttggtaagggtcgacgttacgttatgttgatcggtatcggtttcggcgatgatttcggttttatttattcgtttcgttagtaacgtttgttttagtatttggttagttttatgcgcgtcgtcgtgtagtaaatttttacgtttgagatatagcgtggtgttcgtttcggttgtaatgttttggtatttggttagcgcggttggacgttt

SEQ ID NO: 6452 - DNA, 738 bp, Artificial Sequence
  chemically treated genomic DNA (Homo sapiens) CpG-island No: 6452
aaacgtccaaccgcgctaaccaaataccaaaacattacaaccgaaacgaacaccacgctatatctcaaacgtaaaaatttactacacgacgacgcgcataaaactaaccaaatactaaaacaaacgttactaacgaaacgaataaataaaaccgaaatcatcgccgaaaccgataccgatcaacataacgtaacgtcgacccttaccaacgccctactcgacctaaaataccgtatttatataaataccaaaaacgttaaacgccaatcgcctaacgtttttcgtatacgcttaataaatacgaaaataatcccgatacataacgattccgcgacgctaaaaaatacctataacgaaacgctacgcgactaatccgataattacgaaaccgcgcactatatactaaacaccgcaactaacccgcatccttatccgaccattatacgtaaatttcaacgaataattaacgaaaaaaccaaaacgcaaattctaaaaaaaaaaaatcgcctaccgaataccgatatcgcctatattaacgacgattcgaataccatcgacatatttactaatttcatcaataaaaccaacgatcgacctaattaaaattaaaaccaaataatcgcgatattaaaactaacgaacacgacgcgccgctaaaacataatcgcgtaaatatatatttcgatataaaaacgcaaataatacaaaccgaaaacgaacaaattaaaaaatcttact

SEQ ID NO: 6453 - DNA, 515 bp, Artificial Sequence
  chemically treated genomic DNA (Homo sapiens) CpG-island No: 6453
gcggtgaagtaatattaaaacgcggaagatacgcgtggtcgtttggtgatgttttgtatgatatcggttttcgatggtatttttatttttattgacgacgaagaagcgaaatagtttcgtgaaagcgtggtcgagtggttgatgattaattattcgtacgattgttcggtatgtgaagagggcggtaattgttatttttaggatatgattgtgatgatcggatatagttttcgtcgttatcgttttattaaacgtatttatcgtaattaggatttggggttatttattttttacgaaatgaatcgttgtatcgtttgttatcgttgtgtgcgttattataaagattacgttgacggtatagatttgggcgtttacggtgcgtacgataacgtttatttcggtcgttcggaagacggtacgttggaaagcgaatttttcggtaatttggtcgaaatttgttcgatcggcgtatttatcgataaaacgtatttcgagcgttataatcgtaaatggga

SEQ ID NO: 6454 - DNA, 515 bp, Artificial Sequence
  chemically treated genomic DNA (Homo sapiens) CpG-island No: 6454
tcccatttacgattataacgctcgaaatacgttttatcgataaatacgccgatcgaacaaatttcgaccaaattaccgaaaaattcgctttccaacgtaccgtcttccgaacgaccgaaataaacgttatcgtacgcaccgtaaacgcccaaatctataccgtcaacgtaatctttataataacgcacacaacgataacaaacgatacaacgattcatttcgtaaaaaataaataaccccaaatcctaattacgataaatacgtttaataaaacgataacgacgaaaactatatccgatcatcacaatcatatcctaaaaataacaattaccgccctcttcacataccgaacaatcgtacgaataattaatcatcaaccactcgaccacgctttcacgaaactatttcgcttcttcgtcgtcaataaaaataaaaataccatcgaaaaccgatatcatacaaaacatcaccaaacgaccacgcgtatcttccgcgttttaatattacttcaccgc

SEQ ID NO: 6455 - DNA, 515 bp, Artificial Sequence
  chemically treated genomic DNA (Homo sapiens) CpG-island No: 6455
ttttatttacggttgtaacgttcggagtgcgttttgtcggtaaatacgtcggtcgggtaaatttcgattaggttatcggaaaattcgttttttagcgtgtcgtttttcgggcgatcgaagtagacgttgtcgtgcgtatcgtaaacgtttagatttgtatcgttagcgtaatttttgtagtaacgtatatagcggtagtaggcgatgtagcggtttatttcgtgagagatgaatggttttaaattttgattacggtgggtacgtttggtgaaacggtagcgacggaagttgtgttcggttattatagttatattttgaagatggtagttatcgttttttttatatatcggatagtcgtgcgggtggttggttattaattattcgattacgtttttacggaattgtttcgttttttcgtcgttaatggaaataaaggtgttatcggaagtcggtgttatataggatattattaggcgattacgcgtgtttttcgcgttttggtattgttttatcgt

SEQ ID NO: 6456 - DNA, 515 bp, Artificial Sequence
  chemically treated genomic DNA (Homo sapiens) CpG-island No: 6456
acgataaaacaataccaaaacgcgaaaaacacgcgtaatcgcctaataatatcctatataacaccgacttccgataacacctttatttccattaacgacgaaaaaacgaaacaattccgtaaaaacgtaatcgaataattaataaccaaccacccgcacgactatccgatatataaaaaaaacgataactaccatcttcaaaatataactataataaccgaacacaacttccgtcgctaccgtttcaccaaacgtacccaccgtaatcaaaatttaaaaccattcatctctcacgaaataaaccgctacatcgcctactaccgctatatacgttactacaaaaattacgctaacgatacaaatctaaacgtttacgatacgcacgacaacgtctacttcgatcgcccgaaaaacgacacgctaaaaaacgaattttccgataacctaatcgaaatttacccgaccgacgtatttaccgacaaaacgcactccgaacgttacaaccgtaaataaaa

SEQ ID NO: 6457 - DNA, 986 bp, Artificial Sequence
  chemically treated genomic DNA (Homo sapiens) CpG-island No: 6457
  misc_feature (819)..(819): n is either a, c, g or t
  misc_feature (978)..(978): n is either a, c, g or t
gcgtcgagtatttgttagtaatgttttatcggttgtaatattagtttcggtgaacgttacggcgaattgcgtcgtatcgaaaatcgttataacggtacggtaaattattattttttttgcgatcgtggtcgtttcggttacggttacgttaatttgaaggatcgttcgcgttagttagtatagcgtcgtggcgatgattttattatttttaacgtcgaataggtaatgtagggcgcggtagatattttgcgttagtcgaagaaagtgatcggtattggtttttcgcgtgttagcgtggaaagtaattttgcgttgcgtgaattggtgggcgaagaaaatttttatatcggtatcgtttacggtgagtaggaacgtttgtaattggcgttgaaagtgttgcgtgaaggcggtatttatatttcggttttgcgcgaaatcgaattttacgatgcggtattggtgttgggcgaagacgttatttagatcggcgcgcgcgtcgcgttggtagtgcgttaggttgtgaaaggtaaagcgcgcgaaatggcggtagtatagaaagtggttgattggtagattgcggtaatttttaatatcggttaacgtgcgaagtattcgttgtttgttattacgttgatgatattcgtttggatgatatcgcggcgtggatttatcgcgtatcggttgaagattaggcgcgtttaggttttgttatcgtttatgcgttggataattttgtattagcggttgacggtatcgaatttgagttgtaaagtaaaatcgacgttatcgtgtaggtattggtaggtgcgaagaaatcgntgattattttacggacgaacgtcggtagtttagaggtgaatttagcggcggtttacgtcgcgaaagttttgaaggtcgcggcgttgatcgtcgtattattatgattgttcggttcgttaataagtatgggttggtatatttagataattaatattattnaaataagt

SEQ ID NO: 6458 - DNA, 986 bp, Artificial Sequence
  chemically treated genomic DNA (Homo sapiens) CpG-island No: 6458
  misc_feature (9)..(9): n is either a, c, g or t
  misc_feature (168)..(168): n is either a, c, g or t
acttatttnaataatattaattatctaaatataccaacccatacttattaacgaaccgaacaatcataataatacgacgatcaacgccgcgaccttcaaaactttcgcgacgtaaaccgccgctaaattcacctctaaactaccgacgttcgtccgtaaaataatcancgatttcttcgcacctaccaatacctacacgataacgtcgattttactttacaactcaaattcgataccgtcaaccgctaatacaaaattatccaacgcataaacgataacaaaacctaaacgcgcctaatcttcaaccgatacgcgataaatccacgccgcgatatcatccaaacgaatatcatcaacgtaataacaaacaacgaatacttcgcacgttaaccgatattaaaaattaccgcaatctaccaatcaaccactttctatactaccgccatttcgcgcgctttacctttcacaacctaacgcactaccaacgcgacgcgcgcgccgatctaaataacgtcttcgcccaacaccaataccgcatcgtaaaattcgatttcgcgcaaaaccgaaatataaataccgccttcacgcaacactttcaacgccaattacaaacgttcctactcaccgtaaacgataccgatataaaaattttcttcgcccaccaattcacgcaacgcaaaattactttccacgctaacacgcgaaaaaccaataccgatcactttcttcgactaacgcaaaatatctaccgcgccctacattacctattcgacgttaaaaataataaaatcatcgccacgacgctatactaactaacgcgaacgatccttcaaattaacgtaaccgtaaccgaaacgaccacgatcgcaaaaaaaataataatttaccgtaccgttataacgattttcgatacgacgcaattcgccgtaacgttcaccgaaactaatattacaaccgataaaacattactaacaaatactcgacgc

SEQ ID NO: 6459 - DNA, 986 bp, Artificial Sequence
  chemically treated genomic DNA (Homo sapiens) CpG-island No: 6459
  misc_feature (9)..(9): n is either a, c, g or t
  misc_feature (168)..(168): n is either a, c, g or t
atttatttnagtgatattggttgtttggatatgttagtttatgtttgttgacgaatcgggtaattatggtgatacgacggttagcgtcgcgatttttagggttttcgcgacgtaagtcgtcgttgaatttatttttaagttatcggcgttcgttcgtgagataattancggttttttcgtatttgttagtgtttgtacgatgacgtcgattttgttttgtagtttaggttcgatatcgttaatcgttggtgtagagttatttagcgtatgggcgatggtaaaatttaaacgcgtttgatttttaatcggtgcgcggtaagtttacgtcgcgatattatttagacgggtgttattaacgtggtaataaatagcggatgtttcgtacgttgatcgatgttgaggattgtcgtaatttgttagttagttattttttgtgttgtcgttatttcgcgcgttttattttttatagtttgacgtattgttagcgcgacgcgcgcgtcggtttgggtaacgttttcgtttagtattagtatcgtatcgtaagattcgatttcgcgtagagtcggagtataaatgtcgtttttacgtagtatttttagcgttagttgtagacgtttttgtttatcgtgagcgatatcggtgtagaagtttttttcgtttattagtttacgtagcgtaaagttgttttttacgttggtacgcggagaattaatatcgattatttttttcgattgacgtagaatatttgtcgcgttttgtattgtttgttcggcgttgagggtaatgaaattatcgttacgacgttgtattggttgacgcggacgattttttaggttgacgtaatcgtaatcgaaacgattacggtcgtagaggaagtagtggtttatcgtatcgttgtaacggttttcgatacgacgtagttcgtcgtaacgtttatcggggttgatgttatagtcgatggaatattgttggtagatgttcggcgt

SEQ ID NO: 6460 - DNA, 986 bp, Artificial Sequence
  chemically treated genomic DNA (Homo sapiens) CpG-island No: 6460
  misc_feature (819)..(819): n is either a, c, g or t
  misc_feature (978)..(978): n is either a, c, g or t
acgccgaacatctaccaacaatattccatcgactataacatcaaccccgataaacgttacgacgaactacgtcgtatcgaaaaccgttacaacgatacgataaaccactacttcctctacgaccgtaatcgtttcgattacgattacgtcaacctaaaaaatcgtccgcgtcaaccaatacaacgtcgtaacgataatttcattaccctcaacgccgaacaaacaatacaaaacgcgacaaatattctacgtcaatcgaaaaaaataatcgatattaattctccgcgtaccaacgtaaaaaacaactttacgctacgtaaactaataaacgaaaaaaacttctacaccgatatcgctcacgataaacaaaaacgtctacaactaacgctaaaaatactacgtaaaaacgacatttatactccgactctacgcgaaatcgaatcttacgatacgatactaatactaaacgaaaacgttacccaaaccgacgcgcgcgtcgcgctaacaatacgtcaaactataaaaaataaaacgcgcgaaataacgacaacacaaaaaataactaactaacaaattacgacaatcctcaacatcgatcaacgtacgaaacatccgctatttattaccacgttaataacacccgtctaaataatatcgcgacgtaaacttaccgcgcaccgattaaaaatcaaacgcgtttaaattttaccatcgcccatacgctaaataactctacaccaacgattaacgatatcgaacctaaactacaaaacaaaatcgacgtcatcgtacaaacactaacaaatacgaaaaaaccgntaattatctcacgaacgaacgccgataacttaaaaataaattcaacgacgacttacgtcgcgaaaaccctaaaaatcgcgacgctaaccgtcgtatcaccataattacccgattcgtcaacaaacataaactaacatatccaaacaaccaatatcactnaaataaat

SEQ ID NO: 6461 - DNA, 585 bp, Artificial Sequence
  chemically treated genomic DNA (Homo sapiens) CpG-island No: 6461
aaagataacggtagggagagaacgttataagagagggaaagttagagcgaaaattggtaattcgtttcgaggttttcgttattacgggtgatttgaggatttagtacgaggcgagaggcgagagtatggggttgggaagagttataaaattcgtttgtgattagttcggatgggggtatcggtcgtttgtgattgggtgacgtcgagatatagagttgcgttttgaattacgtagggttttgggtagtaaaggttttgtaaggattttaatcgaaagggggagggggaaggtcgttaataaacggttgagtttataattcgggtcggggcgttttttaatttttatggagagagttaggttggagtcgtcgttttagtcgtattttttgagtttcgtttcgtttttgttgtcggtcgagggtatttttttttgggtagcggtcgtgaagattttttcgtcgtcgtttatgttgtgcgcggtcgttattgcgatcgtggttttttcgtgtagggagggtttggtgtcgtgtgcggcgtagtagattgttggaggtgaagttggagtaggtgttgttgttattatag

SEQ ID NO: 6462 - DNA, 585 bp, Artificial Sequence
  chemically treated genomic DNA (Homo sapiens) CpG-island No: 6462
ctataataacaacaacacctactccaacttcacctccaacaatctactacgccgcacacgacaccaaaccctccctacacgaaaaaaccacgatcgcaataacgaccgcgcacaacataaacgacgacgaaaaaatcttcacgaccgctacccaaaaaaaaataccctcgaccgacaacaaaaacgaaacgaaactcaaaaaatacgactaaaacgacgactccaacctaactctctccataaaaattaaaaaacgccccgacccgaattataaactcaaccgtttattaacgaccttccccctccccctttcgattaaaatccttacaaaacctttactacccaaaaccctacgtaattcaaaacgcaactctatatctcgacgtcacccaatcacaaacgaccgatacccccatccgaactaatcacaaacgaattttataactcttcccaaccccatactctcgcctctcgcctcgtactaaatcctcaaatcacccgtaataacgaaaacctcgaaacgaattaccaattttcgctctaactttccctctcttataacgttctctccctaccgttatcttt

SEQ ID NO: 6463 - DNA, 585 bp, Artificial Sequence
  chemically treated genomic DNA (Homo sapiens) CpG-island No: 6463
ttgtggtagtagtaatatttgttttagttttatttttagtagtttgttgcgtcgtatacggtattaaattttttttatacgaggaggttacggtcgtaatggcggtcgcgtatagtatgggcggcgacggaggggtttttacggtcgttgtttaaaaggaggtgttttcgatcggtagtagggacggagcgggatttaaagggtgcggttgaggcggcggttttagtttagttttttttatggaggttgggggacgtttcggttcggattgtgagtttagtcgtttgttggcgattttttttttttttttttcggttaagatttttgtaaggtttttgttatttagaattttacgtggtttaaaacgtagttttatgtttcggcgttatttaattataagcgatcgatatttttattcgggttaattataggcgggttttgtggttttttttagttttatgttttcgtttttcgtttcgtgttgagtttttaaattattcgtgatggcgggagtttcgagacgggttgttagttttcgttttgatttttttttttttgtggcgttttttttttgtcgttgttttt

SEQ ID NO: 6464 - DNA, 585 bp, Artificial Sequence
  chemically treated genomic DNA (Homo sapiens) CpG-island No: 6464
aaaaacaacgacaaaaaaaaaacgccacaaaaaaaaaaaaatcaaaacgaaaactaacaacccgtctcgaaactcccgccatcacgaataatttaaaaactcaacacgaaacgaaaaacgaaaacataaaactaaaaaaaaccacaaaacccgcctataattaacccgaataaaaatatcgatcgcttataattaaataacgccgaaacataaaactacgttttaaaccacgtaaaattctaaataacaaaaaccttacaaaaatcttaaccgaaaaaaaaaaaaaaaaaatcgccaacaaacgactaaactcacaatccgaaccgaaacgtcccccaacctccataaaaaaaactaaactaaaaccgccgcctcaaccgcaccctttaaatcccgctccgtccctactaccgatcgaaaacacctccttttaaacaacgaccgtaaaaacccctccgtcgccgcccatactatacgcgaccgccattacgaccgtaacctcctcgtataaaaaaaatttaataccgtatacgacgcaacaaactactaaaaataaaactaaaacaaatattactactaccacaa

SEQ ID NO: 6465 - DNA, 564 bp, Artificial Sequence
  chemically treated genomic DNA (Homo sapiens) CpG-island No: 6465
tttaggcgtggtagtagattgtcgttgaaattggtattagtttgatgcgtagtttaacgaatttttaaaagggattagtcgcgatgagttttgtcggcgtattttgtaatatcggggcgtaaaaggacgtggtcggaatttttaattttcgttaggagagggcgtaattggcgtatcgtaaaaatttgtttatgtttatttattacgcgagttgacggttaacgttgttttattcggattcgttttttgttggtagattttcgtgtatagtagatttcggttgggcggtttttgtttttttgaatgcgtcgacgattttagcggcgttggagttggcgagttttttattttttgcgcggatgtatttttaatttaaaaattcgaatcggatttaggaaatttttttcgtcgtattgtgtagggttgggcgtgcgtacgtaggtatgtattaggtattgaagatgcgtagcgggtagtgaggttatttcgggagttattttatgtttcgaaaaggtttaaatttcgaatttacgttaaaatttagttaggtaattaatcgggata

SEQ ID NO: 6466 - DNA, 564 bp, Artificial Sequence
  chemically treated genomic DNA (Homo sapiens) CpG-island No: 6466
tatcccgattaattacctaactaaattttaacgtaaattcgaaatttaaaccttttcgaaacataaaataactcccgaaataacctcactacccgctacgcatcttcaatacctaatacatacctacgtacgcacgcccaaccctacacaatacgacgaaaaaaatttcctaaatccgattcgaatttttaaattaaaaatacatccgcgcaaaaaataaaaaactcgccaactccaacgccgctaaaatcgtcgacgcattcaaaaaaacaaaaaccgcccaaccgaaatctactatacacgaaaatctaccaacaaaaaacgaatccgaataaaacaacgttaaccgtcaactcgcgtaataaataaacataaacaaatttttacgatacgccaattacgccctctcctaacgaaaattaaaaattccgaccacgtccttttacgccccgatattacaaaatacgccgacaaaactcatcgcgactaatcccttttaaaaattcgttaaactacgcatcaaactaataccaatttcaacgacaatctactaccacgcctaaa

SEQ ID NO: 6467 - DNA, 564 bp, Artificial Sequence
  chemically treated genomic DNA (Homo sapiens) CpG-island No: 6467
tatttcgattgattatttggttagattttggcgtaaattcggaatttgggttttttcgggatatggggtaattttcgaggtgattttattgttcgttgcgtatttttaatgtttgatatatgtttgcgtgcgtacgtttagttttgtatagtgcggcgagaaagattttttgggttcggttcgagtttttaagttgggaatgtattcgcgtagaaggtgaaaaattcgttagttttagcgtcgttaaaatcgtcggcgtatttagggagatagaagtcgtttaatcgagatttgttgtgtacggagatttgttagtaaagagcgaattcgggtagaatagcgttgatcgttaattcgcgtagtgagtggatatagatagatttttgcgatacgttagttgcgtttttttttggcggaggttaaaggtttcggttacgtttttttgcgtttcggtgttgtagaatgcgtcggtaggatttatcgcggttgattttttttagggattcgttaaattgcgtattaagttgatgttaattttagcggtaatttgttgttacgtttggg

SEQ ID NO: 6468 - DNA, 564 bp, Artificial Sequence
  chemically treated genomic DNA (Homo sapiens) CpG-island No: 6468
cccaaacgtaacaacaaattaccgctaaaattaacatcaacttaatacgcaatttaacgaatccctaaaaaaaatcaaccgcgataaatcctaccgacgcattctacaacaccgaaacgcaaaaaaacgtaaccgaaacctttaacctccgccaaaaaaaaacgcaactaacgtatcgcaaaaatctatctatatccactcactacgcgaattaacgatcaacgctattctacccgaattcgctctttactaacaaatctccgtacacaacaaatctcgattaaacgacttctatctccctaaatacgccgacgattttaacgacgctaaaactaacgaatttttcaccttctacgcgaatacattcccaacttaaaaactcgaaccgaacccaaaaaatctttctcgccgcactatacaaaactaaacgtacgcacgcaaacatatatcaaacattaaaaatacgcaacgaacaataaaatcacctcgaaaattaccccatatcccgaaaaaacccaaattccgaatttacgccaaaatctaaccaaataatcaatcgaaata

SEQ ID NO: 6469 - DNA, 662 bp, Artificial Sequence
  chemically treated genomic DNA (Homo sapiens) CpG-island No: 6469
gcgcgttttcggtgtttttaacggatggagaagacggaattataacgtaaggtagatttcgtgattgatttaggtgaggtttcgcgaggtgtttttaattttacgacgatagtaggaaacgatttattcgtatcgttttaattttacgttatagtggagttatttttttgggcgttttttagcgtgcgcgtgcgtttgcgtatgcgtatttattttttttcgttttcgcgtagatttgttttcgttagtcgcgcgtgggtagaggttttaggcgggcgttgcgaagggttgttgttagagttcggattttgttacggcgcgaagttttttttttggggcggggaaaggtatcgtattcgttatttagtgtgaatgaattgtggcgtgggttttaagggtaggttgcggagtattcgggtcgtggttatgaatttattcgtgattttggcgttaggtaggcgttgaggaagaagttattcgagcggatttcgaggtgaggttggttgatttttatgtgcgttttatagtttagtagatatatttttttgtttgttcgaaattcgcggcgattgtttttttgttagagttcgtatttgttattgggaatttgttcgtttgagttttttttttgatttagtttttgtcgttagtagggtgtcgat

SEQ ID NO: 6470 - DNA, 662 bp, Artificial Sequence
  chemically treated genomic DNA (Homo sapiens) CpG-island No: 6470
atcgacaccctactaacgacaaaaactaaatcaaaaaaaaaactcaaacgaacaaattcccaataacaaatacgaactctaacaaaaaaacaatcgccgcgaatttcgaacaaacaaaaaaatatatctactaaactataaaacgcacataaaaatcaaccaacctcacctcgaaatccgctcgaataacttcttcctcaacgcctacctaacgccaaaatcacgaataaattcataaccacgacccgaatactccgcaacctacccttaaaacccacgccacaattcattcacactaaataacgaatacgatacctttccccgccccaaaaaaaaaacttcgcgccgtaacaaaatccgaactctaacaacaacccttcgcaacgcccgcctaaaacctctacccacgcgcgactaacgaaaacaaatctacgcgaaaacgaaaaaaaataaatacgcatacgcaaacgcacgcgcacgctaaaaaacgcccaaaaaaataactccactataacgtaaaattaaaacgatacgaataaatcgtttcctactatcgtcgtaaaattaaaaacacctcgcgaaacctcacctaaatcaatcacgaaatctaccttacgttataattccgtcttctccatccgttaaaaacaccgaaaacgcgc

SEQ ID NO: 6471 - DNA, 662 bp, Artificial Sequence
  chemically treated genomic DNA (Homo sapiens) CpG-island No: 6471
gtcggtattttgttggcgataagggttgggttagggaagagatttaagcgaatagatttttagtagtaggtgcgaattttggtaagagggtagtcgtcgcggatttcggatagataggaggatgtgtttattggattgtgagacgtatataaaggttaattagttttatttcggagttcgttcgggtggttttttttttaacgtttgtttagcgttagggttacgggtgagtttatggttacggttcgggtatttcgtagtttgtttttagagtttacgttatagtttatttatattaggtagcgggtgcggtattttttttcgttttaaggagggaatttcgcgtcgtaataaggttcgaattttagtaataatttttcgtaacgttcgtttaaggtttttatttacgcgcgattggcggagataagtttgcgcgggggcgggggagagtaagtgcgtatgcgtagacgtacgcgtacgttaagaaacgtttaagggagtaattttattgtgacgtaaaattggggcggtgcgagtaagtcgttttttgttgtcgtcgtgagattaaagatatttcgcgagattttatttaaattagttacggggtttgttttgcgttgtggtttcgttttttttattcgttggagatatcggaaacgcgt

SEQ ID NO: 6472 - DNA, 662 bp, Artificial Sequence
  chemically treated genomic DNA (Homo sapiens) CpG-island No: 6472
acgcgtttccgatatctccaacgaataaaaaaaacgaaaccacaacgcaaaacaaaccccgtaactaatttaaataaaatctcgcgaaatatctttaatctcacgacgacaacaaaaaacgacttactcgcaccgccccaattttacgtcacaataaaattactcccttaaacgtttcttaacgtacgcgtacgtctacgcatacgcacttactctcccccgcccccgcgcaaacttatctccgccaatcgcgcgtaaataaaaaccttaaacgaacgttacgaaaaattattactaaaattcgaaccttattacgacgcgaaattccctccttaaaacgaaaaaaaataccgcacccgctacctaatataaataaactataacgtaaactctaaaaacaaactacgaaatacccgaaccgtaaccataaactcacccgtaaccctaacgctaaacaaacgttaaaaaaaaaaccacccgaacgaactccgaaataaaactaattaacctttatatacgtctcacaatccaataaacacatcctcctatctatccgaaatccgcgacgactaccctcttaccaaaattcgcacctactactaaaaatctattcgcttaaatctcttccctaacccaacccttatcgccaacaaaataccgac

SEQ ID NO: 6473 - DNA, 911 bp, Artificial Sequence
  chemically treated genomic DNA (Homo sapiens) CpG-island No: 6473
tatcgacgcggtaagtaaattatttttaacgttgtcggaaagcgtttcggagaagtgtttcgtattcggtaataatttttattgtttttaggttagatcgttttacgatgtttgaaaacgggttttgtttgtcgtttgaagcgggatatttagcgttagagtgttaattttgtcgttcggttgtgtgggagcgttaaatattatttagtgtaggtgaaagtttcgcggttagcgggcgtatgttttttaggtttgttagttttagattattggcgcgaattcggagttcgttattgcgtttattgtttttgtcgttaacgttttgtttcggtatttaggttagcgttaatgtttcgttcggttagggtttgtcgtttatcgtgattcgtgtatcgggaatagagaattgttagttcggatttttacgcgtaatatgcgcggttagattatttatcgatagcgtatgcgtttgtttttcgtttaattagttggtatcgttttgttttagttagacgttatcgtcggttatatcgtttttgtcgatcgttatttagtttttaagggagaattgtgtcgtttttagcgtaatattgttttgtatttatttatcgagttacggttttaggtcgatgttattcgtttggagttagacgcgattattgtttaataattttttattatcgcgtaaatttatgcgtatttgtattacgtcgtgttgttcggtaaggttggagaggtttattaggtttttcgtacggtgtcgacgtggatcgtttagttaggtgagttgtgggatcgttagttcggcgcgttgatcggatggcgttaggaaattgattttattgtcgcgaagatcgaaatggttttattgacgaagaaatagatcgttgatgtgattggtttttagatat

SEQ ID NO: 6474 - DNA, 911 bp, Artificial Sequence
  chemically treated genomic DNA (Homo sapiens) CpG-island No: 6474
atatctaaaaaccaatcacatcaacgatctatttcttcgtcaataaaaccatttcgatcttcgcgacaataaaatcaatttcctaacgccatccgatcaacgcgccgaactaacgatcccacaactcacctaactaaacgatccacgtcgacaccgtacgaaaaacctaataaacctctccaaccttaccgaacaacacgacgtaatacaaatacgcataaatttacgcgataataaaaaattattaaacaataatcgcgtctaactccaaacgaataacatcgacctaaaaccgtaactcgataaataaatacaaaacaatattacgctaaaaacgacacaattctcccttaaaaactaaataacgatcgacaaaaacgatataaccgacgataacgtctaactaaaacaaaacgataccaactaattaaacgaaaaacaaacgcatacgctatcgataaataatctaaccgcgcatattacgcgtaaaaatccgaactaacaattctctattcccgatacacgaatcacgataaacgacaaaccctaaccgaacgaaacattaacgctaacctaaataccgaaacaaaacgttaacgacaaaaacaataaacgcaataacgaactccgaattcgcgccaataatctaaaactaacaaacctaaaaaacatacgcccgctaaccgcgaaactttcacctacactaaataatatttaacgctcccacacaaccgaacgacaaaattaacactctaacgctaaatatcccgcttcaaacgacaaacaaaacccgttttcaaacatcgtaaaacgatctaacctaaaaacaataaaaattattaccgaatacgaaacacttctccgaaacgctttccgacaacgttaaaaataatttacttaccgcgtcgata

SEQ ID NO: 6475 - DNA, 911 bp, Artificial Sequence
  chemically treated genomic DNA (Homo sapiens) CpG-island No: 6475
atgtttggaagttagttatattagcgatttgttttttcgttaatgggattatttcgattttcgcgatagtgaagttagttttttgacgttattcggttagcgcgtcgagttggcgattttataatttatttggttgaacgatttacgtcgatatcgtgcggaaggtttggtaagtttttttagttttatcggatagtacggcgtgatgtaggtgcgtatggatttgcgcgatgatgaggggttgttaagtaatggtcgcgtttggttttaggcggatgatatcgatttgaagtcgtggttcggtaaatggatgtaggataatattgcgttggaaacggtatagtttttttttgaaggttggatgacgatcgataaaggcgatgtaatcggcggtgacgtttggttgaaatagggcggtgttagttggttgggcgagaagtaaacgtatacgttgtcggtggataatttgatcgcgtatattacgcgtgaaaattcgggttggtagttttttattttcgatatacggattacgatggacggtaaattttggtcgagcggagtattgacgttggtttggatatcggaataggacgttggcggtaaagataataaacgtagtgacgaatttcggattcgcgttagtaatttggagttggtaggtttggagggtatacgttcgttggtcgcgaaatttttatttgtattgggtgatgtttggcgtttttatataatcgagcggtaagattaatattttggcgttggatatttcgttttaggcggtagataagattcgtttttaggtatcgtggagcgatttggtttggaagtaatggaaattattatcgggtgcggaatattttttcgggacgtttttcggtagcgttgaaaatggtttgtttatcgcgtcgatg

SEQ ID NO: 6476 - DNA, 911 bp, Artificial Sequence
  chemically treated genomic DNA (Homo sapiens) CpG-island No: 6476
catcgacgcgataaacaaaccattttcaacgctaccgaaaaacgtcccgaaaaaatattccgcacccgataataatttccattacttccaaaccaaatcgctccacgatacctaaaaacgaatcttatctaccgcctaaaacgaaatatccaacgccaaaatattaatcttaccgctcgattatataaaaacgccaaacatcacccaatacaaataaaaatttcgcgaccaacgaacgtataccctccaaacctaccaactccaaattactaacgcgaatccgaaattcgtcactacgtttattatctttaccgccaacgtcctattccgatatccaaaccaacgtcaatactccgctcgaccaaaatttaccgtccatcgtaatccgtatatcgaaaataaaaaactaccaacccgaattttcacgcgtaatatacgcgatcaaattatccaccgacaacgtatacgtttacttctcgcccaaccaactaacaccgccctatttcaaccaaacgtcaccgccgattacatcgcctttatcgatcgtcatccaaccttcaaaaaaaaactataccgtttccaacgcaatattatcctacatccatttaccgaaccacgacttcaaatcgatatcatccgcctaaaaccaaacgcgaccattacttaacaacccctcatcatcgcgcaaatccatacgcacctacatcacgccgtactatccgataaaactaaaaaaacttaccaaaccttccgcacgatatcgacgtaaatcgttcaaccaaataaattataaaatcgccaactcgacgcgctaaccgaataacgtcaaaaaactaacttcactatcgcgaaaatcgaaataatcccattaacgaaaaaacaaatcgctaatataactaacttccaaacat

SEQ ID NO: 6477 - DNA, 803 bp, Artificial Sequence
  chemically treated genomic DNA (Homo sapiens) CpG-island No: 6477
cggatttttatttcggcgggggcgggggaggcgggcgcgggttttttgtttttttttcggttttggtttttgcgcggggtgtttttttcgatttcgggtcgatttttcgattttcggtcgttgttttggtcgtttcgaggagttttcgcgtttcgttgttttacgttgagggtatcgaaatttagcgttttgttttcgaaggcgttttttacgttgtagaatatgtcgtcgtatttttgtcgcgggatttggttcgtggtgttcggtttggttaggtatacgggtagatcgttttcgtgggagttgttttagttttttcggttcgaggttatggtttaagtacgaaagcggttcgcgggttttttttttttagaggcggaaagggtagtcgtcggtagcgtgcgtcgagttatagtgattgtggcgggaggaggcgtttgagttttcgcgttagaggcggtagtgttgtttcgatttttgtttgtttttagcgagttagcgagttatatagttagttagcgcgcggagtaggggtttagagtagcgtcgcgtttggtttattcgttggatttttcgttcggtcgtatttttttacgtatttttaattttaacgtggtttttcgggttgacgtagcgtcggtgtttattataattataaattaaatttggcgcgcgcgtatacgtatatataggcgtatattgttcgttcgcgtaatagttttgttttatatattttcgcgtaatttagacgttttagaaatgtttatattttagtatttgattgttttatttatattaatttt

SEQ ID NO: 6478 - DNA, 803 bp, Artificial Sequence
  chemically treated genomic DNA (Homo sapiens) CpG-island No: 6478
aaaattaatataaataaaacaatcaaatactaaaatataaacatttctaaaacgtctaaattacgcgaaaatatataaaacaaaactattacgcgaacgaacaatatacgcctatatatacgtatacgcgcgcgccaaatttaatttataattataataaacaccgacgctacgtcaacccgaaaaaccacgttaaaattaaaaatacgtaaaaaaatacgaccgaacgaaaaatccaacgaataaaccaaacgcgacgctactctaaacccctactccgcgcgctaactaactatataactcgctaactcgctaaaaacaaacaaaaatcgaaacaacactaccgcctctaacgcgaaaactcaaacgcctcctcccgccacaatcactataactcgacgcacgctaccgacgactaccctttccgcctctaaaaaaaaaaaacccgcgaaccgctttcgtacttaaaccataacctcgaaccgaaaaaactaaaacaactcccacgaaaacgatctacccgtatacctaaccaaaccgaacaccacgaaccaaatcccgcgacaaaaatacgacgacatattctacaacgtaaaaaacgccttcgaaaacaaaacgctaaatttcgataccctcaacgtaaaacaacgaaacgcgaaaactcctcgaaacgaccaaaacaacgaccgaaaatcgaaaaatcgacccgaaatcgaaaaaaacaccccgcgcaaaaaccaaaaccgaaaaaaaaacaaaaaacccgcgcccgcctcccccgcccccgccgaaataaaaatccg

SEQ ID NO: 6479 - DNA, 803 bp, Artificial Sequence
  chemically treated genomic DNA (Homo sapiens) CpG-island No: 6479
ggagttagtgtgggtgaagtagttaagtgttggagtgtgaatatttttaagacgtttaaattgcgcgaaagtgtgtgaggtaaggttgttgcgcgagcgggtagtgtgcgtttgtgtgtgcgtgtgcgcgcgcgttaagtttggtttgtgattgtgatgggtatcgacgttgcgttagttcgggaggttacgttagggttgggggtgcgtgaggaggtgcggtcgggcgagaggtttagcgagtgagttaagcgcggcgttattttgggtttttgtttcgcgcgttagttggttgtgtggttcgttggttcgttagggataagtaggaatcggagtagtattgtcgtttttggcgcgaaggtttaggcgttttttttcgttatagttattgtggttcggcgtacgttgtcggcggttgtttttttcgtttttggggaagaaaaattcgcgggtcgttttcgtgtttgaattatggtttcgggtcggaggggttgggatagtttttacgaagacgatttgttcgtgtatttggttaggtcgggtattacggattaggtttcgcggtagaaatacggcggtatgttttgtaacgtggagggcgttttcgagagtaagacgttggatttcgatgtttttagcgtggggtagcggggcgcgaagatttttcggagcggttagggtagcgatcgaggatcggggagtcggttcgggatcgagggggatatttcgcgtaggggttaaggtcgggaagagagtagggagttcgcgttcgtttttttcgttttcgtcggggtagagattcg

SEQ ID NO: 6480 - DNA, 803 bp, Artificial Sequence
  chemically treated genomic DNA (Homo sapiens) CpG-island No: 6480
cgaatctctaccccgacgaaaacgaaaaaaacgaacgcgaactccctactctcttcccgaccttaacccctacgcgaaatatccccctcgatcccgaaccgactccccgatcctcgatcgctaccctaaccgctccgaaaaatcttcgcgccccgctaccccacgctaaaaacatcgaaatccaacgtcttactctcgaaaacgccctccacgttacaaaacataccgccgtatttctaccgcgaaacctaatccgtaatacccgacctaaccaaatacacgaacaaatcgtcttcgtaaaaactatcccaacccctccgacccgaaaccataattcaaacacgaaaacgacccgcgaatttttcttccccaaaaacgaaaaaaacaaccgccgacaacgtacgccgaaccacaataactataacgaaaaaaaacgcctaaaccttcgcgccaaaaacgacaatactactccgattcctacttatccctaacgaaccaacgaaccacacaaccaactaacgcgcgaaacaaaaacccaaaataacgccgcgcttaactcactcgctaaacctctcgcccgaccgcacctcctcacgcacccccaaccctaacgtaacctcccgaactaacgcaacgtcgatacccatcacaatcacaaaccaaacttaacgcgcgcgcacacgcacacacaaacgcacactacccgctcgcgcaacaaccttacctcacacactttcgcgcaatttaaacgtcttaaaaatattcacactccaacacttaactacttcacccacactaactcc

SEQ ID NO: 6481 - DNA, 554 bp, Artificial Sequence
  chemically treated genomic DNA (Homo sapiens) CpG-island No: 6481
tcgtcgagtatcgttagttttacgttaaatttttttagttttttttcgttgttatagatattttggaaaattagttcgttcggtgcgttacgacggatcgtttcgatttgggtggtgacgtgcgttagtatatagttttgagttgggatgttgaatttgtcgattacgttatagatggtatttaatacgcggtttaagttttttacgtcgttagttatcgggttaacgtcgattatcgtatcgtttatttcgaaggaaagtttttcgtagatttgcgcggcgatattttgtacgtcgttacgggtgttatttggttgtaaacgggcgttaaaggtgttcggaatatcgatggtggtattggtttttttgattatcggtatttttttcgcgtcgtagattaggttcgcgttggagtaaattttcgttatcgtcgcgattattttcgaggttagttttttgcgggtaaaggtaatgtcgtttacgttggttttatcgtttagtatatatttacgtagttcgttgatgttttagtttttaatttggttgtaggtcgt

SEQ ID NO: 6482 - DNA, 554 bp, Artificial Sequence
  chemically treated genomic DNA (Homo sapiens) CpG-island No: 6482
acgacctacaaccaaattaaaaactaaaacatcaacgaactacgtaaatatatactaaacgataaaaccaacgtaaacgacattacctttacccgcaaaaaactaacctcgaaaataatcgcgacgataacgaaaatttactccaacgcgaacctaatctacgacgcgaaaaaaataccgataatcaaaaaaaccaataccaccatcgatattccgaacacctttaacgcccgtttacaaccaaataacacccgtaacgacgtacaaaatatcgccgcgcaaatctacgaaaaactttccttcgaaataaacgatacgataatcgacgttaacccgataactaacgacgtaaaaaacttaaaccgcgtattaaataccatctataacgtaatcgacaaattcaacatcccaactcaaaactatatactaacgcacgtcaccacccaaatcgaaacgatccgtcgtaacgcaccgaacgaactaattttccaaaatatctataacaacgaaaaaaaactaaaaaaatttaacgtaaaactaacgatactcgacga

SEQ ID NO: 6483 - DNA, 554 bp, Artificial Sequence
  chemically treated genomic DNA (Homo sapiens) CpG-island No: 6483
acggtttataattagattaaaaattggagtattagcgaattgcgtgagtatgtgttgagcgatgaaattagcgtggacgatattgtttttattcgtaaagggttgatttcggaagtggtcgcggcggtagcgaagatttgttttaacgcggatttgatttacggcgcgaagaaaatgtcggtaattaaaaaggttaatattattatcggtatttcgggtatttttagcgttcgtttgtagttaaatgatattcgtgacgacgtgtaaagtatcgtcgcgtaaatttacgaagggttttttttcggggtgggcgatgcggtgatcggcgttaattcggtgattgacgacgtggaaaatttaagtcgcgtgttggatattatttatggcgtgatcgataaatttaatattttaatttagggttgtgtattggcgtacgttattatttagatcgaagcgattcgtcgtggcgtatcgggcgggttgattttttagagtatttgtggtagcgaaaaagggttgaaagagtttggcgtggagttggcgatgttcgacga

SEQ ID NO: 6484 - DNA, 554 bp, Artificial Sequence
  chemically treated genomic DNA (Homo sapiens) CpG-island No: 6484
tcgtcgaacatcgccaactccacgccaaactctttcaaccctttttcgctaccacaaatactctaaaaaatcaacccgcccgatacgccacgacgaatcgcttcgatctaaataataacgtacgccaatacacaaccctaaattaaaatattaaatttatcgatcacgccataaataatatccaacacgcgacttaaattttccacgtcgtcaatcaccgaattaacgccgatcaccgcatcgcccaccccgaaaaaaaacccttcgtaaatttacgcgacgatactttacacgtcgtcacgaatatcatttaactacaaacgaacgctaaaaatacccgaaataccgataataatattaacctttttaattaccgacattttcttcgcgccgtaaatcaaatccgcgttaaaacaaatcttcgctaccgccgcgaccacttccgaaatcaaccctttacgaataaaaacaatatcgtccacgctaatttcatcgctcaacacatactcacgcaattcgctaatactccaatttttaatctaattataaaccgt

SEQ ID NO: 6485 - DNA, 750 bp, Artificial Sequence
  chemically treated genomic DNA (Homo sapiens) CpG-island No: 6485
taggatttgatttcggcgttggtgaaaattttcgtcgattcgcgtagtaatattatcggtattaaagatattatcgatttcgtcgtttatttgcgtagtatgatttatatcgttaaaggtgtttattcgtattttatcgtgttttgcggttacgacgattatttgtttaatattttgttgttcggcggcgacggggcgatatcggcgagcggtaattttgtttcgtaggtgtcggtgaattttttgaaagtttggcgcgacggggacgtggcgaaagcggtcgggtattattagattttgttgtaaatttcgtagatgtattagttggatacgtcgtttgtgaacgtgattaaagaggcgatcgtgttttgcggtcgttttgtttttacgtacgtgttgtcgttcgtttcgtcgttggacgagtcgcgtaaggcgtagttgaaaattttgttgtaatagtttaagttttgttgagtcggacgataacgatgattattgagaaaatttttatttcgtaggacgacgcgttttatgcggtgattatttacgcggcggggtcgtagggcgttttgtcgcgtgatttcgtagatgttgatggaaatttttagcggtaattttgttcggtatgacgttagacgttcgggatgggtttgggacgtttataagtttattcgttaaaaaggtgttgattatcggtttttatttagatttatcgtattgtgttttaaaggttgtatggtattgatttgt

SEQ ID NO: 6486 - DNA, 750 bp, Artificial Sequence
  chemically treated genomic DNA (Homo sapiens) CpG-island No: 6486
acaaatcaataccatacaacctttaaaacacaatacgataaatctaaataaaaaccgataatcaacacctttttaacgaataaacttataaacgtcccaaacccatcccgaacgtctaacgtcataccgaacaaaattaccgctaaaaatttccatcaacatctacgaaatcacgcgacaaaacgccctacgaccccgccgcgtaaataatcaccgcataaaacgcgtcgtcctacgaaataaaaattttctcaataatcatcgttatcgtccgactcaacaaaacttaaactattacaacaaaattttcaactacgccttacgcgactcgtccaacgacgaaacgaacgacaacacgtacgtaaaaacaaaacgaccgcaaaacacgatcgcctctttaatcacgttcacaaacgacgtatccaactaatacatctacgaaatttacaacaaaatctaataatacccgaccgctttcgccacgtccccgtcgcgccaaactttcaaaaaattcaccgacacctacgaaacaaaattaccgctcgccgatatcgccccgtcgccgccgaacaacaaaatattaaacaaataatcgtcgtaaccgcaaaacacgataaaatacgaataaacacctttaacgatataaatcatactacgcaaataaacgacgaaatcgataatatctttaataccgataatattactacgcgaatcgacgaaaattttcaccaacgccgaaatcaaatccta

SEQ ID NO: 6487 - DNA, 750 bp, Artificial Sequence
  chemically treated genomic DNA (Homo sapiens) CpG-island No: 6487
ataggttaatgttatataatttttagagtatagtgcgatgaatttaagtggaggtcgataattagtatttttttagcgggtgagtttgtgggcgttttaagtttatttcgggcgtttggcgttatgtcgaatagggttgtcgttggagatttttattagtatttgcggggttacgcggtagagcgttttgcggtttcgtcgcgtgggtgattatcgtataaaacgcgtcgttttgcggggtgaaaatttttttaatggttatcgttatcgttcggtttagtaaagtttgagttgttgtagtagggtttttagttgcgttttgcgcggttcgtttagcggcgaggcgggcggtagtacgtgcgtggagataggacgatcgtagagtacgatcgtttttttaattacgtttataaacggcgtatttagttgatatatttgcggaatttgtagtaaggtttgatgatattcggtcgttttcgttacgttttcgtcgcgttaggtttttagaagatttatcgatatttgcggggtaaagttgtcgttcgtcgatatcgtttcgtcgtcgtcgagtagtagggtattgaatagatgatcgtcgtagtcgtagagtacggtgaagtgcggatgggtatttttgacggtatggattatgttgcgtaggtgggcgacggagtcgatggtgtttttgatgtcgataatattgttgcgcgagtcggcgagggtttttattagcgtcggagttagattttg

SEQ ID NO: 6488 - DNA, 750 bp, Artificial Sequence
  chemically treated genomic DNA (Homo sapiens) CpG-island No: 6488
caaaatctaactccgacgctaataaaaaccctcgccgactcgcgcaacaatattatcgacatcaaaaacaccatcgactccgtcgcccacctacgcaacataatccataccgtcaaaaatacccatccgcacttcaccgtactctacgactacgacgatcatctattcaataccctactactcgacgacgacgaaacgatatcgacgaacgacaactttaccccgcaaatatcgataaatcttctaaaaacctaacgcgacgaaaacgtaacgaaaacgaccgaatatcatcaaaccttactacaaattccgcaaatatatcaactaaatacgccgtttataaacgtaattaaaaaaacgatcgtactctacgatcgtcctatctccacgcacgtactaccgcccgcctcgccgctaaacgaaccgcgcaaaacgcaactaaaaaccctactacaacaactcaaactttactaaaccgaacgataacgataaccattaaaaaaattttcaccccgcaaaacgacgcgttttatacgataatcacccacgcgacgaaaccgcaaaacgctctaccgcgtaaccccgcaaatactaataaaaatctccaacgacaaccctattcgacataacgccaaacgcccgaaataaacttaaaacgcccacaaactcacccgctaaaaaaatactaattatcgacctccacttaaattcatcgcactatactctaaaaattatataacattaacctat

SEQ ID NO: 6489 - DNA, 1029 bp, Artificial Sequence
  chemically treated genomic DNA (Homo sapiens) CpG-island No: 6489
ttttcgcgatggtttggatgttatttttttgcggttttttttgtaagttttgacggattttcggcgagtcggcgagggtacgcgttattgttagtgttttgttggttagtttatttcgcgttatattattgatttgcgagaagtagtatgttgtttgtgtttggtgttaatgtcgcgatggttagtaatttttttatttattcggttgatgttttgatgtttgatttcgaagatttcgtagtattgcgtgaaaaagatatcgttcgtcgtatggtttattacgcgttgtaatattcgttgtatcgcgatattgaaattattgtgcgtgttaacgcgttggatttcgaatggggtgttaacgatttggaagtcgtcgttcgcggtggtgcggacgttgtgcgtttgtcgaaaatcgatatcgtttaggatgttttggatattgaaaaagagattttgcgtatcgaaaaagtttgtggtcgtgaattcggtagtatcggtttgttggcggcgattgaattttcgttggggattattcgcgtagtggaaatcgtttacgttttcgagcgtttgatcggtatcgttttcggtgtagaagattatgtgcgtaatttgcgtatagaacgtttttcggaaggaattgaattgttgttcgtacgttgttttattttgtaggtcgcgcgttttgcgggtatttaggcgttcgatatcgtttatttcgacgttaataacgaagtcggatttttgtaagaagtcgtttatattaaatagttgggttttgacggtaaatcgttgattaattcgcgttagattgatttgttgtataatttttacgtatcgatttagaaagaagtggattacgttcgtcgcgtcgtagaagtcgttgaagtcgtcgttcgcgaagggtttcgcgtggtttttttgaacggtaagatggtggacggttcggttatcgatcgcgttcgtttggtgttttttcgtgtagaatttttcggtattcgcgaagaataataattaatgtaagaaattaaa

SEQ ID NO: 6490 - DNA, 1029 bp, Artificial Sequence
  chemically treated genomic DNA (Homo sapiens) CpG-island No: 6490
tttaatttcttacattaattattattcttcgcgaataccgaaaaattctacacgaaaaaacaccaaacgaacgcgatcgataaccgaaccgtccaccatcttaccgttcaaaaaaaccacgcgaaacccttcgcgaacgacgacttcaacgacttctacgacgcgacgaacgtaatccacttctttctaaatcgatacgtaaaaattatacaacaaatcaatctaacgcgaattaatcaacgatttaccgtcaaaacccaactatttaatataaacgacttcttacaaaaatccgacttcgttattaacgtcgaaataaacgatatcgaacgcctaaatacccgcaaaacgcgcgacctacaaaataaaacaacgtacgaacaacaattcaattccttccgaaaaacgttctatacgcaaattacgcacataatcttctacaccgaaaacgataccgatcaaacgctcgaaaacgtaaacgatttccactacgcgaataatccccaacgaaaattcaatcgccgccaacaaaccgatactaccgaattcacgaccacaaactttttcgatacgcaaaatctctttttcaatatccaaaacatcctaaacgatatcgattttcgacaaacgcacaacgtccgcaccaccgcgaacgacgacttccaaatcgttaacaccccattcgaaatccaacgcgttaacacgcacaataatttcaatatcgcgatacaacgaatattacaacgcgtaataaaccatacgacgaacgatatctttttcacgcaatactacgaaatcttcgaaatcaaacatcaaaacatcaaccgaataaataaaaaaattactaaccatcgcgacattaacaccaaacacaaacaacatactacttctcgcaaatcaataatataacgcgaaataaactaaccaacaaaacactaacaataacgcgtaccctcgccgactcgccgaaaatccgtcaaaacttacaaaaaaaaccgcaaaaaaataacatccaaaccatcgcgaaaa

SEQ ID NO: 6491 - DNA, 1029 bp, Artificial Sequence
  chemically treated genomic DNA (Homo sapiens) CpG-island No: 6491
tttagttttttatattgattattatttttcgcggatgtcggaaagttttgtacgggagagtattagacgggcgcgatcgataatcggatcgtttattattttgtcgtttagggaaattacgcgaggtttttcgcgagcggcggttttagcggtttttacgacgcggcgggcgtgatttatttttttttgggtcggtgcgtagaggttgtgtagtagattaatttgacgcgggttgattagcgatttgtcgttaaagtttagttgtttgatgtgggcggttttttgtagaaattcggtttcgttgttagcgtcggaatagacggtatcgaacgtttgaatattcgtagagcgcgcggtttgtaaaatggaatagcgtgcgaatagtagtttagtttttttcggggagcgttttgtacgtaggttgcgtatatagttttttgtatcgagggcgatatcgattaaacgttcggaagcgtgagcgatttttattgcgcgggtaatttttagcggagatttaatcgtcgttagtaggtcggtgttgtcgggtttacgattataggttttttcgatacgtaggattttttttttaatatttagaatattttgagcggtatcggttttcggtagacgtataacgttcgtattatcgcgaacgacggtttttaggtcgttaatattttattcggaatttagcgcgttgatacgtataatggttttaatatcgcgatatagcggatgttgtagcgcgtggtaaattatgcggcgggcggtgttttttttacgtaatgttacggagttttcgaggttaaatattagggtattagtcgggtagatgaaggagttgttgattatcgcggtattggtattaggtataaataatatgttatttttcgtaaattagtgatatgacgcgagatgggttagttaataaggtattggtagtggcgcgtattttcgtcgattcgtcggaaattcgttagggtttgtagaaaaaatcgtaggagagtggtatttaggttatcgcggaag

SEQ ID NO: 6492 - DNA, 1029 bp, Artificial Sequence
  chemically treated genomic DNA (Homo sapiens) CpG-island No: 6492
cttccgcgataacctaaataccactctcctacgattttttctacaaaccctaacgaatttccgacgaatcgacgaaaatacgcgccactaccaataccttattaactaacccatctcgcgtcatatcactaatttacgaaaaataacatattatttatacctaataccaataccgcgataatcaacaactccttcatctacccgactaataccctaatatttaacctcgaaaactccgtaacattacgtaaaaaaaacaccgcccgccgcataatttaccacgcgctacaacatccgctatatcgcgatattaaaaccattatacgtatcaacgcgctaaattccgaataaaatattaacgacctaaaaaccgtcgttcgcgataatacgaacgttatacgtctaccgaaaaccgataccgctcaaaatattctaaatattaaaaaaaaaatcctacgtatcgaaaaaacctataatcgtaaacccgacaacaccgacctactaacgacgattaaatctccgctaaaaattacccgcgcaataaaaatcgctcacgcttccgaacgtttaatcgatatcgccctcgatacaaaaaactatatacgcaacctacgtacaaaacgctccccgaaaaaaactaaactactattcgcacgctattccattttacaaaccgcgcgctctacgaatattcaaacgttcgataccgtctattccgacgctaacaacgaaaccgaatttctacaaaaaaccgcccacatcaaacaactaaactttaacgacaaatcgctaatcaacccgcgtcaaattaatctactacacaacctctacgcaccgacccaaaaaaaaataaatcacgcccgccgcgtcgtaaaaaccgctaaaaccgccgctcgcgaaaaacctcgcgtaatttccctaaacgacaaaataataaacgatccgattatcgatcgcgcccgtctaatactctcccgtacaaaactttccgacatccgcgaaaaataataatcaatataaaaaactaaa

SEQ ID NO: 6493 - DNA, 1198 bp, Artificial Sequence
  chemically treated genomic DNA (Homo sapiens) CpG-island No: 6493
acggcggttaggcgtagtttgtcgcgtaggtatttagtaaagaaagtaaagtcgtcggaggtaatcgttattttttagtttagcgtttttagtttgagtattagttgcgttaagtttggtattagcggtagatttttacgtatttgttgtagaatattggcgttagcgttttttagcgtcgttatacggttgcgtaggttggcggtaaaatcgagttcgtcgcgtatcgttcgttcggttattttcgttattatttcgttcgtttcggttagtttggtaattttattaatatatttaatttggatggcggtggagtttatatttattattagtaaattcggcgtgcgtaggtgcgggattttttttagcggggcgatatttagttgcgtttcgtgggttaggcgtgtagttcgtgcggtgagtgaatttgttagacgaattatttgataattttttacgtattaggcggtaataattattatcgtcgtatttagtttgttttggtattgggttagacgttgtttatttagtttacgattatatagtagttagtcgttacgatttgcgtggaatttagtggattattttttattatttatgaagagtcgttcgggtataagaatatttttgtaggcgatttagtatgttgtattttttcggttcgtttatgtacggcgtaatgtgcgaatatatacgtagcggattttggtaatttttgtggcgtatggcgcggttaaatttatattggttgaatttcgttatagcgttcggtagtagcggatgttgggttttacgtttcgtttcgttttcggtaaagttcgttatatataagtcgattggttcggcggtgtatagtattagatttatttagtttagcgttttgttagatgttaataacggatcgtttttttcggttaacgtttcggttttattttcgtttatcgtaaggatagagacgtgatttttgaggaattgttgttattattgcggattttcggtaatgataaatttggtgtttagcgttagtattatcggtacgttatattttttcgcgtatttaatggtttttatggttgttttcggtatgggtttattcggtttgtaacgtattagatatgaggtgagaattagtgtcgaggtttcggtaattatatttttcggaatgtttttagttcgtagttggtttatgtggtttgga

SEQ ID NO: 6494 - DNA, 1198 bp, Artificial Sequence
  chemically treated genomic DNA (Homo sapiens) CpG-island No: 6494
tccaaaccacataaaccaactacgaactaaaaacattccgaaaaatataattaccgaaacctcgacactaattctcacctcatatctaatacgttacaaaccgaataaacccataccgaaaacaaccataaaaaccattaaatacgcgaaaaaatataacgtaccgataatactaacgctaaacaccaaatttatcattaccgaaaatccgcaataataacaacaattcctcaaaaatcacgtctctatccttacgataaacgaaaataaaaccgaaacgttaaccgaaaaaaacgatccgttattaacatctaacaaaacgctaaactaaataaatctaatactatacaccgccgaaccaatcgacttatatataacgaactttaccgaaaacgaaacgaaacgtaaaacccaacatccgctactaccgaacgctataacgaaattcaaccaatataaatttaaccgcgccatacgccacaaaaattaccaaaatccgctacgtatatattcgcacattacgccgtacataaacgaaccgaaaaaatacaacatactaaatcgcctacaaaaatattcttatacccgaacgactcttcataaataataaaaaataatccactaaattccacgcaaatcgtaacgactaactactatataatcgtaaactaaataaacaacgtctaacccaataccaaaacaaactaaatacgacgataataattattaccgcctaatacgtaaaaaattatcaaataattcgtctaacaaattcactcaccgcacgaactacacgcctaacccacgaaacgcaactaaatatcgccccgctaaaaaaaatcccgcacctacgcacgccgaatttactaataataaatataaactccaccgccatccaaattaaatatattaataaaattaccaaactaaccgaaacgaacgaaataataacgaaaataaccgaacgaacgatacgcgacgaactcgattttaccgccaacctacgcaaccgtataacgacgctaaaaaacgctaacgccaatattctacaacaaatacgtaaaaatctaccgctaataccaaacttaacgcaactaatactcaaactaaaaacgctaaactaaaaaataacgattacctccgacgactttactttctttactaaatacctacgcgacaaactacgcctaaccgccgt

SEQ ID NO: 6495 - DNA, 1198 bp, Artificial Sequence
  chemically treated genomic DNA (Homo sapiens) CpG-island No: 6495
tttaggttatatgaattagttgcgggttgaaagtatttcggaagatgtgattgtcggagtttcggtattggtttttattttatatttggtgcgttgtaagtcgggtgaatttatgtcggaagtaattatgaaagttattgagtacgcgaagaaatataacgtatcggtggtgttgacgttgggtattaagtttgttattgtcgagaattcgtagtggtggtagtaattttttaaagattacgtttttatttttgcgatgaacgaagatgaagtcgaagcgttgatcggagaaagcgattcgttgttggtatttgataaggcgttggattgggtagatttggtgttgtgtatcgtcgggttaatcggtttgtatatggcgggttttatcgaagacgaagcgaaacgtaaaatttagtattcgttgttgtcgggcgttatagcggaatttaattagtatgagtttagtcgcgttatgcgttataaggattgttagaattcgttgcgtgtatattcgtatattgcgtcgtatatgggcgggtcggaaaaatgtaatatattgggtcgtttgtagagatgtttttatgttcgggcggttttttataagtggtgaaaagtgatttattggattttacgtaggtcgtagcggttggttgttgtatggtcgtgggttggataaataacgtttgatttaatattagagtaaattgggtgcggcgatggtgattgttgtcgtttggtgcgtggaagattattaggtgattcgtttggtaggtttatttatcgtacgggttatacgtttggtttacgaagcgtagttggatgtcgtttcgttggggaaaatttcgtatttgcgtacgtcgggtttgttggtgatggatatggattttatcgttatttagattgaatgtattgatgaaattgttaaattggtcggaacgggcgagatggtggcggaagtaatcgaacgggcgatgcgcggcgaattcgattttatcgttagtttgcgtagtcgtgtggcgacgttgaaaggcgttgacgttaatattttgtaataggtgcgtgaaaatttgtcgttgatgttaggtttaacgtaattggtgtttaagttggaaacgttgggttggaaagtggcgattgttttcggcggttttattttttttgttgaatatttgcgcgataagttgcgtttgatcgtcgt

SEQ ID NO: 6496 - DNA, 1198 bp, Artificial Sequence
  chemically treated genomic DNA (Homo sapiens) CpG-island No: 6496
acgacgatcaaacgcaacttatcgcgcaaatattcaacaaaaaaaataaaaccgccgaaaacaatcgccactttccaacccaacgtttccaacttaaacaccaattacgttaaacctaacatcaacgacaaattttcacgcacctattacaaaatattaacgtcaacgcctttcaacgtcgccacacgactacgcaaactaacgataaaatcgaattcgccgcgcatcgcccgttcgattacttccgccaccatctcgcccgttccgaccaatttaacaatttcatcaatacattcaatctaaataacgataaaatccatatccatcaccaacaaacccgacgtacgcaaatacgaaattttccccaacgaaacgacatccaactacgcttcgtaaaccaaacgtataacccgtacgataaataaacctaccaaacgaatcacctaataatcttccacgcaccaaacgacaacaatcaccatcgccgcacccaatttactctaatattaaatcaaacgttatttatccaacccacgaccatacaacaaccaaccgctacgacctacgtaaaatccaataaatcacttttcaccacttataaaaaaccgcccgaacataaaaacatctctacaaacgacccaatatattacatttttccgacccgcccatatacgacgcaatatacgaatatacacgcaacgaattctaacaatccttataacgcataacgcgactaaactcatactaattaaattccgctataacgcccgacaacaacgaatactaaattttacgtttcgcttcgtcttcgataaaacccgccatatacaaaccgattaacccgacgatacacaacaccaaatctacccaatccaacgccttatcaaataccaacaacgaatcgctttctccgatcaacgcttcgacttcatcttcgttcatcgcaaaaataaaaacgtaatctttaaaaaattactaccaccactacgaattctcgacaataacaaacttaatacccaacgtcaacaccaccgatacgttatatttcttcgcgtactcaataactttcataattacttccgacataaattcacccgacttacaacgcaccaaatataaaataaaaaccaataccgaaactccgacaatcacatcttccgaaatactttcaacccgcaactaattcatataacctaaa

SEQ ID NO: 6497 - DNA, 658 bp, Artificial Sequence
  chemically treated genomic DNA (Homo sapiens) CpG-island No: 6497
ggtagagatatcggtaattatcggtataattggaaggttgtcgattagaattataaattcgttgacgaagttatcgtgttaggtattttaaggcgtggtcgtcgtaaagattagcgatagtgttggtagttttttatttgtttttatagatcgtttattatgcgtatgttcggggtatggatacgtttataaagttgatttaaaagaataaataggatttcgtcgtcgataaatcgtgcgtaattatttggattatcgcgttttggtaggttaattggttgtcggtgagatagtaattagtacgaagtttatgtgggaaatcgaggtgtaggcgattagacgtttgatatcggtttgggcgaaggttatttacgtatcgtagaagatgtcgataatatttagttatatagtaattggcgcgaattttgtcgacgcgttcgggaatagcggtagggagaaacgtagtaaatcgtaagcggtagtttttagtaagattttcgcgaggttaacggaatcggcggtcggagtttgggagtgcgtattcggtagttagttatgtagcggaattatcggtattttgattgcgaaggcgatgaagaagtttagtattaataggtattttatattattggatattggcgtatttagtagtttttta

SEQ ID NO: 6498 - DNA, 658 bp, Artificial Sequence
  chemically treated genomic DNA (Homo sapiens) CpG-island No: 6498
taaaaaactactaaatacgccaatatccaataatataaaatacctattaatactaaacttcttcatcgccttcgcaatcaaaataccgataattccgctacataactaactaccgaatacgcactcccaaactccgaccgccgattccgttaacctcgcgaaaatcttactaaaaactaccgcttacgatttactacgtttctccctaccgctattcccgaacgcgtcgacaaaattcgcgccaattactatataactaaatattatcgacatcttctacgatacgtaaataaccttcgcccaaaccgatatcaaacgtctaatcgcctacacctcgatttcccacataaacttcgtactaattactatctcaccgacaaccaattaacctaccaaaacgcgataatccaaataattacgcacgatttatcgacgacgaaatcctatttattcttttaaatcaactttataaacgtatccataccccgaacatacgcataataaacgatctataaaaacaaataaaaaactaccaacactatcgctaatctttacgacgaccacgccttaaaatacctaacacgataacttcgtcaacgaatttataattctaatcgacaaccttccaattataccgataattaccgatatctctacc

SEQ ID NO: 6499 - DNA, 658 bp, Artificial Sequence
  chemically treated genomic DNA (Homo sapiens) CpG-island No: 6499
tgaagagttgttgaatacgttaatgtttagtggtgtggaatatttgttaatgttgggtttttttatcgttttcgtagttaaaatgtcggtggtttcgttgtatggttggttgtcggatgcgtatttttaggtttcgatcgtcggtttcgttgatttcgcggggattttgttgaaaattgtcgtttacggtttgttgcgtttttttttgtcgttgttttcgaacgcgtcggtagagttcgcgttaattgttatgtggttgggtgttatcggtattttttacggtgcgtggatggttttcgtttagatcgatattaaacgtttgatcgtttatatttcggttttttatatgggtttcgtgttgattgttattttatcggtagttagttggtttattagggcgcggtaatttagatgattgcgtacggtttgtcggcggcggggttttgtttatttttttgggttagttttatgaacgtatttatatttcggatatgcgtatgatgggcggtttgtgggagtagatgaaaggttgttagtattgtcgttgatttttgcggcggttacgttttggaatgtttggtacggtaatttcgttagcgaatttatgattttggtcggtagttttttagttgtatcggtgattatcggtatttttatt

SEQ ID NO: 6500 - DNA, 658 bp, Artificial Sequence
  chemically treated genomic DNA (Homo sapiens) CpG-island No: 6500
aataaaaataccgataatcaccgatacaactaaaaaactaccgaccaaaatcataaattcgctaacgaaattaccgtaccaaacattccaaaacgtaaccgccgcaaaaatcaacgacaatactaacaacctttcatctactcccacaaaccgcccatcatacgcatatccgaaatataaatacgttcataaaactaacccaaaaaaataaacaaaaccccgccgccgacaaaccgtacgcaatcatctaaattaccgcgccctaataaaccaactaactaccgataaaataacaatcaacacgaaacccatataaaaaaccgaaatataaacgatcaaacgtttaatatcgatctaaacgaaaaccatccacgcaccgtaaaaaataccgataacacccaaccacataacaattaacgcgaactctaccgacgcgttcgaaaacaacgacaaaaaaaaacgcaacaaaccgtaaacgacaattttcaacaaaatccccgcgaaatcaacgaaaccgacgatcgaaacctaaaaatacgcatccgacaaccaaccatacaacgaaaccaccgacattttaactacgaaaacgataaaaaaacccaacattaacaaatattccacaccactaaacattaacgtattcaacaactcttca

SEQ ID NO: 6501 - DNA, 557 bp, Artificial Sequence
  chemically treated genomic DNA (Homo sapiens) CpG-island No: 6501
  misc_feature (227)..(227): n is either a, c, g or t
atcgatagttcgttggaagaagttgttgcgttggatggtgcgatatcgtggtaggtttttcgttttgttttgttgtcgttgttagtatcgattttggcggtggtatttattttgtcggttatcgttgttattattgaagtttcggtcgcgtcgtttgtattgcgtgacgtaaatagttatattttggtcggggggatgtagtaatattttaattcgtaaaattattntgtggggtgatttttgtcgtcgttgtcgtgatgtttgtattatcgattaatattcgttttttgttggtttaacgttggttgggtaatcgttttgacggaaggtggtgttagtttattagttattaggatgaaatcggtattaaaacgttgggcgaaatttttacggtcgatattttcgttttgatcgcgtagttcgtcgtagaattttagacgtttgagcgaattatcgtcgtatattataaattgaatgcgttgttgttagtcgagcgttagtttagttattattttttcggttttaatgtgattggtgattttttcgttggttagatt

SEQ ID NO: 6502 - DNA, 557 bp, Artificial Sequence
  chemically treated genomic DNA (Homo sapiens) CpG-island No: 6502
  misc_feature (331)..(331): n is either a, c, g or t
aatctaaccaacgaaaaaatcaccaatcacattaaaaccgaaaaaataataactaaactaacgctcgactaacaacaacgcattcaatttataatatacgacgataattcgctcaaacgtctaaaattctacgacgaactacgcgatcaaaacgaaaatatcgaccgtaaaaatttcgcccaacgttttaataccgatttcatcctaataactaataaactaacaccaccttccgtcaaaacgattacccaaccaacgttaaaccaacaaaaaacgaatattaatcgataatacaaacatcacgacaacgacgacaaaaatcaccccacanaataattttacgaattaaaatattactacatccccccgaccaaaatataactatttacgtcacgcaatacaaacgacgcgaccgaaacttcaataataacaacgataaccgacaaaataaataccaccgccaaaatcgatactaacaacgacaacaaaacaaaacgaaaaacctaccacgatatcgcaccatccaacgcaacaacttcttccaacgaactatcgat

SEQ ID NO: 6503 - DNA, 557 bp, Artificial Sequence
  chemically treated genomic DNA (Homo sapiens) CpG-island No: 6503
  misc_feature (331)..(331): n is either a, c, g or t
gatttgattagcgaagagattattaattatattgaagtcggaaaagtggtgattaaattggcgttcgattggtagtagcgtatttagtttgtgatgtgcgacgatggttcgtttaagcgtttgaagttttgcgacgagttgcgcgattaaaacgaagatatcgatcgtgaagatttcgtttagcgttttgatgtcgattttattttgatgattggtgaattggtattatttttcgttaaggcggttgtttagttagcgttgagttagtaagaagcgaatgttgatcggtaatgtagatattacggtagcggcggtaaaagttattttatanggtagttttgcgggttgaggtattgttgtattttttcggttagggtgtagttgtttacgttacgtagtataagcgacgcgatcggaattttagtaatggtagcgataatcgataggatgaatattatcgttagaatcggtattgatagcggtaataggataaggcggaaggtttgttacggtgtcgtattatttagcgtagtagttttttttagcgaattgtcgat

SEQ ID NO: 6504 - DNA, 557 bp, Artificial Sequence
  chemically treated genomic DNA (Homo sapiens) CpG-island No: 6504
  misc_feature (227)..(227): n is either a, c, g or t
atcgacaattcgctaaaaaaaactactacgctaaataatacgacaccgtaacaaaccttccgccttatcctattaccgctatcaataccgattctaacgataatattcatcctatcgattatcgctaccattactaaaattccgatcgcgtcgcttatactacgtaacgtaaacaactacaccctaaccgaaaaaatacaacaatacctcaacccgcaaaactaccntataaaataacttttaccgccgctaccgtaatatctacattaccgatcaacattcgcttcttactaactcaacgctaactaaacaaccgccttaacgaaaaataataccaattcaccaatcatcaaaataaaatcgacatcaaaacgctaaacgaaatcttcacgatcgatatcttcgttttaatcgcgcaactcgtcgcaaaacttcaaacgcttaaacgaaccatcgtcgcacatcacaaactaaatacgctactaccaatcgaacgccaatttaatcaccacttttccgacttcaatataattaataatctcttcgctaatcaaatc

SEQ ID NO: 6505 - DNA, 801 bp, Artificial Sequence
  chemically treated genomic DNA (Homo sapiens) CpG-island No: 6505
agcgttgtgcgtttattgtagaatttattggcgcgattttttattgtgttttaaggtcgggttggtgatcgggaattttattgttggcgtgcgttattaggcgcgggtagttcgttatcgcgagtaacgtatacggtatttatatgaaatgtcgaaagttttggcggtgggtcgtagttcgtaggatatcgttgttattagcgaataatttattgtttttacgttttatgttcgtagttaggtgttgttgttcgatgataacggtaaattgtagtcgttaatatattcgtaaggaatgacgtcgtgggacgatgttatcgcgtagtggagttttgataaaggtttgtttgcgggcgcgggtatcgatacgttattcggtgtatcgtattagattttgtcgttaaaaagcggcgagaaaatttacgggttggtggtggtggagtcggggaatttgcgttagttgatgatttcggaatagtagcgtttgttggagacgtttacgttgttagtcgttaatgtttttgagcggttgacgttaatcgttagcgaagaataggcgcggatggtaagcgaacgtgaatagattcgtaacgttttgttggcggcgttttcgtatgatttacgtacgtcgtttacggtgttgtttggttaggtagaaattttaacgttcgatttggtaagcgaaggattattttacgttcgttaggttagcgagattcgttagtatgtgttgaatattattcgattggtgaataatttattggatatggcgcgaatttagttcggcggttttaatttgaa

SEQ ID NO: 6506 - DNA, 801 bp, Artificial Sequence
  chemically treated genomic DNA (Homo sapiens) CpG-island No: 6506
ttcaaattaaaaccgccgaactaaattcgcgccatatccaataaattattcaccaatcgaataatattcaacacatactaacgaatctcgctaacctaacgaacgtaaaataatccttcgcttaccaaatcgaacgttaaaatttctacctaaccaaacaacaccgtaaacgacgtacgtaaatcatacgaaaacgccgccaacaaaacgttacgaatctattcacgttcgcttaccatccgcgcctattcttcgctaacgattaacgtcaaccgctcaaaaacattaacgactaacaacgtaaacgtctccaacaaacgctactattccgaaatcatcaactaacgcaaattccccgactccaccaccaccaacccgtaaattttctcgccgctttttaacgacaaaatctaatacgatacaccgaataacgtatcgatacccgcgcccgcaaacaaacctttatcaaaactccactacgcgataacatcgtcccacgacgtcattccttacgaatatattaacgactacaatttaccgttatcatcgaacaacaacacctaactacgaacataaaacgtaaaaacaataaattattcgctaataacaacgatatcctacgaactacgacccaccgccaaaactttcgacatttcatataaataccgtatacgttactcgcgataacgaactacccgcgcctaataacgcacgccaacaataaaattcccgatcaccaacccgaccttaaaacacaataaaaaatcgcgccaataaattctacaataaacgcacaacgct

SEQ ID NO: 6507 - DNA, 801 bp, Artificial Sequence
  chemically treated genomic DNA (Homo sapiens) CpG-island No: 6507
tttaaattaaagtcgtcggattgaattcgcgttatatttagtagattatttattagtcgggtagtgtttagtatatgttgacggatttcgttggtttggcgggcgtggggtgatttttcgtttgttagatcgagcgttaagatttttgtttgattaaatagtatcgtaagcggcgtgcgtaaattatgcgaaagcgtcgttagtagggcgttgcggatttgtttacgttcgtttgttattcgcgtttgtttttcgttggcggttagcgttagtcgtttaagggtattggcgattaatagcgtaaacgtttttagtaggcgttgttgtttcgggattattaattggcgtagatttttcggttttattattattagttcgtaggttttttcgtcgttttttagcggtaaaatttggtacggtatatcgggtaacgtgtcggtgttcgcgttcgtaggtaggtttttattaaaattttattgcgcgatggtatcgttttacggcgttattttttgcggatgtgttaacggttgtaatttatcgttgttatcgggtaataatatttgattgcgggtatgaaacgtggaggtaataaattgttcgttggtggtagcgatattttgcggattgcggtttatcgttagagttttcgatattttatataagtgtcgtgtgcgttgttcgcggtaacgggttattcgcgtttgataacgtacgttagtagtaaggttttcgattattagttcgattttagagtatagtagaaggtcgcgttagtgagttttgtaatgaacgtataacgtt

SEQ ID NO: 6508 - DNA, 801 bp, Artificial Sequence
  chemically treated genomic DNA (Homo sapiens) CpG-island No: 6508
aacgttatacgttcattacaaaactcactaacgcgaccttctactatactctaaaatcgaactaataatcgaaaaccttactactaacgtacgttatcaaacgcgaataacccgttaccgcgaacaacgcacacgacacttatataaaatatcgaaaactctaacgataaaccgcaatccgcaaaatatcgctaccaccaacgaacaatttattacctccacgtttcatacccgcaatcaaatattattacccgataacaacgataaattacaaccgttaacacatccgcaaaaaataacgccgtaaaacgataccatcgcgcaataaaattttaataaaaacctacctacgaacgcgaacaccgacacgttacccgatataccgtaccaaattttaccgctaaaaaacgacgaaaaaacctacgaactaataataataaaaccgaaaaatctacgccaattaataatcccgaaacaacaacgcctactaaaaacgtttacgctattaatcgccaatacccttaaacgactaacgctaaccgccaacgaaaaacaaacgcgaataacaaacgaacgtaaacaaatccgcaacgccctactaacgacgctttcgcataatttacgcacgccgcttacgatactatttaatcaaacaaaaatcttaacgctcgatctaacaaacgaaaaatcaccccacgcccgccaaaccaacgaaatccgtcaacatatactaaacactacccgactaataaataatctactaaatataacgcgaattcaatccgacgactttaatttaaa

SEQ ID NO: 6509 - DNA, 687 bp, Artificial Sequence
  chemically treated genomic DNA (Homo sapiens) CpG-island No: 6509
  misc_feature (534)..(534): n is either a, c, g or t
  misc_feature (673)..(673): n is either a, c, g or t
  misc_feature (683)..(683): n is either a, c, g or t
gtttattttaatgcggttagttgtatatcgttaatattacgacgtttacgacgcggacgatttttaggttattacgcgggttacggtcgttacgatcgcgcggattacggttattcggttacggaatttacgtttcggacgtatcggcgtatttggcggtacgatagagtacgtttattttgtgttatttttagtagtgtcgtagttagagttcgagaattagtttttttaattttataagtcggttgaatttggttaataggggtcggatatattttaattttggttttatcgggggggatttaaacgggaatttttacggggtgggtataaatcggtggtagaatttcgaaagagatttaattagagggaggacgtaatttaatcgggtaaataagagcgtcggacgtcgggtcggcgatacgattataatttcgatgaatacgacgttttatcgtacggcggagagaagtatattttaaaagattcgtaaataataggtttaatttagatttttttttatattatcgaagngttatttttttttaggttatacggtcgacgtttttttcggtcggagttgtatcggtgtgtaaaatatattttttggaattaataatgcgtagtttattattcgggtaagatttgcgttttatcgaggttattcgttttnggtaatatgntggt

SEQ ID NO: 6510 - DNA, 687 bp, Artificial Sequence
  chemically treated genomic DNA (Homo sapiens) CpG-island No: 6510
  misc_feature (5)..(5): n is either a, c, g or t
  misc_feature (15)..(15): n is either a, c, g or t
  misc_feature (154)..(154): n is either a, c, g or t
accancatattaccnaaaacgaataacctcgataaaacgcaaatcttacccgaataataaactacgcattattaattccaaaaaatatattttacacaccgatacaactccgaccgaaaaaaacgtcgaccgtataacctaaaaaaaaataacncttcgataatataaaaaaaaatctaaattaaacctattatttacgaatcttttaaaatatacttctctccgccgtacgataaaacgtcgtattcatcgaaattataatcgtatcgccgacccgacgtccgacgctcttatttacccgattaaattacgtcctccctctaattaaatctctttcgaaattctaccaccgatttatacccaccccgtaaaaattcccgtttaaatcccccccgataaaaccaaaattaaaatatatccgacccctattaaccaaattcaaccgacttataaaattaaaaaaactaattctcgaactctaactacgacactactaaaaataacacaaaataaacgtactctatcgtaccgccaaatacgccgatacgtccgaaacgtaaattccgtaaccgaataaccgtaatccgcgcgatcgtaacgaccgtaacccgcgtaataacctaaaaatcgtccgcgtcgtaaacgtcgtaatattaacgatatacaactaaccgcattaaaataaac

SEQ ID NO: 6511 - DNA, 687 bp, Artificial Sequence
  chemically treated genomic DNA (Homo sapiens) CpG-island No: 6511
  misc_feature (5)..(5): n is either a, c, g or t
  misc_feature (15)..(15): n is either a, c, g or t
  misc_feature (154)..(154): n is either a, c, g or t
attantatattattnggagcgaatgatttcggtggaacgtagattttattcgagtggtaggttgcgtattgttggttttaggaggtgtattttgtatatcggtataatttcgatcgaaaaaagcgtcggtcgtatgatttgaaaaagggtggtntttcggtggtgtgagggggggtttgggttgggtttgttgtttgcgggttttttggggtgtgttttttttcgtcgtgcggtagggcgtcgtgtttatcggggttgtagtcgtgtcgtcggttcggcgttcggcgtttttgtttgttcggttgggttgcgttttttttttagttaggtttttttcgagattttgttatcggtttgtgtttatttcgtggaaattttcgtttaagtttttttcggtggaattaggattgggatatattcggtttttgttgattaaatttagtcgatttgtgaagttgaaagagttgattttcgaattttggttgcggtattgttgaaaatggtatagggtgaacgtattttgtcgtatcgttagatgcgtcgatgcgttcgaaacgtgaatttcgtgatcggatgatcgtggttcgcgcgatcgtaacgatcgtggttcgcgtggtgatttgaagatcgttcgcgtcgtgaacgtcgtgatgttggcgatatgtagttgatcgtattgaagtgggt

SEQ ID NO: 6512 - DNA, 687 bp, Artificial Sequence
  chemically treated genomic DNA (Homo sapiens) CpG-island No: 6512
  misc_feature (534)..(534): n is either a, c, g or t
  misc_feature (673)..(673): n is either a, c, g or t
  misc_feature (683)..(683): n is either a, c, g or t
acccacttcaatacgatcaactacatatcgccaacatcacgacgttcacgacgcgaacgatcttcaaatcaccacgcgaaccacgatcgttacgatcgcgcgaaccacgatcatccgatcacgaaattcacgtttcgaacgcatcgacgcatctaacgatacgacaaaatacgttcaccctataccattttcaacaataccgcaaccaaaattcgaaaatcaactctttcaacttcacaaatcgactaaatttaatcaacaaaaaccgaatatatcccaatcctaattccaccgaaaaaaacttaaacgaaaatttccacgaaataaacacaaaccgataacaaaatctcgaaaaaaacctaactaaaaaaaaaacgcaacccaaccgaacaaacaaaaacgccgaacgccgaaccgacgacacgactacaaccccgataaacacgacgccctaccgcacgacgaaaaaaaacacaccccaaaaaacccgcaaacaacaaacccaacccaaaccccccctcacaccaccgaaanaccaccctttttcaaatcatacgaccgacgcttttttcgatcgaaattataccgatatacaaaatacacctcctaaaaccaacaatacgcaacctaccactcgaataaaatctacgttccaccgaaatcattcgctccnaataatatantaat

SEQ ID NO: 6513 - DNA, 1174 bp, Artificial Sequence
  chemically treated genomic DNA (Homo sapiens) CpG-island No: 6513
  misc_feature (403)..(403): n is either a, c, g or t
  misc_feature (445)..(445): n is either a, c, g or t
  misc_feature (561)..(561): n is either a, c, g or t
  misc_feature (726)..(726): n is either a, c, g or t
  misc_feature (809)..(810): n is either a, c, g or t
aggtcgatgtgaatagttgtttcgcgtgttacgtgggcgttgaggacggaggtaacgagattggagtttatttagggcggggaggtggtagcgttgcgcggacgtcgggagaacgtcgattagggagaaggtcgattagggagaacgtaagttcgagcgtttaattaggtgggggtggtacgttattaggtcgatttttattaacgggtaaagcggacgtttacgattcggttaagcgtttagtagaatttgtcggcgtatttatatggagcggcgtatcgtatgcggtacgtggttttttgttatgatcgttacgataatatcgttaattagacgcgtagcggttggtatttcgttgttcgtatcgtatttgtattatgcggcgatggttcgcgcgttagtngtggatgttcgtttttgcgacgtttcgcggttagtcgtattnttaggtcgttaaagttgcggatgaggtatggtcggagtaaattataataggtatatcggagacggtgaacggttagttttgtaatgtgtattaataattcgtcgacggttcggaangagtatcggatagcggtagatttaataatagcgggcgcgatagtattaatttagttacgataatcggcgcgtgagatagttagtttagttttagtgcgcgttgcgtggttgtttcgcgatcgtagtttgagtacgttattagaatcgtgtgaggtatgatatttngtgagcgtagcgatataagatttggttggcgcgtcgtttaggagtagtcgcgagtttcgcgacgttcgtagttattgttgaanntatttaaggagtaaaatcggttacggtatatttgtagaaggtttaaatacgttatcggaagcgttttggattaacgtcgtcgtgggtcgttcggtaggggttagtcggtagatggtcgaattaatttttacgtcgggttaggggttaatttggatgggtattttcggtcggtcggatgtttattggaaggaatttattatattcgtatattgtacgcggattattcggtatgcgcgtatcgtcgcgtgataaatcgcgcgagtcgtcgttcgaaaatttattttggtacgtgtaacgtcggtttattgcgagcgttcgttagtagttagatatatggatgtttaggagagtaaattaataaaga

SEQ ID NO: 6514 - DNA, 1174 bp, Artificial Sequence
  chemically treated genomic DNA (Homo sapiens) CpG-island No: 6514
  misc_feature (365)..(366): n is either a, c, g or t
  misc_feature (449)..(449): n is either a, c, g or t
  misc_feature (614)..(614): n is either a, c, g or t
  misc_feature (730)..(730): n is either a, c, g or t
  misc_feature (772)..(772): n is either a, c, g or t
tctttattaatttactctcctaaacatccatatatctaactactaacgaacgctcgcaataaaccgacgttacacgtaccaaaataaattttcgaacgacgactcgcgcgatttatcacgcgacgatacgcgcataccgaataatccgcgtacaatatacgaatataataaattccttccaataaacatccgaccgaccgaaaatacccatccaaattaacccctaacccgacgtaaaaattaattcgaccatctaccgactaacccctaccgaacgacccacgacgacgttaatccaaaacgcttccgataacgtatttaaaccttctacaaatataccgtaaccgattttactccttaaatannttcaacaataactacgaacgtcgcgaaactcgcgactactcctaaacgacgcgccaaccaaatcttatatcgctacgctcacnaaatatcatacctcacacgattctaataacgtactcaaactacgatcgcgaaacaaccacgcaacgcgcactaaaactaaactaactatctcacgcgccgattatcgtaactaaattaatactatcgcgcccgctattattaaatctaccgctatccgatactcnttccgaaccgtcgacgaattattaatacacattacaaaactaaccgttcaccgtctccgatatacctattataatttactccgaccatacctcatccgcaactttaacgacctaanaatacgactaaccgcgaaacgtcgcaaaaacgaacatccacnactaacgcgcgaaccatcgccgcataatacaaatacgatacgaacaacgaaataccaaccgctacgcgtctaattaacgatattatcgtaacgatcataacaaaaaaccacgtaccgcatacgatacgccgctccatataaatacgccgacaaattctactaaacgcttaaccgaatcgtaaacgtccgctttacccgttaataaaaatcgacctaataacgtaccacccccacctaattaaacgctcgaacttacgttctccctaatcgaccttctccctaatcgacgttctcccgacgtccgcgcaacgctaccacctccccgccctaaataaactccaatctcgttacctccgtcctcaacgcccacgtaacacgcgaaacaactattcacatcgacct

SEQ ID NO: 6515 - DNA, 1174 bp, Artificial Sequence
  chemically treated genomic DNA (Homo sapiens) CpG-island No: 6515
  misc_feature (365)..(366): n is either a, c, g or t
  misc_feature (449)..(449): n is either a, c, g or t
  misc_feature (614)..(614): n is either a, c, g or t
  misc_feature (730)..(730): n is either a, c, g or t
  misc_feature (772)..(772): n is either a, c, g or t
tttttgttaatttgtttttttgagtatttatatgtttaattgttagcgaacgttcgtagtgaatcggcgttatacgtgttagggtaggttttcgggcggcgattcgcgcggtttgttacgcggcgatacgcgtatgtcgagtggttcgcgtataatgtacgggtatggtgggttttttttagtaagtattcgatcggtcgggaatgtttatttaggttggtttttagttcgacgtgagggttaattcggttatttatcggttggtttttatcggacgatttacgacgacgttagtttagaacgttttcggtgacgtatttgggttttttgtaggtgtatcgtgatcggttttattttttaggtanntttagtaatggttgcggacgtcgcgggattcgcggttatttttggacggcgcgttagttagattttgtgtcgttgcgtttatngggtgttatgttttatacggttttgatggcgtgtttaggttacggtcgcggagtagttacgtaacgcgtattaggattgggttagttattttacgcgtcgattgtcgtagttgggttagtattatcgcgttcgttgttgttaggtttatcgttattcgatgtttntttcgagtcgtcggcgggttgttggtgtatattgtagagttggtcgtttatcgttttcggtatatttattatggtttgtttcggttatgttttattcgtaattttagcggtttganggtacggttagtcgcgggacgtcgtaagggcgggtatttatngttggcgcgcgggttatcgtcgtatgatgtaggtacggtgcgggtaacggagtgttagtcgttacgcgtttggttaacggtattgtcgtggcggttatggtagaaggttacgtgtcgtatgcgatgcgtcgttttatatgggtgcgtcggtagattttgttaggcgtttgatcgggtcgtgggcgttcgttttgttcgttaataggggtcggtttggtggcgtgttatttttatttggttgggcgttcgggtttgcgttttttttggtcggttttttttttggtcggcgttttttcggcgttcgcgtagcgttgttattttttcgttttgggtaagttttagtttcgttgttttcgtttttagcgtttacgtggtacgcggggtagttatttatatcggttt

SEQ ID NO: 6516 - DNA, 1174 bp, Artificial Sequence
  chemically treated genomic DNA (Homo sapiens) CpG-island No: 6516
  misc_feature (403)..(403): n is either a, c, g or t
  misc_feature (445)..(445): n is either a, c, g or t
  misc_feature (561)..(561): n is either a, c, g or t
  misc_feature (726)..(726): n is either a, c, g or t
  misc_feature (809)..(810): n is either a, c, g or t
aaaccgatataaataactaccccgcgtaccacgtaaacgctaaaaacgaaaacaacgaaactaaaacttacccaaaacgaaaaaataacaacgctacgcgaacgccgaaaaaacgccgaccaaaaaaaaaaccgaccaaaaaaaacgcaaacccgaacgcccaaccaaataaaaataacacgccaccaaaccgacccctattaacgaacaaaacgaacgcccacgacccgatcaaacgcctaacaaaatctaccgacgcacccatataaaacgacgcatcgcatacgacacgtaaccttctaccataaccgccacgacaataccgttaaccaaacgcgtaacgactaacactccgttacccgcaccgtacctacatcatacgacgataacccgcgcgccaacnataaatacccgcccttacgacgtcccgcgactaaccgtaccntcaaaccgctaaaattacgaataaaacataaccgaaacaaaccataataaatataccgaaaacgataaacgaccaactctacaatatacaccaacaacccgccgacgactcgaaanaaacatcgaataacgataaacctaacaacaacgaacgcgataatactaacccaactacgacaatcgacgcgtaaaataactaacccaatcctaatacgcgttacgtaactactccgcgaccgtaacctaaacacgccatcaaaaccgtataaaacataacacccnataaacgcaacgacacaaaatctaactaacgcgccgtccaaaaataaccgcgaatcccgcgacgtccgcaaccattactaaanntacctaaaaaataaaaccgatcacgatacacctacaaaaaacccaaatacgtcaccgaaaacgttctaaactaacgtcgtcgtaaatcgtccgataaaaaccaaccgataaataaccgaattaaccctcacgtcgaactaaaaaccaacctaaataaacattcccgaccgatcgaatacttactaaaaaaaacccaccatacccgtacattatacgcgaaccactcgacatacgcgtatcgccgcgtaacaaaccgcgcgaatcgccgcccgaaaacctaccctaacacgtataacgccgattcactacgaacgttcgctaacaattaaacatataaatactcaaaaaaacaaattaacaaaaa

SEQ ID NO: 6517 - DNA, 602 bp, Artificial Sequence
  chemically treated genomic DNA (Homo sapiens) CpG-island No: 6517
acgtcgtattatttttttttatcggattcgtttgaacgtaatttgggcgttttcgtaaaacgtcgaacgaaggtacgttgttttatggtttggtgaggatggtaacgatatgtgggacgttatttttttttgcggtttttgtgcgtgattcgtcgtaagtcgttggatgaaattggcggtattgttgtcgaaacgtgattgaagatgcgtatatttttttgcggttgtatcgtcgtggttatttttcgcgtatatgcgtatttcgtaggcggcggggttggcgatcgaaagttgtcggcgtatatcggttagcgtattcgttgggcgcgcgggatggtataatttttcgtttcgataattcgtttatcggtaaagggttgaagtttgttagcggttatgttacgttaacgttatgttttattttttgtcgggtattttcggttgatttttttgattgcgtcgttggcgtttttgttgttttatgttttattatttatgcgtttagcgttgatgtatcgttttattcgtgttgtcgttatgattttatgtatagttttgtattaatttttaagattttagggttattttatcgttattttttt

SEQ ID NO: 6518 - DNA, 602 bp, Artificial Sequence
  chemically treated genomic DNA (Homo sapiens) CpG-island No: 6518
aaaaaaataacgataaaataaccctaaaatcttaaaaattaatacaaaactatacataaaatcataacgacaacacgaataaaacgatacatcaacgctaaacgcataaataataaaacataaaacaacaaaaacgccaacgacgcaatcaaaaaaatcaaccgaaaatacccgacaaaaaataaaacataacgttaacgtaacataaccgctaacaaacttcaaccctttaccgataaacgaattatcgaaacgaaaaattataccatcccgcgcgcccaacgaatacgctaaccgatatacgccgacaactttcgatcgccaaccccgccgcctacgaaatacgcatatacgcgaaaaataaccacgacgatacaaccgcaaaaaaatatacgcatcttcaatcacgtttcgacaacaataccgccaatttcatccaacgacttacgacgaatcacgcacaaaaaccgcaaaaaaaaataacgtcccacatatcgttaccatcctcaccaaaccataaaacaacgtaccttcgttcgacgttttacgaaaacgcccaaattacgttcaaacgaatccgataaaaaaaaataatacgacgt

SEQ ID NO: 6519 - DNA, 602 bp, Artificial Sequence
  chemically treated genomic DNA (Homo sapiens) CpG-island No: 6519
gaaagagtggcgatgaggtggttttgggattttgggagttggtgtagggttgtgtatgggattatagcggtagtacgaatagggcgatgtattaacgttgggcgtatagatgatgaggtatgaagtagtaggaacgttagcggcgtagttaggaagattagtcgggaatgttcgataagaagtggaatatggcgttgacgtaatatagtcgttagtaaattttagttttttatcggtgagcgggttatcgagacggaagattgtattatttcgcgcgtttagcgaatacgttgatcgatatgcgtcgatagttttcggtcgttagtttcgtcgtttgcggaatacgtatatacgcggaggatagttacgacggtgtaatcgtagagaagtatgcgtatttttagttacgtttcgatagtaatgtcgttaattttatttagcggtttacgacgaattacgtataggaatcgtagaagaaagtggcgttttatatatcgttgttatttttattagattatagaatagcgtgttttcgttcggcgttttacggaaacgtttaggttgcgtttaaacgggttcggtgagaagaagtggtgcggcgt

SEQ ID NO: 6520 - DNA, 602 bp, Artificial Sequence
  chemically treated genomic DNA (Homo sapiens) CpG-island No: 6520
acgccgcaccacttcttctcaccgaacccgtttaaacgcaacctaaacgtttccgtaaaacgccgaacgaaaacacgctattctataatctaataaaaataacaacgatatataaaacgccactttcttctacgattcctatacgtaattcgtcgtaaaccgctaaataaaattaacgacattactatcgaaacgtaactaaaaatacgcatacttctctacgattacaccgtcgtaactatcctccgcgtatatacgtattccgcaaacgacgaaactaacgaccgaaaactatcgacgcatatcgatcaacgtattcgctaaacgcgcgaaataatacaatcttccgtctcgataacccgctcaccgataaaaaactaaaatttactaacgactatattacgtcaacgccatattccacttcttatcgaacattcccgactaatcttcctaactacgccgctaacgttcctactacttcatacctcatcatctatacgcccaacgttaatacatcgccctattcgtactaccgctataatcccatacacaaccctacaccaactcccaaaatcccaaaaccacctcatcgccactctttc

SEQ ID NO: 6521 - DNA, 589 bp, Artificial Sequence
  chemically treated genomic DNA (Homo sapiens) CpG-island No: 6521
cgttcggcgtatcgattggttcgaattagggattggaaatcgcgttatgttggagattattatttagtaggttatagtgtcggtggttgtgatgttggtatcggcgtttttagttatatcgcgtaggcgattggaaatggggtcgacgcggtgttagtgaatacggcgattgtcgtcgcggacgattcgttaatatggcgaaggtatttcgtttggcggtagaagtaggtttattggacgttagttcggatcgggtagtcgtagatattttgtttatgttattagtcgttgatcggatttttggaggtatcggtatgaaaatttttagcgatcgcggcgataattggattgggacgatattcgtttgcgtattaacggtaaaacgttgttgacgtagagcgggcgttaaatgtttcgtaatttattcgcgacgtatgatggcgttgttatcgtttgtcgttagtggttatttggaataattgtttaacgggcgtagcgtttgattcgttagcgatttggtaatatagttagttttacgtttcgttttatttttttaatttttgcgttaacgattgtacgtttgtggatt

SEQ ID NO: 6522 - DNA, 589 bp, Artificial Sequence
  chemically treated genomic DNA (Homo sapiens) CpG-island No: 6522
aatccacaaacgtacaatcgttaacgcaaaaattaaaaaaataaaacgaaacgtaaaactaactatattaccaaatcgctaacgaatcaaacgctacgcccgttaaacaattattccaaataaccactaacgacaaacgataacaacgccatcatacgtcgcgaataaattacgaaacatttaacgcccgctctacgtcaacaacgttttaccgttaatacgcaaacgaatatcgtcccaatccaattatcgccgcgatcgctaaaaattttcataccgatacctccaaaaatccgatcaacgactaataacataaacaaaatatctacgactacccgatccgaactaacgtccaataaacctacttctaccgccaaacgaaataccttcgccatattaacgaatcgtccgcgacgacaatcgccgtattcactaacaccgcgtcgaccccatttccaatcgcctacgcgatataactaaaaacgccgataccaacatcacaaccaccgacactataacctactaaataataatctccaacataacgcgatttccaatccctaattcgaaccaatcgatacgccgaacg

SEQ ID NO: 6523 - DNA, 589 bp, Artificial Sequence
  chemically treated genomic DNA (Homo sapiens) CpG-island No: 6523
aatttatagacgtgtagtcgttagcgtaaagattggaaagataaagcgggacgtagaattaattgtgttgttaaatcgttgacgggttagacgttgcgttcgttgggtagttgttttagatagttattggcggtaggcgataatagcgttattatgcgtcgcgggtgagttgcgaggtatttagcgttcgttttacgttagtagcgttttgtcgttgatacgtaggcggatgtcgttttagtttagttgtcgtcgcgatcgttgaaggtttttatgtcgatgtttttagaaattcggttagcggttggtggtatgagtaaaatatttgcggttgttcggttcggattgacgtttagtaggtttgtttttatcgttagacgaaatgttttcgttatgttgacggatcgttcgcgacggtaatcgtcgtatttattaatatcgcgtcggttttatttttagtcgtttgcgcggtatggttgggaacgtcgatgttagtattataattatcggtattgtggtttgttggataataatttttagtatggcgcggtttttagtttttgattcgagttaatcggtgcgtcgagcg

SEQ ID NO: 6524 - DNA, 589 bp, Artificial Sequence
  chemically treated genomic DNA (Homo sapiens) CpG-island No: 6524
cgctcgacgcaccgattaactcgaatcaaaaactaaaaaccgcgccatactaaaaattattatccaacaaaccacaataccgataattataatactaacatcgacgttcccaaccataccgcgcaaacgactaaaaataaaaccgacgcgatattaataaatacgacgattaccgtcgcgaacgatccgtcaacataacgaaaacatttcgtctaacgataaaaacaaacctactaaacgtcaatccgaaccgaacaaccgcaaatattttactcataccaccaaccgctaaccgaatttctaaaaacatcgacataaaaaccttcaacgatcgcgacgacaactaaactaaaacgacatccgcctacgtatcaacgacaaaacgctactaacgtaaaacgaacgctaaatacctcgcaactcacccgcgacgcataataacgctattatcgcctaccgccaataactatctaaaacaactacccaacgaacgcaacgtctaacccgtcaacgatttaacaacacaattaattctacgtcccgctttatctttccaatctttacgctaacgactacacgtctataaatt

SEQ ID NO: 6525 - DNA, 737 bp, Artificial Sequence
  chemically treated genomic DNA (Homo sapiens) CpG-island No: 6525
  misc_feature (710)..(710): n is either a, c, g or t
  misc_feature (724)..(724): n is either a, c, g or t
taattcggcgagtagtcgggtatcgtcggtttgtggggatatttttttagcgttatcgttatttgagagcgtaaatttataattcgttttgtttcgggaataacgttaagaattgttttttcgtttgggtgcggtttgcgttatttgttcgttgacgttttataacgttacgtttcgttttattttagcgtaattagaattagtaatatcggtagaattattattcgttagcggtttattgttttcggtagttgacgcgaggttgttacggttttgttagtagttttttttcggttcgttataagtggtaatggcgggtagagttgtaacgttaggcgtttagcgtttgcgttagtttatgttgatagttttttcggtgtatgtcgattacggttagcgaaagcggtaaattttgtttattgagttggggcggaatatgatcggagttagcgttagttcggcgttttattttcggtattatcgatgcggtagataattcgttgcgtatcgtaagttataaatttataggaatggatatttagttcggcgcgacggtagcgcgggtgatgtcgttttttgtaattattgcgtaatgttgcgtatatgttgttggtgaattattgttcggttgttagttgttggtcgatatttaacggggcgaaatgtaggttattatattttgttttagttttttttttagtaagggcggngagaatatcggtangtacgacgatgga

SEQ ID NO: 6526 - DNA, 737 bp, Artificial Sequence
  chemically treated genomic DNA (Homo sapiens) CpG-island No: 6526
  misc_feature (14)..(14): n is either a, c, g or t
  misc_feature (28)..(28): n is either a, c, g or t
tccatcgtcgtacntaccgatattctcnccgcccttactaaaaaaaaaactaaaacaaaatataataacctacatttcgccccgttaaatatcgaccaacaactaacaaccgaacaataattcaccaacaacatatacgcaacattacgcaataattacaaaaaacgacatcacccgcgctaccgtcgcgccgaactaaatatccattcctataaatttataacttacgatacgcaacgaattatctaccgcatcgataataccgaaaataaaacgccgaactaacgctaactccgatcatattccgccccaactcaataaacaaaatttaccgctttcgctaaccgtaatcgacatacaccgaaaaaactatcaacataaactaacgcaaacgctaaacgcctaacgttacaactctacccgccattaccacttataacgaaccgaaaaaaaactactaacaaaaccgtaacaacctcgcgtcaactaccgaaaacaataaaccgctaacgaataataattctaccgatattactaattctaattacgctaaaataaaacgaaacgtaacgttataaaacgtcaacgaacaaataacgcaaaccgcacccaaacgaaaaaacaattcttaacgttattcccgaaacaaaacgaattataaatttacgctctcaaataacgataacgctaaaaaaatatccccacaaaccgacgatacccgactactcgccgaatta

SEQ ID NO: 6527 - DNA, 737 bp, Artificial Sequence
  chemically treated genomic DNA (Homo sapiens) CpG-island No: 6527
  misc_feature (14)..(14): n is either a, c, g or t
  misc_feature (28)..(28): n is either a, c, g or t
tttatcgtcgtgtntatcgatatttttntcgtttttattggaagaggagttgaagtaggatatgatgatttgtatttcgtttcgttgaatatcgattagtaattggtaatcgagtagtgatttattaatagtatatgcgtaatattgcgtagtggttgtagaaaacggtattattcgcgttatcgtcgcgtcggattggatgtttatttttgtgggtttatggtttgcgatgcgtaacgggttatttgtcgtatcgatgatgtcggggatggagcgtcgggttggcgttggtttcggttatgtttcgttttagtttaatgagtaggatttatcgttttcgttaatcgtagtcggtatgtatcggaaaagttattagtatgggttggcgtagacgttgaacgtttgacgttatagttttgttcgttattattatttatggcgaatcggaagggaattgttgatagggtcgtggtagtttcgcgttagttatcgaaaatagtgggtcgttggcgggtgatgattttgtcgatattgttgattttggttgcgttggagtggagcggggcgtgacgttatggagcgttagcgaataggtggcgtaagtcgtatttaggcggaggaatagtttttaacgttgttttcggagtagaacggattgtgaatttacgtttttaggtgacgatggcgttgaaaaaatatttttataggtcgacgatattcggttgttcgtcgagttg

SEQ ID NO: 6528 - DNA, 737 bp, Artificial Sequence
  chemically treated genomic DNA (Homo sapiens) CpG-island No: 6528
  misc_feature (710)..(710): n is either a, c, g or t
  misc_feature (724)..(724): n is either a, c, g or t
caactcgacgaacaaccgaatatcgtcgacctataaaaatattttttcaacgccatcgtcacctaaaaacgtaaattcacaatccgttctactccgaaaacaacgttaaaaactattcctccgcctaaatacgacttacgccacctattcgctaacgctccataacgtcacgccccgctccactccaacgcaaccaaaatcaacaatatcgacaaaatcatcacccgccaacgacccactattttcgataactaacgcgaaactaccacgaccctatcaacaattcccttccgattcgccataaataataataacgaacaaaactataacgtcaaacgttcaacgtctacgccaacccatactaataacttttccgatacataccgactacgattaacgaaaacgataaatcctactcattaaactaaaacgaaacataaccgaaaccaacgccaacccgacgctccatccccgacatcatcgatacgacaaataacccgttacgcatcgcaaaccataaacccacaaaaataaacatccaatccgacgcgacgataacgcgaataataccgttttctacaaccactacgcaatattacgcatatactattaataaatcactactcgattaccaattactaatcgatattcaacgaaacgaaatacaaatcatcatatcctacttcaactcctcttccaataaaaacganaaaaatatcgatanacacgacgataaa

SEQ ID NO: 6529 - DNA, 814 bp, Artificial Sequence
  chemically treated genomic DNA (Homo sapiens) CpG-island No: 6529
  misc_feature (266)..(266): n is either a, c, g or t
gtcgacgtcggaggttgtaggatttgcggtgaggtaatcgcgtttgtatataatagtattttttgttggtcgttgcgcgggttgggatggtgttgtcgttttttagttattgacgtttatcgcgcgtttgtcgttaaaaatgatgtgatcggttatagcggagtacgaatggttaggttaggacgcgatttggtttgatcgagatagttcgcgcggtgttggcgcgacggttttgcggcgtgacggtgcgatttatcgattaaaanttttttgttgataatcgttgagatcgttcgtgcgcgggtagtcgtttgtacgttcgttttaattatcgttttaaatagcggattgacgtcggtttggaggtagtgacgtttatcgggttattatcgtcgtgatagtcgttttatttatatcgcgagtttcgcgttttgcggtagtagggtaggtagttaggtagttttagttttttagatcgggtttttgcgtttagttatcgagattagcgtattgttacggatgtagtatatgtcgttgattagcgacgatttattagatttttatcgcgttcgtattttatgcggcggttatttataaacggttaggtttcgttttataggtttagttgtagcgtttattttgtagcgggatgttagggtagcgggtatttgggtgcggaagttaaagcgatagttcgggcgttcgttttaagtagtagtacggaggtattcggatttttagttagacggtagcgagaacgttgtcggttgagtcggtattaataatgatgtagttaattgtaaataaatttttt

SEQ ID NO: 6530 - DNA, 814 bp, Artificial Sequence
  chemically treated genomic DNA (Homo sapiens) CpG-island No: 6530
  misc_feature (549)..(549): n is either a, c, g or t
aaaaaatttatttacaattaactacatcattattaataccgactcaaccgacaacgttctcgctaccgtctaactaaaaatccgaatacctccgtactactacttaaaacgaacgcccgaactatcgctttaacttccgcacccaaatacccgctaccctaacatcccgctacaaaataaacgctacaactaaacctataaaacgaaacctaaccgtttataaataaccgccgcataaaatacgaacgcgataaaaatctaataaatcgtcgctaatcaacgacatatactacatccgtaacaatacgctaatctcgataactaaacgcaaaaacccgatctaaaaaactaaaactacctaactacctaccctactaccgcaaaacgcgaaactcgcgatataaataaaacgactatcacgacgataataacccgataaacgtcactacctccaaaccgacgtcaatccgctatttaaaacgataattaaaacgaacgtacaaacgactacccgcgcacgaacgatctcaacgattatcaacaaaaaanttttaatcgataaatcgcaccgtcacgccgcaaaaccgtcgcgccaacaccgcgcgaactatctcgatcaaaccaaatcgcgtcctaacctaaccattcgtactccgctataaccgatcacatcatttttaacgacaaacgcgcgataaacgtcaataactaaaaaacgacaacaccatcccaacccgcgcaacgaccaacaaaaaatactattatatacaaacgcgattacctcaccgcaaatcctacaacctccgacgtcgac

SEQ ID NO: 6531 - DNA, 814 bp, Artificial Sequence
  chemically treated genomic DNA (Homo sapiens) CpG-island No: 6531
  misc_feature (549)..(549): n is either a, c, g or t
aggaggtttatttgtaattgattatattattattggtgtcggtttagtcggtaacgttttcgttatcgtttgattgaagattcgaatattttcgtgttgttgtttgaagcgggcgttcggattatcgttttgattttcgtatttagatgttcgttgttttggtatttcgttatagggtaaacgttataattgggtttatgaaacggaatttgatcgtttatgaataatcgtcgtatggagtgcggacgcggtaaaggtttggtggatcgtcgttgattaacggtatgtgttatattcgtggtaatgcgttgatttcgataattgggcgtaagaattcggtttggagaattggagttatttgattgtttgttttattatcgtaaggcgcgagattcgcgatatgggtgaaacgattattacggcggtgatggttcggtgagcgttattatttttaaatcggcgttaattcgttgtttgaagcgatgattgaagcgggcgtgtaggcggttattcgcgtacggacgattttaacggttattagtaggaagnttttggtcgatggatcgtatcgttacgtcgtagggtcgtcgcgttagtatcgcgcgggttatttcgattaggttaaatcgcgttttaatttgattattcgtatttcgttatgatcgattatattatttttgacggtaaacgcgcggtgggcgttaatggttggaaggcgatagtattattttaattcgcgtaacggttaataagaagtgttgttatgtgtaggcgcgattgttttatcgtagattttgtaattttcggcgtcggt

SEQ ID NO: 6532 - DNA, 814 bp, Artificial Sequence
  chemically treated genomic DNA (Homo sapiens) CpG-island No: 6532
  misc_feature (266)..(266): n is either a, c, g or t
accgacgccgaaaattacaaaatctacgataaaacaatcgcgcctacacataacaacacttcttattaaccgttacgcgaattaaaataatactatcgccttccaaccattaacgcccaccgcgcgtttaccgtcaaaaataatataatcgatcataacgaaatacgaataatcaaattaaaacgcgatttaacctaatcgaaataacccgcgcgatactaacgcgacgaccctacgacgtaacgatacgatccatcgaccaaaancttcctactaataaccgttaaaatcgtccgtacgcgaataaccgcctacacgcccgcttcaatcatcgcttcaaacaacgaattaacgccgatttaaaaataataacgctcaccgaaccatcaccgccgtaataatcgtttcacccatatcgcgaatctcgcgccttacgataataaaacaaacaatcaaataactccaattctccaaaccgaattcttacgcccaattatcgaaatcaacgcattaccacgaatataacacataccgttaatcaacgacgatccaccaaacctttaccgcgtccgcactccatacgacgattattcataaacgatcaaattccgtttcataaacccaattataacgtttaccctataacgaaataccaaaacaacgaacatctaaatacgaaaatcaaaacgataatccgaacgcccgcttcaaacaacaacacgaaaatattcgaatcttcaatcaaacgataacgaaaacgttaccgactaaaccgacaccaataataatataatcaattacaaataaacctcct

SEQ ID NO: 6533 - DNA, 1765 bp, Artificial Sequence
  chemically treated genomic DNA (Homo sapiens) CpG-island No: 6533
tattggcgatcgttagcggggttataaataaattgtgttgcggaaatgtatttgtaacgtcgggaattgtttgcgaaatagtttcgttacgtcggttgtatataagagtcgttcgttagttataaattagtaatgttttgtttttaatatgtcgggcgataatgttcgttattttttcgtatatcggtttatcgtaggttaaatttttttatcgtgatcgcgtttgtattgtttcgtttttttagcgaaatacggcgattttcggcgagagttagagagatgtgatgtcgtcggtggttttattcgtcgagtacgttattttgtttttttttacgatgtaatgtcggtagtgtcgtcgtcgatatttattatatcggcgttgtttattgtagtagattcgtaattgcggttggtttatttagtatatggtttattttagttcggtagattttagtacgttgatggaaatacgcgggttcgtatcggaggaaatgaagtcgtcgtatggttaaaacgacgatcgaattgttgttgagcgtgtcgagatggcgacgaataatggtgatagcgtcgaagaaatttagacgatgtcgtcgcgaattatatcggtttagtcgaggtatatcgttacggttgatcgtcgcggtcgataaatatcgaaaatatatcgtaagtggttaatttaattttaggtatagcggggatatcgtcgcggggggcggttcggtgatcgcggtgttcgcgcgtgggatgatatatttcgagtttatatttattcgtattagtagttcgcgttatacggagttatagttattagtattatcggtaggttgatcggcgtttatatttcgtagcgaatttggatattcgtatttcgtatgttatagattcggtaggaatcgtttgttcgattcggagttgtattcggatagtatttttagtatgtgtcggataatcgtatcgttcgtgacgcgtattatttttatcggtatgacgttacggtaggttgatagagaaaatcgattttatttcggaaggggttatcgtacggatgatgagcggatttatcggtattattacgatagttagtatcgttggtgtattatacgcggatataatatgtagagtcgttggtcgaaagcgttatttttacgattcgttgggtcgtagggtggtaaaacgggtgtggcgcgtgaacgggatttgacgggttggatgtcgttgttacggaaatcgtaaggatttggtacggttgggacggcgatcggttgattacgatatagaacgacgaattcgtatttagacgatttattagtcggggagttttacgttatttatagggttgaaatcgttatcggtgagttggcgaaaacgtagcgtcgtagtcggcggatattttttagtagttcggcggcgaagacggtggtagtgtggtgtttcgtcggtgttggtgtagatgttcgatcggttggaaagtgaaattttgttgatcgggtgagtgaggaaagtcgtcgttggttggtatcgtgcggtcgacggtggagtagatgtaaaattagatggattcggtgtatacgtcggcggaaaaatttatttgtattattgcgattatcgcggtttgtcgttggcgttgttagtacggaaggggtaatagaatggtgcgtagaatacgatgaatgggtaatttgttgaatgaagagaattcgtattagttgtagtagtttattcgttgtcggggtagtagtatgatgaggagttcggtttg

SEQ ID NO: 6534 - DNA, 1765 bp, Artificial Sequence
  chemically treated genomic DNA (Homo sapiens) CpG-island No: 6534
caaaccgaactcctcatcatactactaccccgacaacgaataaactactacaactaatacgaattctcttcattcaacaaattacccattcatcgtattctacgcaccattctattaccccttccgtactaacaacgccaacgacaaaccgcgataatcgcaataatacaaataaatttttccgccgacgtatacaccgaatccatctaattttacatctactccaccgtcgaccgcacgataccaaccaacgacgactttcctcactcacccgatcaacaaaatttcactttccaaccgatcgaacatctacaccaacaccgacgaaacaccacactaccaccgtcttcgccgccgaactactaaaaaatatccgccgactacgacgctacgttttcgccaactcaccgataacgatttcaaccctataaataacgtaaaactccccgactaataaatcgtctaaatacgaattcgtcgttctatatcgtaatcaaccgatcgccgtcccaaccgtaccaaatccttacgatttccgtaacaacgacatccaacccgtcaaatcccgttcacgcgccacacccgttttaccaccctacgacccaacgaatcgtaaaaataacgctttcgaccaacgactctacatattatatccgcgtataatacaccaacgatactaactatcgtaataataccgataaatccgctcatcatccgtacgataaccccttccgaaataaaatcgattttctctatcaacctaccgtaacgtcataccgataaaaataatacgcgtcacgaacgatacgattatccgacacatactaaaaatactatccgaatacaactccgaatcgaacaaacgattcctaccgaatctataacatacgaaatacgaatatccaaattcgctacgaaatataaacgccgatcaacctaccgataatactaataactataactccgtataacgcgaactactaatacgaataaatataaactcgaaatatatcatcccacgcgcgaacaccgcgatcaccgaaccgccccccgcgacgatatccccgctatacctaaaattaaattaaccacttacgatatattttcgatatttatcgaccgcgacgatcaaccgtaacgatatacctcgactaaaccgatataattcgcgacgacatcgtctaaatttcttcgacgctatcaccattattcgtcgccatctcgacacgctcaacaacaattcgatcgtcgttttaaccatacgacgacttcatttcctccgatacgaacccgcgtatttccatcaacgtactaaaatctaccgaactaaaataaaccatatactaaataaaccaaccgcaattacgaatctactacaataaacaacgccgatataataaatatcgacgacgacactaccgacattacatcgtaaaaaaaaacaaaataacgtactcgacgaataaaaccaccgacgacatcacatctctctaactctcgccgaaaatcgccgtatttcgctaaaaaaacgaaacaatacaaacgcgatcacgataaaaaaatttaacctacgataaaccgatatacgaaaaaataacgaacattatcgcccgacatattaaaaacaaaacattactaatttataactaacgaacgactcttatatacaaccgacgtaacgaaactatttcgcaaacaattcccgacgttacaaatacatttccgcaacacaatttatttataaccccgctaacgatcgccaata

SEQ ID NO: 6535 - DNA, 1765 bp, Artificial Sequence
  chemically treated genomic DNA (Homo sapiens) CpG-island No: 6535
taggtcggattttttattatattgttgtttcggtagcggataagttgttgtagttgatgcgggttttttttatttagtaggttgtttatttatcgtattttgcgtattattttgttgtttttttcgtgttgatagcgttagcggtaggtcgcgatggtcgtagtggtataggtggattttttcgtcggcgtgtatatcgggtttatttggttttgtatttgttttatcgtcggtcgtacgatgttagttagcggcggttttttttatttattcggttagtaggattttattttttagtcggtcgagtatttgtattagtatcggcgggatattatattgttatcgttttcgtcgtcggattgttgaagggtattcgtcggttgcggcgttgcgttttcgttagtttatcggtggcggttttaattttatgagtggcgtgaagtttttcggttgataaatcgtttggatgcgggttcgtcgttttgtatcgtggttagtcggtcgtcgttttagtcgtattaggtttttgcggttttcgtgatagcgatatttagttcgttaggtttcgtttacgcgttatattcgttttgttattttgcggtttagcgggtcgtaaagatagcgttttcgattagcggttttgtatattgtgttcgcgtgtagtgtattagcggtgttgattgtcgtaatggtatcggtgagttcgtttattattcgtgcgataatttttttcgggatgaggtcggttttttttgttagtttgtcgtgacgttatatcggtaaagatagtgcgcgttacgggcgatacggttattcggtatatgttgagggtgttgttcgggtgtagtttcgggtcgggtaggcggtttttgtcgggtttgtggtatacgggatgcggatatttagattcgttgcggggtgtgaacgtcggttagtttgtcggtggtgttgatagttgtaatttcgtatggcgcgggttgttgatgcggatgggtataagttcgaggtgtattattttacgcgcggatatcgcggttatcggatcgtttttcgcggcggtattttcgttgtgtttggggttgaattggttatttgcgatgtgttttcgatgtttgtcgatcgcgacggttagtcgtggcggtatgtttcgattgggtcgatgtggttcgcgacggtatcgtttggattttttcggcgttgttattattgttcgtcgttatttcgatacgtttagtagtaattcggtcgtcgttttagttatgcggcgattttatttttttcggtacggattcgcgtatttttattaacgtgttggaatttgtcggattggagtgagttatgtgttggatgagttaatcgtagttgcggatttgttgtaatggataacgtcggtgtagtggatatcggcggcggtattatcggtattgtatcgtgaaaaagggtaaggtgacgtattcggcggatgaagttatcggcgatattatatttttttgattttcgtcggaaatcgtcgtatttcgttggaaaggcggagtagtataagcgcggttacggtgaagagatttggtttgcggtaaatcggtgtacgaaaaaatggcggatattgtcgttcggtatattgaaggtagggtattattgatttatggttggcgggcggtttttgtatgtaatcggcgtggcggaattgtttcgtaaataattttcggcgttataggtgtattttcgtagtatagtttgtttatgatttcgttggcgatcgttagta

SEQ ID NO: 6536 - DNA, 1765 bp, Artificial Sequence
  chemically treated genomic DNA (Homo sapiens) CpG-island No: 6536
tactaacgatcgccaacgaaatcataaacaaactatactacgaaaatacacctataacgccgaaaattatttacgaaacaattccgccacgccgattacatacaaaaaccgcccgccaaccataaatcaataataccctaccttcaatataccgaacgacaatatccgccattttttcgtacaccgatttaccgcaaaccaaatctcttcaccgtaaccgcgcttatactactccgcctttccaacgaaatacgacgatttccgacgaaaatcaaaaaaatataatatcgccgataacttcatccgccgaatacgtcaccttaccctttttcacgatacaataccgataataccgccgccgatatccactacaccgacgttatccattacaacaaatccgcaactacgattaactcatccaacacataactcactccaatccgacaaattccaacacgttaataaaaatacgcgaatccgtaccgaaaaaaataaaatcgccgcataactaaaacgacgaccgaattactactaaacgtatcgaaataacgacgaacaataataacaacgccgaaaaaatccaaacgataccgtcgcgaaccacatcgacccaatcgaaacataccgccacgactaaccgtcgcgatcgacaaacatcgaaaacacatcgcaaataaccaattcaaccccaaacacaacgaaaataccgccgcgaaaaacgatccgataaccgcgatatccgcgcgtaaaataatacacctcgaacttatacccatccgcatcaacaacccgcgccatacgaaattacaactatcaacaccaccgacaaactaaccgacgttcacaccccgcaacgaatctaaatatccgcatcccgtataccacaaacccgacaaaaaccgcctacccgacccgaaactacacccgaacaacaccctcaacatataccgaataaccgtatcgcccgtaacgcgcactatctttaccgatataacgtcacgacaaactaacaaaaaaaaccgacctcatcccgaaaaaaattatcgcacgaataataaacgaactcaccgataccattacgacaatcaacaccgctaatacactacacgcgaacacaatatacaaaaccgctaatcgaaaacgctatctttacgacccgctaaaccgcaaaataacaaaacgaatataacgcgtaaacgaaacctaacgaactaaatatcgctatcacgaaaaccgcaaaaacctaatacgactaaaacgacgaccgactaaccacgatacaaaacgacgaacccgcatccaaacgatttatcaaccgaaaaacttcacgccactcataaaattaaaaccgccaccgataaactaacgaaaacgcaacgccgcaaccgacgaatacccttcaacaatccgacgacgaaaacgataacaatataatatcccgccgatactaatacaaatactcgaccgactaaaaaataaaatcctactaaccgaataaataaaaaaaaccgccgctaactaacatcgtacgaccgacgataaaacaaatacaaaaccaaataaacccgatatacacgccgacgaaaaaatccacctataccactacgaccatcgcgacctaccgctaacgctatcaacacgaaaaaaacaacaaaataatacgcaaaatacgataaataaacaacctactaaataaaaaaaacccgcatcaactacaacaacttatccgctaccgaaacaacaatataataaaaaatccgaccta

SEQ ID NO: 6537 - DNA, 855 bp, Artificial Sequence
  chemically treated genomic DNA (Homo sapiens) CpG-island No: 6537
ggtgcgcgagagcgttggatcggtgcggtgcgttttatgcggtaggatttgtgagatagtggtagatatgataaaggtgggttacgtgggggtggttggatttcgggtcgaatttagaaaggagggattattattcggggtatttagtttgagatagcgggttacgggtatcgatttaattaagtgttaagagtgggggtaggaatggcgatcgaaggtcgtaagggataagcgttaggggtttagggggtatagcggcggggttagtttggaggtgaatgtcgtgagtttgattttggtcgtaatgatatacgggtgttggcgttggatttggtggggtttggggaacgtgggattcgatcggaagggtagggcgttaatatagtgttggggcgggtagttgatgcgtacggtgtttggttagtgcggattcgcggggaaaaatttggatagtatgatacgtgggtcgtaggagattgcggatagtggacggtattggtgggaaagtggcgtgggggtggggggttttgatggtggtattttcggtcgagacggtgcgtgtaatatgcggcggcgtgaaagattgtttggggggtgtgacggggggataatgatgatgtattttgatgcgcgggattcggaaggggttgtggacgcgagttgatatgtgttgtaagcggatcgcgatgaagggggtatgtcgggtggtgttattatcgcgtcgatatcgcgggagtcggtgtaaaagtgtatagttattcgtatagggtagtaatggttgaatatcggtatttattttacgaattatgttcgatagcggtatcgggagttgaacgtttgttgattgaatattta

SEQ ID NO: 6538 - DNA, 855 bp, Artificial Sequence
  chemically treated genomic DNA (Homo sapiens) CpG-island No: 6538
taaatattcaatcaacaaacgttcaactcccgataccgctatcgaacataattcgtaaaataaataccgatattcaaccattactaccctatacgaataactatacacttttacaccgactcccgcgatatcgacgcgataataacaccacccgacatacccccttcatcgcgatccgcttacaacacatatcaactcgcgtccacaaccccttccgaatcccgcgcatcaaaatacatcatcattatccccccgtcacaccccccaaacaatctttcacgccgccgcatattacacgcaccgtctcgaccgaaaataccaccatcaaaaccccccacccccacgccactttcccaccaataccgtccactatccgcaatctcctacgacccacgtatcatactatccaaatttttccccgcgaatccgcactaaccaaacaccgtacgcatcaactacccgccccaacactatattaacgccctacccttccgatcgaatcccacgttccccaaaccccaccaaatccaacgccaacacccgtatatcattacgaccaaaatcaaactcacgacattcacctccaaactaaccccgccgctataccccctaaacccctaacgcttatcccttacgaccttcgatcgccattcctacccccactcttaacacttaattaaatcgatacccgtaacccgctatctcaaactaaataccccgaataataatccctcctttctaaattcgacccgaaatccaaccacccccacgtaacccacctttatcatatctaccactatctcacaaatcctaccgcataaaacgcaccgcaccgatccaacgctctcgcgcacc

SEQ ID NO: 6539 - DNA, 855 bp, Artificial Sequence
  chemically treated genomic DNA (Homo sapiens) CpG-island No: 6539
tgggtatttaattagtaaacgtttaattttcggtatcgttatcgggtataattcgtggagtggatgtcggtgtttaattattgttattttgtacgggtggttgtatatttttatatcggttttcgcggtgtcggcgcggtagtggtattattcggtatgttttttttatcgcggttcgtttgtaatatatattaattcgcgtttataatttttttcgagtttcgcgtattaaggtatattattattgttttttcgttatattttttaagtagttttttacgtcgtcgtatattatacgtatcgtttcggtcgagggtgttattattaaaattttttatttttacgttatttttttattaatatcgtttattattcgtaattttttacggtttacgtattatattatttaggttttttttcgcgggttcgtattaattaggtatcgtgcgtattaattattcgttttagtattgtattagcgttttattttttcgatcgggttttacgttttttaagttttattaggtttagcgttaatattcgtatgttattacggttagggttaggtttacggtatttatttttaggttaatttcgtcgttatattttttgaatttttaacgtttgttttttacggttttcggtcgttatttttgtttttatttttaatatttaattaaatcggtattcgtagttcgttgttttaagttaggtatttcgggtagtggttttttttttttaaattcggttcggggtttagttatttttacgtaatttatttttattatatttattattattttataagttttgtcgtataaagcgtatcgtatcggtttaacgttttcgcgtatt

SEQ ID NO: 6540 - DNA, 855 bp, Artificial Sequence
  chemically treated genomic DNA (Homo sapiens) CpG-island No: 6540
aatacgcgaaaacgttaaaccgatacgatacgctttatacgacaaaacttataaaataataataaatataataaaaataaattacgtaaaaataactaaaccccgaaccgaatttaaaaaaaaaaaaccactacccgaaatacctaacttaaaacaacgaactacgaataccgatttaattaaatattaaaaataaaaacaaaaataacgaccgaaaaccgtaaaaaacaaacgttaaaaattcaaaaaatataacgacgaaattaacctaaaaataaataccgtaaacctaaccctaaccgtaataacatacgaatattaacgctaaacctaataaaacttaaaaaacgtaaaacccgatcgaaaaaataaaacgctaatacaatactaaaacgaataattaatacgcacgatacctaattaatacgaacccgcgaaaaaaaacctaaataatataatacgtaaaccgtaaaaaattacgaataataaacgatattaataaaaaaataacgtaaaaataaaaaattttaataataacaccctcgaccgaaacgatacgtataatatacgacgacgtaaaaaactacttaaaaaatataacgaaaaaacaataataatataccttaatacgcgaaactcgaaaaaaattataaacgcgaattaatatatattacaaacgaaccgcgataaaaaaaacataccgaataataccactaccgcgccgacaccgcgaaaaccgatataaaaatatacaaccacccgtacaaaataacaataattaaacaccgacatccactccacgaattatacccgataacgataccgaaaattaaacgtttactaattaaataccca

SEQ ID NO: 6541 - DNA, 570 bp, Artificial Sequence
  chemically treated genomic DNA (Homo sapiens) CpG-island No: 6541
gattaatttacgttcgttagtggagcgtattaacggcgcgacggtggatgtacgtttgggtaataaatttcgtatttttcgtggttatacggtagcgtttatcgatttgagcggttttaaagatgaagtgagcgtcgcgtttgatcgcgtgatgagcgatgagatcgttttcgacgagggcgaggcgttttatttttatttaggagagttggcgttggcggtgacgttggagtcggtgacgttgttagtcgatttggtgggttggttggacgggcgttttttattggcgcgtttggggttgatggtgtacgttatcgcgtatcgtatcgattcgggttggtttggttgtattgtgttggagttttataatttcggtaagttgtcgttggcgttgcgttcgggtatgttaattggtgcgttgagttttgagtcgtttttcggttcggcggtgcgattttataatcgtcgtgaagatgcgaaatatcgtaattagtagggcgcggtagttagtcgaatcgataaagattaatttaggtttattgaggatattatgagacgatttttgacgaa

SEQ ID NO: 6542 - DNA, 570 bp, Artificial Sequence
  chemically treated genomic DNA (Homo sapiens) CpG-island No: 6542
ttcgtcaaaaatcgtctcataatatcctcaataaacctaaattaatctttatcgattcgactaactaccgcgccctactaattacgatatttcgcatcttcacgacgattataaaatcgcaccgccgaaccgaaaaacgactcaaaactcaacgcaccaattaacatacccgaacgcaacgccaacgacaacttaccgaaattataaaactccaacacaatacaaccaaaccaacccgaatcgatacgatacgcgataacgtacaccatcaaccccaaacgcgccaataaaaaacgcccgtccaaccaacccaccaaatcgactaacaacgtcaccgactccaacgtcaccgccaacgccaactctcctaaataaaaataaaacgcctcgccctcgtcgaaaacgatctcatcgctcatcacgcgatcaaacgcgacgctcacttcatctttaaaaccgctcaaatcgataaacgctaccgtataaccacgaaaaatacgaaatttattacccaaacgtacatccaccgtcgcgccgttaatacgctccactaacgaacgtaaattaatc

SEQ ID NO: 6543 - DNA, 570 bp, Artificial Sequence
  chemically treated genomic DNA (Homo sapiens) CpG-island No: 6543
ttcgttagaaatcgttttatggtatttttaatgggtttgaattagtttttatcgattcggttggttatcgcgttttgttggttgcgatatttcgtatttttacggcggttgtaaggtcgtatcgtcgggtcggaaagcggtttaaagtttagcgtattaattaatatgttcggacgtagcgttagcggtagtttatcggagttgtagaattttagtataatgtaattagattagttcggatcgatgcggtgcgcggtgacgtgtattattagttttagacgcgttagtgaggaacgttcgtttagttagtttattagatcggttggtagcgttatcgattttagcgttatcgttagcgttagtttttttgggtgaagatagaacgtttcgttttcgtcgagaacgattttatcgtttattacgcggttaagcgcggcgtttattttatttttgggatcgtttagatcgataaacgttgtcgtgtgattacggaaggtacgaaatttattgtttaggcgtatatttatcgtcgcgtcgttaatacgttttattggcggacgtgggttgatt

SEQ ID NO: 6544 - DNA, 570 bp, Artificial Sequence
  chemically treated genomic DNA (Homo sapiens) CpG-island No: 6544
aatcaacccacgtccgccaataaaacgtattaacgacgcgacgataaatatacgcctaaacaataaatttcgtaccttccgtaatcacacgacaacgtttatcgatctaaacgatcccaaaaataaaataaacgccgcgcttaaccgcgtaataaacgataaaatcgttctcgacgaaaacgaaacgttctatcttcacccaaaaaaactaacgctaacgataacgctaaaatcgataacgctaccaaccgatctaataaactaactaaacgaacgttcctcactaacgcgtctaaaactaataatacacgtcaccgcgcaccgcatcgatccgaactaatctaattacattatactaaaattctacaactccgataaactaccgctaacgctacgtccgaacatattaattaatacgctaaactttaaaccgctttccgacccgacgatacgaccttacaaccgccgtaaaaatacgaaatatcgcaaccaacaaaacgcgataaccaaccgaatcgataaaaactaattcaaacccattaaaaataccataaaacgatttctaacgaa

SEQ ID NO: 6545 - DNA, 932 bp, Artificial Sequence
  chemically treated genomic DNA (Homo sapiens) CpG-island No: 6545
agttggtttgttttggtgaatgtgaatgtcgggagtgcgcggatttgtggtcgagtattatttgcggcgttggtgttggcgtgtgaggaatatgcgaatgttgggtatcgggacggtcgggggtgataaggttttgtttgcgcgcgggttatgttaagtttgtgggttcggttttgatgcgtaggtgtttcgatatatgttgcgggtatagtggtttgcggcgcgtatttttttggagaatggtgaataagggcggggcggaaaatggtttgcggaaatgagattgtttgggtaggttaatgaggtacggtcgcgggaggggagtaatgtgcggggttgggattacgcgcgaaaatatgttgttgttttattttaggggcgttattacggtcggttgtagggtgatcgggtcggtggttgtagttgtttgtattggggatgatttgggaatagtgcgttgaacgtttagtcggcgggtattgatggtaggacgttggggaggttgttaggtgatgaggacgtgtcgatgggaatgtgtgaggtggagaaggtaaagggatatggatcgtagggattattggaaggggtttgtacgtatttgggaatcgagggtgtatggcgtttgatgtatattatagaatgtcggggttgatatgtaattgcgcgtgtgtgagtttatggggaggtttttattttcggcgatagttggtttgtaatcgtgttgggatgttttgtttatttggataagcgaatacgtagggttcgttaaggtttggggcggttggtcggtgtagtttttagtgaggttagtttttaggatgcggcgggggtgggagttcggcggaagttttggggcgcgtttggggtagttgttagttcgtagggtgcgtaattgttgtgtgaagattcggaaggtgtgtacggatcggggt

SEQ ID NO: 6546 - DNA, 932 bp, Artificial Sequence
  chemically treated genomic DNA (Homo sapiens) CpG-island No: 6546
accccgatccgtacacaccttccgaatcttcacacaacaattacgcaccctacgaactaacaactaccccaaacgcgccccaaaacttccgccgaactcccacccccgccgcatcctaaaaactaacctcactaaaaactacaccgaccaaccgccccaaaccttaacgaaccctacgtattcgcttatccaaataaacaaaacatcccaacacgattacaaaccaactatcgccgaaaataaaaacctccccataaactcacacacgcgcaattacatatcaaccccgacattctataatatacatcaaacgccatacaccctcgattcccaaatacgtacaaaccccttccaataatccctacgatccatatccctttaccttctccacctcacacattcccatcgacacgtcctcatcacctaacaacctccccaacgtcctaccatcaatacccgccgactaaacgttcaacgcactattcccaaatcatccccaatacaaacaactacaaccaccgacccgatcaccctacaaccgaccgtaataacgcccctaaaataaaacaacaacatattttcgcgcgtaatcccaaccccgcacattactcccctcccgcgaccgtacctcattaacctacccaaacaatctcatttccgcaaaccattttccgccccgcccttattcaccattctccaaaaaaatacgcgccgcaaaccactatacccgcaacatatatcgaaacacctacgcatcaaaaccgaacccacaaacttaacataacccgcgcgcaaacaaaaccttatcacccccgaccgtcccgatacccaacattcgcatattcctcacacgccaacaccaacgccgcaaataatactcgaccacaaatccgcgcactcccgacattcacattcaccaaaacaaaccaact

SEQ ID NO: 6547 - DNA, 932 bp, Artificial Sequence
  chemically treated genomic DNA (Homo sapiens) CpG-island No: 6547
atttcgattcgtgtatatttttcgggtttttatataatagttacgtattttacgagttagtagttattttaaacgcgttttaaggttttcgtcgaatttttattttcgtcgtattttagggattggttttattaagggttgtatcggttaatcgttttaagttttaacggattttacgtattcgtttatttaggtgggtaggatattttaatacggttataagttaattatcgtcggaggtaggagtttttttataggtttatatacgcgtagttatatattaatttcggtattttgtagtgtgtattaaacgttatgtattttcggtttttaggtacgtataggttttttttaatagtttttacggtttatgtttttttattttttttattttatatatttttatcggtacgtttttattatttagtaatttttttagcgttttattattagtattcgtcggttaggcgtttaacgtattgtttttaagttatttttagtataagtaattgtaattatcggttcggttattttatagtcggtcgtaatagcgtttttaaagtaaggtaataatatgttttcgcgcgtagttttagtttcgtatattatttttttttcgcggtcgtgttttattagtttatttaagtaattttattttcgtaaattatttttcgtttcgtttttatttattattttttaagggggtgcgcgtcgtaagttattatattcgtagtatatgtcggagtatttacgtattaaagtcgggtttataaatttggtatggttcgcgcgtaagtagggttttgttattttcggtcgtttcggtgtttaatattcgtatgttttttatacgttaatattagcgtcgtagataatattcggttataagttcgcgtattttcggtatttatatttattaaggtaggttagtt

SEQ ID NO: 6548 - DNA, 932 bp, Artificial Sequence
  chemically treated genomic DNA (Homo sapiens) CpG-island No: 6548
aactaacctaccttaataaatataaataccgaaaatacgcgaacttataaccgaatattatctacgacgctaatattaacgtataaaaaacatacgaatattaaacaccgaaacgaccgaaaataacaaaaccctacttacgcgcgaaccataccaaatttataaacccgactttaatacgtaaatactccgacatatactacgaatataataacttacgacgcgcacccccttaaaaaataataaataaaaacgaaacgaaaaataatttacgaaaataaaattacttaaataaactaataaaacacgaccgcgaaaaaaaaataatatacgaaactaaaactacgcgcgaaaacatattattaccttactttaaaaacgctattacgaccgactataaaataaccgaaccgataattacaattacttatactaaaaataacttaaaaacaatacgttaaacgcctaaccgacgaatactaataataaaacgctaaaaaaattactaaataataaaaacgtaccgataaaaatatataaaataaaaaaaataaaaaaacataaaccgtaaaaactattaaaaaaaacctatacgtacctaaaaaccgaaaatacataacgtttaatacacactacaaaataccgaaattaatatataactacgcgtatataaacctataaaaaaactcctacctccgacgataattaacttataaccgtattaaaatatcctacccacctaaataaacgaatacgtaaaatccgttaaaacttaaaacgattaaccgatacaacccttaataaaaccaatccctaaaatacgacgaaaataaaaattcgacgaaaaccttaaaacgcgtttaaaataactactaactcgtaaaatacgtaactattatataaaaacccgaaaaatatacacgaatcgaaat

SEQ ID NO: 6549 - DNA, 617 bp, Artificial Sequence
  chemically treated genomic DNA (Homo sapiens) CpG-island No: 6549
  misc_feature (24)..(24): n is either a, c, g or t
  misc_feature (33)..(34): n is either a, c, g or t
  misc_feature (47)..(48): n is either a, c, g or t
  misc_feature (65)..(66): n is either a, c, g or t
tcgagtcggggcgaaatttacgtnatttttttnntgggcgtgggggnngttgcgagcgtcgggtnntttttttagtgatacgagttagtcgtgttttttggatagatttgtcggtagagttggattttcgatatcgaggcgtttcgtattttcgacggtcgttttcgtagttcgattagttttcgtcgtcgtcgcgtttttgcgtgcgttcgggtttcgtcgcggttcgtaggttttcggtcgtcgggggtttttttttttcgttgggggaattgggggtcgggtttcgcgtatgcgttgtcggcgttttcgcgtttcgcggggcggggggttgggaattggagtttttttttgttagttttggtttcgttttttgttcgtttttttttttcgtttcggcggaaagttttttttttattttcgttgaggttagtggtagttttttgggtattttttcggtttgcgtagggagtaaagggatcgcggcgttatttgcgcgtattacgcgtgaaacgtgcggataggacgtttttagaaagttttgtttttcgcgcgtattgttttagttatttttacgtcggttttatttgttttttttttttttttttttttttttt

SEQ ID NO: 6550 - DNA, 617 bp, Artificial Sequence
  chemically treated genomic DNA (Homo sapiens) CpG-island No: 6550
  misc_feature (552)..(553): n is either a, c, g or t
  misc_feature (570)..(571): n is either a, c, g or t
  misc_feature (584)..(585): n is either a, c, g or t
  misc_feature (594)..(594): n is either a, c, g or t
aaaaaaaaaaaaaaaaaaaaaaaaaaacaaataaaaccgacgtaaaaataactaaaacaatacgcgcgaaaaacaaaactttctaaaaacgtcctatccgcacgtttcacgcgtaatacgcgcaaataacgccgcgatccctttactccctacgcaaaccgaaaaaatacccaaaaaactaccactaacctcaacgaaaataaaaaaaaaactttccgccgaaacgaaaaaaaaaaacgaacaaaaaacgaaaccaaaactaacaaaaaaaaactccaattcccaaccccccgccccgcgaaacgcgaaaacgccgacaacgcatacgcgaaacccgacccccaattcccccaacgaaaaaaaaaaacccccgacgaccgaaaacctacgaaccgcgacgaaacccgaacgcacgcaaaaacgcgacgacgacgaaaactaatcgaactacgaaaacgaccgtcgaaaatacgaaacgcctcgatatcgaaaatccaactctaccgacaaatctatccaaaaaacacgactaactcgtatcactaaaaaaannacccgacgctcgcaacnncccccacgcccannaaaaaaatnacgtaaatttcgccccgactcga

SEQ ID NO: 6551 - DNA, 617 bp, Artificial Sequence
  chemically treated genomic DNA (Homo sapiens) CpG-island No: 6551
  misc_feature (552)..(553): n is either a, c, g or t
  misc_feature (570)..(571): n is either a, c, g or t
  misc_feature (584)..(585): n is either a, c, g or t
  misc_feature (594)..(594): n is either a, c, g or t
aaaaaaaaagagagagagaaagaaaaataggtggaatcgacgtaaggatggttagagtagtgcgcgcggaaggtagaattttttgggggcgttttgttcgtacgttttacgcgtggtgcgcgtaggtggcgtcgcggtttttttgttttttgcgtaagtcggaggggtgtttagaaggttattattagttttagcgaaggtgagagagaagtttttcgtcgaagcgagggaggagggcgggtaggaagcggagttagagttggtaaagaaaggttttaatttttagtttttcgtttcgcggggcgcgggggcgtcggtagcgtatgcgcgaggttcggtttttaatttttttagcgagggagggaggttttcggcggtcgggagtttgcgagtcgcggcgggattcgagcgtacgtaggggcgcggcgacggcgggggttagtcgggttgcggaggcggtcgtcgggagtgcggagcgtttcggtatcgagggtttaattttgtcggtaggtttatttagagggtacggttggttcgtgttattgggagggnngttcggcgttcgtagtnntttttacgtttanngagaggatngcgtgagtttcgtttcggttcga

SEQ ID NO: 6552 - DNA, 617 bp, Artificial Sequence
  chemically treated genomic DNA (Homo sapiens) CpG-island No: 6552
  misc_feature (24)..(24): n is either a, c, g or t
  misc_feature (33)..(34): n is either a, c, g or t
  misc_feature (47)..(48): n is either a, c, g or t
  misc_feature (65)..(66): n is either a, c, g or t
tcgaaccgaaacgaaactcacgcnatcctctcnntaaacgtaaaaannactacgaacgccgaacnnccctcccaataacacgaaccaaccgtaccctctaaataaacctaccgacaaaattaaaccctcgataccgaaacgctccgcactcccgacgaccgcctccgcaacccgactaacccccgccgtcgccgcgcccctacgtacgctcgaatcccgccgcgactcgcaaactcccgaccgccgaaaacctccctccctcgctaaaaaaattaaaaaccgaacctcgcgcatacgctaccgacgcccccgcgccccgcgaaacgaaaaactaaaaattaaaacctttctttaccaactctaactccgcttcctacccgccctcctccctcgcttcgacgaaaaacttctctctcaccttcgctaaaactaataataaccttctaaacacccctccgacttacgcaaaaaacaaaaaaaccgcgacgccacctacgcgcaccacgcgtaaaacgtacgaacaaaacgcccccaaaaaattctaccttccgcgcgcactactctaaccatccttacgtcgattccacctatttttctttctctctctcttttttttt

SEQ ID NO: 6553 - DNA, 669 bp, Artificial Sequence
  chemically treated genomic DNA (Homo sapiens) CpG-island No: 6553
ggggcggcgttgagcgtttatggtcgtagttgttgggcggtgtgatgttgacgttgttgttatttcgttcgttaattttgatggggtttgatgatggcgtggcgcgtaatttcgggttggttttgtcgtttgcgcgtttggtagcgttgtcgttggcgattgttattagtgcgttgttggtgaacgttgtggggattatcggttttatcgggttgttcgcgtcgttttggtaaaaatgttgggggcgcggcgtttgttgttacgattgatgttggcgtcgttgattggtgcgttgattttttggtttttcgattaaattattttttggttgattcgcgtgtggatggaagtgtttatcggttcggttattgcgttgatcggtgcgtcgttgttattgtggttgttgtcgcgtttacgtagtattagcgcgtcggatataaggttaacgatcgtgtcgcggttgaacgttaatatgtgttggcgtttgttttcgcgggcggcgtgttgttgttgatggttgtggtggtggcgttgtcgtttggtcgtgatgcgtacggttggacgtgggcgagcggggcgttgttcgaggatttaatgttttggcgttggtcgcgaattatggcggcgttgtttgcgggcgttatgttggcggtggcgggttgttattat

SEQ ID NO: 6554 - DNA, 669 bp, Artificial Sequence
  chemically treated genomic DNA (Homo sapiens) CpG-island No: 6554
ataataacaacccgccaccgccaacataacgcccgcaaacaacgccgccataattcgcgaccaacgccaaaacattaaatcctcgaacaacgccccgctcgcccacgtccaaccgtacgcatcacgaccaaacgacaacgccaccaccacaaccatcaacaacaacacgccgcccgcgaaaacaaacgccaacacatattaacgttcaaccgcgacacgatcgttaaccttatatccgacgcgctaatactacgtaaacgcgacaacaaccacaataacaacgacgcaccgatcaacgcaataaccgaaccgataaacacttccatccacacgcgaatcaaccaaaaaataatttaatcgaaaaaccaaaaaatcaacgcaccaatcaacgacgccaacatcaatcgtaacaacaaacgccgcgcccccaacatttttaccaaaacgacgcgaacaacccgataaaaccgataatccccacaacgttcaccaacaacgcactaataacaatcgccaacgacaacgctaccaaacgcgcaaacgacaaaaccaacccgaaattacgcgccacgccatcatcaaaccccatcaaaattaacgaacgaaataacaacaacgtcaacatcacaccgcccaacaactacgaccataaacgctcaacgccgcccc

SEQ ID NO: 6555 - DNA, 669 bp, Artificial Sequence
  chemically treated genomic DNA (Homo sapiens) CpG-island No: 6555
ataataatagttcgttatcgttagtatgacgttcgtaaatagcgtcgttataattcgcggttagcgttagggtattaaattttcgagtaacgtttcgttcgtttacgtttagtcgtgcgtattacgattaaacgatagcgttattattatagttattaatagtagtacgtcgttcgcgagggtaaacgttagtatatgttggcgtttagtcgcgatacgatcgttgattttatattcggcgcgttaatgttgcgtaaacgcggtaatagttatagtagtagcggcgtatcgattaacgtagtgatcgaatcggtggatatttttatttatacgcgagttagttagaggatgatttgatcggaaagttagaggattagcgtattaattaacgacgttagtattagtcgtggtagtagacgtcgcgtttttagtatttttgttagagcggcgcgaataattcgataaagtcgataatttttatagcgtttattagtagcgtattgatgataatcgttagcgatagcgttgttagacgcgtaagcgataaggttagttcgagattgcgcgttacgttattattaagttttattagggttaacggacgaagtagtagtaacgttagtattatatcgtttagtagttgcggttataaacgtttaacgtcgtttt

SEQ ID NO: 6556 - DNA, 669 bp, Artificial Sequence
  chemically treated genomic DNA (Homo sapiens) CpG-island No: 6556
aaaacgacgttaaacgtttataaccgcaactactaaacgatataatactaacgttactactacttcgtccgttaaccctaataaaacttaataataacgtaacgcgcaatctcgaactaaccttatcgcttacgcgtctaacaacgctatcgctaacgattatcatcaatacgctactaataaacgctataaaaattatcgactttatcgaattattcgcgccgctctaacaaaaatactaaaaacgcgacgtctactaccacgactaatactaacgtcgttaattaatacgctaatcctctaactttccgatcaaatcatcctctaactaactcgcgtataaataaaaatatccaccgattcgatcactacgttaatcgatacgccgctactactataactattaccgcgtttacgcaacattaacgcgccgaatataaaatcaacgatcgtatcgcgactaaacgccaacatatactaacgtttaccctcgcgaacgacgtactactattaataactataataataacgctatcgtttaatcgtaatacgcacgactaaacgtaaacgaacgaaacgttactcgaaaatttaataccctaacgctaaccgcgaattataacgacgctatttacgaacgtcatactaacgataacgaactattattat

SEQ ID NO: 6557 - DNA, 528 bp, Artificial Sequence
  chemically treated genomic DNA (Homo sapiens) CpG-island No: 6557
tagatcgcgcgtattcgttttttttttggggcgtcggcggagcgtggttaattaacgggcgcggttatggtagcggaagtcggaagcggcgagcggggtcgttttgggtttaggggaggcgggtcgagggcgtttgagttgaggttcgcgtcgattttgggttggaggaggtggcggtcgttgaggttgcggcgtgaagacggcgggtatggtggggcgggagaaagagttttttatatattttgttttcgggagttgtcggttggtggaggtgagggagtcggtttgggcgttttcggtgggagcgggggcgtcgagggggacgagttatcggggcgcgggcggttttgtaggcgtatttcgttcgggttagagttttcggtcgggagtggttttatcgttatttttttagtttcggattcgaggggggcgttatcgagtttgtttattttagcgtatacgggttagtgttttttttttttagttattgcggtaggaagtaagtaggtggaggttttattttcgagt

SEQ ID NO: 6558 - DNA, 528 bp, Artificial Sequence
  chemically treated genomic DNA (Homo sapiens) CpG-island No: 6558
actcgaaaataaaacctccacctacttacttcctaccgcaataactaaaaaaaaaaaacactaacccgtatacgctaaaataaacaaactcgataacgcccccctcgaatccgaaactaaaaaaataacgataaaaccactcccgaccgaaaactctaacccgaacgaaatacgcctacaaaaccgcccgcgccccgataactcgtccccctcgacgcccccgctcccaccgaaaacgcccaaaccgactccctcacctccaccaaccgacaactcccgaaaacaaaatatataaaaaactctttctcccgccccaccatacccgccgtcttcacgccgcaacctcaacgaccgccacctcctccaacccaaaatcgacgcgaacctcaactcaaacgccctcgacccgcctcccctaaacccaaaacgaccccgctcgccgcttccgacttccgctaccataaccgcgcccgttaattaaccacgctccgccgacgccccaaaaaaaaaacgaatacgcgcgatcta

SEQ ID NO: 6559 - DNA, 528 bp, Artificial Sequence
  chemically treated genomic DNA (Homo sapiens) CpG-island No: 6559
attcgaaagtaaaatttttatttatttgttttttgtcgtagtggttggaagaaaaaaatattgattcgtgtgcgttgagataaataaattcggtggcgtttttttcggattcggggttgggagggtggcggtgagattattttcggtcggaggttttgattcgggcggaatacgtttgtaaagtcgttcgcgtttcggtggttcgtttttttcggcgttttcgtttttatcggagacgtttaggtcgatttttttatttttattagtcgatagttttcgggaataaagtgtatagagagttttttttttcgttttattatgttcgtcgtttttacgtcgtagttttagcggtcgttattttttttaatttaggatcgacgcgggttttagtttagacgttttcggttcgttttttttaggtttagaacgatttcgttcgtcgttttcggttttcgttgttatagtcgcgttcgttgattggttacgtttcgtcgacgttttagaaagagggcgggtacgcgcggtttg

SEQ ID NO: 6560 - DNA, 528 bp, Artificial Sequence
  chemically treated genomic DNA (Homo sapiens) CpG-island No: 6560
caaaccgcgcgtacccgccctctttctaaaacgtcgacgaaacgtaaccaatcaacgaacgcgactataacaacgaaaaccgaaaacgacgaacgaaatcgttctaaacctaaaaaaaacgaaccgaaaacgtctaaactaaaacccgcgtcgatcctaaattaaaaaaaataacgaccgctaaaactacgacgtaaaaacgacgaacataataaaacgaaaaaaaaaactctctatacactttattcccgaaaactatcgactaataaaaataaaaaaatcgacctaaacgtctccgataaaaacgaaaacgccgaaaaaaacgaaccaccgaaacgcgaacgactttacaaacgtattccgcccgaatcaaaacctccgaccgaaaataatctcaccgccaccctcccaaccccgaatccgaaaaaaacgccaccgaatttatttatctcaacgcacacgaatcaatatttttttcttccaaccactacgacaaaaaacaaataaataaaaattttactttcgaat

SEQ ID NO: 6561 - DNA, 607 bp, Artificial Sequence
  chemically treated genomic DNA (Homo sapiens) CpG-island No: 6561
  misc_feature (193)..(193): n is either a, c, g or t
  misc_feature (358)..(358): n is either a, c, g or t
  misc_feature (581)..(581): n is either a, c, g or t
  misc_feature (587)..(587): n is either a, c, g or t
  misc_feature (589)..(589): n is either a, c, g or t
atggcggttttattgtttagggttcggtaggtgtaagaattggcgcgtttatcggcgtggcgtgttcggtgtgttcgggcgggatgatttcgggtaattcggtaaattcgttgttgggggcgaaggtgttgttcggcgagacggattttgcgttgttcggttcgttgtcgtttattttttttcgtatttatancggggttcggacgaagacgtttgtatcggtgggcgttttttgtttcggttggaaagcgttttttgatattcgtttatagttacgtgatgacggattgatatttaacgacggcggggggcggagtatttattttgagtcgttgttgtcgggggaagcggtgtatantcgtaatgagttaatgtggttggtgcgcggtggtaaggtaggatagtcggacgggtatacgtttgcgcggttgtggggggcgttgtcgtcggatattcggttaagttcgtatttttatttggcgattaataaggtataggggtcgcggtgggtattggggtgggttgaacgggtgttcggtttttaaagacgtcgatgatatttattgataattatcgtaggnatttantnggttgattaatttagtaa

SEQ ID NO: 6562 - DNA, 607 bp, Artificial Sequence
  chemically treated genomic DNA (Homo sapiens) CpG-island No: 6562
  misc_feature (19)..(19): n is either a, c, g or t
  misc_feature (21)..(21): n is either a, c, g or t
  misc_feature (27)..(27): n is either a, c, g or t
  misc_feature (250)..(250): n is either a, c, g or t
  misc_feature (415)..(415): n is either a, c, g or t
ttactaaattaatcaaccnantaaatncctacgataattatcaataaatatcatcgacgtctttaaaaaccgaacacccgttcaacccaccccaatacccaccgcgacccctataccttattaatcgccaaataaaaatacgaacttaaccgaatatccgacgacaacgccccccacaaccgcgcaaacgtatacccgtccgactatcctaccttaccaccgcgcaccaaccacattaactcattacgantatacaccgcttcccccgacaacaacgactcaaaataaatactccgccccccgccgtcgttaaatatcaatccgtcatcacgtaactataaacgaatatcaaaaaacgctttccaaccgaaacaaaaaacgcccaccgatacaaacgtcttcgtccgaaccccgntataaatacgaaaaaaaataaacgacaacgaaccgaacaacgcaaaatccgtctcgccgaacaacaccttcgcccccaacaacgaatttaccgaattacccgaaatcatcccgcccgaacacaccgaacacgccacgccgataaacgcgccaattcttacacctaccgaaccctaaacaataaaaccgccat

SEQ ID NO: 6563 - DNA, 607 bp, Artificial Sequence
  chemically treated genomic DNA (Homo sapiens) CpG-island No: 6563
  misc_feature (19)..(19): n is either a, c, g or t
  misc_feature (21)..(21): n is either a, c, g or t
  misc_feature (27)..(27): n is either a, c, g or t
  misc_feature (250)..(250): n is either a, c, g or t
  misc_feature (415)..(415): n is either a, c, g or t
ttgttgagttaattagttngntgagtntttacgatgattattagtaggtattatcgacgtttttaggaatcgggtattcgtttagtttattttagtatttatcgcggtttttgtgttttgttggtcgttaggtaaaaatgcgggtttaatcggatattcggcgatagcgttttttatagtcgcgtaagcgtatgttcgttcggttgttttgttttattatcgcgtattagttatattgatttattgcggntgtatatcgtttttttcggtagtagcggtttaaagtgaatgtttcgtttttcgtcgtcgttgagtattagttcgttattacgtagttgtaagcggatattagaaggcgttttttagtcggggtagaaaacgtttatcggtgtaggcgttttcgttcggatttcgntgtaggtgcgggagagaatgaacggtagcgggtcgggtagcgtaaggttcgtttcgtcgggtagtattttcgtttttagtagcggatttatcgggttgttcgaagttatttcgttcggatatatcgagtacgttacgtcggtgggcgcgttaatttttatatttgtcgaattttggataatgggatcgttat

SEQ ID NO: 6564 - DNA, 607 bp, Artificial Sequence
  chemically treated genomic DNA (Homo sapiens) CpG-island No: 6564
  misc_feature (193)..(193): n is either a, c, g or t
  misc_feature (358)..(358): n is either a, c, g or t
  misc_feature (581)..(581): n is either a, c, g or t
  misc_feature (587)..(587): n is either a, c, g or t
  misc_feature (589)..(589): n is either a, c, g or t
ataacgatcccattatccaaaattcgacaaatataaaaattaacgcgcccaccgacgtaacgtactcgatatatccgaacgaaataacttcgaacaacccgataaatccgctactaaaaacgaaaatactacccgacgaaacgaaccttacgctacccgacccgctaccgttcattctctcccgcacctacancgaaatccgaacgaaaacgcctacaccgataaacgttttctaccccgactaaaaaacgccttctaatatccgcttacaactacgtaataacgaactaatactcaacgacgacgaaaaacgaaacattcactttaaaccgctactaccgaaaaaaacgatatacanccgcaataaatcaatataactaatacgcgataataaaacaaaacaaccgaacgaacatacgcttacgcgactataaaaaacgctatcgccgaatatccgattaaacccgcatttttacctaacgaccaacaaaacacaaaaaccgcgataaatactaaaataaactaaacgaatacccgattcctaaaaacgtcgataatacctactaataatcatcgtaaanactcancnaactaattaactcaacaa

SEQ ID NO: 6565 - DNA, 514 bp, Artificial Sequence
  chemically treated genomic DNA (Homo sapiens) CpG-island No: 6565
agttcgtaatcgagtgtttttatgaaagtgatttgcgtcgggtaaagcgacgttggtatggcgtttttcgttcggtatgtcgattttaatttttgtttcggtaaaggcgtaaatatatttacggttttcgtttcgatcgttgcgcggatgaaataggtcgtagagtaaatcggacgcgacgttggtttttatgtgttgtttatggtgattgtcgatgaaatcgacgatgtcgttcgcgttaaatgggaatattataaagcgggcgcggatgaagaggcgttaagttggttaatcgaataaagttagaaagatattcgtttcggtattgatattaacgttcgttagatggtcgattttatttcggcggtaaatattaatatggggacgttagtcggtttttacgttagtgtcgaggggtatttcgattgttgttattcggtgtggttattttgtttttttggagaagagtcgtgaagcgatttgtatttatttttatttgtttgttattataggt

SEQ ID NO: 6566 - DNA, 514 bp, Artificial Sequence
  chemically treated genomic DNA (Homo sapiens) CpG-island No: 6566
acctataataacaaacaaataaaaataaatacaaatcgcttcacgactcttctccaaaaaaacaaaataaccacaccgaataacaacaatcgaaatacccctcgacactaacgtaaaaaccgactaacgtccccatattaatatttaccgccgaaataaaatcgaccatctaacgaacgttaatatcaataccgaaacgaatatctttctaactttattcgattaaccaacttaacgcctcttcatccgcgcccgctttataatattcccatttaacgcgaacgacatcgtcgatttcatcgacaatcaccataaacaacacataaaaaccaacgtcgcgtccgatttactctacgacctatttcatccgcgcaacgatcgaaacgaaaaccgtaaatatatttacgcctttaccgaaacaaaaattaaaatcgacataccgaacgaaaaacgccataccaacgtcgctttacccgacgcaaatcactttcataaaaacactcgattacgaact

SEQ ID NO: 6567 - DNA, 514 bp, Artificial Sequence
  chemically treated genomic DNA (Homo sapiens) CpG-island No: 6567
gtttgtaataataggtagataagaatgagtgtaggtcgttttacgatttttttttagaggggtagaataattatatcggatgataatagtcgaggtatttttcgatattggcgtaagaatcgattaacgtttttatattgatgtttatcgtcgaagtgggatcggttatttgacgaacgttggtgttagtatcggagcgggtatttttttgattttgttcggttagttagtttaacgtttttttattcgcgttcgttttgtagtgtttttatttggcgcgagcggtatcgtcggttttatcggtaattattataaataatatataagagttaacgtcgcgttcggtttgttttgcggtttgttttattcgcgtagcggtcggggcgaaagtcgtgggtgtatttacgtttttgtcgaaatagaagttgaaatcggtatatcgggcggagaacgttatgttagcgtcgttttgttcggcgtagattatttttatggggatattcggttgcggatt

SEQ ID NO: 6568 - DNA, 514 bp, Artificial Sequence
  chemically treated genomic DNA (Homo sapiens) CpG-island No: 6568
aatccgcaaccgaatatccccataaaaataatctacgccgaacaaaacgacgctaacataacgttctccgcccgatataccgatttcaacttctatttcgacaaaaacgtaaatacacccacgactttcgccccgaccgctacgcgaataaaacaaaccgcaaaacaaaccgaacgcgacgttaactcttatatattatttataataattaccgataaaaccgacgataccgctcgcgccaaataaaaacactacaaaacgaacgcgaataaaaaaacgttaaactaactaaccgaacaaaatcaaaaaaatacccgctccgatactaacaccaacgttcgtcaaataaccgatcccacttcgacgataaacatcaatataaaaacgttaatcgattcttacgccaatatcgaaaaatacctcgactattatcatccgatataattattctacccctctaaaaaaaaatcgtaaaacgacctacactcattcttatctacctattattacaaac

SEQ ID NO: 6569 - DNA, 534 bp, Artificial Sequence
  chemically treated genomic DNA (Homo sapiens) CpG-island No: 6569
tggtcgcgtcgcgttcgtttagtagtttggcggtgcgtatttcgttattgtgcgtttatatatcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagttattttgtagcgggtatagtacgaagggcgagttgtcgttggcgtttagtattagtacgcgtattagcgtttcgttgtttaaagtcggggagtcgcggtttgaagcgtttattcggaattcgaacgtttgtagggtttcgtagtttagcgatttgagggcgaataggtggtcgttgtttgtgttgatggagattagggaggcgaggggtaggtgcggattttggggcggtagtagcgagtaggtgatcgggcgtggtttgagattcgatagtagagaaattgaattttttttattgtgttttaaagtttagttttttatgttaaata

SEQ ID NO: 6570 - DNA, 534 bp, Artificial Sequence
  chemically treated genomic DNA (Homo sapiens) CpG-island No: 6570
tatttaacataaaaaactaaactttaaaacacaataaaaaaaattcaatttctctactatcgaatctcaaaccacgcccgatcacctactcgctactaccgccccaaaatccgcacctacccctcgcctccctaatctccatcaacacaaacaacgaccacctattcgccctcaaatcgctaaactacgaaaccctacaaacgttcgaattccgaataaacgcttcaaaccgcgactccccgactttaaacaacgaaacgctaatacgcgtactaatactaaacgccaacgacaactcgcccttcgtactatacccgctacaaaataactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgatatataaacgcacaataacgaaatacgcaccgccaaactactaaacgaacgcgacgcgacca

SEQ ID NO: 6571 - DNA, 534 bp, Artificial Sequence
  chemically treated genomic DNA (Homo sapiens) CpG-island No: 6571
tatttggtatgaggaattaggttttagagtatagtggagggaatttaatttttttattgtcgggttttaagttacgttcggttatttattcgttgttgtcgttttaggattcgtatttgtttttcgtttttttggtttttattaatatagataacggttatttgttcgtttttaggtcgttggattacgaggttttgtaggcgttcgagtttcgggtgggcgttttagatcgcggtttttcggttttgagtagcgaggcgttggtgcgcgtgttggtgttggacgttaacgataattcgtttttcgtgttgtattcgttgtagaatggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggtgtgtgggcgtataatggcgaggtgcgtatcgttaggttgttgagcgagcgcgacgcggtta

SEQ ID NO: 6572 - DNA, 534 bp, Artificial Sequence
  chemically treated genomic DNA (Homo sapiens) CpG-island No: 6572
taaccgcgtcgcgctcgctcaacaacctaacgatacgcacctcgccattatacgcccacacaccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccattctacaacgaatacaacacgaaaaacgaattatcgttaacgtccaacaccaacacgcgcaccaacgcctcgctactcaaaaccgaaaaaccgcgatctaaaacgcccacccgaaactcgaacgcctacaaaacctcgtaatccaacgacctaaaaacgaacaaataaccgttatctatattaataaaaaccaaaaaaacgaaaaacaaatacgaatcctaaaacgacaacaacgaataaataaccgaacgtaacttaaaacccgacaataaaaaaattaaattccctccactatactctaaaacctaattcctcataccaaata

SEQ ID NO: 6573 - DNA, 531 bp, Artificial Sequence
  chemically treated genomic DNA (Homo sapiens) CpG-island No: 6573
ttgttcgttcgcgagaataatagtttcgttttgtatattggtagcgttagtatcgtagagattaatatttaggttatttattcgttgttgtcgtttcggaattcgtatttgtttttcgtttttttggtttttattaatatagataacggttatttgttcgtttttaggtcgttggattacgaggttttgtaggagttcgagtttcgcgtgggcgttttagatcgcggttttacggcgttgagtagcgaggcgttggtgcgcgtgttggtgttggacgttaacgatagtttatttttcgtgttgttttcgttgtagaacggtttcgcgttttgtatcgagttgatgtttcgggcgggtcgtcgagtcgggttatttggtgattaaggtggtggcggtggacggtgattcgggttagaacgtttggttgtcgtagtagttgtttaaggttacggagttagggttgttcggcgtgtgggcgtataatgtattgataggttgttgagcgagcgtgatatagttaagtataggttg

SEQ ID NO: 6574 - DNA, 531 bp, Artificial Sequence
  chemically treated genomic DNA (Homo sapiens) CpG-island No: 6574
caacctatacttaactatatcacgctcgctcaacaacctatcaatacattatacgcccacacgccgaacaaccctaactccgtaaccttaaacaactactacgacaaccaaacgttctaacccgaatcaccgtccaccgccaccaccttaatcaccaaataacccgactcgacgacccgcccgaaacatcaactcgatacaaaacgcgaaaccgttctacaacgaaaacaacacgaaaaataaactatcgttaacgtccaacaccaacacgcgcaccaacgcctcgctactcaacgccgtaaaaccgcgatctaaaacgcccacgcgaaactcgaactcctacaaaacctcgtaatccaacgacctaaaaacgaacaaataaccgttatctatattaataaaaaccaaaaaaacgaaaaacaaatacgaattccgaaacgacaacaacgaataaataacctaaatattaatctctacgatactaacgctaccaatatacaaaacgaaactattattctcgcgaacgaacaa

SEQ ID NO: 6575 - DNA, 531 bp, Artificial Sequence
  chemically treated genomic DNA (Homo sapiens) CpG-island No: 6575
tagtttgtgtttggttgtgttacgttcgtttagtagtttgttagtgtattgtgcgtttatacgtcgaatagttttggtttcgtggttttgagtaattgttacgatagttaggcgttttggttcgagttatcgtttatcgttattattttggttattaggtagttcggttcggcggttcgttcggggtattagttcggtgtagggcgcggagtcgttttgtagcgggaatagtacgaagagtgagttgtcgttggcgtttagtattagtacgcgtattagcgtttcgttgtttagcgtcgtggagtcgcggtttgaagcgtttacgcggaattcgaatttttgtagggtttcgtagtttagcgatttgagggcgaataggtggtcgttgtttgtgttgatggagattagggaggcgaggggtaggtgcgggtttcggggcggtagtagcgagtaggtgatttggatgttggtttttgcggtgttgacgttgttaatatgtagggcggggttgttgttttcgcggacgaatag

SEQ ID NO: 6576 - DNA, 531 bp, Artificial Sequence
  chemically treated genomic DNA (Homo sapiens) CpG-island No: 6576
ctattcgtccgcgaaaacaacaaccccgccctacatattaacaacgtcaacaccgcaaaaaccaacatccaaatcacctactcgctactaccgccccgaaacccgcacctacccctcgcctccctaatctccatcaacacaaacaacgaccacctattcgccctcaaatcgctaaactacgaaaccctacaaaaattcgaattccgcgtaaacgcttcaaaccgcgactccacgacgctaaacaacgaaacgctaatacgcgtactaatactaaacgccaacgacaactcactcttcgtactattcccgctacaaaacgactccgcgccctacaccgaactaataccccgaacgaaccgccgaaccgaactacctaataaccaaaataataacgataaacgataactcgaaccaaaacgcctaactatcgtaacaattactcaaaaccacgaaaccaaaactattcgacgtataaacgcacaatacactaacaaactactaaacgaacgtaacacaaccaaacacaaacta

SEQ ID NO: 6577 - DNA, 769 bp, Artificial Sequence
  chemically treated genomic DNA (Homo sapiens) CpG-island No: 6577
cgagtataatataatcgtgttgttttttgacgttaatgataacgtttttatttttatttaaattttttatattttgttcgttcgcgagaataatagtttcgttttgtatatcggtagcgttagcgttatagatagagatttagcgtattaacgtttaggttaattattcgttgttgtcgttttagatcgggatttgtttttcgtttttttggtttttattaacgcgtataatggttattagtatgtttttaggtcggtggattataaggtttatacgtagttcgagtttcgcgtgcgcgttatagatcgcgggttttcggcgttacgtagcgaggcgttggtgcgagtgttggtgttggacgttaacgatatttcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagcgagcgcgacgcggttaagtataggttggtggtgttggttaaggataatggcgagttttcgcgttcggttatcgttacgttgtacgtgtttttggtggacggttttttttagttttatttgtttttttcggaggcggtttcggtttaggtttaggtcgatttgtttatcgtttat

SEQ ID NO: 6578 - DNA, 769 bp, Artificial Sequence
  chemically treated genomic DNA (Homo sapiens) CpG-island No: 6578
ataaacgataaacaaatcgacctaaacctaaaccgaaaccgcctccgaaaaaaacaaataaaactaaaaaaaaccgtccaccaaaaacacgtacaacgtaacgataaccgaacgcgaaaactcgccattatccttaaccaacaccaccaacctatacttaaccgcgtcgcgctcgctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaaatatcgttaacgtccaacaccaacactcgcaccaacgcctcgctacgtaacgccgaaaacccgcgatctataacgcgcacgcgaaactcgaactacgtataaaccttataatccaccgacctaaaaacatactaataaccattatacgcgttaataaaaaccaaaaaaacgaaaaacaaatcccgatctaaaacgacaacaacgaataattaacctaaacgttaatacgctaaatctctatctataacgctaacgctaccgatatacaaaacgaaactattattctcgcgaacgaacaaaatataaaaaatttaaataaaaataaaaacgttatcattaacgtcaaaaaacaacacgattatattatactcg

SEQ ID NO: 6579 - DNA, 769 bp, Artificial Sequence
  chemically treated genomic DNA (Homo sapiens) CpG-island No: 6579
gtagacggtgagtaagtcggtttgggtttgggtcggggtcgttttcgggagaggtaggtagggttgggagaagtcgtttattaggagtacgtgtagcgtggcggtggtcgagcgcggaggttcgttattgtttttgattagtattattagtttgtgtttggtcgcgtcgcgttcgtttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgaggtgtcgttggcgtttagtattagtattcgtattagcgtttcgttgcgtaacgtcggggattcgcggtttgtggcgcgtacgcgaaattcgaattgcgtgtaggttttgtagtttatcgatttggaggtatattagtggttattgtgcgcgttgatggagattaaggaggcgaggggtaggtttcggtttggggcggtagtagcgagtagttgatttgggcgttggtgcgttgagtttttgtttgtggcgttgacgttgtcgatgtgtagggcggggttgttgttttcgcggacgaatagggtgtaggaggtttgggtgaaggtgggggcgttgttattgacgttagagagtagtacggttatgttgtattcg

SEQ ID NO: 6580 - DNA, 769 bp, Artificial Sequence
  chemically treated genomic DNA (Homo sapiens) CpG-island No: 6580
cgaatacaacataaccgtactactctctaacgtcaataacaacgcccccaccttcacccaaacctcctacaccctattcgtccgcgaaaacaacaaccccgccctacacatcgacaacgtcaacgccacaaacaaaaactcaacgcaccaacgcccaaatcaactactcgctactaccgccccaaaccgaaacctacccctcgcctccttaatctccatcaacgcgcacaataaccactaatatacctccaaatcgataaactacaaaacctacacgcaattcgaatttcgcgtacgcgccacaaaccgcgaatccccgacgttacgcaacgaaacgctaatacgaatactaatactaaacgccaacgacacctcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaacgaacgcgacgcgaccaaacacaaactaataatactaatcaaaaacaataacgaacctccgcgctcgaccaccgccacgctacacgtactcctaataaacgacttctcccaaccctacctacctctcccgaaaacgaccccgacccaaacccaaaccgacttactcaccgtctac

SEQ ID NO: 6581 - DNA, 689 bp, Artificial Sequence
  chemically treated genomic DNA (Homo sapiens) CpG-island No: 6581
tattaatacggataacggttatttgttcgttttttagtcgttggattacgaggttttgtaggttttcgagtttcgcgtgggcgttatagatcgcggtttttcggcgttgagtagcgaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagcgagcgcgacgtggttaagtataggttagtggtgttggttaaggataatggcgagttttcgcgttcggttatcgttacgttgtaagtgtttttggtggacggttttttttaattttatttgtcgtttttagaggcggtttcggtttaagtttaggtcgattcgtttatcgtttatttggtggtggtattggtttcggtgttttcgtttttttttttttcggtgtttttgttcgtggtagtgcggttgtgtaggaggagtagggcggttttagtgggtcgttgttcggtgttcgagggtttttttttagggt

SEQ ID NO: 6582 - DNA, 689 bp, Artificial Sequence
  chemically treated genomic DNA (Homo sapiens) CpG-island No: 6582
accctaaaaaaaaaccctcgaacaccgaacaacgacccactaaaaccgccctactcctcctacacaaccgcactaccacgaacaaaaacaccgaaaaaaaaaaaaacgaaaacaccgaaaccaataccaccaccaaataaacgataaacgaatcgacctaaacttaaaccgaaaccgcctctaaaaacgacaaataaaattaaaaaaaaccgtccaccaaaaacacttacaacgtaacgataaccgaacgcgaaaactcgccattatccttaaccaacaccactaacctatacttaaccacgtcgcgctcgctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctcgctactcaacgccgaaaaaccgcgatctataacgcccacgcgaaactcgaaaacctacaaaacctcgtaatccaacgactaaaaaacgaacaaataaccgttatccgtattaata

SEQ ID NO: 6583 - DNA, 689 bp, Artificial Sequence
  chemically treated genomic DNA (Homo sapiens) CpG-island No: 6583
gttttggaaaggggttttcgggtatcgagtagcgatttattgaggtcgttttgttttttttgtatagtcgtattgttacgaataggaatatcgagaagaggaagagcgaagatatcgaggttaatgttattattaggtagacggtaagcgagtcggtttgggtttgggtcggggtcgtttttgggagcggtaggtagggttgagagaagtcgtttattaggagtatttgtagcgtggcggtggtcgagcgcggaggttcgttattgtttttgattagtattattagtttgtgtttggttacgtcgcgttcgtttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttcgttgtttaacgtcgggaagtcgcggtttgtggcgtttacgcggaattcgaaagtttgtagggtttcgtagtttagcgattggagagcgaataggtggtcgttgttcgtgttaatg

SEQ ID NO: 6584 - DNA, 689 bp, Artificial Sequence
  chemically treated genomic DNA (Homo sapiens) CpG-island No: 6584
cattaacacgaacaacgaccacctattcgctctccaatcgctaaactacgaaaccctacaaactttcgaattccgcgtaaacgccacaaaccgcgacttcccgacgttaaacaacgaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaacgaacgcgacgtaaccaaacacaaactaataatactaatcaaaaacaataacgaacctccgcgctcgaccaccgccacgctacaaatactcctaataaacgacttctctcaaccctacctaccgctcccaaaaacgaccccgacccaaacccaaaccgactcgcttaccgtctacctaataataacattaacctcgatatcttcgctcttcctcttctcgatattcctattcgtaacaatacgactatacaaaaaaaacaaaacgacctcaataaatcgctactcgatacccgaaaacccctttccaaaac

SEQ ID NO: 6585 - DNA, 553 bp, Artificial Sequence
  chemically treated genomic DNA (Homo sapiens) CpG-island No: 6585
tattaacgcggataacggttatttattcgtttttaggtttttggattacgaggttttgtaggagttcgggtttcgcgtgggcgtcgtagatcgcggtttttcggcgttgagtagcgaggtgttggtgcgcgtgttggtgttggacgttaacgataattcgtttttcgtgttgtattcgttgtagaacggtttcgcgttttgtatcgagttggtgttttgggcggtcgagtcgggttatttggtgattaaggtggtggcggtggacggtgattcgggttagaacgtttggttgtcgtattagttgtttaaggttacggagttcgggttattcggcgtgtgggcgtataatggcgaggtgcgtatcgttaggttgttgagcgagcgcgacgcggttaagtataggttggtggtgttggttaaggataatggcgagttttcgcgttcggttatcgttacgttgtacgtgtttttggtggacggttttttttagttttatttgtttttttcggaggcggtttcggtttaggtttaggtcgattcgtttattgtttat

SEQ ID NO: 6586 - DNA, 553 bp, Artificial Sequence
  chemically treated genomic DNA (Homo sapiens) CpG-island No: 6586
ataaacaataaacgaatcgacctaaacctaaaccgaaaccgcctccgaaaaaaacaaataaaactaaaaaaaaccgtccaccaaaaacacgtacaacgtaacgataaccgaacgcgaaaactcgccattatccttaaccaacaccaccaacctatacttaaccgcgtcgcgctcgctcaacaacctaacgatacgcacctcgccattatacgcccacacgccgaataacccgaactccgtaaccttaaacaactaatacgacaaccaaacgttctaacccgaatcaccgtccaccgccaccaccttaatcaccaaataacccgactcgaccgcccaaaacaccaactcgatacaaaacgcgaaaccgttctacaacgaatacaacacgaaaaacgaattatcgttaacgtccaacaccaacacgcgcaccaacacctcgctactcaacgccgaaaaaccgcgatctacgacgcccacgcgaaacccgaactcctacaaaacctcgtaatccaaaaacctaaaaacgaataaataaccgttatccgcgttaata

SEQ ID NO: 6587 - DNA, 553 bp, Artificial Sequence
  chemically treated genomic DNA (Homo sapiens) CpG-island No: 6587
gtagatagtgagcgagtcggtttgggtttgggtcggggtcgttttcgggagaggtaggtagggttgggagaagtcgtttattaggagtacgtgtagcgtggcggtggtcgagcgcggaggttcgttattgtttttgattagtattattagtttgtgtttggtcgcgtcgcgttcgtttagtagtttggcggtgcgtatttcgttattgtgcgtttatacgtcgaatagttcgggtttcgtggttttgagtagttggtacgatagttaggcgttttggttcgagttatcgtttatcgttattattttggttattaggtagttcggttcggtcgtttagggtattagttcggtgtagggcgcggagtcgttttgtagcgggtatagtacgaagggcgagttgtcgttggcgtttagtattagtacgcgtattagtatttcgttgtttagcgtcggggagtcgcggtttgcggcgtttacgcgaaattcgaatttttgtagggtttcgtagtttaaagatttgagggcgaataggtggtcgttgttcgcgttgatg

SEQ ID NO: 6588 - DNA, 553 bp, Artificial Sequence
  chemically treated genomic DNA (Homo sapiens) CpG-island No: 6588
catcaacgcgaacaacgaccacctattcgccctcaaatctttaaactacgaaaccctacaaaaattcgaatttcgcgtaaacgccgcaaaccgcgactccccgacgctaaacaacgaaatactaatacgcgtactaatactaaacgccaacgacaactcgcccttcgtactatacccgctacaaaacgactccgcgccctacaccgaactaataccctaaacgaccgaaccgaactacctaataaccaaaataataacgataaacgataactcgaaccaaaacgcctaactatcgtaccaactactcaaaaccacgaaacccgaactattcgacgtataaacgcacaataacgaaatacgcaccgccaaactactaaacgaacgcgacgcgaccaaacacaaactaataatactaatcaaaaacaataacgaacctccgcgctcgaccaccgccacgctacacgtactcctaataaacgacttctcccaaccctacctacctctcccgaaaacgaccccgacccaaacccaaaccgactcgctcactatctac

SEQ ID NO: 6589 - DNA, 759 bp, Artificial Sequence
  chemically treated genomic DNA (Homo sapiens) CpG-island No: 6589
aaaatcgagtataatataacggttttggttttcgacgttaatgataacgttttcgtttttatttaaattttttatattttgttcgttcgcgagaataatagtttcgttttgtatatcggtagcgttagcgttatagatagagattcgggtattaacgtttaggttatttattcgttgttgtcgttttaagattcgtatttgtttttcgtttttttggtttttattaacgcggataacggttatttgttcgtttttaggtcgttggattacgaggttttgtaggttttcgagtttcgcgtgggcgttatagatcgcggttttttcgcgttgagtagcgaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggtgtgtgggcgtataatggggaggtgcgtatcgttaggttgttgagcgagcgcgacgcggttaagtataggttggtggtgttggttaaggataatggcgagtttttcgttgttcggttatataatacgcgtgttatttgttttttgggtggagcggtttttttttagttttaatttgttcgtttttcggagggttgtttttagttt

SEQ ID NO: 6590 - DNA, 759 bp, Artificial Sequence
  chemically treated genomic DNA (Homo sapiens) CpG-island No: 6590
aaactaaaaacaaccctccgaaaaacgaacaaattaaaactaaaaaaaaaccgctccacccaaaaaacaaataacacgcgtattatataaccgaacaacgaaaaactcgccattatccttaaccaacaccaccaacctatacttaaccgcgtcgcgctcgctcaacaacctaacgatacgcacctccccattatacgcccacacaccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctcgctactcaacgcgaaaaaaccgcgatctataacgcccacgcgaaactcgaaaacctacaaaacctcgtaatccaacgacctaaaaacgaacaaataaccgttatccgcgttaataaaaaccaaaaaaacgaaaaacaaatacgaatcttaaaacgacaacaacgaataaataacctaaacgttaatacccgaatctctatctataacgctaacgctaccgatatacaaaacgaaactattattctcgcgaacgaacaaaatataaaaaatttaaataaaaacgaaaacgttatcattaacgtcgaaaaccaaaaccgttatattatactcgatttt

SEQ ID NO: 6591 - DNA, 759 bp, Artificial Sequence
  chemically treated genomic DNA (Homo sapiens) CpG-island No: 6591
aggttggaggtagtttttcgaaaagcgggtaggttagggttgaggaaaagtcgttttatttaggaagtaagtgatacgcgtgttgtgtggtcgagtaacgaaaggttcgttattgtttttgattagtattattagtttgtgtttggtcgcgtcgcgttcgtttagtagtttggcggtgcgtatttttttattgtgcgtttatatatcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttcgttgtttagcgcgggggagtcgcggtttgtggcgtttacgcggaattcgaaagtttgtagggtttcgtagtttagcgatttgagggcgaataggtggtcgttgttcgcgttgatggagattagggaggcgaggggtaggtgcgggttttggggcggtagtagcgagtaggtgatttgggcgttggtgttcgagtttttgtttgtggcgttgacgttgtcgatgtgtagggcggggttgttgttttcgcggacgaatagggtgtaggaggtttgggtgaaggcgggggcgttgttattgacgtcggagattaggatcgttatgttgtgttcggtttt

SEQ ID NO: 6592 - DNA, 759 bp, Artificial Sequence
  chemically treated genomic DNA (Homo sapiens) CpG-island No: 6592
aaaaccgaacacaacataacgatcctaatctccgacgtcaataacaacgcccccgccttcacccaaacctcctacaccctattcgtccgcgaaaacaacaaccccgccctacacatcgacaacgtcaacgccacaaacaaaaactcgaacaccaacgcccaaatcacctactcgctactaccgccccaaaacccgcacctacccctcgcctccctaatctccatcaacgcgaacaacgaccacctattcgccctcaaatcgctaaactacgaaaccctacaaactttcgaattccgcgtaaacgccacaaaccgcgactcccccgcgctaaacaacgaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgatatataaacgcacaataaaaaaatacgcaccgccaaactactaaacgaacgcgacgcgaccaaacacaaactaataatactaatcaaaaacaataacgaacctttcgttactcgaccacacaacacgcgtatcacttacttcctaaataaaacgacttttcctcaaccctaacctacccgcttttcgaaaaactacctccaacct

SEQ ID NO: 6593 - DNA, 670 bp, Artificial Sequence
  chemically treated genomic DNA (Homo sapiens) CpG-island No: 6593
tcggggtcgtttagttttttttgtatagtcgtatcgttacgaataggagtatcgagaggaggaagagcgaagatatcgaggttaacgttattattaggtagacggtgagcgagttggtttggttcggggtcgttttcgggagtcgtaggtagggttgggagaagtcgtttattaggagtacgtgtagcgtggcggtggtcgagcgcggaggttcgttattgtttttgattagtattattagtttttgtttggttgcgtcgcgttcgtttagtagtttggcggtgcgtatttcgttattgtgcgtttatatatcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagttgttttgtagcgggtatagtacgaagggcgagttgtcgttggcgtttagtattagtacgcgtattagcgtttcgttgtttaaagtcggggagtcgcggtttgaggcgtttacgcggaagtcgaaagtttgtagggtttcgtagtttagcgatttgagggtaaataggtggttattgttcgcgttgatggagattagggaggcgaggggtaggtg

SEQ ID NO: 6594 - DNA, 670 bp, Artificial Sequence
  chemically treated genomic DNA (Homo sapiens) CpG-island No: 6594
cacctacccctcgcctccctaatctccatcaacgcgaacaataaccacctatttaccctcaaatcgctaaactacgaaaccctacaaactttcgacttccgcgtaaacgcctcaaaccgcgactccccgactttaaacaacgaaacgctaatacgcgtactaatactaaacgccaacgacaactcgcccttcgtactatacccgctacaaaacaactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgatatataaacgcacaataacgaaatacgcaccgccaaactactaaacgaacgcgacgcaaccaaacaaaaactaataatactaatcaaaaacaataacgaacctccgcgctcgaccaccgccacgctacacgtactcctaataaacgacttctcccaaccctacctacgactcccgaaaacgaccccgaaccaaaccaactcgctcaccgtctacctaataataacgttaacctcgatatcttcgctcttcctcctctcgatactcctattcgtaacgatacgactatacaaaaaaaactaaacgaccccga

SEQ ID NO: 6595 - DNA, 670 bp, Artificial Sequence
  chemically treated genomic DNA (Homo sapiens) CpG-island No: 6595
tatttgtttttcgtttttttggtttttattaacgcggataatggttatttgtttgtttttaggtcgttggattacgaggttttgtaggttttcgattttcgcgtgggcgttttagatcgcggtttttcggttttgagtagcgaggcgttggtgcgcgtattggtgttggacgttaacgataattcgtttttcgtgttgtattcgttgtagaatagtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggtgtgtgggcgtataatggcgaggtgcgtatcgttaggttgttgagcgagcgcgacgtagttaagtagaggttggtggtgttggttaaggataatggcgagttttcgcgttcggttatcgttacgttgtacgtgtttttggtggacggttttttttagttttatttgcggttttcggaggcggtttcggattaggttaattcgtttatcgtttatttggtggtggcgttggtttcggtgttttcgtttttttttttttcggtgtttttgttcgtggcggtgcggttgtgtaggaggagttgggcggtttcgg

SEQ ID NO: 6596 - DNA, 670 bp, Artificial Sequence
  chemically treated genomic DNA (Homo sapiens) CpG-island No: 6596
ccgaaaccgcccaactcctcctacacaaccgcaccgccacgaacaaaaacaccgaaaaaaaaaaaaacgaaaacaccgaaaccaacgccaccaccaaataaacgataaacgaattaacctaatccgaaaccgcctccgaaaaccgcaaataaaactaaaaaaaaccgtccaccaaaaacacgtacaacgtaacgataaccgaacgcgaaaactcgccattatccttaaccaacaccaccaacctctacttaactacgtcgcgctcgctcaacaacctaacgatacgcacctcgccattatacgcccacacaccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaactattctacaacgaatacaacacgaaaaacgaattatcgttaacgtccaacaccaatacgcgcaccaacgcctcgctactcaaaaccgaaaaaccgcgatctaaaacgcccacgcgaaaatcgaaaacctacaaaacctcgtaatccaacgacctaaaaacaaacaaataaccattatccgcgttaataaaaaccaaaaaaacgaaaaacaaata

SEQ ID NO: 6597 - DNA, 564 bp, Artificial Sequence
  chemically treated genomic DNA (Homo sapiens) CpG-island No: 6597
gcgttggcggggcgtgaagcggtaatcgtaatcgatatcgtcggaattacgcgtgacgtgttgcgtgagtatatttatattgacggaatgtcgttgtatattatcgatatcgtcgggttacgtgaagttagtgacgaagtagaacgtattggtatcgagcgcgcgtggtaggaaattgaataggtcgatcgcgtgttgtttatggtcgatggtattataatagacgtcgtggattcggtagagatttggtcggaatttattgttcgtttgttagcgaaattgtcgattatcgtggtgcgtaataaagtcgatattatcggcgaaacgttgggaatgagtgaagtgaacggttacgcgttaattcgtttttcggtaaggattggtgaaggcgtggacgtgttgcgtaattattttaaatagagtatgggttttgatattaatatggaaggcggttttttggcgcgtcgtcgttatttataggcgttggaataggtagcggaatatttataatagggtaaagcgtaattgttgggagtttgggtaggtgaattgttggcggaagag

SEQ ID NO: 6598 - DNA, 564 bp, Artificial Sequence
  chemically treated genomic DNA (Homo sapiens) CpG-island No: 6598
ctcttccgccaacaattcacctacccaaactcccaacaattacgctttaccctattataaatattccgctacctattccaacgcctataaataacgacgacgcgccaaaaaaccgccttccatattaatatcaaaacccatactctatttaaaataattacgcaacacgtccacgccttcaccaatccttaccgaaaaacgaattaacgcgtaaccgttcacttcactcattcccaacgtttcgccgataatatcgactttattacgcaccacgataatcgacaatttcgctaacaaacgaacaataaattccgaccaaatctctaccgaatccacgacgtctattataataccatcgaccataaacaacacgcgatcgacctattcaatttcctaccacgcgcgctcgataccaatacgttctacttcgtcactaacttcacgtaacccgacgatatcgataatatacaacgacattccgtcaatataaatatactcacgcaacacgtcacgcgtaattccgacgatatcgattacgattaccgcttcacgccccgccaacgc

SEQ ID NO: 6599 - DNA, 564 bp, Artificial Sequence
  chemically treated genomic DNA (Homo sapiens) CpG-island No: 6599
ttttttcgttagtagtttatttgtttaggtttttaatagttgcgttttgttttgttgtagatgtttcgttgtttgttttagcgtttgtaggtggcgacgacgcgttaggaagtcgttttttatgttggtgttaaagtttatgttttgtttgagatggttacgtagtacgtttacgtttttattagtttttgtcgagagacgaattaacgcgtgatcgtttattttatttatttttagcgtttcgtcggtgatatcggttttattgcgtattacggtgatcggtagtttcgttggtagacgggtaataaatttcggttagatttttgtcggatttacggcgtttgttgtggtgttatcgattataaatagtacgcggtcggtttgtttaattttttgttacgcgcgttcgatattaatacgttttatttcgttattggttttacgtagttcggcggtatcgatgatatgtagcggtatttcgttaatgtggatatgtttacgtagtacgttacgcgtagtttcggcgatatcggttacgattgtcgttttacgtttcgttagcgt

SEQ ID NO: 6600 - DNA, 564 bp, Artificial Sequence
  chemically treated genomic DNA (Homo sapiens) CpG-island No: 6600
acgctaacgaaacgtaaaacgacaatcgtaaccgatatcgccgaaactacgcgtaacgtactacgtaaacatatccacattaacgaaataccgctacatatcatcgataccgccgaactacgtaaaaccaataacgaaataaaacgtattaatatcgaacgcgcgtaacaaaaaattaaacaaaccgaccgcgtactatttataatcgataacaccacaacaaacgccgtaaatccgacaaaaatctaaccgaaatttattacccgtctaccaacgaaactaccgatcaccgtaatacgcaataaaaccgatatcaccgacgaaacgctaaaaataaataaaataaacgatcacgcgttaattcgtctctcgacaaaaactaataaaaacgtaaacgtactacgtaaccatctcaaacaaaacataaactttaacaccaacataaaaaacgacttcctaacgcgtcgtcgccacctacaaacgctaaaacaaacaacgaaacatctacaacaaaacaaaacgcaactattaaaaacctaaacaaataaactactaacgaaaaaa

SEQ ID NO: 6601 - DNA, 555 bp, Artificial Sequence
  chemically treated genomic DNA (Homo sapiens) CpG-island No: 6601
tgttttagtagttcgtgaatagtttgttcggcggcgtattgtatcgtttgatcgttaaataggatttgtattgtttttttcgtatatcgggtaattattggcgcggcgtaacgttaggttgcgttattggttcgatttatcgtcgaatagtcggagttttttcgtaggtgtttttatatcgtttaataatttaatggtttttagtgtttgtaaagtgtttataatttcgattatcgggttaattacgttcgtcgtgcggtagttgcgttttggtttttggttatttggttataggtagcggtaatatttttgtttttagggcggcgttagtattattaattgatcgttaaattcgatcgcgttggcggtgataagcggcgtgttgagtgttacgtaggcggtattaattttttggcgagtcgttatattgtcggtatagtcgagtattatatcggttcgtgtaatcgtattttttaacgttttattcgttaatcgttgttgtaatgttgttagttgaatgtcgggatttaattgtgttagtcgttgttggttgat

SEQ ID NO: 6602 - DNA, 555 bp, Artificial Sequence
  chemically treated genomic DNA (Homo sapiens) CpG-island No: 6602
atcaaccaacaacgactaacacaattaaatcccgacattcaactaacaacattacaacaacgattaacgaataaaacgttaaaaaatacgattacacgaaccgatataatactcgactataccgacaatataacgactcgccaaaaaattaataccgcctacgtaacactcaacacgccgcttatcaccgccaacgcgatcgaatttaacgatcaattaataatactaacgccgccctaaaaacaaaaatattaccgctacctataaccaaataaccaaaaaccaaaacgcaactaccgcacgacgaacgtaattaacccgataatcgaaattataaacactttacaaacactaaaaaccattaaattattaaacgatataaaaacacctacgaaaaaactccgactattcgacgataaatcgaaccaataacgcaacctaacgttacgccgcgccaataattacccgatatacgaaaaaaacaatacaaatcctatttaacgatcaaacgatacaatacgccgccgaacaaactattcacgaactactaaaaca

SEQ ID NO: 6603 - DNA, 555 bp, Artificial Sequence
  chemically treated genomic DNA (Homo sapiens) CpG-island No: 6603
gttagttaatagcgattgatatagttgaatttcgatatttaattgatagtattataataacggttaacgggtgaggcgttaaaagatgcggttgtacgggtcgatgtggtgttcgattgtatcgataatatggcgattcgttaggagattaatgtcgtttgcgtggtatttaatacgtcgtttattatcgttagcgcggtcggatttggcggttagttgatggtattgacgtcgttttgggagtaggggtgttatcgttgtttgtggttagataattaggagttagaacgtaattgtcgtacggcgggcgtggttggttcggtggtcggggttatgggtattttgtaggtattggaagttattaagttattaagcggtatagagatatttgcgggagaatttcgattgttcgacggtaaatcgagttagtggcgtagtttggcgttgcgtcgcgttagtggttgttcggtatgcggaggaagtaatgtagattttgtttaacgattaagcgatgtagtgcgtcgtcgggtaaattgtttacgaattattggagta

SEQ ID NO: 6604 - DNA, 555 bp, Artificial Sequence
  chemically treated genomic DNA (Homo sapiens) CpG-island No: 6604
tactccaataattcgtaaacaatttacccgacgacgcactacatcgcttaatcgttaaacaaaatctacattacttcctccgcataccgaacaaccactaacgcgacgcaacgccaaactacgccactaactcgatttaccgtcgaacaatcgaaattctcccgcaaatatctctataccgcttaataacttaataacttccaatacctacaaaatacccataaccccgaccaccgaaccaaccacgcccgccgtacgacaattacgttctaactcctaattatctaaccacaaacaacgataacacccctactcccaaaacgacgtcaataccatcaactaaccgccaaatccgaccgcgctaacgataataaacgacgtattaaataccacgcaaacgacattaatctcctaacgaatcgccatattatcgatacaatcgaacaccacatcgacccgtacaaccgcatcttttaacgcctcacccgttaaccgttattataatactatcaattaaatatcgaaattcaactatatcaatcgctattaactaac

SEQ ID NO: 6605 - DNA, 607 bp, Artificial Sequence
  chemically treated genomic DNA (Homo sapiens) CpG-island No: 6605
tcggtcgtttattcgaggtagtttcggaatttcggatttagttatgcgcgtagggaattgtcgggtcgagcgagtttatcgaagtgtttcgcgtcgtgcgcgtttcgagcgttcgttttagttttcgggtgagttttttagtcgtcgttcggtcgcgtttgggtcgttttttcggttagggggagcgggagtgtaggtagcgggaagggagtcggtttcgtaggtttcgggggcgagcgggcgcggggtaggcgtcgggcgggaggaagttagcgtaggcgcggtcgagtttcgggagtcgaggttggaaacgttggagcgggcgttgttatcgaaggcggttcgggatcgggacgcgggttcgagcgatcggagcgcggttgtcgtggcgttggtcgtagtttaggttgatgtcgttggatcgggcgtgtcgttatcgtcgtcgtcgtcggatttcgttaggttggttcgtgggttttcgtaggttgcgcgttgagtttcggaatcgtcgcgcgtcggggatttttttttcgcggtttagttcgttttgtttttggtttttggggtttgtcgtttgttttttttttttgttggtttaagttgcggg

SEQ ID NO: 6606 - DNA, 607 bp, Artificial Sequence
  chemically treated genomic DNA (Homo sapiens) CpG-island No: 6606
cccgcaacttaaaccaacaaaaaaaaaaaacaaacgacaaaccccaaaaaccaaaaacaaaacgaactaaaccgcgaaaaaaaaatccccgacgcgcgacgattccgaaactcaacgcgcaacctacgaaaacccacgaaccaacctaacgaaatccgacgacgacgacgataacgacacgcccgatccaacgacatcaacctaaactacgaccaacgccacgacaaccgcgctccgatcgctcgaacccgcgtcccgatcccgaaccgccttcgataacaacgcccgctccaacgtttccaacctcgactcccgaaactcgaccgcgcctacgctaacttcctcccgcccgacgcctaccccgcgcccgctcgcccccgaaacctacgaaaccgactcccttcccgctacctacactcccgctccccctaaccgaaaaaacgacccaaacgcgaccgaacgacgactaaaaaactcacccgaaaactaaaacgaacgctcgaaacgcgcacgacgcgaaacacttcgataaactcgctcgacccgacaattccctacgcgcataactaaatccgaaattccgaaactacctcgaataaacgaccga

SEQ ID NO: 6607 - DNA, 607 bp, Artificial Sequence
  chemically treated genomic DNA (Homo sapiens) CpG-island No: 6607
ttcgtagtttgggttagtagaagggaagggtagacggtaggttttagaggttaggggtaggacggattgagtcgcggggagggggttttcggcgcgcggcggtttcggagtttagcgcgtagtttgcgggagtttacgggttagtttggcggggttcgacggcggcggcggtggcggtacgttcgatttagcggtattagtttgggttacgattagcgttacggtagtcgcgtttcggtcgttcggattcgcgtttcggtttcgggtcgttttcggtggtagcgttcgttttagcgtttttagtttcggttttcggggttcggtcgcgtttacgttgattttttttcgttcggcgtttgtttcgcgttcgttcgttttcggagtttgcggggtcggtttttttttcgttgtttgtattttcgttttttttggtcgggagggcggtttaagcgcggtcgagcggcggttggagggtttattcgggagttggagcgggcgttcgaggcgcgtacggcgcgggatatttcggtgagttcgttcggttcggtagttttttgcgcgtatggttgggttcggggtttcgagattgtttcgggtaggcggtcgg

SEQ ID NO: 6608 - DNA, 607 bp, Artificial Sequence
  chemically treated genomic DNA (Homo sapiens) CpG-island No: 6608
ccgaccgcctacccgaaacaatctcgaaaccccgaacccaaccatacgcgcaaaaaactaccgaaccgaacgaactcaccgaaatatcccgcgccgtacgcgcctcgaacgcccgctccaactcccgaataaaccctccaaccgccgctcgaccgcgcttaaaccgccctcccgaccaaaaaaaacgaaaatacaaacaacgaaaaaaaaaccgaccccgcaaactccgaaaacgaacgaacgcgaaacaaacgccgaacgaaaaaaaatcaacgtaaacgcgaccgaaccccgaaaaccgaaactaaaaacgctaaaacgaacgctaccaccgaaaacgacccgaaaccgaaacgcgaatccgaacgaccgaaacgcgactaccgtaacgctaatcgtaacccaaactaataccgctaaatcgaacgtaccgccaccgccgccgccgtcgaaccccgccaaactaacccgtaaactcccgcaaactacgcgctaaactccgaaaccgccgcgcgccgaaaaccccctccccgcgactcaatccgtcctacccctaacctctaaaacctaccgtctacccttcccttctactaacccaaactacgaa

SEQ ID NO: 6609 - DNA, 800 bp, Artificial Sequence
  chemically treated genomic DNA (Homo sapiens) CpG-island No: 6609
  misc_feature (612)..(612): n is either a, c, g or t
  misc_feature (637)..(637): n is either a, c, g or t
  misc_feature (649)..(649): n is either a, c, g or t
gtatttgcgttaggcgtatagtatttttgggcgcgggacgggcgaacgtcgtgggttttaagttgagttgggtcggttttgtagcgtcggagagtaggcggcgtagggaagggagatggggcgggatgtggggaaagttgtcgatgtttggattttttcggttcggatggcgttagttgtttttagtttagtcgcggaaattcgagttttttttagcggttcgacggttcgggcgtttcgtaattttgggtttttttcgcggtgttttcgtcgttcgtttttgcgttttggtcggtttttacgttttttcgaggtttcggcgtagcgcggtcgtcgtttatttttttatattttagaggtcgtagcgtcgttttttttttcgtatttttttttcgtaaaggagtttttcgtttcgcgcgaggtcgcggcgaggaggggcgcggttcggcgtttgggagtttatattttttcgacgcgcgtatcgtttagtagggttgtcgcgtattttcggtttcgtcgcgtatgttcgtcggtaagtattttcggttttcgtgttagttattgtgttttttcgttttttacgttttttagtcgtttttttagtgagtgttnatttatagtgtgtgttcgtgtgttnattcgtgtgttnatttgtgtgtcgagtacgtaagtcggttggttttgtttggagttggtggcggcgaagttggacggcggatggtgacgttgttatggtttggcggtgtcgtgtgttatgtatgttgtttatagggtcggtgttgtgattgagtgttggttat

SEQ ID NO: 6610 - DNA, 800 bp, Artificial Sequence
  chemically treated genomic DNA (Homo sapiens) CpG-island No: 6610
  misc_feature (152)..(152): n is either a, c, g or t
  misc_feature (164)..(164): n is either a, c, g or t
  misc_feature (189)..(189): n is either a, c, g or t
ataaccaacactcaatcacaacaccgaccctataaacaacatacataacacacgacaccgccaaaccataacaacgtcaccatccgccgtccaacttcgccgccaccaactccaaacaaaaccaaccgacttacgtactcgacacacaaatnaacacacgaatnaacacacgaacacacactataaatnaacactcactaaaaaaacgactaaaaaacgtaaaaaacgaaaaaacacaataactaacacgaaaaccgaaaatacttaccgacgaacatacgcgacgaaaccgaaaatacgcgacaaccctactaaacgatacgcgcgtcgaaaaaatataaactcccaaacgccgaaccgcgcccctcctcgccgcgacctcgcgcgaaacgaaaaactcctttacgaaaaaaaaatacgaaaaaaaaaacgacgctacgacctctaaaatataaaaaaataaacgacgaccgcgctacgccgaaacctcgaaaaaacgtaaaaaccgaccaaaacgcaaaaacgaacgacgaaaacaccgcgaaaaaaacccaaaattacgaaacgcccgaaccgtcgaaccgctaaaaaaaactcgaatttccgcgactaaactaaaaacaactaacgccatccgaaccgaaaaaatccaaacatcgacaactttccccacatcccgccccatctcccttccctacgccgcctactctccgacgctacaaaaccgacccaactcaacttaaaacccacgacgttcgcccgtcccgcgcccaaaaatactatacgcctaacgcaaatac

SEQ ID NO: 6611 - DNA, 800 bp, Artificial Sequence
  chemically treated genomic DNA (Homo sapiens) CpG-island No: 6611
  misc_feature (152)..(152): n is either a, c, g or t
  misc_feature (164)..(164): n is either a, c, g or t
  misc_feature (189)..(189): n is either a, c, g or t
gtggttagtatttagttatagtatcgattttgtgagtagtatgtatggtatacggtatcgttaggttatggtagcgttattattcgtcgtttagtttcgtcgttattagttttaggtagggttagtcgatttacgtattcgatatataaatngatatacggatnagtatacgaatatatattgtggatnaatatttattagagggacgattgagggacgtggggaacgggggaatatagtgattgatacggagatcggaggtatttatcgacgagtatacgcgacgggatcggggatacgcggtagttttgttaggcggtgcgcgcgtcggaggaatgtaagtttttaggcgtcgggtcgcgttttttttcgtcgcggtttcgcgcggggcggaggatttttttgcgggggaggaatgcgaggaaggagacggcgttgcggtttttggaatgtggggggataggcggcggtcgcgttgcgtcgggatttcggaggggcgtggaggtcggttaggacgtaggggcgggcggcggaggtatcgcggggagagtttagggttgcggggcgttcgggtcgtcgggtcgttgggaagagttcggattttcgcggttgagttggaggtagttggcgttattcgggtcggagagatttaagtatcgatagttttttttatatttcgttttattttttttttttgcgtcgtttgtttttcggcgttgtagggtcgatttagtttagtttggaatttacggcgttcgttcgtttcgcgtttaggaatattgtgcgtttagcgtagatgt

SEQ ID NO: 6612 - DNA, 800 bp, Artificial Sequence
  chemically treated genomic DNA (Homo sapiens) CpG-island No: 6612
  misc_feature (612)..(612): n is either a, c, g or t
  misc_feature (637)..(637): n is either a, c, g or t
  misc_feature (649)..(649): n is either a, c, g or t
acatctacgctaaacgcacaatattcctaaacgcgaaacgaacgaacgccgtaaattccaaactaaactaaatcgaccctacaacgccgaaaaacaaacgacgcaaaaaaaaaaaataaaacgaaatataaaaaaaactatcgatacttaaatctctccgacccgaataacgccaactacctccaactcaaccgcgaaaatccgaactcttcccaacgacccgacgacccgaacgccccgcaaccctaaactctccccgcgatacctccgccgcccgcccctacgtcctaaccgacctccacgcccctccgaaatcccgacgcaacgcgaccgccgcctatccccccacattccaaaaaccgcaacgccgtctccttcctcgcattcctcccccgcaaaaaaatcctccgccccgcgcgaaaccgcgacgaaaaaaaacgcgacccgacgcctaaaaacttacattcctccgacgcgcgcaccgcctaacaaaactaccgcgtatccccgatcccgtcgcgtatactcgtcgataaatacctccgatctccgtatcaatcactatattcccccgttccccacgtccctcaatcgtccctctaataaatattnatccacaatatatattcgtatactnatccgtatatcnatttatatatcgaatacgtaaatcgactaaccctacctaaaactaataacgacgaaactaaacgacgaataataacgctaccataacctaacgataccgtataccatacatactactcacaaaatcgatactataactaaatactaaccac

SEQ ID NO: 6613 - DNA, 562 bp, Artificial Sequence
  chemically treated genomic DNA (Homo sapiens) CpG-island No: 6613
taggcgggtcgggttttcgtggttagatttatcgttagatcgttaattatcggtagttttttgttgcgtatttgcgtagtaattgttttagtacgcgcgtatttgaaatttgatgcggtaatgcgttgataatatcgcgttatttttttttttttatatcgcgcgtatacgtattgaattatttcgttttcgtagattttacggatttcggcgcgcgaagtgataatttttttttagtcggataattcggtttttgtacgatatttagtagttgatcgaggtggttttcggttggtcgataaatgcgaatggcgattgagttattttatttaggatatgcggtggaaatacggcggtaggttacgggaaaatcggtggtcgttaattatagttgggtaacggcggaataaagggagcgcgaaagcgttaaatgggtttatagcgttgtagtattaatacggaatatatatatatcgattaaattttttaaattaatgaggcgttattttttaattcgaagtgtaatagtaatataatatattttcgggacgttattatagta

SEQ ID NO: 6614 - DNA, 562 bp, Artificial Sequence
  chemically treated genomic DNA (Homo sapiens) CpG-island No: 6614
tactataataacgtcccgaaaatatattatattactattacacttcgaattaaaaaataacgcctcattaatttaaaaaatttaatcgatatatatatattccgtattaatactacaacgctataaacccatttaacgctttcgcgctccctttattccgccgttacccaactataattaacgaccaccgattttcccgtaacctaccgccgtatttccaccgcatatcctaaataaaataactcaatcgccattcgcatttatcgaccaaccgaaaaccacctcgatcaactactaaatatcgtacaaaaaccgaattatccgactaaaaaaaaattatcacttcgcgcgccgaaatccgtaaaatctacgaaaacgaaataattcaatacgtatacgcgcgatataaaaaaaaaaaaataacgcgatattatcaacgcattaccgcatcaaatttcaaatacgcgcgtactaaaacaattactacgcaaatacgcaacaaaaaactaccgataattaacgatctaacgataaatctaaccacgaaaacccgacccgccta

SEQ ID NO: 6615 - DNA, 562 bp, Artificial Sequence
  chemically treated genomic DNA (Homo sapiens) CpG-island No: 6615
tgttgtggtagcgtttcgaggatgtgttgtgttgttgttgtatttcgggttggagggtggcgttttattgatttgggagatttagtcggtgtgtgtatatttcgtgttggtgttgtagcgttatgggtttatttggcgttttcgcgttttttttgtttcgtcgttgtttaattgtggttaacggttatcggttttttcgtggtttgtcgtcgtgtttttatcgtatattttgggtgaagtggtttagtcgttattcgtatttatcgattagtcgaaaattatttcgattagttgttggatatcgtgtaggggtcggattattcgattgaagggaaattattatttcgcgcgtcgagattcgtaaaatttacgagaacggagtggtttagtgcgtatgcgcgcggtgtggaagaaagaagatggcgcggtgttattagcgtattgtcgtattaggttttaggtgcgcgcgtattggagtaattgttgcgtaaatgcgtaataaaaagttgtcgatggttgacgatttggcgatgaatttgattacgagaattcgattcgtttg

SEQ ID NO: 6616 - DNA, 562 bp, Artificial Sequence
  chemically treated genomic DNA (Homo sapiens) CpG-island No: 6616
caaacgaatcgaattctcgtaatcaaattcatcgccaaatcgtcaaccatcgacaactttttattacgcatttacgcaacaattactccaatacgcgcgcacctaaaacctaatacgacaatacgctaataacaccgcgccatcttctttcttccacaccgcgcgcatacgcactaaaccactccgttctcgtaaattttacgaatctcgacgcgcgaaataataatttcccttcaatcgaataatccgacccctacacgatatccaacaactaatcgaaataattttcgactaatcgataaatacgaataacgactaaaccacttcacccaaaatatacgataaaaacacgacgacaaaccacgaaaaaaccgataaccgttaaccacaattaaacaacgacgaaacaaaaaaaacgcgaaaacgccaaataaacccataacgctacaacaccaacacgaaatatacacacaccgactaaatctcccaaatcaataaaacgccaccctccaacccgaaatacaacaacaacacaacacatcctcgaaacgctaccacaaca

SEQ ID NO: 6617 - DNA, 1137 bp, Artificial Sequence
  chemically treated genomic DNA (Homo sapiens) CpG-island No: 6617
  misc_feature (3)..(3): n is either a, c, g or t
gtnacgtttaataatttaacgttattacgtatatttttgcgtataaacgatattcgcgcgcgtgtacgtatagtacgtatatacgtttttcgtacgtttaacgaaacgtttttatatatatatatatatacgtttttgttttacgtgtaaattacgtgcgtatatatttacgttttttgtatatttataagcgtatattgtacgtattttattattagttttacgttttttttatttatattcgttttatatacgagatattcgttttattgtttatttacgtatacgtcgtgtcgtttttttgttttttatcgtagtgataatgcgcgttttttttaagtatcggcgatttatatatatttttaatttcgatacggttttattgatttatttgtattatatttttgcgtttagatattttatttacgtgtttcgttgtgcgattcgcgcgttttatcgttggtcgcggtcgcgaattcgtatcgtattttcgtttcggatatcgtttcggtcgttaggtacgcgatcgtattacgtacgcgttttttgagttttttttgtttttttcgtcgcgtcgcggttttttcgcgtttgggcggcgcgtcgacgttcgtagtttttttttttttcgtagtcgtttggtcgcgtgttcgtttttgaagtcgttatcgttttgatcggttgttttttcgttttatggcggttacgtacgcgattgcggtattttcgggggttttacgttcgatagtggtatgtgttttttagtcgtttgttagtcgtcgcgcgtagttcgttggcgcgttcgttgattgacgtggtttttgtttttggcgcggttcgttttcgatgcgttatcgaattttcgcgcgttaggtttcgcgggaggatttcgtagcgtttcgttatatcgggtttcgcgttttagtcgttttcgtacgttgggcgtttttacgcgtcgttcgtgttcggttgtcgtttggtttcgtttttcggggggacgcgttcgattgtcgcgtttttggcgcgttaggcggcgcgcgtgttttgggtttttttcggcgtcgggggtttttggggttgagtgtcgcgcggtatagcgcgttttgtttttattcggtaacggtagttttcgcgtcg

SEQ ID NO: 6618 - DNA, 1137 bp, Artificial Sequence
  chemically treated genomic DNA (Homo sapiens) CpG-island No: 6618
  misc_feature (1135)..(1135): n is either a, c, g or t
cgacgcgaaaactaccgttaccgaataaaaacaaaacgcgctataccgcgcgacactcaaccccaaaaacccccgacgccgaaaaaaacccaaaacacgcgcgccgcctaacgcgccaaaaacgcgacaatcgaacgcgtccccccgaaaaacgaaaccaaacgacaaccgaacacgaacgacgcgtaaaaacgcccaacgtacgaaaacgactaaaacgcgaaacccgatataacgaaacgctacgaaatcctcccgcgaaacctaacgcgcgaaaattcgataacgcatcgaaaacgaaccgcgccaaaaacaaaaaccacgtcaatcaacgaacgcgccaacgaactacgcgcgacgactaacaaacgactaaaaaacacataccactatcgaacgtaaaacccccgaaaataccgcaatcgcgtacgtaaccgccataaaacgaaaaaacaaccgatcaaaacgataacgacttcaaaaacgaacacgcgaccaaacgactacgaaaaaaaaaaaaactacgaacgtcgacgcgccgcccaaacgcgaaaaaaccgcgacgcgacgaaaaaaacaaaaaaaactcaaaaaacgcgtacgtaatacgatcgcgtacctaacgaccgaaacgatatccgaaacgaaaatacgatacgaattcgcgaccgcgaccaacgataaaacgcgcgaatcgcacaacgaaacacgtaaataaaatatctaaacgcaaaaatataatacaaataaatcaataaaaccgtatcgaaattaaaaatatatataaatcgccgatacttaaaaaaaacgcgcattatcactacgataaaaaacaaaaaaacgacacgacgtatacgtaaataaacaataaaacgaatatctcgtatataaaacgaatataaataaaaaaaacgtaaaactaataataaaatacgtacaatatacgcttataaatatacaaaaaacgtaaatatatacgcacgtaatttacacgtaaaacaaaaacgtatatatatatatatataaaaacgtttcgttaaacgtacgaaaaacgtatatacgtactatacgtacacgcgcgcgaatatcgtttatacgcaaaaatatacgtaataacgttaaattattaaacgtnac

SEQ ID NO: 6619 - DNA, 1137 bp, Artificial Sequence
  chemically treated genomic DNA (Homo sapiens) CpG-island No: 6619
  misc_feature (1135)..(1135): n is either a, c, g or t
cggcgcgggggttatcgttgtcgggtggagatagggcgcgttgtgtcgcgcggtatttagttttaggggttttcggcgtcgagggggatttaggatacgcgcgtcgtttggcgcgttaggggcgcggtaatcggacgcgttttttcgggggacgaaattaggcggtagtcgagtacgggcggcgcgtgaaggcgtttagcgtgcgagggcggttgagacgcggggttcggtatggcggggcgttgcggagttttttcgcggggtttggcgcgcgaaggttcggtggcgtatcgagggcgggtcgcgttaggggtagaaattacgttaattagcgggcgcgttaacgggttacgcgcggcggttagtaaacggttagggggtatatattattgtcgagcgtggggttttcgaaagtgtcgtagtcgcgtgcgtggtcgttatgaagcggaggagtagtcggttagggcgatgacggttttaagggcgagtacgcggttaagcggttacgaggagaggaggggttgcgagcgtcgacgcgtcgtttaggcgcgagagagtcgcggcgcggcggagaaggtaggggagatttaaggggcgcgtgcgtggtgcggtcgcgtgtttggcggtcgaagcggtgttcgaagcgggggtgcggtgcgggttcgcggtcgcggttagcggtggagcgcgcgggtcgtatagcgagatacgtgggtgagatgtttggacgtagggatgtggtgtaagtgggttagtgaggtcgtgtcggggttgagagtgtgtgtgagtcgtcggtgtttgagggaggcgcgtattgttattgcgatgggagatagggaggcggtacggcgtgtgcgtaggtggatagtagagcgggtgtttcgtgtgtgggacgggtgtaagtgaggagagcgtggggttggtgatgaggtgcgtgtagtgtgcgtttgtaggtgtgtagagggcgtgggtgtgtgcgtacgtgatttgtacgtggggtagaggcgtgtgtgtgtgtgtgtgtagaggcgtttcgttaggcgtgcggagagcgtgtgtgcgtgttgtgcgtgtacgcgcgcggatatcgtttgtgcgtaagagtgtgcgtagtgacgttaggttgttgggcgtngt

SEQ ID NO: 6620 - DNA, 1137 bp, Artificial Sequence
  chemically treated genomic DNA (Homo sapiens) CpG-island No: 6620
  misc_feature (3)..(3): n is either a, c, g or t
acnacgcccaacaacctaacgtcactacgcacactcttacgcacaaacgatatccgcgcgcgtacacgcacaacacgcacacacgctctccgcacgcctaacgaaacgcctctacacacacacacacacacgcctctaccccacgtacaaatcacgtacgcacacacccacgccctctacacacctacaaacgcacactacacgcacctcatcaccaaccccacgctctcctcacttacacccgtcccacacacgaaacacccgctctactatccacctacgcacacgccgtaccgcctccctatctcccatcgcaataacaatacgcgcctccctcaaacaccgacgactcacacacactctcaaccccgacacgacctcactaacccacttacaccacatccctacgtccaaacatctcacccacgtatctcgctatacgacccgcgcgctccaccgctaaccgcgaccgcgaacccgcaccgcacccccgcttcgaacaccgcttcgaccgccaaacacgcgaccgcaccacgcacgcgccccttaaatctcccctaccttctccgccgcgccgcgactctctcgcgcctaaacgacgcgtcgacgctcgcaacccctcctctcctcgtaaccgcttaaccgcgtactcgcccttaaaaccgtcatcgccctaaccgactactcctccgcttcataacgaccacgcacgcgactacgacactttcgaaaaccccacgctcgacaataatatataccccctaaccgtttactaaccgccgcgcgtaacccgttaacgcgcccgctaattaacgtaatttctacccctaacgcgacccgccctcgatacgccaccgaaccttcgcgcgccaaaccccgcgaaaaaactccgcaacgccccgccataccgaaccccgcgtctcaaccgccctcgcacgctaaacgccttcacgcgccgcccgtactcgactaccgcctaatttcgtcccccgaaaaaacgcgtccgattaccgcgcccctaacgcgccaaacgacgcgcgtatcctaaatccccctcgacgccgaaaacccctaaaactaaataccgcgcgacacaacgcgccctatctccacccgacaacgataacccccgcgccg

SEQ ID NO: 6621 - DNA, 500 bp, Artificial Sequence
  chemically treated genomic DNA (Homo sapiens) CpG-island No: 6621
tggattgtcgcgtgttgtgggtattgtacgaggtgcgtttttatttttagcggttaagagggtttataagatcgaatttaattttttagaagtttacgcgatatttacgtttttaaattaaggtttttcgcgcgtacggtttgttgggagatgtagtttattatttatatattagttattttgatgttttggaagagagcgcggtcgttacgttggttttgtatttttaggagacgttcgtagttttcgcgttttttttcggttaattcgcggaagaagtggtttacgttttttagagttatattatcgcggtcgaaatagaagttttacgggaagagatggaggtaataatggttagcgggaggcgaggttaaggggatttcgttttttgtttattcgatcgtataaagaaggttggcgcgtgtagtgagggtcggaggtgcgtagttggaggaaattagggttaggggcgttttggggatttattagagagaggtagg

SEQ ID NO: 6622 - DNA, 500 bp, Artificial Sequence
  chemically treated genomic DNA (Homo sapiens) CpG-island No: 6622
cctacctctctctaataaatccccaaaacgcccctaaccctaatttcctccaactacgcacctccgaccctcactacacgcgccaaccttctttatacgatcgaataaacaaaaaacgaaatccccttaacctcgcctcccgctaaccattattacctccatctcttcccgtaaaacttctatttcgaccgcgataatataactctaaaaaacgtaaaccacttcttccgcgaattaaccgaaaaaaaacgcgaaaactacgaacgtctcctaaaaatacaaaaccaacgtaacgaccgcgctctcttccaaaacatcaaaataactaatatataaataataaactacatctcccaacaaaccgtacgcgcgaaaaaccttaatttaaaaacgtaaatatcgcgtaaacttctaaaaaattaaattcgatcttataaaccctcttaaccgctaaaaataaaaacgcacctcgtacaatacccacaacacgcgacaatcca

SEQ ID NO: 6623 - DNA, 500 bp, Artificial Sequence
  chemically treated genomic DNA (Homo sapiens) CpG-island No: 6623
tttatttttttttggtgagtttttaggacgtttttggttttaattttttttagttgcgtattttcggtttttattgtacgcgttagttttttttgtgcggtcgggtaaatagagggcggagtttttttggtttcgtttttcgttaattattgttgtttttattttttttcgtagggtttttatttcgatcgcgatgatgtggttttggaaggcgtgagttatttttttcgcgaattggtcgaggagaagcgcgagggttacgagcgttttttgaagatgtaaaattagcgtggcggtcgcgtttttttttaggatattaaggtaattagtgtgtgggtaatggattatattttttagtaggtcgtgcgcgcgaggagttttgatttgagggcgtaggtgtcgcgtgggtttttgggagattgagttcggttttgtgagtttttttaatcgttggaaatagaggcgtatttcgtgtagtgtttataatacgcggtagttta

SEQ ID NO: 6624 - DNA, 500 bp, Artificial Sequence
  chemically treated genomic DNA (Homo sapiens) CpG-island No: 6624
taaactaccgcgtattataaacactacacgaaatacgcctctatttccaacgattaaaaaaactcacaaaaccgaactcaatctcccaaaaacccacgcgacacctacgccctcaaatcaaaactcctcgcgcgcacgacctactaaaaaatataatccattacccacacactaattaccttaatatcctaaaaaaaaacgcgaccgccacgctaattttacatcttcaaaaaacgctcgtaaccctcgcgcttctcctcgaccaattcgcgaaaaaaataactcacgccttccaaaaccacatcatcgcgatcgaaataaaaaccctacgaaaaaaaataaaaacaacaataattaacgaaaaacgaaaccaaaaaaactccgccctctatttacccgaccgcacaaaaaaaactaacgcgtacaataaaaaccgaaaatacgcaactaaaaaaaattaaaaccaaaaacgtcctaaaaactcaccaaaaaaaaataaa

SEQ ID NO: 6625 - DNA, 786 bp, Artificial Sequence
  chemically treated genomic DNA (Homo sapiens) CpG-island No: 6625
gattagcgtacgtttaaacggtttggatagatatttcgtagtatcgttttgtagggtcgatttttagaggattttttcgtttgaatatcgttattattagcgtgttgttgacgttggtcgataacgatacgtcggtgtggttttttattttattaaataacgatatcgttaattagagtttgcgtttttatattaacgcgtcgttggttagttagtcggaataggcgattttcgcggtgacggatgaggcgatttttagcgaatagtttaacgttttttttatcggtatcgtcgttgcgtcggaagcgggtgcgacgttgattttataggtcgttagtttgagcggcggacgtatgttgcgttttattggtgcgggtattgtcgaagaacgaatgatcgtttcgtagttgtcggagtgtattttgtacgaatttatcgagcgttcgtattcgttttcgttcggtatcgatttgattttgatttgtggcgagcgtttgttggttatttcgcgaattatttatgtggatgtgtgtttatgtacgttgtcgtgaaagggggcgagaatgcgatcgacgtcgtttattttttgtaagagagtcgacgtcgaggcgatatcgatttgttcgaattgagcgtcgtttagattgaatagtagtttaatttcgcggtagatcgcgtgatgatcgaaggcgtattgtcgacgtttgattggtcgttcgtagttattagttgattaataggcgtaaaaaaatcgggggaattattttataagcgttaatttaaggg

SEQ ID NO: 6626 - DNA, 786 bp, Artificial Sequence
  chemically treated genomic DNA (Homo sapiens) CpG-island No: 6626
cccttaaattaacgcttataaaataattcccccgatttttttacgcctattaatcaactaataactacgaacgaccaatcaaacgtcgacaatacgccttcgatcatcacgcgatctaccgcgaaattaaactactattcaatctaaacgacgctcaattcgaacaaatcgatatcgcctcgacgtcgactctcttacaaaaaataaacgacgtcgatcgcattctcgccccctttcacgacaacgtacataaacacacatccacataaataattcgcgaaataaccaacaaacgctcgccacaaatcaaaatcaaatcgataccgaacgaaaacgaatacgaacgctcgataaattcgtacaaaatacactccgacaactacgaaacgatcattcgttcttcgacaatacccgcaccaataaaacgcaacatacgtccgccgctcaaactaacgacctataaaatcaacgtcgcacccgcttccgacgcaacgacgataccgataaaaaaaacgttaaactattcgctaaaaatcgcctcatccgtcaccgcgaaaatcgcctattccgactaactaaccaacgacgcgttaatataaaaacgcaaactctaattaacgatatcgttatttaataaaataaaaaaccacaccgacgtatcgttatcgaccaacgtcaacaacacgctaataataacgatattcaaacgaaaaaatcctctaaaaatcgaccctacaaaacgatactacgaaatatctatccaaaccgtttaaacgtacgctaatc

SEQ ID NO: 6627 - DNA, 786 bp, Artificial Sequence
  chemically treated genomic DNA (Homo sapiens) CpG-island No: 6627
tttttaagttagcgtttatgggataattttttcggtttttttacgtttgttaattagttaatggttgcgggcgattaattaagcgtcggtaatgcgttttcggttattacgcgatttatcgcgaggttaagttgttgtttaatttgggcgacgtttagttcgggtaaatcggtatcgtttcggcgtcggtttttttgtagagagtgggcggcgtcgatcgtattttcgtttttttttacggtaacgtatatgagtatatatttatatgagtggttcgcggaatagttagtaggcgttcgttataggttaggattaggtcgatgtcgagcgggaacggatgcgggcgttcggtgagttcgtgtagaatgtatttcggtagttgcggagcgattattcgtttttcggtaatattcgtattagtaaggcgtaatatgcgttcgtcgtttaggttggcgatttgtaaaattagcgtcgtattcgttttcggcgtaacggcggtgtcggtggaaagggcgttgagttgttcgttggaaatcgttttattcgttatcgcgaaggtcgtttgtttcggttggttgattagcggcgcgttggtatgaaaacgtaggttttggttgacgatatcgttatttaatggggtagaaagttatatcggcgtgtcgttatcggttagcgttagtagtacgttggtggtggcgatatttagacggggggattttttaagagtcgattttgtagagcgatgttgcggggtatttatttagatcgtttggacgtacgttggtt

SEQ ID NO: 6628 - DNA, 786 bp, Artificial Sequence
  chemically treated genomic DNA (Homo sapiens) CpG-island No: 6628
aaccaacgtacgtccaaacgatctaaataaataccccgcaacatcgctctacaaaatcgactcttaaaaaatccccccgtctaaatatcgccaccaccaacgtactactaacgctaaccgataacgacacgccgatataactttctaccccattaaataacgatatcgtcaaccaaaacctacgttttcataccaacgcgccgctaatcaaccaaccgaaacaaacgaccttcgcgataacgaataaaacgatttccaacgaacaactcaacgccctttccaccgacaccgccgttacgccgaaaacgaatacgacgctaattttacaaatcgccaacctaaacgacgaacgcatattacgccttactaatacgaatattaccgaaaaacgaataatcgctccgcaactaccgaaatacattctacacgaactcaccgaacgcccgcatccgttcccgctcgacatcgacctaatcctaacctataacgaacgcctactaactattccgcgaaccactcatataaatatatactcatatacgttaccgtaaaaaaaaacgaaaatacgatcgacgccgcccactctctacaaaaaaaccgacgccgaaacgataccgatttacccgaactaaacgtcgcccaaattaaacaacaacttaacctcgcgataaatcgcgtaataaccgaaaacgcattaccgacgcttaattaatcgcccgcaaccattaactaattaacaaacgtaaaaaaaccgaaaaaattatcccataaacgctaacttaaaaa

SEQ ID NO: 6629 - DNA, 807 bp, Artificial Sequence
  chemically treated genomic DNA (Homo sapiens) CpG-island No: 6629
gatttggcgtaggttatgatgttcgttttttataagtttattagtagtagtttcgtgaacgattatgtaggaatttttttcgcgtgtgtagttttagatatggacgaacggcgtatgttaaatgcgtcgtttagtttgcgtttgatattggtggaaaaattgcgtcgatgttggatttcggttattcggtattgacgtagatcgcgtagtattggcgttgttgtaaaaaatggattatcgttagtattttgttttttcgggtttttttagtaaatgtcgtttgtatgagtggtttttagttcgtgtcgcggaaggaaaaggcgttaacgtaacgaggtttattggtgtaggtaggtgatagagcgagtaaatttttattcgttggcgtgttggggcgtataacgtttgtcgttgtttgggcgttgttttatcgttttggaggagttgcgttgggggtatttggcgatgtttgtcgtttgggaagttcgtaagcggtggcgttgttttgggtgatttgttcgagaaagcgatataatatttggtagagagtattatgcggtatcgattacgcgttattattattattagtggtttgttttttcgtcgtttcgacgggcggggagtatgttgattttttaagttggttgggaaatggattacggtagataaataattcgtttgttggttagtgatttaacgttgtaaattgtcgcgttggggatgttacgattttgtttagcgtagcgtttgcgggggtaatgttcgaggaaattttttttgtaaatttggcgtaaataatagttatat

SEQ ID NO: 6630 - DNA, 807 bp, Artificial Sequence
  chemically treated genomic DNA (Homo sapiens) CpG-island No: 6630
atataactattatttacgccaaatttacaaaaaaaatttcctcgaacattacccccgcaaacgctacgctaaacaaaatcgtaacatccccaacgcgacaatttacaacgttaaatcactaaccaacaaacgaattatttatctaccgtaatccatttcccaaccaacttaaaaaatcaacatactccccgcccgtcgaaacgacgaaaaaacaaaccactaataataataataacgcgtaatcgataccgcataatactctctaccaaatattatatcgctttctcgaacaaatcacccaaaacaacgccaccgcttacgaacttcccaaacgacaaacatcgccaaatacccccaacgcaactcctccaaaacgataaaacaacgcccaaacaacgacaaacgttatacgccccaacacgccaacgaataaaaatttactcgctctatcacctacctacaccaataaacctcgttacgttaacgccttttccttccgcgacacgaactaaaaaccactcatacaaacgacatttactaaaaaaacccgaaaaaacaaaatactaacgataatccattttttacaacaacgccaatactacgcgatctacgtcaataccgaataaccgaaatccaacatcgacgcaatttttccaccaatatcaaacgcaaactaaacgacgcatttaacatacgccgttcgtccatatctaaaactacacacgcgaaaaaaattcctacataatcgttcacgaaactactactaataaacttataaaaaacgaacatcataacctacgccaaatc

SEQ ID NO: 6631 - DNA, 807 bp, Artificial Sequence
  chemically treated genomic DNA (Homo sapiens) CpG-island No: 6631
atgtaattattatttacgttaaatttatagagaagattttttcgagtattgttttcgtagacgttgcgttgaatagagtcgtggtatttttagcgcgatagtttgtagcgttgggttattgattagtaaacgggttgtttatttgtcgtggtttattttttagttaatttaaaaaattagtatgtttttcgttcgtcggaacggcgaagaggtaaattattgatggtaatagtgacgcgtggtcggtgtcgtatgatattttttgttagatgttgtgtcgttttttcgagtaaattatttagaataacgttatcgtttgcgggttttttagacggtaggtatcgttaaatgtttttagcgtaatttttttagaacgataaaatagcgtttaggtaacgataggcgttatacgttttagtacgttagcgggtaaaaatttgttcgttttgttatttgtttgtattagtaggtttcgttgcgttaacgtttttttttttcgcgatacgggttgaaaattatttatataggcggtatttgttgggggagttcgggaaagtagagtgttggcggtgatttattttttgtagtagcgttagtgttgcgcgatttgcgttagtgtcggatgatcgggatttagtatcgacgtagtttttttattaatgttagacgtaggttaagcggcgtatttaatatgcgtcgttcgtttatgtttgaagttgtatacgcgaaagaagtttttgtatagtcgtttacgaaattgttgttgatgggtttgtggaaggcgggtattatagtttgcgttagatt

SEQ ID NO: 6632 - DNA, 807 bp, Artificial Sequence
  chemically treated genomic DNA (Homo sapiens) CpG-island No: 6632
aatctaacgcaaactataatacccgccttccacaaacccatcaacaacaatttcgtaaacgactatacaaaaacttctttcgcgtatacaacttcaaacataaacgaacgacgcatattaaatacgccgcttaacctacgtctaacattaataaaaaaactacgtcgatactaaatcccgatcatccgacactaacgcaaatcgcgcaacactaacgctactacaaaaaataaatcaccgccaacactctactttcccgaactcccccaacaaataccgcctatataaataattttcaacccgtatcgcgaaaaaaaaaaacgttaacgcaacgaaacctactaatacaaacaaataacaaaacgaacaaatttttacccgctaacgtactaaaacgtataacgcctatcgttacctaaacgctattttatcgttctaaaaaaattacgctaaaaacatttaacgatacctaccgtctaaaaaacccgcaaacgataacgttattctaaataatttactcgaaaaaacgacacaacatctaacaaaaaatatcatacgacaccgaccacgcgtcactattaccatcaataatttacctcttcgccgttccgacgaacgaaaaacatactaattttttaaattaactaaaaaataaaccacgacaaataaacaacccgtttactaatcaataacccaacgctacaaactatcgcgctaaaaataccacgactctattcaacgcaacgtctacgaaaacaatactcgaaaaaatcttctctataaatttaacgtaaataataattacat

SEQ ID NO: 6633 - DNA, 575 bp, Artificial Sequence
  chemically treated genomic DNA (Homo sapiens) CpG-island No: 6633
attcgtcgtttgatttagtttcgataatttaattgtcgttcgtcgtcgataatcgcgatgttgttatcgtagtatgtcgcgttagaatgtcggttagcggtaaattttgttagtagttttttttcgatagcgacgggtaaattttttcggttagcgggtgaatggatgtttattttcgttttttaatgtaatttaaaaacgtttaatatggtagaagtttgacgtttgtttcgcgttatttatttaacggtgacgacgtaggttaattttcgtttcggtaaatagacgtatttgattttttcgtagtttcgttagcggatggttattatttattcgtcgttattttcgttgttatattaattataatgtcgttaaatagttcgcggtcgaacggttttagtttagtaatatttgggtcgcggtttgatgcgggaaatcgtttagcgcgggggtcggatgagtagataggttagagttagtgcgtttttttgcgaattcgttttattttaaagggagttgcgagatgttatagcgtcggcgtggtgattagttgtggaaagaaggaacgtgtaatt

SEQ ID NO: 6634 - DNA, 575 bp, Artificial Sequence
  chemically treated genomic DNA (Homo sapiens) CpG-island No: 6634
aattacacgttccttctttccacaactaatcaccacgccgacgctataacatctcgcaactccctttaaaataaaacgaattcgcaaaaaaacgcactaactctaacctatctactcatccgacccccgcgctaaacgatttcccgcatcaaaccgcgacccaaatattactaaactaaaaccgttcgaccgcgaactatttaacgacattataattaatataacaacgaaaataacgacgaataaataataaccatccgctaacgaaactacgaaaaaatcaaatacgtctatttaccgaaacgaaaattaacctacgtcgtcaccgttaaataaataacgcgaaacaaacgtcaaacttctaccatattaaacgtttttaaattacattaaaaaacgaaaataaacatccattcacccgctaaccgaaaaaatttacccgtcgctatcgaaaaaaaactactaacaaaatttaccgctaaccgacattctaacgcgacatactacgataacaacatcgcgattatcgacgacgaacgacaattaaattatcgaaactaaatcaaacgacgaat

SEQ ID NO: 6635 - DNA, 575 bp, Artificial Sequence
  chemically treated genomic DNA (Homo sapiens) CpG-island No: 6635
agttatacgttttttttttttatagttgattattacgtcgacgttgtggtatttcgtaattttttttaaggtaaagcgaattcgtaagaaaacgtattgattttggtttgtttgtttattcgattttcgcgttgagcggtttttcgtattaggtcgcgatttaggtattgttgaattggaatcgttcgatcgcgaattgtttggcggtattgtggttggtgtgatagcgaaggtaacggcgaatgggtggtgattattcgttggcgaagttgcgggaaaattaggtgcgtttgtttgtcggagcggggattggtttgcgtcgttatcgttgggtgagtggcgcgaaataggcgttaaatttttattatgttgaacgtttttggattgtattaaggagcgaggatgagtatttatttattcgttggtcggaagagtttgttcgtcgttatcgggaaaaagttattggtaggatttgtcgttgatcgatattttgacgcgatatgttgcggtgatagtatcgcggttatcgacggcgagcgatagttgagttatcgggattgaattaggcggcggat

SEQ ID NO: 6636 - DNA, 575 bp, Artificial Sequence
  chemically treated genomic DNA (Homo sapiens) CpG-island No: 6636
atccgccgcctaattcaatcccgataactcaactatcgctcgccgtcgataaccgcgatactatcaccgcaacatatcgcgtcaaaatatcgatcaacgacaaatcctaccaataactttttcccgataacgacgaacaaactcttccgaccaacgaataaataaatactcatcctcgctccttaatacaatccaaaaacgttcaacataataaaaatttaacgcctatttcgcgccactcacccaacgataacgacgcaaaccaatccccgctccgacaaacaaacgcacctaattttcccgcaacttcgccaacgaataatcaccacccattcgccgttaccttcgctatcacaccaaccacaataccgccaaacaattcgcgatcgaacgattccaattcaacaatacctaaatcgcgacctaatacgaaaaaccgctcaacgcgaaaatcgaataaacaaacaaaccaaaatcaatacgttttcttacgaattcgctttaccttaaaaaaaattacgaaataccacaacgtcgacgtaataatcaactataaaaaaaaaaaacgtataact

SEQ ID NO: 6637 - DNA, 1052 bp, Artificial Sequence
  chemically treated genomic DNA (Homo sapiens) CpG-island No: 6637
ttcgtatcgtttggaatatcggacggtttttgttagtatggtttgaatatggcgtttaatattggttttcgtttcgttattaatattggatcgatatcggtggttaggcgattcggattatttattcggtattggttattgcgtcgcgtagtatttttaacgtgtggtcggtaattttatttgtaggtatagtacgcgtagcgtcgaataacgttgattcgtattgtcgaagtcgaggttagtatatttacgacgatttgttcggttagtgttgaagaatgataattatcgcgtttatgtcgtcggttttagcgatgagcggaataggggattttgagcgtttaggcggttggcgatattgcgttgtagtaacgtagtatttcggttgaatcggtaaatattatttcgcgtacgcgattattattcgtagttgcgcgtttacggttttatttcgatttggtagtaattgtattacgttggcggtatattcgtttttagtaaaatggcgattttttgcgcggtaatagcggcgtttgttttgtcggttttgttagtacgttgttatttgtcgttatgcggcggcgatttgttcggtgaaaatagttagcgggaagttttacggatgatatatattataggttttaatggacggtgggtttcgttagcgaaatttttcgtatttgttcggcgtagtagtggagaaaatcgatcgtttcgcgtattcggtaatggcgttattgaaggttttttcggttttacgtattagaatataattagttgttgtatttggttttttattagtacggtagcgcggtgtaaatcgttgcgcgtttagtcggaggcgtggtaaattagattggcgcgttataatcgtattttttagcgtttgttttattttacgcggcgtggttttacgttatagtttataatatttttcggtttcgtagggttaataacgggcgatatttatttgtcgttatcggttgttttagtattggtaaggtttgttattttttagtgtattattgagtagggtagaggagagcgaggtt

SEQ ID NO: 6638 - DNA, 1052 bp, Artificial Sequence
  chemically treated genomic DNA (Homo sapiens) CpG-island No: 6638
aacctcgctctcctctaccctactcaataatacactaaaaaataacaaaccttaccaatactaaaacaaccgataacgacaaataaatatcgcccgttattaaccctacgaaaccgaaaaatattataaactataacgtaaaaccacgccgcgtaaaataaaacaaacgctaaaaaatacgattataacgcgccaatctaatttaccacgcctccgactaaacgcgcaacgatttacaccgcgctaccgtactaataaaaaaccaaatacaacaactaattatattctaatacgtaaaaccgaaaaaaccttcaataacgccattaccgaatacgcgaaacgatcgattttctccactactacgccgaacaaatacgaaaaatttcgctaacgaaacccaccgtccattaaaacctataatatatatcatccgtaaaacttcccgctaactattttcaccgaacaaatcgccgccgcataacgacaaataacaacgtactaacaaaaccgacaaaacaaacgccgctattaccgcgcaaaaaatcgccattttactaaaaacgaatataccgccaacgtaatacaattactaccaaatcgaaataaaaccgtaaacgcgcaactacgaataataatcgcgtacgcgaaataatatttaccgattcaaccgaaatactacgttactacaacgcaatatcgccaaccgcctaaacgctcaaaatcccctattccgctcatcgctaaaaccgacgacataaacgcgataattatcattcttcaacactaaccgaacaaatcgtcgtaaatatactaacctcgacttcgacaatacgaatcaacgttattcgacgctacgcgtactatacctacaaataaaattaccgaccacacgttaaaaatactacgcgacgcaataaccaataccgaataaataatccgaatcgcctaaccaccgatatcgatccaatattaataacgaaacgaaaaccaatattaaacgccatattcaaaccatactaacaaaaaccgtccgatattccaaacgatacgaa

SEQ ID NO: 6639 - DNA, 1052 bp, Artificial Sequence
  chemically treated genomic DNA (Homo sapiens) CpG-island No: 6639
ggtttcgtttttttttgttttgtttaatagtgtattgaaaaatggtaggttttgttaatgttggaataatcggtagcggtaggtgaatgtcgttcgttattaattttgcggaatcgaaagatattgtgggttatggcgtgaagttacgtcgcgtgaagtagaataggcgttggaaagtgcggttataacgcgttaatttggtttgttacgttttcggttgaacgcgtagcgatttgtatcgcgttgtcgtgttgatggaaagttagatgtagtaattgattgtattttggtgcgtgaggtcggaaaaatttttagtaacgttattgtcgaatgcgcgaagcggtcgattttttttattattacgtcggataggtgcgggagatttcgttaacgaaatttatcgtttattagggtttgtggtgtgtattattcgtggaatttttcgttggttatttttatcgggtagatcgtcgtcgtatggcggtaggtaatagcgtgttggtaaaatcggtagaataaacgtcgttattgtcgcgtaagggatcgttattttgttggaagcgggtgtatcgttagcgtggtgtaattgttgttaggtcggggtgaaatcgtgggcgcgtaattgcgggtgatgatcgcgtgcgcggggtgatgtttatcggtttaatcgaagtgttacgttattgtagcgtaatatcgttagtcgtttggacgtttagggttttttatttcgtttatcgttgaaatcggcggtatgaacgcgatgattgttattttttagtattgatcgaataggtcgtcgtggatgtattggtttcggtttcgatagtgcgggttagcgttgttcggcgttgcgcgtgttgtgtttgtagatgagattgtcgattatacgttgaaaatgttgcgcggcgtaatggttaatgtcggatgggtaattcgggtcgtttgattatcgatatcggtttagtattgatagcgaagcgaaagttaatattgagcgttatatttagattatgttagtaaaggtcgttcggtgttttaggcggtgcggg

SEQ ID NO: 6640 - DNA, 1052 bp, Artificial Sequence
  chemically treated genomic DNA (Homo sapiens) CpG-island No: 6640
cccgcaccgcctaaaacaccgaacgacctttactaacataatctaaatataacgctcaatattaactttcgcttcgctatcaatactaaaccgatatcgataatcaaacgacccgaattacccatccgacattaaccattacgccgcgcaacattttcaacgtataatcgacaatctcatctacaaacacaacacgcgcaacgccgaacaacgctaacccgcactatcgaaaccgaaaccaatacatccacgacgacctattcgatcaatactaaaaaataacaatcatcgcgttcataccgccgatttcaacgataaacgaaataaaaaaccctaaacgtccaaacgactaacgatattacgctacaataacgtaacacttcgattaaaccgataaacatcaccccgcgcacgcgatcatcacccgcaattacgcgcccacgatttcaccccgacctaacaacaattacaccacgctaacgatacacccgcttccaacaaaataacgatcccttacgcgacaataacgacgtttattctaccgattttaccaacacgctattacctaccgccatacgacgacgatctacccgataaaaataaccaacgaaaaattccacgaataatacacaccacaaaccctaataaacgataaatttcgttaacgaaatctcccgcacctatccgacgtaataataaaaaaaatcgaccgcttcgcgcattcgacaataacgttactaaaaatttttccgacctcacgcaccaaaatacaatcaattactacatctaactttccatcaacacgacaacgcgatacaaatcgctacgcgttcaaccgaaaacgtaacaaaccaaattaacgcgttataaccgcactttccaacgcctattctacttcacgcgacgtaacttcacgccataacccacaatatctttcgattccgcaaaattaataacgaacgacattcacctaccgctaccgattattccaacattaacaaaacctaccatttttcaatacactattaaacaaaacaaaaaaaaacgaaacc

SEQ ID NO: 6641 - DNA, 511 bp, Artificial Sequence
  chemically treated genomic DNA (Homo sapiens) CpG-island No: 6641
tcggggcggattcgggttcgatttcgtcgtattaggtttagtatttagagacggtgttatcggaatatcgtattcgggaattttgagcgtttatgaggaagtcggagggagagtgacgaggacgttacggcggcgggaagcgatttttatttatataagagttttaaggtttgaaatttagaatacgttttcgatagggagttaggtttacgaagtcgcgttaaggattaaatatcgttattagacgtatcgtatcgttttatttttaagatagataggaatcgcgtcgtttttttatggtttatttgaagtaacggcgttttggaatttacgtaaagggaattttaaggtaataggtggaatttcggttttttatacgcgtggaaatcgcgtttaggaatggaaacgattattataggcgaattaattagattttagtttggtttagtttttggacgattagagatttgttcgtagtttaaagtcgtttttttgcgttaggacgtttatt

SEQ ID NO: 6642 - DNA, 511 bp, Artificial Sequence
  chemically treated genomic DNA (Homo sapiens) CpG-island No: 6642
aataaacgtcctaacgcaaaaaaacgactttaaactacgaacaaatctctaatcgtccaaaaactaaaccaaactaaaatctaattaattcgcctataataatcgtttccattcctaaacgcgatttccacgcgtataaaaaaccgaaattccacctattaccttaaaattccctttacgtaaattccaaaacgccgttacttcaaataaaccataaaaaaacgacgcgattcctatctatcttaaaaataaaacgatacgatacgtctaataacgatatttaatccttaacgcgacttcgtaaacctaactccctatcgaaaacgtattctaaatttcaaaccttaaaactcttatataaataaaaatcgcttcccgccgccgtaacgtcctcgtcactctccctccgacttcctcataaacgctcaaaattcccgaatacgatattccgataacaccgtctctaaatactaaacctaatacgacgaaatcgaacccgaatccgccccga

SEQ ID NO: 6643 - DNA, 511 bp, Artificial Sequence
  chemically treated genomic DNA (Homo sapiens) CpG-island No: 6643
ggtgagcgttttggcgtagggggacgattttgagttgcgggtaggtttttggtcgtttaggagttgggttaggttggggtttggttgattcgtttatagtggtcgtttttatttttgggcgcggtttttacgcgtgtgggaaatcggggttttatttattgttttgggattttttttgcgtgggttttaaggcgtcgttgttttaaatgggttatggaagggcggcgcggtttttgtttgttttgggggtggggcggtgcggtgcgtttggtggcggtgtttggtttttggcgcggtttcgtgggtttggttttttgtcgggggcgtgttttgggttttagattttggagtttttgtataggtgggagtcgtttttcgtcgtcgtagcgttttcgttatttttttttcgatttttttatgggcgtttagagttttcggatgcgatatttcggtgatatcgtttttgggtgttgggtttagtgcgacgaggtcgggttcgggttcgtttcgg

SEQ ID NO: 6644 - DNA, 511 bp, Artificial Sequence
  chemically treated genomic DNA (Homo sapiens) CpG-island No: 6644
ccgaaacgaacccgaacccgacctcgtcgcactaaacccaacacccaaaaacgatatcaccgaaatatcgcatccgaaaactctaaacgcccataaaaaaatcgaaaaaaaaataacgaaaacgctacgacgacgaaaaacgactcccacctatacaaaaactccaaaatctaaaacccaaaacacgcccccgacaaaaaaccaaacccacgaaaccgcgccaaaaaccaaacaccgccaccaaacgcaccgcaccgccccacccccaaaacaaacaaaaaccgcgccgcccttccataacccatttaaaacaacgacgccttaaaacccacgcaaaaaaaatcccaaaacaataaataaaaccccgatttcccacacgcgtaaaaaccgcgcccaaaaataaaaacgaccactataaacgaatcaaccaaaccccaacctaacccaactcctaaacgaccaaaaacctacccgcaactcaaaatcgtccccctacgccaaaacgctcacc

SEQ ID NO: 6645 - DNA, 518 bp, Artificial Sequence
  chemically treated genomic DNA (Homo sapiens) CpG-island No: 6645
ttacgttttcggaggcgatttgttttttttatcgcgcgtttcgaaagtattgttttttttcggggtttcgggttatcgattttatttatagagcggcgggaggattgtaggtacggtcggtttagggtattcggttcggcggaaaatgtagaggtcgcgttcgtttttaattaacggttttgattcgtttagcgtagttttcgacggacgtaggtttcgcgcggtatttatcggcgcgcgtcgtataatggcgttcgtcggtcggcggcgaagtgcgttattcgtcgtttcgaattataatttttagacgttttcgcggcgcgttagttgttttatttagcggcggttattttgattggtcggttaggggcggtaggtaagtcggggatagtaggaggaggatattcgtcgatgtttttcggcggttagttaggtaaggggaggtttttggtgagggacgttaggtcgtagggtttatattaatgtgggcggcgattcgagttgggagagagtcgtgt

SEQ ID NO: 6646 - DNA, 518 bp, Artificial Sequence
  chemically treated genomic DNA (Homo sapiens) CpG-island No: 6646
acacgactctctcccaactcgaatcgccgcccacattaatataaaccctacgacctaacgtccctcaccaaaaacctccccttacctaactaaccgccgaaaaacatcgacgaatatcctcctcctactatccccgacttacctaccgcccctaaccgaccaatcaaaataaccgccgctaaataaaacaactaacgcgccgcgaaaacgtctaaaaattataattcgaaacgacgaataacgcacttcgccgccgaccgacgaacgccattatacgacgcgcgccgataaataccgcgcgaaacctacgtccgtcgaaaactacgctaaacgaatcaaaaccgttaattaaaaacgaacgcgacctctacattttccgccgaaccgaataccctaaaccgaccgtacctacaatcctcccgccgctctataaataaaatcgataacccgaaaccccgaaaaaaaacaatactttcgaaacgcgcgataaaaaaaacaaatcgcctccgaaaacgtaa

SEQ ID NO: 6647 - DNA, 518 bp, Artificial Sequence
  chemically treated genomic DNA (Homo sapiens) CpG-island No: 6647
gtacgatttttttttagttcgggtcgtcgtttatattagtgtgggttttgcggtttagcgttttttattagaggtttttttttgtttagttgatcgtcgagggatatcgacgagtattttttttttgttgttttcggtttgtttgtcgtttttaatcggttagttaagatggtcgtcgttgggtgaggtagttggcgcgtcgcgggggcgtttgggagttgtagttcgggacggcgggtgacgtatttcgtcgtcggtcgacgggcgttattgtgcggcgcgcgtcggtgagtgtcgcgcgaaatttgcgttcgtcgggggttgcgttgggcgggttagaatcgttagttgggggcgagcgcggtttttgtatttttcgtcgagtcgggtattttgagtcggtcgtgtttgtagttttttcgtcgttttgtgggtggggtcggtgattcggaatttcgaggggagatagtgttttcggggcgcgcggtggagagaatagatcgttttcggaagcgtgg

SEQ ID NO: 6648 - DNA, 518 bp, Artificial Sequence
  chemically treated genomic DNA (Homo sapiens) CpG-island No: 6648
ccacgcttccgaaaacgatctattctctccaccgcgcgccccgaaaacactatctcccctcgaaattccgaatcaccgaccccacccacaaaacgacgaaaaaactacaaacacgaccgactcaaaatacccgactcgacgaaaaatacaaaaaccgcgctcgcccccaactaacgattctaacccgcccaacgcaacccccgacgaacgcaaatttcgcgcgacactcaccgacgcgcgccgcacaataacgcccgtcgaccgacgacgaaatacgtcacccgccgtcccgaactacaactcccaaacgcccccgcgacgcgccaactacctcacccaacgacgaccatcttaactaaccgattaaaaacgacaaacaaaccgaaaacaacaaaaaaaaaatactcgtcgatatccctcgacgatcaactaaacaaaaaaaaacctctaataaaaaacgctaaaccgcaaaacccacactaatataaacgacgacccgaactaaaaaaaaatcgtac

SEQ ID NO: 6649 - DNA, 517 bp, Artificial Sequence
  chemically treated genomic DNA (Homo sapiens) CpG-island No: 6649
atgcgagtcggaatttacgggtgacgttaaggaaagagcgggggcgtttagattagttcggagcgatttcgtttttagaggagtgattttaatcgttacggagcgttttatttattaggagaattacgtttttggttagattttcgttttagcggttcgatatgtttattatttaggtgaaatttattcgcggacgcgtttttttcgttttataaggattcggcggatttttattcgttaagattttttttcgaggaaacggaggtagcgtagggtttagggatgcgtcggtatttacggttgcggtcggcggtagttatgtttcgggcgattgcgtttgcgcggttgtcggataaggatgtgcgcgtgcgcggagttttcgagtttttttcgtttaacgtggggcggtcgcgggtatcgggttatttattattttggcgtggatttgttcggggcggacgcgtaggtatttatttttttttatggttttttttgattttaattcgatgttattatt

SEQ ID NO: 6650 - DNA, 517 bp, Artificial Sequence
  chemically treated genomic DNA (Homo sapiens) CpG-island No: 6650
aataataacatcgaattaaaatcaaaaaaaaccataaaaaaaaataaatacctacgcgtccgccccgaacaaatccacgccaaaataataaataacccgatacccgcgaccgccccacgttaaacgaaaaaaactcgaaaactccgcgcacgcgcacatccttatccgacaaccgcgcaaacgcaatcgcccgaaacataactaccgccgaccgcaaccgtaaataccgacgcatccctaaaccctacgctacctccgtttcctcgaaaaaaaatcttaacgaataaaaatccgccgaatccttataaaacgaaaaaaacgcgtccgcgaataaatttcacctaaataataaacatatcgaaccgctaaaacgaaaatctaaccaaaaacgtaattctcctaataaataaaacgctccgtaacgattaaaatcactcctctaaaaacgaaatcgctccgaactaatctaaacgcccccgctctttccttaacgtcacccgtaaattccgactcgcat

SEQ ID NO: 6651 - DNA, 517 bp, Artificial Sequence
  chemically treated genomic DNA (Homo sapiens) CpG-island No: 6651
aatgatagtatcgggttaaaattagaggagattataggagaaagtaaatgtttgcgcgttcgtttcgagtaagtttacgttagggtaatgaataattcggtattcgcggtcgttttacgttgggcgggggaagttcggggatttcgcgtacgcgtatatttttgttcggtagtcgcgtaagcgtaatcgttcggaatatggttgtcgtcggtcgtaatcgtaagtgtcgacgtatttttgagttttgcgttgttttcgttttttcggagggaagttttggcgggtggaggttcgtcgggtttttgtggggcgggaggggcgcgttcgcgggtgggttttatttgggtggtgggtatgtcgggtcgttagggcgagggtttggttaggggcgtagtttttttggtgggtgggacgtttcgtggcgattggggttatttttttgaggacgaggtcgtttcgggttggtttggacgttttcgttttttttttagcgttattcgtgagtttcggttcgtat

SEQ ID NO: 6652 - DNA, 517 bp, Artificial Sequence
  chemically treated genomic DNA (Homo sapiens) CpG-island No: 6652
atacgaaccgaaactcacgaataacgctaaaaaaaaaacgaaaacgtccaaaccaacccgaaacgacctcgtcctcaaaaaaataaccccaatcgccacgaaacgtcccacccaccaaaaaaactacgcccctaaccaaaccctcgccctaacgacccgacatacccaccacccaaataaaacccacccgcgaacgcgcccctcccgccccacaaaaacccgacgaacctccacccgccaaaacttccctccgaaaaaacgaaaacaacgcaaaactcaaaaatacgtcgacacttacgattacgaccgacgacaaccatattccgaacgattacgcttacgcgactaccgaacaaaaatatacgcgtacgcgaaatccccgaacttcccccgcccaacgtaaaacgaccgcgaataccgaattattcattaccctaacgtaaacttactcgaaacgaacgcgcaaacatttactttctcctataatctcctctaattttaacccgatactatcatt

SEQ ID NO: 6653 - DNA, 546 bp, Artificial Sequence
  chemically treated genomic DNA (Homo sapiens) CpG-island No: 6653
cgatcgatattttcgacgtttaggatgaggaatatcgggagtcggtgttgttttttaacgttgcggttcgcgtggcggtggaagtaggtattgtcgattattggtataagtatgttggtttgaaaggggtaattgtcgggatgacgggttacggggaatttgtttcggcggataagttgttttcgttttttggttttatcgtcgagaatattgtggtaaaagcgtataaggtgttgggagtgaaaggtgtttgatggtgattgtcggatgttgattgtcggatgcgacgttgacgcgttttattcggtttatagcgttttattcggtttatatgtttcgttattttgtttaacgggtgatttataacgtgggttaggcgtttggtttatgttagttatcgtaggtgggttttgcggcgtaacgtattaggcgaaaacgttgatcgttaaagcgttagcgcgtttgaatgttataatcgtttaattcgcgttttttcgttaaggttattagtttacgcgattttttataaaacggggcggtttttgg

SEQ ID NO: 6654 - DNA, 546 bp, Artificial Sequence
  chemically treated genomic DNA (Homo sapiens) CpG-island No: 6654
ccaaaaaccgccccgttttataaaaaatcgcgtaaactaataaccttaacgaaaaaacgcgaattaaacgattataacattcaaacgcgctaacgctttaacgatcaacgttttcgcctaatacgttacgccgcaaaacccacctacgataactaacataaaccaaacgcctaacccacgttataaatcacccgttaaacaaaataacgaaacatataaaccgaataaaacgctataaaccgaataaaacgcgtcaacgtcgcatccgacaatcaacatccgacaatcaccatcaaacacctttcactcccaacaccttatacgcttttaccacaatattctcgacgataaaaccaaaaaacgaaaacaacttatccgccgaaacaaattccccgtaacccgtcatcccgacaattacccctttcaaaccaacatacttataccaataatcgacaatacctacttccaccgccacgcgaaccgcaacgttaaaaaacaacaccgactcccgatattcctcatcctaaacgtcgaaaatatcgatcg

SEQ ID NO: 6655 - DNA, 546 bp, Artificial Sequence
  chemically treated genomic DNA (Homo sapiens) CpG-island No: 6655
ttaagaatcgtttcgttttatgagaagtcgcgtgaattggtgattttagcgaaagggcgcggattaagcgattgtggtatttaggcgcgttggcgttttgacggttagcgttttcgtttggtgcgttacgtcgtagaatttatttgcgataattggtatgggttagacgtttggtttacgttgtggattattcgttaaataaaatggcgggatatgtaggtcggataagacgttgtaggtcggataagacgcgttagcgtcgtattcggtaattagtattcggtaattattattaggtattttttatttttagtattttatgcgtttttgttataatattttcggcggtaaagttaaagaacgggaatagtttattcgtcggagtagatttttcgtaattcgttatttcgataattgttttttttagattaatatatttgtattagtaatcggtaatatttgtttttatcgttacgcgagtcgtaacgttagaaggtaatatcgattttcgatattttttattttgggcgtcgaaaatatcggtcg

SEQ ID NO: 6656 - DNA, 546 bp, Artificial Sequence
  chemically treated genomic DNA (Homo sapiens) CpG-island No: 6656
cgaccgatattttcgacgcccaaaataaaaaatatcgaaaatcgatattaccttctaacgttacgactcgcgtaacgataaaaacaaatattaccgattactaatacaaatatattaatctaaaaaaaacaattatcgaaataacgaattacgaaaaatctactccgacgaataaactattcccgttctttaactttaccgccgaaaatattataacaaaaacgcataaaatactaaaaataaaaaatacctaataataattaccgaatactaattaccgaatacgacgctaacgcgtcttatccgacctacaacgtcttatccgacctacatatcccgccattttatttaacgaataatccacaacgtaaaccaaacgtctaacccataccaattatcgcaaataaattctacgacgtaacgcaccaaacgaaaacgctaaccgtcaaaacgccaacgcgcctaaataccacaatcgcttaatccgcgccctttcgctaaaatcaccaattcacgcgacttctcataaaacgaaacgattcttaa

SEQ ID NO: 6657 - DNA, 673 bp, Artificial Sequence
  chemically treated genomic DNA (Homo sapiens) CpG-island No: 6657
attatggtttagttttttatacgttttttcgtcgggtttcgtttttacggtttttagtgaagtcggagggcggggtttaatcgcgtttggttgcgcggaaattaagatttttttttagagttgcggaggacgcggtcgtcgttttttttaattttttaggttttcgaggtcgggtttagagtttttagttttttttgaaattttggagcggaattagaagtgcgcgtggttatagcggcgttttttgttttttagtcgtcgttggtttaacggtttttttagtagtagtttttgcgattaggtgcggttttaggtgcggtttagttattcggagggaggtagacgggggcggggtttcggtgagggagagatgggagcggggattgggtgaagggcgagatgggggtggggttttcgttaagggtgagacgggggcgggattttcgttaaggggaaattggggttaagtttttgttaaggaaaaaatggggcggggaattcgttaaaaggaaaatgggggcggggtttgggtgaaggaaaaataggggtcgaattttttttaaggggaaatagggtcgggttttcgttaaggaaaaaatgggtcgggttttggttaaggaaaaaattcggggggatatttttaaggaaatataggggtcgggaattttttttt

SEQ ID NO: 6658 - DNA, 673 bp, Artificial Sequence
  chemically treated genomic DNA (Homo sapiens) CpG-island No: 6658
aaaaaaaaattcccgacccctatatttccttaaaaatatccccccgaattttttccttaaccaaaacccgacccattttttccttaacgaaaacccgaccctatttccccttaaaaaaaattcgacccctatttttccttcacccaaaccccgcccccattttccttttaacgaattccccgccccattttttccttaacaaaaacttaaccccaatttccccttaacgaaaatcccgcccccgtctcacccttaacgaaaaccccacccccatctcgcccttcacccaatccccgctcccatctctccctcaccgaaaccccgcccccgtctacctccctccgaataactaaaccgcacctaaaaccgcacctaatcgcaaaaactactactaaaaaaaccgttaaaccaacgacgactaaaaaacaaaaaacgccgctataaccacgcgcacttctaattccgctccaaaatttcaaaaaaaactaaaaactctaaacccgacctcgaaaacctaaaaaattaaaaaaaacgacgaccgcgtcctccgcaactctaaaaaaaaatcttaatttccgcgcaaccaaacgcgattaaaccccgccctccgacttcactaaaaaccgtaaaaacgaaacccgacgaaaaaacgtataaaaaactaaaccataat

SEQ ID NO: 6659 - DNA, 673 bp, Artificial Sequence
  chemically treated genomic DNA (Homo sapiens) CpG-island No: 6659
aaaagagagttttcggtttttatatttttttgggaatgttttttcgggttttttttttaattaggattcggtttattttttttttaacgaagattcggttttatttttttttaaaggggattcggtttttgttttttttttatttaggtttcgtttttattttttttttaacggatttttcgttttattttttttttaataaagatttggttttaatttttttttaacgggggtttcgttttcgttttatttttaacggagattttatttttatttcgttttttatttagttttcgtttttattttttttttatcgagatttcgttttcgtttgttttttttcgggtggttaagtcgtatttgaagtcgtatttggtcgtagaggttattgttggggaaatcgttgggttagcggcggttaaagggtaggaggcgtcgttgtggttacgcgtatttttgatttcgttttagggttttagaaggaattgagggttttggattcggtttcggaggtttgaggagttgggaggggcggcggtcgcgtttttcgtaattttggggagaagttttagttttcgcgtagttaaacgcgattggatttcgtttttcggttttattggggatcgtgggggcggaattcggcgggaggacgtatggggggttggattatgat

SEQ ID NO: 6660 - DNA, 673 bp, Artificial Sequence
  chemically treated genomic DNA (Homo sapiens) CpG-island No: 6660
atcataatccaaccccccatacgtcctcccgccgaattccgcccccacgatccccaataaaaccgaaaaacgaaatccaatcgcgtttaactacgcgaaaactaaaacttctccccaaaattacgaaaaacgcgaccgccgcccctcccaactcctcaaacctccgaaaccgaatccaaaaccctcaattccttctaaaaccctaaaacgaaatcaaaaatacgcgtaaccacaacgacgcctcctaccctttaaccgccgctaacccaacgatttccccaacaataacctctacgaccaaatacgacttcaaatacgacttaaccacccgaaaaaaaacaaacgaaaacgaaatctcgataaaaaaaaaataaaaacgaaaactaaataaaaaacgaaataaaaataaaatctccgttaaaaataaaacgaaaacgaaacccccgttaaaaaaaaattaaaaccaaatctttattaaaaaaaaaataaaacgaaaaatccgttaaaaaaaaaataaaaacgaaacctaaataaaaaaaaaacaaaaaccgaatcccctttaaaaaaaaataaaaccgaatcttcgttaaaaaaaaaataaaccgaatcctaattaaaaaaaaaacccgaaaaaacattcccaaaaaaatataaaaaccgaaaactctctttt

SEQ ID NO: 6661 - DNA, 587 bp, Artificial Sequence
  chemically treated genomic DNA (Homo sapiens) CpG-island No: 6661
tcgggggcgggttcgcggcgttcggcggtcgagtaaattttttcgaatatagtttgtttcgtttttttttttttgttgttttgttttttttttcgtcggataaggtacgtcgcgagaacggtttcgtttttttttttttgttcgggcgcgggttttatttcgggggggttcgttgcggcgtaatagttttattacggggcgttcgttggttttggtacgggtgtttgggggtttcgtcgagtcgtttataaaggaaggtttcgtggggttgtttgtaggggcgttttttttttttagcgtttttacgcggcgtttcgcgttttttttcgtttagttttttttgggttttcgttcgtaggttcgggttcggcggggcgttcgattatttttttgttattgggggtgtcgcgtgtcggcggtttcgtaggggtttataaaaaaaagacgcgttttcgttttttttttcgtcgtcggttttacgggtattagtagtcggcgtttacggggggcgttttttagggtggtgggggatatatatatatatatatatatttttttttttggataggaagtagaatttattggtg

SEQ ID NO: 6662 - DNA, 587 bp, Artificial Sequence
  chemically treated genomic DNA (Homo sapiens) CpG-island No: 6662
caccaataaattctacttcctatccaaaaaaaaaaatatatatatatatatatatatcccccaccaccctaaaaaacgccccccgtaaacgccgactactaatacccgtaaaaccgacgacgaaaaaaaaaacgaaaacgcgtcttttttttataaacccctacgaaaccgccgacacgcgacacccccaataacaaaaaaataatcgaacgccccgccgaacccgaacctacgaacgaaaacccaaaaaaaactaaacgaaaaaaaacgcgaaacgccgcgtaaaaacgctaaaaaaaaaaaacgcccctacaaacaaccccacgaaaccttcctttataaacgactcgacgaaacccccaaacacccgtaccaaaaccaacgaacgccccgtaataaaactattacgccgcaacgaacccccccgaaataaaacccgcgcccgaacaaaaaaaaaaaaacgaaaccgttctcgcgacgtaccttatccgacgaaaaaaaaaacaaaacaacaaaaaaaaaaaaacgaaacaaactatattcgaaaaaatttactcgaccgccgaacgccgcgaacccgcccccga

SEQ ID NO: 6663 - DNA, 587 bp, Artificial Sequence
  chemically treated genomic DNA (Homo sapiens) CpG-island No: 6663
tattaataaattttattttttgtttaaaaaaaaaaatgtgtgtgtgtgtgtgtgtgttttttattattttaaaagacgtttttcgtgggcgtcggttgttgatattcgtggagtcggcggcgggaaggaaaacgggggcgcgttttttttttgtgagtttttgcggggtcgtcggtacgcggtatttttagtggtaagggagtgatcgaacgtttcgtcgagttcggatttgcgggcgggggtttagggagggttaagcggggagaagcgcgaagcgtcgcgtgaagacgttggagaggagaggcgtttttgtaagtagttttacggagtttttttttatgaacggttcggcgaggtttttaggtattcgtgttagggttagcgaacgtttcgtagtggagttgttgcgtcgtaacggattttttcggggtagagttcgcgttcgggtaggagagaagagacggggtcgttttcgcggcgtgttttattcggcggggggagagatagggtagtagaagggagggggcggaataggttgtgttcggggaggtttgttcgatcgtcggacgtcgcgagttcgttttcgg

SEQ ID NO: 6664 - DNA, 587 bp, Artificial Sequence
  chemically treated genomic DNA (Homo sapiens) CpG-island No: 6664
ccgaaaacgaactcgcgacgtccgacgatcgaacaaacctccccgaacacaacctattccgccccctcccttctactaccctatctctccccccgccgaataaaacacgccgcgaaaacgaccccgtctcttctctcctacccgaacgcgaactctaccccgaaaaaatccgttacgacgcaacaactccactacgaaacgttcgctaaccctaacacgaatacctaaaaacctcgccgaaccgttcataaaaaaaaactccgtaaaactacttacaaaaacgcctctcctctccaacgtcttcacgcgacgcttcgcgcttctccccgcttaaccctccctaaacccccgcccgcaaatccgaactcgacgaaacgttcgatcactcccttaccactaaaaataccgcgtaccgacgaccccgcaaaaactcacaaaaaaaaaacgcgcccccgttttccttcccgccgccgactccacgaatatcaacaaccgacgcccacgaaaaacgtcttttaaaataataaaaaacacacacacacacacacacatttttttttttaaacaaaaaataaaatttattaata

SEQ ID NO: 6665 - DNA, 804 bp, Artificial Sequence
  chemically treated genomic DNA (Homo sapiens) CpG-island No: 6665
tcgttttaattacgtttttatggcgtagttttttttttgttttcgtttttcgttttttatttttcgagcgtttttatcgttttttagttacgtttttggcgtttggttttgttgtagtttggttttcgtttagattacgatttttcggttaggttttcgtcgttaatttcgtttttaaggtttcgtttcgttttagtttcgttttttagcggttgttcgagtttttattcgttttagttacgtttttaaggcgtggttttcgtttgtagttttatttaggtttcgtttcgttttagtcgcgtttttcgggtttgattttcgttttattttagttacgttttttggatttggttttcgtttttagtttcgttttttagtcgcgttttagtttcgttttttggatttggtttcgttttttggtttcgtttttgagtttcgtttaattttagcgacgtttttcgggtttgggtttcgtttttagtttcgttttcgggtttcgtttttttttagttacgtttttcggatttggttttagtttttagtttcgttttcgattttcgttttattttagttacgttttttcggatttggttttggtttttagtttcgttttcgatttttattttatttcggttacgtatttcggatttggttttcgtttttagtttcggttttcgagattagttttaatttaggtttcgttttttggatttggttttagtttttagtcgcggttaaattacgttttagttatttttcgtaagttttttattgttttagttacgttttttaggttggtttttg

SEQ ID NO: 6666 - DNA, 804 bp, Artificial Sequence
  chemically treated genomic DNA (Homo sapiens) CpG-island No: 6666
caaaaaccaacctaaaaaacgtaactaaaacaataaaaaacttacgaaaaataactaaaacgtaatttaaccgcgactaaaaactaaaaccaaatccaaaaaacgaaacctaaattaaaactaatctcgaaaaccgaaactaaaaacgaaaaccaaatccgaaatacgtaaccgaaataaaataaaaatcgaaaacgaaactaaaaaccaaaaccaaatccgaaaaaacgtaactaaaataaaacgaaaatcgaaaacgaaactaaaaactaaaaccaaatccgaaaaacgtaactaaaaaaaaacgaaacccgaaaacgaaactaaaaacgaaacccaaacccgaaaaacgtcgctaaaattaaacgaaactcaaaaacgaaaccaaaaaacgaaaccaaatccaaaaaacgaaactaaaacgcgactaaaaaacgaaactaaaaacgaaaaccaaatccaaaaaacgtaactaaaataaaacgaaaatcaaacccgaaaaacgcgactaaaacgaaacgaaacctaaataaaactacaaacgaaaaccacgccttaaaaacgtaactaaaacgaataaaaactcgaacaaccgctaaaaaacgaaactaaaacgaaacgaaaccttaaaaacgaaattaacgacgaaaacctaaccgaaaaatcgtaatctaaacgaaaaccaaactacaacaaaaccaaacgccaaaaacgtaactaaaaaacgataaaaacgctcgaaaaataaaaaacgaaaaacgaaaacaaaaaaaaaactacgccataaaaacgtaattaaaacga

SEQ ID NO: 6667 - DNA, 804 bp, Artificial Sequence
  chemically treated genomic DNA (Homo sapiens) CpG-island No: 6667
tagaaattagtttggaaagcgtggttgaggtagtgagaggtttgcgggaggtggttgaggcgtgatttggtcgcgattgggaattaagattaagtttagaaggcggggtttggattgaggttaatttcggaagtcggggttagagacgaggattaagttcggaatgcgtggtcggggtggggtgaggatcggaggcggggttagagattaggattaagttcggaaaggcgtggttggggtggggcgaggatcggaggcggggttagaaattgggattaagttcggaaggcgtggttggggaggggcgagattcggggacggggttagaggcgaggtttaagttcggaaggcgtcgttggagttgggcgaggtttaggggcggagttagagaacggaattaagtttagaaggcggggttggggcgcggttagggggcggggttagagacgaggattaagtttagaaggcgtggttggggtggggcgaggattaagttcggaaggcgcggttggagcggggcgaggtttaggtggggttgtagacgagaattacgttttggaggcgtggttagggcgggtagaggttcggataatcgttggaaggcggggttggggcggggcgagattttgggggcggggttgacgacgaggatttagtcgagaggtcgtggtttggacggaaattaggttgtagtaggattaggcgttaagggcgtggttggggagcgatggagacgttcggaaggtggggagcgggggacggagatagggagaagattacgttatgaaggcgtggttgaggcgg

SEQ ID NO: 6668 - DNA, 804 bp, Artificial Sequence
  chemically treated genomic DNA (Homo sapiens) CpG-island No: 6668
ccgcctcaaccacgccttcataacgtaatcttctccctatctccgtcccccgctccccaccttccgaacgtctccatcgctccccaaccacgcccttaacgcctaatcctactacaacctaatttccgtccaaaccacgacctctcgactaaatcctcgtcgtcaaccccgcccccaaaatctcgccccgccccaaccccgccttccaacgattatccgaacctctacccgccctaaccacgcctccaaaacgtaattctcgtctacaaccccacctaaacctcgccccgctccaaccgcgccttccgaacttaatcctcgccccaccccaaccacgccttctaaacttaatcctcgtctctaaccccgccccctaaccgcgccccaaccccgccttctaaacttaattccgttctctaactccgcccctaaacctcgcccaactccaacgacgccttccgaacttaaacctcgcctctaaccccgtccccgaatctcgcccctccccaaccacgccttccgaacttaatcccaatttctaaccccgcctccgatcctcgccccaccccaaccacgcctttccgaacttaatcctaatctctaaccccgcctccgatcctcaccccaccccgaccacgcattccgaacttaatcctcgtctctaaccccgacttccgaaattaacctcaatccaaaccccgccttctaaacttaatcttaattcccaatcgcgaccaaatcacgcctcaaccacctcccgcaaacctctcactacctcaaccacgctttccaaactaatttcta

SEQ ID NO: 6669 - DNA, 573 bp, Artificial Sequence
  chemically treated genomic DNA (Homo sapiens) CpG-island No: 6669
tttttattcgcggttggttcggttttgggatcgaattattttttagcgagaggaaggttaaatttttcgatcggttacgggaaggtcgcggtcgtcgttttgttagtcgtttcggcgtttttaggatttttcgggtttttttaatcggaagcggaagtgcgtgtcggcgggattatggcgattttggtcgaattgtcggattcggttttgttcgagatttttttttatttttcggtacgggatcggattcgtatttttaggtgcggtttcgttttcggggggaagggtagggcggagggcgtagttggtatttggagatgcgatgtggttcggggttggggtcgttttaatcgcgcgtttttttttttagggtttgttatcgttggaagaggttggtggacgatcggtggttgtggcgatatgtcgatttgacgttttatacggtacgcgtagttggtcgggcgggtttgggtcgcggtcgcggtgttcggatttcgaagattattttttttattttgggattgtgtgtcggggttcgggttggggatttagagttaggcgattcggggttta

SEQ ID NO: 6670 - DNA, 573 bp, Artificial Sequence
  chemically treated genomic DNA (Homo sapiens) CpG-island No: 6670
taaaccccgaatcgcctaactctaaatccccaacccgaaccccgacacacaatcccaaaataaaaaaaataatcttcgaaatccgaacaccgcgaccgcgacccaaacccgcccgaccaactacgcgtaccgtataaaacgtcaaatcgacatatcgccacaaccaccgatcgtccaccaacctcttccaacgataacaaaccctaaaaaaaaaaacgcgcgattaaaacgaccccaaccccgaaccacatcgcatctccaaataccaactacgccctccgccctacccttccccccgaaaacgaaaccgcacctaaaaatacgaatccgatcccgtaccgaaaaataaaaaaaaatctcgaacaaaaccgaatccgacaattcgaccaaaatcgccataatcccgccgacacgcacttccgcttccgattaaaaaaacccgaaaaatcctaaaaacgccgaaacgactaacaaaacgacgaccgcgaccttcccgtaaccgatcgaaaaatttaaccttcctctcgctaaaaaataattcgatcccaaaaccgaaccaaccgcgaataaaaa

SEQ ID NO: 6671 - DNA, 573 bp, Artificial Sequence
  chemically treated genomic DNA (Homo sapiens) CpG-island No: 6671
taggtttcggatcgtttggttttaaatttttagttcgggtttcgatatatagttttagggtgggagaggtggttttcggggttcgggtatcgcgatcgcggtttaggttcgttcggttagttgcgcgtatcgtgtagagcgttaggtcgatatgtcgttatagttatcggtcgtttattagttttttttagcggtgatagattttgggggaggggacgcgcggttagaacgattttagtttcgggttatatcgtatttttaggtgttagttgcgtttttcgttttgttttttttttcggaggcggggtcgtatttggagatgcggattcggtttcgtatcgggaggtaagagaagatttcgagtaggatcgagttcggtagttcgattaaagtcgttatgatttcgtcgatacgtattttcgttttcggttaaagagattcgaggggttttgggggcgtcgaggcggttgatagggcggcggtcgcgattttttcgtagtcggtcgagaaatttgatttttttttcgttgggaagtgattcggttttagggtcggattagtcgcggatgggga

SEQ ID NO: 6672 - DNA, 573 bp, Artificial Sequence
  chemically treated genomic DNA (Homo sapiens) CpG-island No: 6672
tccccatccgcgactaatccgaccctaaaaccgaatcacttcccaacgaaaaaaaaatcaaatttctcgaccgactacgaaaaaatcgcgaccgccgccctatcaaccgcctcgacgcccccaaaacccctcgaatctctttaaccgaaaacgaaaatacgtatcgacgaaatcataacgactttaatcgaactaccgaactcgatcctactcgaaatcttctcttacctcccgatacgaaaccgaatccgcatctccaaatacgaccccgcctccgaaaaaaaaaacaaaacgaaaaacgcaactaacacctaaaaatacgatataacccgaaactaaaatcgttctaaccgcgcgtcccctcccccaaaatctatcaccgctaaaaaaaactaataaacgaccgataactataacgacatatcgacctaacgctctacacgatacgcgcaactaaccgaacgaacctaaaccgcgatcgcgatacccgaaccccgaaaaccacctctcccaccctaaaactatatatcgaaacccgaactaaaaatttaaaaccaaacgatccgaaaccta

SEQ ID NO: 6673 - DNA, 828 bp, Artificial Sequence
  chemically treated genomic DNA (Homo sapiens) CpG-island No: 6673
  misc_feature (750)..(750): n is either a, c, g or t
  misc_feature (758)..(759): n is either a, c, g or t
  misc_feature (761)..(761): n is either a, c, g or t
  misc_feature (763)..(763): n is either a, c, g or t
agattcgggtagggattcggtgagggggagacgggggtggggttttggtgatcgaaagacgggggcggagatttggtgaggggagacggaggcggggattcggtgataggattaacgggggcggggattcggtgagggagagataggggcgggaatcggtgaggggagacggaggcggggaatcggtgaggggagagacgggggcggggattcggtgacggggagacgggggcgggaatcggtgaggggacgacgggggcggggattcggtgagggaagagaagagggcgggattcggtgagggggagacgggggcggggatttggtgagcggacgacgggggcggggattcggtgaggggagagaagagggattaggtgagggggagatagggattcgatgatagatagggtagggtttcggtgaggggaatcgggggtcggggatttcgtaagggagagataggggtggggattaggtgatggggagattgggacgagaattcggtgagggagagacggggggcggggattcggtgaggggttgttagaggcgggattttagtgaggggagagaagagggcgggattttagtgaagggagagaagagggcggggattcgatgagggggagacggggtcggggattcgatgacgggaagggtaggggattcgatgaaggagagattgtggcggggattcgattaaggagatgtcggggcggggttttcgtgaggggataaatagggatngtaatttnntnanggggattttagtcgtggggatatgtataaatgacgtcggttcggcgatttttagagttttttttg

SEQ ID NO: 6674 - DNA, 828 bp, Artificial Sequence
  chemically treated genomic DNA (Homo sapiens) CpG-island No: 6674
  misc_feature (66)..(66): n is either a, c, g or t
  misc_feature (68)..(68): n is either a, c, g or t
  misc_feature (70)..(71): n is either a, c, g or t
  misc_feature (79)..(79): n is either a, c, g or t
caaaaaaaactctaaaaatcgccgaaccgacgtcatttatacatatccccacgactaaaatccccntnannaaattacnatccctatttatcccctcacgaaaaccccgccccgacatctccttaatcgaatccccgccacaatctctccttcatcgaatcccctacccttcccgtcatcgaatccccgaccccgtctccccctcatcgaatccccgccctcttctctcccttcactaaaatcccgccctcttctctcccctcactaaaatcccgcctctaacaacccctcaccgaatccccgccccccgtctctccctcaccgaattctcgtcccaatctccccatcacctaatccccacccctatctctcccttacgaaatccccgacccccgattcccctcaccgaaaccctaccctatctatcatcgaatccctatctccccctcacctaatccctcttctctcccctcaccgaatccccgcccccgtcgtccgctcaccaaatccccgcccccgtctccccctcaccgaatcccgccctcttctcttccctcaccgaatccccgcccccgtcgtcccctcaccgattcccgcccccgtctccccgtcaccgaatccccgcccccgtctctcccctcaccgattccccgcctccgtctcccctcaccgattcccgcccctatctctccctcaccgaatccccgcccccgttaatcctatcaccgaatccccgcctccgtctcccctcaccaaatctccgcccccgtctttcgatcaccaaaaccccacccccgtctccccctcaccgaatccctacccgaatct

SEQ ID NO: 6675 - DNA, 828 bp, Artificial Sequence
  chemically treated genomic DNA (Homo sapiens) CpG-island No: 6675
  misc_feature (66)..(66): n is either a, c, g or t
  misc_feature (68)..(68): n is either a, c, g or t
  misc_feature (70)..(71): n is either a, c, g or t
  misc_feature (79)..(79): n is either a, c, g or t
tagagaagattttagagatcgtcggatcgacgttatttgtatatgtttttacggttgaagtttttntnanngagttatnatttttgtttatttttttacgaagatttcgtttcggtatttttttaatcgagttttcgttatagttttttttttatcgagttttttatttttttcgttatcgagttttcggtttcgttttttttttatcgagttttcgtttttttttttttttttattgagatttcgtttttttttttttttttattgaggtttcgtttttgatagttttttatcgagttttcgtttttcgttttttttttatcgagttttcgttttagtttttttattatttaatttttatttttgttttttttttacgaagttttcggttttcggttttttttatcgagattttgttttgtttgttatcgagtttttgttttttttttatttagttttttttttttttttttatcgagttttcgttttcgtcgttcgtttattaagttttcgttttcgttttttttttatcgagtttcgtttttttttttttttttatcgagttttcgttttcgtcgtttttttatcgattttcgttttcgttttttcgttatcgagttttcgttttcgtttttttttttatcgatttttcgttttcgtttttttttatcgattttcgtttttgttttttttttatcgagttttcgttttcgttaattttattatcgagttttcgttttcgtttttttttattaagttttcgttttcgtttttcggttattaagattttattttcgttttttttttatcgagtttttgttcgggttt

SEQ ID NO: 6676 - DNA, 828 bp, Artificial Sequence
  chemically treated genomic DNA (Homo sapiens) CpG-island No: 6676
  misc_feature (750)..(750): n is either a, c, g or t
  misc_feature (758)..(759): n is either a, c, g or t
  misc_feature (761)..(761): n is either a, c, g or t
  misc_feature (763)..(763): n is either a, c, g or t
aaacccgaacaaaaactcgataaaaaaaaaacgaaaataaaatcttaataaccgaaaaacgaaaacgaaaacttaataaaaaaaaacgaaaacgaaaactcgataataaaattaacgaaaacgaaaactcgataaaaaaaaaacaaaaacgaaaatcgataaaaaaaaacgaaaacgaaaaatcgataaaaaaaaaaacgaaaacgaaaactcgataacgaaaaaacgaaaacgaaaatcgataaaaaaacgacgaaaacgaaaactcgataaaaaaaaaaaaaaaaacgaaactcgataaaaaaaaaacgaaaacgaaaacttaataaacgaacgacgaaaacgaaaactcgataaaaaaaaaaaaaaaaaactaaataaaaaaaaaacaaaaactcgataacaaacaaaacaaaatctcgataaaaaaaaccgaaaaccgaaaacttcgtaaaaaaaaaacaaaaataaaaattaaataataaaaaaactaaaacgaaaactcgataaaaaaaaaacgaaaaacgaaaactcgataaaaaactatcaaaaacgaaacctcaataaaaaaaaaaaaaaaaacgaaatctcaataaaaaaaaaaaaaaaaacgaaaactcgataaaaaaaaaacgaaaccgaaaactcgataacgaaaaaaataaaaaactcgataaaaaaaaaactataacgaaaactcgattaaaaaaataccgaaacgaaatcttcgtaaaaaaataaacaaaaatnataactcnntnanaaaaacttcaaccgtaaaaacatatacaaataacgtcgatccgacgatctctaaaatcttctcta

SEQ ID NO: 6677 - DNA, 604 bp, Artificial Sequence
  chemically treated genomic DNA (Homo sapiens) CpG-island No: 6677
gttagtggatgaacgttcgttgtggttagatatcggtaaataatatggtagtaaagagtcgaggattatatcgtcgtttcgttataaagtcgtataatttatttggtcgggaattataataatgcgcggttatttaattaaaatttgaacggttttgttagggttttacgtaaggaaggggtcggtttaataatgggtataataattcggtcggtaaaattatagtcgtcgttttttttagcggggagttttttaatgggttatatcggagagcgggtcgggaaaggcgagagggagatttataaagtgggttcgcgagagcggcgacgaattgcgtcggggggcgttggcgcgcggcgttacgaatagagtttagaatacgagacgcgtagtatttattacgacgttaggtatcgtagcgatagtataatagaagtagtgagcggcggtagtacgggcgaggagataggattattacgcgttagagtcgaattagttttcgacgattaagagcgaggtaatgtaagtatagtgtaattagagttagatagttaaataagatatagagagtattcgtttacgatcgatcgtatatttagtatta

SEQ ID NO: 6678 - DNA, 604 bp, Artificial Sequence
  chemically treated genomic DNA (Homo sapiens) CpG-island No: 6678
taatactaaatatacgatcgatcgtaaacgaatactctctatatcttatttaactatctaactctaattacactatacttacattacctcgctcttaatcgtcgaaaactaattcgactctaacgcgtaataatcctatctcctcgcccgtactaccgccgctcactacttctattatactatcgctacgatacctaacgtcgtaataaatactacgcgtctcgtattctaaactctattcgtaacgccgcgcgccaacgccccccgacgcaattcgtcgccgctctcgcgaacccactttataaatctccctctcgcctttcccgacccgctctccgatataacccattaaaaaactccccgctaaaaaaaacgacgactataattttaccgaccgaattattatacccattattaaaccgaccccttccttacgtaaaaccctaacaaaaccgttcaaattttaattaaataaccgcgcattattataattcccgaccaaataaattatacgactttataacgaaacgacgatataatcctcgactctttactaccatattatttaccgatatctaaccacaacgaacgttcatccactaac

SEQ ID NO: 6679 - DNA, 604 bp, Artificial Sequence
  chemically treated genomic DNA (Homo sapiens) CpG-island No: 6679
tagtgttgggtgtgcgatcggtcgtgggcgagtgttttttatgttttatttaattatttagttttggttgtattgtgtttgtattgtttcgtttttggtcgtcgagagttgattcgattttagcgcgtggtggttttgttttttcgttcgtattgtcgtcgtttattgtttttgttgtgttgtcgttgcggtgtttggcgtcgtgatgggtgttgcgcgtttcgtgttttgggttttattcgtggcgtcgcgcgttaacgtttttcggcgtaattcgtcgtcgttttcgcgagtttattttgtgggtttttttttcgtttttttcgattcgtttttcggtgtagtttattggggaatttttcgttagagagggcggcggttatagttttgtcggtcggattattgtgtttattattgggtcggttttttttttacgtgaggttttggtaagatcgtttaggttttgattgggtgatcgcgtattgttgtggttttcgattaggtgaattgtacggttttatggcgaagcggcgatgtgattttcggttttttattgttatgttgtttatcggtatttggttataacgggcgtttatttattggt

SEQ ID NO: 6680 - DNA, 604 bp, Artificial Sequence
  chemically treated genomic DNA (Homo sapiens) CpG-island No: 6680
accaataaataaacgcccgttataaccaaataccgataaacaacataacaataaaaaaccgaaaatcacatcgccgcttcgccataaaaccgtacaattcacctaatcgaaaaccacaacaatacgcgatcacccaatcaaaacctaaacgatcttaccaaaacctcacgtaaaaaaaaaaccgacccaataataaacacaataatccgaccgacaaaactataaccgccgccctctctaacgaaaaattccccaataaactacaccgaaaaacgaatcgaaaaaaacgaaaaaaaaacccacaaaataaactcgcgaaaacgacgacgaattacgccgaaaaacgttaacgcgcgacgccacgaataaaacccaaaacacgaaacgcgcaacacccatcacgacgccaaacaccgcaacgacaacacaacaaaaacaataaacgacgacaatacgaacgaaaaaacaaaaccaccacgcgctaaaatcgaatcaactctcgacgaccaaaaacgaaacaatacaaacacaatacaaccaaaactaaataattaaataaaacataaaaaacactcgcccacgaccgatcgcacacccaacacta

SEQ ID NO: 6681 - DNA, 1063 bp, Artificial Sequence
  chemically treated genomic DNA (Homo sapiens) CpG-island No: 6681
  misc_feature (1052)..(1052): n is either a, c, g or t
  misc_feature (1054)..(1054): n is either a, c, g or t
ttattcgttattttcgtatgggtcgcggtgtcgtgtttgcgcggaagatttgaaaatggcgagtttgtttggtattatatcgatcgggtgattgcgttgatttttgtgattggcgcggcgatggcgcggtggcgggtgtgttgttcggttagttttacggcgttattaattttttatcggttttatggtcgggatgaaagtttttatcgcggcggtgttcggtggattggtagtatttcgggagcgatgattggcggtttgattttggggatgcggaggcgtttttttttgtttatttgagtacggaatataaagatgtggtttattcgttttgttgattttggtgttgttggtgatgtcgatcggtatttgggtcgttcggaggtagagaaagtatgaaatcgatgtatattgtaatgcgttgttttttgtcgcgatgttttttgtgttggcgggcgtttttatggggtgtaattggagttggatggtattaaattggtggtcgatacggtttcggtgttcgttggtagtgggtgtttatcggtacggcggtggtttttttttttagtttttgcgatcggttttttagaaagggttgaaaagcgttttcggattaagtttattttgttcgttattgatggttttacggtgaagtagaaattgttttcgtggcgttgttggtgtttgcggtggcgtggcgtttatggtttacggggaggtggatttgtatttgattatgatttatttattttcggtttcgggtgaacgtggttgttggtttttttggtttgttggtgttggggtacggcggttttacgttatcggcgtttatatttttgcgttgtttaattattattacgtttgggtttttggatttgtttgtcgattgttggattaatggtagcggcgcgggttttttgttcggtttttcggtgttgcgtttgcgttgaatatttggttatatcgtatttataagtttcgatacgaatattacgaagtcggtaacgttataagtgttaaatgtttgtgggttgttttatatgtacgtgagntnttattcgat

SEQ ID NO: 6682 - DNA, 1063 bp, Artificial Sequence
  chemically treated genomic DNA (Homo sapiens) CpG-island No: 6682
  misc_feature (10)..(10): n is either a, c, g or t
  misc_feature (12)..(12): n is either a, c, g or t
atcgaataananctcacgtacatataaaacaacccacaaacatttaacacttataacgttaccgacttcgtaatattcgtatcgaaacttataaatacgatataaccaaatattcaacgcaaacgcaacaccgaaaaaccgaacaaaaaacccgcgccgctaccattaatccaacaatcgacaaacaaatccaaaaacccaaacgtaataataattaaacaacgcaaaaatataaacgccgataacgtaaaaccgccgtaccccaacaccaacaaaccaaaaaaaccaacaaccacgttcacccgaaaccgaaaataaataaatcataatcaaatacaaatccacctccccgtaaaccataaacgccacgccaccgcaaacaccaacaacgccacgaaaacaatttctacttcaccgtaaaaccatcaataacgaacaaaataaacttaatccgaaaacgcttttcaaccctttctaaaaaaccgatcgcaaaaactaaaaaaaaaaaccaccgccgtaccgataaacacccactaccaacgaacaccgaaaccgtatcgaccaccaatttaataccatccaactccaattacaccccataaaaacgcccgccaacacaaaaaacatcgcgacaaaaaacaacgcattacaatatacatcgatttcatactttctctacctccgaacgacccaaataccgatcgacatcaccaacaacaccaaaatcaacaaaacgaataaaccacatctttatattccgtactcaaataaacaaaaaaaaacgcctccgcatccccaaaatcaaaccgccaatcatcgctcccgaaatactaccaatccaccgaacaccgccgcgataaaaactttcatcccgaccataaaaccgataaaaaattaataacgccgtaaaactaaccgaacaacacacccgccaccgcgccatcgccgcgccaatcacaaaaatcaacgcaatcacccgatcgatataataccaaacaaactcgccattttcaaatcttccgcgcaaacacgacaccgcgacccatacgaaaataacgaataa

SEQ ID NO: 6683 - DNA, 1063 bp, Artificial Sequence
  chemically treated genomic DNA (Homo sapiens) CpG-island No: 6683
  misc_feature (10)..(10): n is either a, c, g or t
  misc_feature (12)..(12): n is either a, c, g or t
gtcgagtaangntttacgtgtatgtagggtaatttataggtatttaatatttgtagcgttgtcggtttcgtgatgttcgtgtcggaatttgtggatgcggtataattaagtgtttagcgtaaacgtagtatcggaaaatcgagtaggaagttcgcgtcgttgttattaatttagtaatcggtaggtaggtttagaagtttaagcgtaatagtgattgagtagcgtaaaagtgtaagcgtcgatggcgtaaaatcgtcgtattttagtattagtagattagaaagattaataattacgtttattcgagatcgaggataagtagattatggttaggtgtaaatttattttttcgtgaattataaacgttacgttatcgtaagtattaatagcgttacgaggatagtttttgttttatcgtggagttattaatggcgggtagaataaatttggttcggaaacgttttttaattttttttggaaagtcggtcgtaaaagttgaagaaaaagattatcgtcgtgtcgataaatatttattgttaacggatatcgaagtcgtgtcgattattagtttggtgttatttagttttagttgtattttataaagacgttcgttagtataaagaatatcgcggtagagagtagcgtattgtaatatgtatcggttttatattttttttattttcgggcgatttaaatatcggtcggtattattagtagtattagaattagtagggcgaatgagttatatttttatatttcgtatttagataggtagaagagagcgttttcgtatttttagaattaggtcgttaattatcgttttcggaatgttgttaatttatcgagtatcgtcgcggtaaaggtttttatttcggttataaagtcgatgaggggttaatgacgtcgtagaattgatcgagtagtatattcgttatcgcgttatcgtcgcgttaattataaaggttagcgtaattattcggtcggtgtaatgttaagtagattcgttatttttagatttttcgcgtaggtacgatatcgcgatttatgcgggaatagcgaatga

SEQ ID NO: 6684 - DNA, 1063 bp, Artificial Sequence
  chemically treated genomic DNA (Homo sapiens) CpG-island No: 6684
  misc_feature (1052)..(1052): n is either a, c, g or t
  misc_feature (1054)..(1054): n is either a, c, g or t
tcattcgctattcccgcataaatcgcgatatcgtacctacgcgaaaaatctaaaaataacgaatctacttaacattacaccgaccgaataattacgctaacctttataattaacgcgacgataacgcgataacgaatatactactcgatcaattctacgacgtcattaacccctcatcgactttataaccgaaataaaaacctttaccgcgacgatactcgataaattaacaacattccgaaaacgataattaacgacctaattctaaaaatacgaaaacgctctcttctacctatctaaatacgaaatataaaaatataactcattcgccctactaattctaatactactaataataccgaccgatatttaaatcgcccgaaaataaaaaaaatataaaaccgatacatattacaatacgctactctctaccgcgatattctttatactaacgaacgtctttataaaatacaactaaaactaaataacaccaaactaataatcgacacgacttcgatatccgttaacaataaatatttatcgacacgacgataatctttttcttcaacttttacgaccgactttccaaaaaaaattaaaaaacgtttccgaaccaaatttattctacccgccattaataactccacgataaaacaaaaactatcctcgtaacgctattaatacttacgataacgtaacgtttataattcacgaaaaaataaatttacacctaaccataatctacttatcctcgatctcgaataaacgtaattattaatctttctaatctactaatactaaaatacgacgattttacgccatcgacgcttacacttttacgctactcaatcactattacgcttaaacttctaaacctacctaccgattactaaattaataacaacgacgcgaacttcctactcgattttccgatactacgtttacgctaaacacttaattataccgcatccacaaattccgacacgaacatcacgaaaccgacaacgctacaaatattaaatacctataaattaccctacatacacgtaaancnttactcgac

SEQ ID NO: 6685 - DNA, 878 bp, Artificial Sequence
  chemically treated genomic DNA (Homo sapiens) CpG-island No: 6685
atagttgttattagcgttagtcgataattttttgtacgttataattacgagagagatcgtgtatcggcgggtaagtttttgtattagtggttcgacggtacgatattcgtcgagtcgtgtgcgattttgtaattaatattttcggtttttagcgacggaaaaattatatattgggttttgttttgtagcgggttggtaggcgttttttgcgtcgttttttcggtacgaagtcggcgttaaattgtaattcgttatttattattagtttggtgcgcgtttacggacgatttttgtcgtttgttggacgttagtaaataggggtgacgggcgttattattgttggaaaacgatagtatcgttacggcggttttttttcggtgatggcgcgttaggtttcggtattggtaagcgtatattcgttagttgcgtcgtcgtcggttgtggtattacgttgtaatcggaaagtttaacgtcgggtcgttgtattgtggtaatattaggaaaatggaaagagcgttttatagtttggttgtaagtcgataatgcgtaattcggtacgagtatatttgtcgtggaagagaggttgttcgcgatatagatattcgtttatcggcgttgattattgttgcggcgaatattagagggtcggtaagttttttagcgtattcggcggcgttttttcgttcgcgcgggttagttagcgatggtaaatttttttcgtattgcgaggttgttatgcggattaattatttgtattcgtttatcgttacgtcgtgattgagcgtaaattgacgaagtttaaacgattggcgattagaatgggcgttgttagattttgtgggattttttagagtatttaatagtatgtagttgtttgt

SEQ ID NO: 6686 - DNA, 878 bp, Artificial Sequence
  chemically treated genomic DNA (Homo sapiens) CpG-island No: 6686
acaaacaactacatactattaaatactctaaaaaatcccacaaaatctaacaacgcccattctaatcgccaatcgtttaaacttcgtcaatttacgctcaatcacgacgtaacgataaacgaatacaaataattaatccgcataacaacctcgcaatacgaaaaaaatttaccatcgctaactaacccgcgcgaacgaaaaaacgccgccgaatacgctaaaaaacttaccgaccctctaatattcgccgcaacaataatcaacgccgataaacgaatatctatatcgcgaacaacctctcttccacgacaaatatactcgtaccgaattacgcattatcgacttacaaccaaactataaaacgctctttccattttcctaatattaccacaatacaacgacccgacgttaaactttccgattacaacgtaataccacaaccgacgacgacgcaactaacgaatatacgcttaccaataccgaaacctaacgcgccatcaccgaaaaaaaaccgccgtaacgatactatcgttttccaacaataataacgcccgtcacccctatttactaacgtccaacaaacgacaaaaatcgtccgtaaacgcgcaccaaactaataataaataacgaattacaatttaacgccgacttcgtaccgaaaaaacgacgcaaaaaacgcctaccaacccgctacaaaacaaaacccaatatataatttttccgtcgctaaaaaccgaaaatattaattacaaaatcgcacacgactcgacgaatatcgtaccgtcgaaccactaatacaaaaacttacccgccgatacacgatctctctcgtaattataacgtacaaaaaattatcgactaacgctaataacaactat

SEQ ID NO: 6687 - DNA, 878 bp, Artificial Sequence
  chemically treated genomic DNA (Homo sapiens) CpG-island No: 6687
gtaggtagttgtatgttgttaggtgttttagaggattttataaggtttggtaacgtttattttggtcgttaatcgtttgaatttcgttagtttgcgtttagttacggcgtggcgatggacgggtataggtgattgattcgtatggtaatttcgtaatgcgggaagaatttgttatcgttggttggttcgcgcgggcgaaaaaacgtcgtcggatgcgttggaaaatttatcgattttttgatgttcgtcgtagtaatggttagcgtcggtaagcggatgtttgtatcgcgggtaattttttttttacggtaaatgtgttcgtgtcggattacgtattatcggtttgtagttaggttgtaaaacgttttttttatttttttgatgttgttatagtatagcggttcggcgttgggtttttcgattgtagcgtggtgttatagtcgacggcggcgtagttggcggatatgcgtttgttagtgtcgaaatttggcgcgttattatcggagaagagtcgtcgtggcgatgttgtcgttttttagtaatggtagcgttcgttatttttgtttgttaacgtttagtaggcgatagaaatcgttcgtgagcgcgtattaaattggtggtggatggcgagttatagtttgacgtcgatttcgtgtcggaagggcggcgtaaaaagcgtttgttagttcgttatagggtaaggtttaatgtatggttttttcgtcgttggaagtcggaaatattggttataaaatcgtatacgattcggcggatatcgtgtcgtcgggttattgatataaggatttgttcgtcgatgtacgatttttttcgtggttgtagcgtgtaggaaattatcgattggcgttggtggtagttgt

SEQ ID NO: 6688 - DNA, 878 bp, Artificial Sequence
  chemically treated genomic DNA (Homo sapiens) CpG-island No: 6688
acaactaccaccaacgccaatcgataatttcctacacgctacaaccacgaaaaaaatcgtacatcgacgaacaaatccttatatcaataacccgacgacacgatatccgccgaatcgtatacgattttataaccaatatttccgacttccaacgacgaaaaaaccatacattaaaccttaccctataacgaactaacaaacgctttttacgccgcccttccgacacgaaatcgacgtcaaactataactcgccatccaccaccaatttaatacgcgctcacgaacgatttctatcgcctactaaacgttaacaaacaaaaataacgaacgctaccattactaaaaaacgacaacatcgccacgacgactcttctccgataataacgcgccaaatttcgacactaacaaacgcatatccgccaactacgccgccgtcgactataacaccacgctacaatcgaaaaacccaacgccgaaccgctatactataacaacatcaaaaaaataaaaaaaacgttttacaacctaactacaaaccgataatacgtaatccgacacgaacacatttaccgtaaaaaaaaaattacccgcgatacaaacatccgcttaccgacgctaaccattactacgacgaacatcaaaaaatcgataaattttccaacgcatccgacgacgttttttcgcccgcgcgaaccaaccaacgataacaaattcttcccgcattacgaaattaccatacgaatcaatcacctatacccgtccatcgccacgccgtaactaaacgcaaactaacgaaattcaaacgattaacgaccaaaataaacgttaccaaaccttataaaatcctctaaaacacctaacaacatacaactacctac

SEQ ID NO: 6689 - DNA, 534 bp, Artificial Sequence
  chemically treated genomic DNA (Homo sapiens) CpG-island No: 6689
gtttgtcgtttaggtttttttagggacgttaggtgttatttttgttcgcgtttgtcggtttttcggttgttttttatattttttttatttcgagatttttttcgtttttggattcgtattttaaatttttttaagcggtttaatttcgatagttatcgtcgttataattcggtatatcgtttcgttttttttatttattatacgtcgcgaacgttttaattttcgttttaagagcgttagttttgcgtttgcgtatatagttatttcgttttgattcgtttcgttattatagaagagttaatcggaagttttgggttgtttaaatttattttgcgtttgtgtatagtacgttttcgtttcgtttcgtttgggcggagtttcgagtgattgcgttttttagaggttagtagaggtattgcggatagatttgtaagcgtttttttttcggtttcgtttttttttttttaagttagttacgtgcgttttagtttcgggacgtcggggttttaatttaaagaggagttggtttggggt

SEQ ID NO: 6690 - DNA, 534 bp, Artificial Sequence
  chemically treated genomic DNA (Homo sapiens) CpG-island No: 6690
accccaaaccaactcctctttaaattaaaaccccgacgtcccgaaactaaaacgcacgtaactaacttaaaaaaaaaaaaacgaaaccgaaaaaaaaacgcttacaaatctatccgcaatacctctactaacctctaaaaaacgcaatcactcgaaactccgcccaaacgaaacgaaacgaaaacgtactatacacaaacgcaaaataaatttaaacaacccaaaacttccgattaactcttctataataacgaaacgaatcaaaacgaaataactatatacgcaaacgcaaaactaacgctcttaaaacgaaaattaaaacgttcgcgacgtataataaataaaaaaaacgaaacgatataccgaattataacgacgataactatcgaaattaaaccgcttaaaaaaatttaaaatacgaatccaaaaacgaaaaaaatctcgaaataaaaaaaatataaaaaacaaccgaaaaaccgacaaacgcgaacaaaaataacacctaacgtccctaaaaaaacctaaacgacaaac

SEQ ID NO: 6691 - DNA, 534 bp, Artificial Sequence
  chemically treated genomic DNA (Homo sapiens) CpG-island No: 6691
gttttagattagtttttttttgggttaaaatttcggcgtttcggagttgaggcgtacgtggttagtttggggaggagagggcggggtcggggaggaggcgtttgtaagtttgttcgtaatgtttttattggtttttagagggcgtaattattcgaggtttcgtttaagcgaggcggggcggaagcgtgttgtgtataggcgtaagatgggtttgggtagtttagagttttcgattggtttttttgtggtggcggggcgggttagaacgagatggttgtgtgcgtaggcgtaagattagcgtttttgggacggaagttaaggcgttcgcggcgtgtggtaagtgaggggggcgggacggtgtatcgggttgtggcggcgatggttgtcggagttgggtcgtttgggggagtttggggtgcgagtttaggggcgagggaagtttcgagatgaggagaatgtaggaggtagtcgaagggtcggtaaacgcggatagagatggtatttggcgtttttgggagaatttgggcgataggt

SEQ ID NO: 6692 - DNA, 534 bp, Artificial Sequence
  chemically treated genomic DNA (Homo sapiens) CpG-island No: 6692
acctatcgcccaaattctcccaaaaacgccaaataccatctctatccgcgtttaccgacccttcgactacctcctacattctcctcatctcgaaacttccctcgcccctaaactcgcaccccaaactcccccaaacgacccaactccgacaaccatcgccgccacaacccgatacaccgtcccgcccccctcacttaccacacgccgcgaacgccttaacttccgtcccaaaaacgctaatcttacgcctacgcacacaaccatctcgttctaacccgccccgccaccacaaaaaaaccaatcgaaaactctaaactacccaaacccatcttacgcctatacacaacacgcttccgccccgcctcgcttaaacgaaacctcgaataattacgccctctaaaaaccaataaaaacattacgaacaaacttacaaacgcctcctccccgaccccgccctctcctccccaaactaaccacgtacgcctcaactccgaaacgccgaaattttaacccaaaaaaaaactaatctaaaac

SEQ ID NO: 6693 - DNA, 751 bp, Artificial Sequence
  chemically treated genomic DNA (Homo sapiens) CpG-island No: 6693
ggttgtttcgcgtaattttattattttttttaatttttacggcgtttcgttattcggggttttcgtttttttcgtaagtttattttttttgcgggtatttgcgtttttgtagtttgcgttttcgtgcgtttatattgaagtttttttcggagtcgagttcgggtttcgttttttgtagaagttttcgttttattaaggttttacgcgagttcgggattttcgttttattcgtatcgtttttatttttagttatcgatttgtttcgtgcgtttttcggaggagttaggcgttcgtacgatttagttcggatattgggggcggcgaagtttcggcgcggggatcgtggtcgggggcgaaggattttcgggcgttttcgtttcggggtcgttgaggcggtagtagcgattttcggaagcgaagacgggtaaggcgagcggttcgagtttattattagtcgttttttatgattcgtattacggtcgtcgcgcgtcgtatcgttttatcggttttcggtaggttgtaatttatgttatttaggatgaatggtttatttattggttatgcgttcgttatttaggttcggcgtgaattgtttattggtcggaatggtagtgatttttttttttgttatttaggtcggtagtgttcgtttttttttgattttgtatcggattacgaattttagcgattattgcgttcggggaaagtcgatatttagaagtcgtaggcgagatgtttgttgggaattgta

SEQ ID NO: 6694 - DNA, 751 bp, Artificial Sequence
  chemically treated genomic DNA (Homo sapiens) CpG-island No: 6694
tacaattcccaacaaacatctcgcctacgacttctaaatatcgactttccccgaacgcaataatcgctaaaattcgtaatccgatacaaaatcaaaaaaaaacgaacactaccgacctaaataacaaaaaaaaaaatcactaccattccgaccaataaacaattcacgccgaacctaaataacgaacgcataaccaataaataaaccattcatcctaaataacataaattacaacctaccgaaaaccgataaaacgatacgacgcgcgacgaccgtaatacgaatcataaaaaacgactaataataaactcgaaccgctcgccttacccgtcttcgcttccgaaaatcgctactaccgcctcaacgaccccgaaacgaaaacgcccgaaaatccttcgcccccgaccacgatccccgcgccgaaacttcgccgcccccaatatccgaactaaatcgtacgaacgcctaactcctccgaaaaacgcacgaaacaaatcgataactaaaaataaaaacgatacgaataaaacgaaaatcccgaactcgcgtaaaaccttaataaaacgaaaacttctacaaaaaacgaaacccgaactcgactccgaaaaaaacttcaatataaacgcacgaaaacgcaaactacaaaaacgcaaatacccgcaaaaaaaataaacttacgaaaaaaacgaaaaccccgaataacgaaacgccgtaaaaattaaaaaaaataataaaattacgcgaaacaacc

SEQ ID NO: 6695 - DNA, 751 bp, Artificial Sequence
  chemically treated genomic DNA (Homo sapiens) CpG-island No: 6695
tataatttttagtagatatttcgtttgcgatttttgaatatcggtttttttcgagcgtaatgatcgttgggattcgtagttcggtataaaattaaggagggacgggtattatcggtttagatgatagaggagggaattattgttatttcgattaatggatagtttacgtcggatttgagtggcgagcgtatagttaatgggtaagttatttattttgagtgatatgggttgtaatttatcggaggtcggtggggcggtacggcgcgcggcggtcgtagtgcgaattatgggaggcggttggtggtgggttcgggtcgttcgttttgttcgttttcgttttcggaggtcgttattgtcgttttagcggtttcggagcgggggcgttcgggggtttttcgttttcggttacggttttcgcgtcggggtttcgtcgtttttagtgttcgagttggatcgtgcggacgtttggttttttcgaaaagcgtacgagataggtcggtggttaggggtgggggcggtgcggatgggacgggggtttcgggttcgcgtgggattttgatggggcgggggtttttgtaggaaacggggttcgggttcggtttcgagaagggttttagtgtgagcgtacggaagcgtagattgtaagagcgtaggtgttcgtagaggggatgggtttgcggggaggacgaggatttcgggtaacggggcgtcgtagggattggagggggtggtagggttgcgcgaggtagtt

SEQ ID NO: 6696 - DNA, 751 bp, Artificial Sequence
  chemically treated genomic DNA (Homo sapiens) CpG-island No: 6696
aactacctcgcgcaaccctaccaccccctccaatccctacgacgccccgttacccgaaatcctcgtcctccccgcaaacccatcccctctacgaacacctacgctcttacaatctacgcttccgtacgctcacactaaaacccttctcgaaaccgaacccgaaccccgtttcctacaaaaacccccgccccatcaaaatcccacgcgaacccgaaacccccgtcccatccgcaccgcccccacccctaaccaccgacctatctcgtacgcttttcgaaaaaaccaaacgtccgcacgatccaactcgaacactaaaaacgacgaaaccccgacgcgaaaaccgtaaccgaaaacgaaaaacccccgaacgcccccgctccgaaaccgctaaaacgacaataacgacctccgaaaacgaaaacgaacaaaacgaacgacccgaacccaccaccaaccgcctcccataattcgcactacgaccgccgcgcgccgtaccgccccaccgacctccgataaattacaacccatatcactcaaaataaataacttacccattaactatacgctcgccactcaaatccgacgtaaactatccattaatcgaaataacaataattccctcctctatcatctaaaccgataatacccgtccctccttaattttataccgaactacgaatcccaacgatcattacgctcgaaaaaaaccgatattcaaaaatcgcaaacgaaatatctactaaaaattata

SEQ ID NO: 6697 - DNA, 771 bp, Artificial Sequence
  chemically treated genomic DNA (Homo sapiens) CpG-island No: 6697
tgaagtgacgtcgtgttaatttacggttcgaaattatttttttcggtaattttcgtgcgtatggggtaaatcgaattgtgttaataacgtcgaaagtttgtgtatcgtttcggcgattttcgtttaacggtcgtgggagttggtatttagaatatttcggaatagttaatatgttggtattaagtttgatgggttttttcgagtcgggtgaaaatattcgggattgtgggaattgtcgtacgggtattaatcgtatcgcgagattttcgaacgattatagtcgtgtttagtatgcgtgatggtttgataagttttattagttttggtatttagagcgtgcgacggtggattgattttttgtatcgaagcgtatttattgtatttgtcgtatacgaattcgataagtatcgagttaagcgggtagtcgtttgggtacggcgttggcgatggcggttgattatgagattaatatggtgtcgttggtgcgtaatttggaagagtttattcgttcgtgagttttgcggttggtgtacgtcgtagtcgcgataggtttgtcgtggagcgtgaaaattattgcgtgcgttaggagcgtaggtgaaggtatagtcgggacgatatcgaaatatttgagtaattgtgtcgatttttaggttcgggtaaaattttattgtgtttacgtatttggtgtagtggagtcgttatagagcgttattaaatattttcgcgaagaatttagaggcgggaattaaatagtcgtttagtaatatttat

SEQ ID NO: 6698 - DNA, 771 bp, Artificial Sequence
  chemically treated genomic DNA (Homo sapiens) CpG-island No: 6698
ataaatattactaaacgactatttaattcccgcctctaaattcttcgcgaaaatatttaataacgctctataacgactccactacaccaaatacgtaaacacaataaaattttacccgaacctaaaaatcgacacaattactcaaatatttcgatatcgtcccgactataccttcacctacgctcctaacgcacgcaataattttcacgctccacgacaaacctatcgcgactacgacgtacaccaaccgcaaaactcacgaacgaataaactcttccaaattacgcaccaacgacaccatattaatctcataatcaaccgccatcgccaacgccgtacccaaacgactacccgcttaactcgatacttatcgaattcgtatacgacaaatacaataaatacgcttcgatacaaaaaatcaatccaccgtcgcacgctctaaataccaaaactaataaaacttatcaaaccatcacgcatactaaacacgactataatcgttcgaaaatctcgcgatacgattaatacccgtacgacaattcccacaatcccgaatattttcacccgactcgaaaaaacccatcaaacttaataccaacatattaactattccgaaatattctaaataccaactcccacgaccgttaaacgaaaatcgccgaaacgatacacaaactttcgacgttattaacacaattcgatttaccccatacgcacgaaaattaccgaaaaaaataatttcgaaccgtaaattaacacgacgtcacttca

SEQ ID NO: 6699 - DNA, 771 bp, Artificial Sequence
  chemically treated genomic DNA (Homo sapiens) CpG-island No: 6699
atgggtattgttgaacggttgtttgattttcgtttttaaatttttcgcggaaatatttgatggcgttttgtaacggttttattgtattaggtgcgtgggtatagtaaagttttattcgggtttaagaatcgatatagttgtttaagtgtttcgatatcgtttcggttgtatttttatttacgtttttagcgtacgtagtaatttttacgttttacggtagatttgtcgcggttacggcgtatattagtcgtaggatttacgggcgaataaatttttttaggttacgtattagcgatattatgttgattttatggttaatcgttatcgttagcgtcgtatttagacggttgttcgtttaattcgatatttatcgaattcgtatacggtagatataatgagtgcgtttcggtataggaagttagtttatcgtcgtacgttttggatgttagagttagtagaatttgttagattattacgtatattgagtacggttgtaatcgttcgaggatttcgcggtgcggttggtgttcgtacggtagtttttatagtttcggatgtttttattcgattcggagaagtttattagatttggtgttagtatgttaattatttcgagatgttttgaatattagtttttacgatcgttaagcgaggatcgtcggaacggtatataggttttcgacgttgttgatatagttcggtttattttatgcgtacggaggttgtcgggaagggtggtttcgagtcgtgggttagtacgacgttatttta

SEQ ID NO: 6700 - DNA, 771 bp, Artificial Sequence
  chemically treated genomic DNA (Homo sapiens) CpG-island No: 6700
taaaataacgtcgtactaacccacgactcgaaaccacccttcccgacaacctccgtacgcataaaataaaccgaactatatcaacaacgtcgaaaacctatataccgttccgacgatcctcgcttaacgatcgtaaaaactaatattcaaaacatctcgaaataattaacatactaacaccaaatctaataaacttctccgaatcgaataaaaacatccgaaactataaaaactaccgtacgaacaccaaccgcaccgcgaaatcctcgaacgattacaaccgtactcaatatacgtaataatctaacaaattctactaactctaacatccaaaacgtacgacgataaactaacttcctataccgaaacgcactcattatatctaccgtatacgaattcgataaatatcgaattaaacgaacaaccgtctaaatacgacgctaacgataacgattaaccataaaatcaacataatatcgctaatacgtaacctaaaaaaatttattcgcccgtaaatcctacgactaatatacgccgtaaccgcgacaaatctaccgtaaaacgtaaaaattactacgtacgctaaaaacgtaaataaaaatacaaccgaaacgatatcgaaacacttaaacaactatatcgattcttaaacccgaataaaactttactatacccacgcacctaatacaataaaaccgttacaaaacgccatcaaatatttccgcgaaaaatttaaaaacgaaaatcaaacaaccgttcaacaatacccat

SEQ ID NO: 6701 - DNA, 559 bp, Artificial Sequence
  chemically treated genomic DNA (Homo sapiens) CpG-island No: 6701
ttttattaggtttataaatcgttatcgattcgtatcgggtaattgtgggttacgatggtatcgcgatagtttgtttttttttaagtagtttttcgattacgttaggatcggtaagcgtcgaggtatcgtttaggttgttggtatcgttcgtcgtaattttgcgtagaatacggcgtataattttgtcggagcgggttttaggtagggagtcggtttagtgtagtacgtttggcgtcgttagcgggttaatttttttacgtatttagttgcggatttttgcgtatagttttggtgacggttttttttcgtgattaagcgtgacgtaggcgtagatcgtttgatttttaatattgtgcggaatatttattacggcggtttcggtaattttcggatgcgttattagcgtcgatttaatttttgtcgtttttagacggtgatcggagacgtttagtacgtcgtttatacgttcggttatttagtaatagttatttttatcgcgacgcgcgtcgtcgtcgttgaaatatatatttttgaaggtggagaagtaggtttgtttaaa

SEQ ID NO: 6702 - DNA, 559 bp, Artificial Sequence
  chemically treated genomic DNA (Homo sapiens) CpG-island No: 6702
tttaaacaaacctacttctccaccttcaaaaatatatatttcaacgacgacgacgcgcgtcgcgataaaaataactattactaaataaccgaacgtataaacgacgtactaaacgtctccgatcaccgtctaaaaacgacaaaaattaaatcgacgctaataacgcatccgaaaattaccgaaaccgccgtaataaatattccgcacaatattaaaaatcaaacgatctacgcctacgtcacgcttaatcacgaaaaaaaaccgtcaccaaaactatacgcaaaaatccgcaactaaatacgtaaaaaaattaacccgctaacgacgccaaacgtactacactaaaccgactccctacctaaaacccgctccgacaaaattatacgccgtattctacgcaaaattacgacgaacgataccaacaacctaaacgatacctcgacgcttaccgatcctaacgtaatcgaaaaactacttaaaaaaaaacaaactatcgcgataccatcgtaacccacaattacccgatacgaatcgataacgatttataaacctaataaaa

SEQ ID NO: 6703 - DNA, 559 bp, Artificial Sequence
  chemically treated genomic DNA (Homo sapiens) CpG-island No: 6703
tttgaatagatttatttttttatttttaaaaatatgtattttagcggcgacggcgcgcgtcgcgatgaagatggttattattggataatcgggcgtgtggacgacgtgttgaacgttttcggttatcgtttggggacggtagagattgagtcggcgttggtggcgtattcgaagattgtcgaagtcgtcgtagtaggtatttcgtataatattaaaggttaggcgatttacgtttacgttacgtttaattacggggaggaatcgttattagaattgtacgtagaagttcgtaattgggtgcgtaaagagattggttcgttggcgacgttagacgtgttgtattggatcgattttttgtttaaaattcgtttcggtaaaattatgcgtcgtattttgcgtaaaattgcggcgggcgatattagtaatttgggcgatatttcgacgtttgtcgattttggcgtagtcgagaagttgtttgaagagaagtaggttatcgcgatgttatcgtaatttataattgttcgatgcgagtcggtaacggtttgtaggtttgataaga

SEQ ID NO: 6704 - DNA, 559 bp, Artificial Sequence
  chemically treated genomic DNA (Homo sapiens) CpG-island No: 6704
tcttatcaaacctacaaaccgttaccgactcgcatcgaacaattataaattacgataacatcgcgataacctacttctcttcaaacaacttctcgactacgccaaaatcgacaaacgtcgaaatatcgcccaaattactaatatcgcccgccgcaattttacgcaaaatacgacgcataattttaccgaaacgaattttaaacaaaaaatcgatccaatacaacacgtctaacgtcgccaacgaaccaatctctttacgcacccaattacgaacttctacgtacaattctaataacgattcctccccgtaattaaacgtaacgtaaacgtaaatcgcctaacctttaatattatacgaaatacctactacgacgacttcgacaatcttcgaatacgccaccaacgccgactcaatctctaccgtccccaaacgataaccgaaaacgttcaacacgtcgtccacacgcccgattatccaataataaccatcttcatcgcgacgcgcgccgtcgccgctaaaatacatatttttaaaaataaaaaaataaatctattcaaa

SEQ ID NO: 6705 - DNA, 904 bp, Artificial Sequence
  chemically treated genomic DNA (Homo sapiens) CpG-island No: 6705
gaagttgattcgtcgaagatttagatcgaagtgtttcgtttgttatcgatttgtttcgcggaagagaacggttttatcgttaatttaggtcgttggttatagtggtattggaaaggtgcggacgtttcggggattgcgttgattgacggcgagatttttttcggtatttttttgcgtttgcgtaagatgtatgtcgaatagggtggcgcgaattcggattaggtgttgaatatgatatggaattacgttatttcgtatgagttatttttagaagaagtggcgatggagagtaacggtaaggcgttggtcgatattatcgattcggtaatcggtgcggttatcgttaagaaaggttaataatttagttcgttcgtttaattgcgcgatgacggtataattttttgtggttgttggattttcgtcggtagttggacgtcggaaggtaattagatggtacgtcgtgataacgtcgattcgtttggtttcggtaatacgttgggttgggtatgggtatggtcgtttaatcgtcgtattttgtataatcgcgttttcgtagattcgtagggtaattcgtgggattcgaagcgttagttgttgaaatgggacggtattaagtggatcggttgggatatttcggattatagcgtagcgttttcgggtagcggcgtcgggtcgtttattatgtagtaggaaggtatggggcgtttgtttgttttcgataagatggcggaaggttcgttttcggaatattacgagtcgtttgaaacgtcgttgggaattaattcgttgtatttaaacgttatttcgaattcggttgtacgtatttttaaagacgacgtcgaagtattgggtaaagtcgataagttttcgtatgtcggaattatttatcgtttgatcgagtatt

SEQ ID NO: 6706 - DNA, 904 bp, Artificial Sequence
  chemically treated genomic DNA (Homo sapiens) CpG-island No: 6706
aatactcgatcaaacgataaataattccgacatacgaaaacttatcgactttacccaatacttcgacgtcgtctttaaaaatacgtacaaccgaattcgaaataacgtttaaatacaacgaattaattcccaacgacgtttcaaacgactcgtaatattccgaaaacgaaccttccgccatcttatcgaaaacaaacaaacgccccataccttcctactacataataaacgacccgacgccgctacccgaaaacgctacgctataatccgaaatatcccaaccgatccacttaataccgtcccatttcaacaactaacgcttcgaatcccacgaattaccctacgaatctacgaaaacgcgattatacaaaatacgacgattaaacgaccatacccatacccaacccaacgtattaccgaaaccaaacgaatcgacgttatcacgacgtaccatctaattaccttccgacgtccaactaccgacgaaaatccaacaaccacaaaaaattataccgtcatcgcgcaattaaacgaacgaactaaattattaacctttcttaacgataaccgcaccgattaccgaatcgataatatcgaccaacgccttaccgttactctccatcgccacttcttctaaaaataactcatacgaaataacgtaattccatatcatattcaacacctaatccgaattcgcgccaccctattcgacatacatcttacgcaaacgcaaaaaaataccgaaaaaaatctcgccgtcaatcaacgcaatccccgaaacgtccgcacctttccaataccactataaccaacgacctaaattaacgataaaaccgttctcttccgcgaaacaaatcgataacaaacgaaacacttcgatctaaatcttcgacgaatcaacttc

SEQ ID NO: 6707 - DNA, 904 bp, Artificial Sequence
  chemically treated genomic DNA (Homo sapiens) CpG-island No: 6707
agtgttcggttagacgataggtggtttcgatatacgggaatttatcggttttatttaatgtttcggcgtcgtttttaaagatacgtgtagtcgggttcgagataacgtttggatgtagcgggttagtttttagcggcgttttaaacggttcgtagtgtttcgggaacggatttttcgttattttatcgagggtaaatagacgttttatgtttttttgttgtatgataaacggttcgacgtcgttattcggaggcgttgcgttgtagttcggaatattttagtcggtttatttagtgtcgttttattttagtaattgacgtttcggattttacgggttattttgcggatttgcggaggcgcggttatatagaatgcggcggttaagcggttatgtttatgtttagtttagcgtgttatcgaggttagacggatcggcgttattacggcgtgttatttggttgtttttcggcgtttagttatcggcgaaaatttagtagttataggaggttgtatcgttatcgcgtaattgggcgaacgaattaagttgttggttttttttgacgataatcgtatcggttgtcggatcggtaatatcggttagcgttttatcgttgttttttatcgttattttttttgaagatggtttatgcggaatggcgtagttttatgttatgtttagtatttggttcgggttcgcgttattttgttcggtatatattttgcgtaagcgtaggaagatatcggagaggatttcgtcgttagttagcgtaattttcggggcgttcgtatttttttagtgttattgtaattagcgatttgagttaacgatagaatcgttttttttcgcgaagtaggtcgatggtagacggaatatttcggtttggattttcgacgagttaatttt

SEQ ID NO: 6708 - DNA, 904 bp, Artificial Sequence
  chemically treated genomic DNA (Homo sapiens) CpG-island No: 6708
aaaattaactcgtcgaaaatccaaaccgaaatattccgtctaccatcgacctacttcgcgaaaaaaaacgattctatcgttaactcaaatcgctaattacaataacactaaaaaaatacgaacgccccgaaaattacgctaactaacgacgaaatcctctccgatatcttcctacgcttacgcaaaatatataccgaacaaaataacgcgaacccgaaccaaatactaaacataacataaaactacgccattccgcataaaccatcttcaaaaaaaataacgataaaaaacaacgataaaacgctaaccgatattaccgatccgacaaccgatacgattatcgtcaaaaaaaaccaacaacttaattcgttcgcccaattacgcgataacgatacaacctcctataactactaaattttcgccgataactaaacgccgaaaaacaaccaaataacacgccgtaataacgccgatccgtctaacctcgataacacgctaaactaaacataaacataaccgcttaaccgccgcattctatataaccgcgcctccgcaaatccgcaaaataacccgtaaaatccgaaacgtcaattactaaaataaaacgacactaaataaaccgactaaaatattccgaactacaacgcaacgcctccgaataacgacgtcgaaccgtttatcatacaacaaaaaaacataaaacgtctatttaccctcgataaaataacgaaaaatccgttcccgaaacactacgaaccgtttaaaacgccgctaaaaactaacccgctacatccaaacgttatctcgaacccgactacacgtatctttaaaaacgacgccgaaacattaaataaaaccgataaattcccgtatatcgaaaccacctatcgtctaaccgaacact

SEQ ID NO: 6709 - DNA, 1135 bp, Artificial Sequence
  chemically treated genomic DNA (Homo sapiens) CpG-island No: 6709
atattttataggattgttatacgtttaataatgacggtagtttgcgttagtcggtcgatacgttgttgacgttgatttattagaaggagaaatattatgtttgtttgtgagtttcgttcggttacgtagtacgatatcgacgcggtttacgcgttgatttgtgagttaaaataggcggagtttgattattacgcgtttcgcgtgggttttaacgttaatttgcgcgatttaaatatgcgttattatttggcgttgtttgatggcgaagttgtcggtatgatcggtttgtatttgtagttttatttgtattatgttaattggatcggcgaaatttaggagttggtggtaatgtcgtaggcgcgcggtttgaacgtcggtagtaagttattggcgtgggtagaagaagaagttcgttaggtcggggtcgaaatgatcgaattttcgattaacgtgaagcgttacgacgcgtatcgtttttatttgcgcgaaggttacgagtagagttattttcgttttattaaggcgttgtaatatgagtttgatttttacgtttatcggtatcggcggcgtatagggcgtttcggtatggggttgcgagtgtgcggtttgcgttagagcgcggcgttcgtcgtagtatcgtcgttaatcgtgtagcggcgtagtgaagtttaacgacgtaattattttgatcgacgtcgggttgtacgatttcgtcgatcgttggtcgttcggatcgttttagtagtttttgttgacgtattattatatggattacgtttagggttgttttcgttgcgttggggcgttggcgattcgatttcggtttacggttcgtcggatgaatagggttgcgacgatttgtttaaatattcgggtttgtttgattttagttatacggtggaatcgtttgtggtgtttgatttgtaggggttataggttacgtttttgtcgtttaattatttaaaattgattttcggttatttgttggaaacggtatatagtcgggtggcgtggttgtttgatatcgtaggtttgtcggaaaaaacgttgaaatttttacgtaataattagtcgtaggtaatggtgatggattgtagttattcgtcgcgcgcggatgtatcgcgtaattattgtg

SEQ ID NO: 6710 - DNA, 1135 bp, Artificial Sequence
  chemically treated genomic DNA (Homo sapiens) CpG-island No: 6710
cacaataattacgcgatacatccgcgcgcgacgaataactacaatccatcaccattacctacgactaattattacgtaaaaatttcaacgttttttccgacaaacctacgatatcaaacaaccacgccacccgactatataccgtttccaacaaataaccgaaaatcaattttaaataattaaacgacaaaaacgtaacctataacccctacaaatcaaacaccacaaacgattccaccgtataactaaaatcaaacaaacccgaatatttaaacaaatcgtcgcaaccctattcatccgacgaaccgtaaaccgaaatcgaatcgccaacgccccaacgcaacgaaaacaaccctaaacgtaatccatataataatacgtcaacaaaaactactaaaacgatccgaacgaccaacgatcgacgaaatcgtacaacccgacgtcgatcaaaataattacgtcgttaaacttcactacgccgctacacgattaacgacgatactacgacgaacgccgcgctctaacgcaaaccgcacactcgcaaccccataccgaaacgccctatacgccgccgataccgataaacgtaaaaatcaaactcatattacaacgccttaataaaacgaaaataactctactcgtaaccttcgcgcaaataaaaacgatacgcgtcgtaacgcttcacgttaatcgaaaattcgatcatttcgaccccgacctaacgaacttcttcttctacccacgccaataacttactaccgacgttcaaaccgcgcgcctacgacattaccaccaactcctaaatttcgccgatccaattaacataatacaaataaaactacaaatacaaaccgatcataccgacaacttcgccatcaaacaacgccaaataataacgcatatttaaatcgcgcaaattaacgttaaaacccacgcgaaacgcgtaataatcaaactccgcctattttaactcacaaatcaacgcgtaaaccgcgtcgatatcgtactacgtaaccgaacgaaactcacaaacaaacataatatttctccttctaataaatcaacgtcaacaacgtatcgaccgactaacgcaaactaccgtcattattaaacgtataacaatcctataaaatat

SEQ ID NO: 6711 - DNA, 1135 bp, Artificial Sequence
  chemically treated genomic DNA (Homo sapiens) CpG-island No: 6711
tatagtgattacgcggtgtattcgcgcgcggcgggtgattgtaatttattattattatttgcggttgattattgcgtaaaaattttagcgtttttttcggtaagtttgcggtgttagatagttacgttattcggttgtgtgtcgtttttagtagataatcgaaggttagttttgagtggttgagcggtaggggcgtgatttgtaatttttgtaaattaaatattataaacggttttatcgtgtggttgaaattaagtaggttcggatgtttaaatagatcgtcgtagttttgtttattcggcgggtcgtaaatcgggatcggatcgttaacgttttagcgtagcggaaatagttttggacgtgatttatatgataatgcgttagtaaaaattgttggaacgattcgggcgattagcgatcggcgagatcgtgtagttcggcgtcgattagggtgattgcgtcgttaaattttattacgtcgttgtacggttggcggcgatattgcggcgagcgtcgcgttttggcgtaggtcgtatattcgtagttttatgtcggaacgttttgtgcgtcgtcggtgtcggtgagcgtgagggttaggtttatgttatagcgttttggtgaagcggaagtggttttgttcgtagttttcgcgtagatagaaacggtgcgcgtcgtggcgttttacgttggtcgaaagttcggttatttcggtttcggtttggcgggtttttttttttgtttacgttagtaatttattgtcgacgtttagatcgcgcgtttgcggtattattattaatttttgaatttcgtcgatttagttgatatgatgtagatgaaattgtaaatgtaggtcgattatgtcgataatttcgttattaagtagcgttagatggtagcgtatgtttgggtcgcgtagattggcgttaaaatttacgcgaaacgcgtggtggttaaatttcgtttgttttagtttataaattagcgcgtaaatcgcgtcggtgtcgtattgcgtggtcgggcgaagtttataagtaggtatggtgtttttttttttgatggattagcgttagtagcgtgtcgatcgattggcgtaggttgtcgttattgttgagcgtatggtaattttgtggagtat

SEQ ID NO: 6712 - DNA, 1135 bp, Artificial Sequence
  chemically treated genomic DNA (Homo sapiens) CpG-island No: 6712
atactccacaaaattaccatacgctcaacaataacgacaacctacgccaatcgatcgacacgctactaacgctaatccatcaaaaaaaaaaacaccatacctacttataaacttcgcccgaccacgcaatacgacaccgacgcgatttacgcgctaatttataaactaaaacaaacgaaatttaaccaccacgcgtttcgcgtaaattttaacgccaatctacgcgacccaaacatacgctaccatctaacgctacttaataacgaaattatcgacataatcgacctacatttacaatttcatctacatcatatcaactaaatcgacgaaattcaaaaattaataataataccgcaaacgcgcgatctaaacgtcgacaataaattactaacgtaaacaaaaaaaaaaacccgccaaaccgaaaccgaaataaccgaactttcgaccaacgtaaaacgccacgacgcgcaccgtttctatctacgcgaaaactacgaacaaaaccacttccgcttcaccaaaacgctataacataaacctaaccctcacgctcaccgacaccgacgacgcacaaaacgttccgacataaaactacgaatatacgacctacgccaaaacgcgacgctcgccgcaatatcgccgccaaccgtacaacgacgtaataaaatttaacgacgcaatcaccctaatcgacgccgaactacacgatctcgccgatcgctaatcgcccgaatcgttccaacaatttttactaacgcattatcatataaatcacgtccaaaactatttccgctacgctaaaacgttaacgatccgatcccgatttacgacccgccgaataaacaaaactacgacgatctatttaaacatccgaacctacttaatttcaaccacacgataaaaccgtttataatatttaatttacaaaaattacaaatcacgcccctaccgctcaaccactcaaaactaaccttcgattatctactaaaaacgacacacaaccgaataacgtaactatctaacaccgcaaacttaccgaaaaaaacgctaaaatttttacgcaataatcaaccgcaaataataataataaattacaatcacccgccgcgcgcgaatacaccgcgtaatcactata

SEQ ID NO: 6713 - DNA, 905 bp, Artificial Sequence
  chemically treated genomic DNA (Homo sapiens) CpG-island No: 6713
tgtggcgagcggtattattatcgtattggatgtcgtggtaattggcgattgtgcgttgacggcgtgcgatcggttggagaatttggagaagatgattaacgttatcgaagagacgtataaacgcggcgttaatcgtcgtcgagtatcgtttgtatttgcgttgcgaattgtcgtattatattacgttgtcgttgtttgaaaaattggtgtagcgcgagtcggtacgttggtgtcgttgatggattattcgtcgggttagcgttagttcgttaatcgcgagaagtatcgcgaatattattagggtaaatatttttttattgatgcgtagatgtagtagtacgaagaagagtaattggcgttcgtcgtacgttggtcgtagtcgaatcgcgaatttatcgtcgttttgtgtcgcgcgcgaaaaattgcgtttgttagttacgatgacgttatttacgtttacgttgttgaattttattagtttggtagcgtgatcgtcgaattttttattacgttcgaagcggcggaagtttcgcgtaagtatggtatgaacgtgttgatgggcgcgtcgaatattgtgcgcggcggttcgtatttcggtaacgtggcggttagtgaattggcgtagtttggtttgttggatattttttttttcgattattatttcgttagtttgttcgatgcggtatttcgcgtcgtcgatgattagagtaatcgttttacgttgtcgtaggcggtgaagttggtgattaaaaatttagcgtaggcgtttaatttttaggatcgcggggtgattggcgagggtaaacgcgtcgatttggtgttggcgtatcgtaaggataattatatttatatcgattacgtttggcgttagggtaaaagggtgttttgatgatgggaaaattgat

SEQ ID NO: 6714 - DNA, 905 bp, Artificial Sequence
  chemically treated genomic DNA (Homo sapiens) CpG-island No: 6714
atcaattttcccatcatcaaaacacccttttaccctaacgccaaacgtaatcgatataaatataattatccttacgatacgccaacaccaaatcgacgcgtttaccctcgccaatcaccccgcgatcctaaaaattaaacgcctacgctaaatttttaatcaccaacttcaccgcctacgacaacgtaaaacgattactctaatcatcgacgacgcgaaataccgcatcgaacaaactaacgaaataataatcgaaaaaaaaaatatccaacaaaccaaactacgccaattcactaaccgccacgttaccgaaatacgaaccgccgcgcacaatattcgacgcgcccatcaacacgttcataccatacttacgcgaaacttccgccgcttcgaacgtaataaaaaattcgacgatcacgctaccaaactaataaaattcaacaacgtaaacgtaaataacgtcatcgtaactaacaaacgcaatttttcgcgcgcgacacaaaacgacgataaattcgcgattcgactacgaccaacgtacgacgaacgccaattactcttcttcgtactactacatctacgcatcaataaaaaaatatttaccctaataatattcgcgatacttctcgcgattaacgaactaacgctaacccgacgaataatccatcaacgacaccaacgtaccgactcgcgctacaccaatttttcaaacaacgacaacgtaatataatacgacaattcgcaacgcaaatacaaacgatactcgacgacgattaacgccgcgtttatacgtctcttcgataacgttaatcatcttctccaaattctccaaccgatcgcacgccgtcaacgcacaatcgccaattaccacgacatccaatacgataataataccgctcgccaca

SEQ ID NO: 6715 - DNA, 905 bp, Artificial Sequence
  chemically treated genomic DNA (Homo sapiens) CpG-island No: 6715
attagtttttttattattagaatatttttttattttgacgttagacgtggtcgatatgaatatgattgtttttgcgatgcgttagtattaggtcggcgcgtttgttttcgttaattatttcgcgattttggagattaagcgtttgcgttggatttttagttattagttttatcgtttgcggtagcgtaaagcggttgttttggttatcggcgacgcgaaatgtcgtatcgagtaggttggcggggtagtagtcggaagagaggatatttagtaggttaagttgcgttagtttattggtcgttacgttgtcggagtgcgagtcgtcgcgtataatattcggcgcgtttattagtacgtttatgttatgtttgcgcgaggttttcgtcgtttcgaacgtggtgggaaattcggcgattacgttgttaagttggtgagatttagtaacgtgggcgtgggtggcgttatcgtggttggtaagcgtaatttttcgcgcgcggtatagggcggcgatggattcgcgattcggttgcgattagcgtgcggcgagcgttagttgttttttttcgtattgttgtatttgcgtattagtgagggagtatttgttttgataatattcgcgatatttttcgcggttggcgaattggcgttggttcggcgagtggtttattagcgatattagcgtatcggttcgcgttgtattagttttttaaatagcggtagcgtggtgtgatgcggtagttcgtagcgtagatgtagacggtgttcggcgacggttgacgtcgcgtttatgcgttttttcgatggcgttgattattttttttagattttttagtcgatcgtacgtcgttagcgtatagtcgttaattgttacggtatttagtacggtggtgatgtcgttcgttata

SEQ ID NO: 6716 - DNA, 905 bp, Artificial Sequence
  chemically treated genomic DNA (Homo sapiens) CpG-island No: 6716
tataacgaacgacatcaccaccgtactaaataccgtaacaattaacgactatacgctaacgacgtacgatcgactaaaaaatctaaaaaaaataatcaacgccatcgaaaaaacgcataaacgcgacgtcaaccgtcgccgaacaccgtctacatctacgctacgaactaccgcatcacaccacgctaccgctatttaaaaaactaatacaacgcgaaccgatacgctaatatcgctaataaaccactcgccgaaccaacgccaattcgccaaccgcgaaaaatatcgcgaatattatcaaaacaaatactccctcactaatacgcaaatacaacaatacgaaaaaaaacaactaacgctcgccgcacgctaatcgcaaccgaatcgcgaatccatcgccgccctataccgcgcgcgaaaaattacgcttaccaaccacgataacgccacccacgcccacgttactaaatctcaccaacttaacaacgtaatcgccgaatttcccaccacgttcgaaacgacgaaaacctcgcgcaaacataacataaacgtactaataaacgcgccgaatattatacgcgacgactcgcactccgacaacgtaacgaccaataaactaacgcaacttaacctactaaatatcctctcttccgactactaccccgccaacctactcgatacgacatttcgcgtcgccgataaccaaaacaaccgctttacgctaccgcaaacgataaaactaataactaaaaatccaacgcaaacgcttaatctccaaaatcgcgaaataattaacgaaaacaaacgcgccgacctaatactaacgcatcgcaaaaacaatcatattcatatcgaccacgtctaacgtcaaaataaaaaaatattctaataataaaaaaactaat

SEQ ID NO: 6717 - DNA, 1103 bp, Artificial Sequence
  chemically treated genomic DNA (Homo sapiens) CpG-island No: 6717
tgacgaacgtggttggttgatagatattagttatattagcgaagggtatcgggtggcggtgtattataggtatgatgagaaaggtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattaacgtttatatttttgatcgggtagttatagagttagtatttgaatagttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgtttgttcgattcggagttgtattcggatagtatttttagtatgtggtcggataatcgtatcgttcgtgacgcgtattatttttatcggtatggatcgttacggtaggttgatagagaaaatcgattttatttcggaaggggttattcgtacggatgatgagcggatttatcggtattattacgatagttagtatcggttggtgtattatacgcggatataatattaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattacgatatagaacgatagaattcgtatttagacgatttattagtcggggagttttacgttatttattagagttgaaatcgttatcggtgagttggcgaaaacgtagcgtcgtagtttggcggatgttttttagtagttcggcggcgaagacggtggt

SEQ ID NO: 6718 - DNA, 1103 bp, Artificial Sequence
  chemically treated genomic DNA (Homo sapiens) CpG-island No: 6718
accaccgtcttcgccgccgaactactaaaaaacatccgccaaactacgacgctacgttttcgccaactcaccgataacgatttcaactctaataaataacgtaaaactccccgactaataaatcgtctaaatacgaattctatcgttctatatcgtaatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttaatattatatccgcgtataatacaccaaccgatactaactatcgtaataataccgataaatccgctcatcatccgtacgaataaccccttccgaaataaaatcgattttctctatcaacctaccgtaacgatccataccgataaaaataatacgcgtcacgaacgatacgattatccgaccacatactaaaaatactatccgaatacaactccgaatcgaacaaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaactattcaaatactaactctataactacccgatcaaaaatataaacgttaataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgacctttctcatcatacctataatacaccgccacccgatacccttcgctaatataactaatatctatcaaccaaccacgttcgtca

SEQ ID NO: 6719 - DNA, 1103 bp, Artificial Sequence
  chemically treated genomic DNA (Homo sapiens) CpG-island No: 6719
gttatcgttttcgtcgtcggattgttgaagggtattcgttaggttgcggcgttgcgttttcgttagtttatcggtggcggttttaattttgatgagtggcgtgaagtttttcggttgataaatcgtttggatgcgggttttgtcgttttgtatcgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggtttttgatattgtgttcgcgtgtagtgtattagtcggtgttgattgtcgtaatggtatcggtgagttcgtttattattcgtgcggataatttttttcgggatgaggtcggttttttttgttagtttgtcgtgacggtttatatcggtaaagatagtgcgcgttacgggcgatacggttattcggttatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtagttgtttaggtgttggttttgtaattgttcggttaggggtataagcgttggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggttttttttattatatttgtaatgtatcgttattcggtgtttttcgttgatatggttgatgtttgttagttagttacgttcgtta

SEQ ID NO: 6720 - DNA, 1103 bp, Artificial Sequence
  chemically treated genomic DNA (Homo sapiens) CpG-island No: 6720
taacgaacgtaactaactaacaaacatcaaccatatcaacgaaaaacaccgaataacgatacattacaaatataataaaaaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaacgcttatacccctaaccgaacaattacaaaaccaacacctaaacaactactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacaccctcaacatataaccgaataaccgtatcgcccgtaacgcgcactatctttaccgatataaaccgtcacgacaaactaacaaaaaaaaccgacctcatcccgaaaaaaattatccgcacgaataataaacgaactcaccgataccattacgacaatcaacaccgactaatacactacacgcgaacacaatatcaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacgatacaaaacgacaaaacccgcatccaaacgatttatcaaccgaaaaacttcacgccactcatcaaaattaaaaccgccaccgataaactaacgaaaacgcaacgccgcaacctaacgaatacccttcaacaatccgacgacgaaaacgataac

SEQ ID NO: 6721 - DNA, 651 bp, Artificial Sequence
  chemically treated genomic DNA (Homo sapiens) CpG-island No: 6721
  misc_feature (329)..(329): n is either a, c, g or t
ttatcggcggcgatcggacgtttcgttttaagtgggaagtgtgtggcgcgttaatggataatttgttagcggatttttgcgttgtaaggcgatagtagagaatatacgttgcggtttagatatgtgacgtattcggttatgaattgtcgtgacgttataatgtggcgcgaagaatgtttattttttggagcgtattgtgttgttagcggtcgtcgttgtcgttatatttgaattatttatcgatttcgattgggcgtcggacgtattagttaatgcgtcgatcggggtcgggaaattaatttggttgtcggtgttattgttggcgtatntttgcgtttacgggaagattatattggtggagtttggttgtttggtagcgcgttacgtcgcgtaacggttggcggagttgtttaacgaaaagttaggcgatatcgttggttatcggatgcgtgcgtaaaattgcgtcgggtcgaatattcgtttggaagtggttatcgaaggcgtgttgacgcgtatgatttagcgtgattcggaattgagcggtgttggattggtgatttttgatgaattttatgagcgtagtttgtaggcggatttggcgttggcgttgttattcgatgtgtaataaggtttgcgtgatgattttaaatt

SEQ ID NO: 6722 - DNA, 651 bp, Artificial Sequence
  chemically treated genomic DNA (Homo sapiens) CpG-island No: 6722
  misc_feature (323)..(323): n is either a, c, g or t
aatttaaaatcatcacgcaaaccttattacacatcgaataacaacgccaacgccaaatccgcctacaaactacgctcataaaattcatcaaaaatcaccaatccaacaccgctcaattccgaatcacgctaaatcatacgcgtcaacacgccttcgataaccacttccaaacgaatattcgacccgacgcaattttacgcacgcatccgataaccaacgatatcgcctaacttttcgttaaacaactccgccaaccgttacgcgacgtaacgcgctaccaaacaaccaaactccaccaatataatcttcccgtaaacgcaaanatacgccaacaataacaccgacaaccaaattaatttcccgaccccgatcgacgcattaactaatacgtccgacgcccaatcgaaatcgataaataattcaaatataacgacaacgacgaccgctaacaacacaatacgctccaaaaaataaacattcttcgcgccacattataacgtcacgacaattcataaccgaatacgtcacatatctaaaccgcaacgtatattctctactatcgccttacaacgcaaaaatccgctaacaaattatccattaacgcgccacacacttcccacttaaaacgaaacgtccgatcgccgccgataa

SEQ ID NO: 6723 - DNA, 651 bp, Artificial Sequence
  chemically treated genomic DNA (Homo sapiens) CpG-island No: 6723
  misc_feature (323)..(323): n is either a, c, g or t
agtttaaggttattacgtagattttgttgtatatcgagtaatagcgttaacgttaaattcgtttgtaagttgcgtttatgaaatttattaaggattattagtttaatatcgtttagtttcgggttacgttggattatgcgcgttagtacgttttcggtaattatttttaggcgggtattcggttcgacgtagttttgcgtacgtattcggtagttaacggtatcgtttggtttttcgttaagtagtttcgttagtcgttgcgcgacgtaacgcgttgttagataattaggttttattagtataattttttcgtgaacgtaggnatgcgttagtagtaatatcggtagttaggttgatttttcggtttcggtcggcgtattaattaatacgttcggcgtttaatcgagatcggtaagtaatttaggtatgacggtagcgacggtcgttgataatataatacgttttagagggtgaatatttttcgcgttatattgtagcgttacggtaatttataatcgagtgcgttatatgtttgaatcgtaacgtgtgttttttgttatcgttttatagcgtagagattcgttaatagattatttattggcgcgttatatattttttatttgaggcgggacgttcggtcgtcgtcgataa

SEQ ID NO: 6724 - DNA, 651 bp, Artificial Sequence
  chemically treated genomic DNA (Homo sapiens) CpG-island No: 6724
  misc_feature (329)..(329): n is either a, c, g or t
ttatcgacgacgaccgaacgtcccgcctcaaataaaaaatatataacgcgccaataaataatctattaacgaatctctacgctataaaacgataacaaaaaacacacgttacgattcaaacatataacgcactcgattataaattaccgtaacgctacaatataacgcgaaaaatattcaccctctaaaacgtattatattatcaacgaccgtcgctaccgtcatacctaaattacttaccgatctcgattaaacgccgaacgtattaattaatacgccgaccgaaaccgaaaaatcaacctaactaccgatattactactaacgcatncctacgttcacgaaaaaattatactaataaaacctaattatctaacaacgcgttacgtcgcgcaacgactaacgaaactacttaacgaaaaaccaaacgataccgttaactaccgaatacgtacgcaaaactacgtcgaaccgaatacccgcctaaaaataattaccgaaaacgtactaacgcgcataatccaacgtaacccgaaactaaacgatattaaactaataatccttaataaatttcataaacgcaacttacaaacgaatttaacgttaacgctattactcgatatacaacaaaatctacgtaataaccttaaact

SEQ ID NO: 6725 - DNA, 524 bp, Artificial Sequence
  chemically treated genomic DNA (Homo sapiens) CpG-island No: 6725
ttttgcgtatcgttaatacgtcgaagcgagagattggttcggttacgttgaaaaagttgggtgagtgggcgatgacgcgtaataaaagtatgtttatcgttagttttgatatgggtttgagttagacgtttagcggacgtggttatgaagtattgattcgttttatttattggttggtagaaatttagcgtttggcggagcgggagtcgattgtcgcggtgcgtgatttgatttatggtatgggattatgaattttggttgtacgaaatatcgtttagttcgaaagtcgtcgaaatgcgtatgaagaacgttaattaattgtttagttggatgacggagatgttggaaggtagtgaattggatgagtcgatgacgtttatttaggtggtgacgcgttttattttgcgcgatatgatggagcgtggtgagagtgaagaagagttggattaggtgtaattgatgattttttacgcgtcgaaagggttggagtttttttatgtttatatggtcggtatggaagaagg

SEQ ID NO: 6726 - DNA, 524 bp, Artificial Sequence
  chemically treated genomic DNA (Homo sapiens) CpG-island No: 6726
ccttcttccataccgaccatataaacataaaaaaactccaaccctttcgacgcgtaaaaaatcatcaattacacctaatccaactcttcttcactctcaccacgctccatcatatcgcgcaaaataaaacgcgtcaccacctaaataaacgtcatcgactcatccaattcactaccttccaacatctccgtcatccaactaaacaattaattaacgttcttcatacgcatttcgacgactttcgaactaaacgatatttcgtacaaccaaaattcataatcccataccataaatcaaatcacgcaccgcgacaatcgactcccgctccgccaaacgctaaatttctaccaaccaataaataaaacgaatcaatacttcataaccacgtccgctaaacgtctaactcaaacccatatcaaaactaacgataaacatacttttattacgcgtcatcgcccactcacccaactttttcaacgtaaccgaaccaatctctcgcttcgacgtattaacgatacgcaaaa

SEQ ID NO: 6727 - DNA, 524 bp, Artificial Sequence
  chemically treated genomic DNA (Homo sapiens) CpG-island No: 6727
tttttttttatatcgattatgtagatataaggaaattttagttttttcgacgcgtggagagttattagttgtatttgatttagtttttttttatttttattacgttttattatgtcgcgtaaagtaaagcgcgttattatttgggtgagcgttatcggtttatttagtttattgttttttagtattttcgttatttagttaaatagttggttgacgttttttatgcgtatttcggcggttttcgggttgggcgatgtttcgtatagttaggatttataattttatgttatggattagattacgtatcgcggtaatcggttttcgtttcgttagacgttggatttttgttaattagtgagtgaagcgggttaatgttttataattacgttcgttaagcgtttgatttaggtttatattaaagttggcggtaaatatgtttttattgcgcgttatcgtttatttatttagtttttttagcgtagtcgggttaatttttcgtttcggcgtgttaacgatacgtagaa

SEQ ID NO: 6728 - DNA, 524 bp, Artificial Sequence
  chemically treated genomic DNA (Homo sapiens) CpG-island No: 6728
ttctacgtatcgttaacacgccgaaacgaaaaattaacccgactacgctaaaaaaactaaataaataaacgataacgcgcaataaaaacatatttaccgccaactttaatataaacctaaatcaaacgcttaacgaacgtaattataaaacattaacccgcttcactcactaattaacaaaaatccaacgtctaacgaaacgaaaaccgattaccgcgatacgtaatctaatccataacataaaattataaatcctaactatacgaaacatcgcccaacccgaaaaccgccgaaatacgcataaaaaacgtcaaccaactatttaactaaataacgaaaatactaaaaaacaataaactaaataaaccgataacgctcacccaaataataacgcgctttactttacgcgacataataaaacgtaataaaaataaaaaaaaactaaatcaaatacaactaataactctccacgcgtcgaaaaaactaaaatttccttatatctacataatcgatataaaaaaaaa

SEQ ID NO: 6729 - DNA, 719 bp, Artificial Sequence
  chemically treated genomic DNA (Homo sapiens) CpG-island No: 6729
  misc_feature (656)..(656): n is either a, c, g or t
  misc_feature (675)..(676): n is either a, c, g or t
  misc_feature (683)..(683): n is either a, c, g or t
  misc_feature (685)..(686): n is either a, c, g or t
  misc_feature (692)..(693): n is either a, c, g or t
  misc_feature (699)..(700): n is either a, c, g or t
tgcggtatcgttgtgttatggcgatttcggacgatttgatttttaaatttgtagatatgttaggcgagaaagtggcgaaggttaatagtgggtattgtacgaagcgcgtgcgcgacggtatggtggttgaatttgttgtttcgcgaggtaatgtcggattttgtatttgcgttttgacgtaggattcgcgtttggatatcgttgaataggttacgtagtttgttaaatacgttaattcggatttatcgcgatcgtatcgcgtttttcgaagagtcgatgtaaaattcggcgtatgattcgcgagtcgttttgtcgtgaaattcggtattgttattgtttgggatgaaagtttgcgcgagtcggattttgtttttgtggttgaagagggcgtgcgcgcggtagttattaaatttacgtttacgggtagtttggaaaaagtacgcgagttaggtatagcgcggcgtacgcgttggggttgacggcggtgattagtttttttattgaatcgagtttaggtttaacgtaattggcgcggattgtcgtttggttaacgtcggatattattttagggttggatacgttggatttgatgtaggcgtagtaggtacgtcgttggtcgggtagtacgttgtttgtcgtggaagttgatgtattgngagcggttagttatgtatnnttttttntnngattgnngtcgtnnggtagttattggttgtgta

SEQ ID NO: 6730 - DNA, 719 bp, Artificial Sequence
  chemically treated genomic DNA (Homo sapiens) CpG-island No: 6730
  misc_feature (20)..(21): n is either a, c, g or t
  misc_feature (27)..(28): n is either a, c, g or t
  misc_feature (34)..(35): n is either a, c, g or t
  misc_feature (37)..(37): n is either a, c, g or t
  misc_feature (44)..(45): n is either a, c, g or t
  misc_feature (64)..(64): n is either a, c, g or t
tacacaaccaataactaccnnacgacnncaatcnnanaaaaaannatacataactaaccgctcncaatacatcaacttccacgacaaacaacgtactacccgaccaacgacgtacctactacgcctacatcaaatccaacgtatccaaccctaaaataatatccgacgttaaccaaacgacaatccgcgccaattacgttaaacctaaactcgattcaataaaaaaactaatcaccgccgtcaaccccaacgcgtacgccgcgctatacctaactcgcgtactttttccaaactacccgtaaacgtaaatttaataactaccgcgcgcacgccctcttcaaccacaaaaacaaaatccgactcgcgcaaactttcatcccaaacaataacaataccgaatttcacgacaaaacgactcgcgaatcatacgccgaattttacatcgactcttcgaaaaacgcgatacgatcgcgataaatccgaattaacgtatttaacaaactacgtaacctattcaacgatatccaaacgcgaatcctacgtcaaaacgcaaatacaaaatccgacattacctcgcgaaacaacaaattcaaccaccataccgtcgcgcacgcgcttcgtacaatacccactattaaccttcgccactttctcgcctaacatatctacaaatttaaaaatcaaatcgtccgaaatcgccataacacaacgataccgca

SEQ ID NO: 6731 - DNA, 719 bp, Artificial Sequence
  chemically treated genomic DNA (Homo sapiens) CpG-island No: 6731
  misc_feature (20)..(21): n is either a, c, g or t
  misc_feature (27)..(28): n is either a, c, g or t
  misc_feature (34)..(35): n is either a, c, g or t
  misc_feature (37)..(37): n is either a, c, g or t
  misc_feature (44)..(45): n is either a, c, g or t
  misc_feature (64)..(64): n is either a, c, g or t
tgtatagttagtgattgttnnacggtnntagttnnangagaagnnatgtataattaatcgtttntagtgtattaatttttacgataggtagcgtgttattcggttagcgacgtatttgttgcgtttgtattagatttagcgtgtttagttttggaatggtgttcggcgttaattaggcggtaattcgcgttagttgcgttaagtttaagttcgatttaatggaagaattgattatcgtcgttagttttagcgcgtgcgtcgcgttgtatttggttcgcgtattttttttagattgttcgtgagcgtgggtttgataattatcgcgcgtacgttttttttagttataaaggtaaaattcggttcgcgtaggtttttattttaggtaatggtaatgtcggattttacggtaaagcgattcgcgaattatacgtcgggttttgtatcggtttttcgagaaacgcgatgcggtcgcgataaattcgggttaacgtatttggtaaattgcgtgatttgtttagcggtgtttaggcgcgaattttgcgttaagacgtaaatgtagagttcggtattgtttcgcgaggtaatagatttagttattatgtcgtcgcgtacgcgtttcgtataatgtttattgttgattttcgttattttttcgtttggtatatttgtaagtttgaggattagatcgttcggaatcgttatgatatagcggtgtcgta

SEQ ID NO: 6732 - DNA, 719 bp, Artificial Sequence
  chemically treated genomic DNA (Homo sapiens) CpG-island No: 6732
  misc_feature (656)..(656): n is either a, c, g or t
  misc_feature (675)..(676): n is either a, c, g or t
  misc_feature (683)..(683): n is either a, c, g or t
  misc_feature (685)..(686): n is either a, c, g or t
  misc_feature (692)..(693): n is either a, c, g or t
  misc_feature (699)..(700): n is either a, c, g or t
tacgacaccgctatatcataacgattccgaacgatctaatcctcaaacttacaaatataccaaacgaaaaaataacgaaaatcaacaataaacattatacgaaacgcgtacgcgacgacataataactaaatctattacctcgcgaaacaataccgaactctacatttacgtcttaacgcaaaattcgcgcctaaacaccgctaaacaaatcacgcaatttaccaaatacgttaacccgaatttatcgcgaccgcatcgcgtttctcgaaaaaccgatacaaaacccgacgtataattcgcgaatcgctttaccgtaaaatccgacattaccattacctaaaataaaaacctacgcgaaccgaattttacctttataactaaaaaaaacgtacgcgcgataattatcaaacccacgctcacgaacaatctaaaaaaaatacgcgaaccaaatacaacgcgacgcacgcgctaaaactaacgacgataatcaattcttccattaaatcgaacttaaacttaacgcaactaacgcgaattaccgcctaattaacgccgaacaccattccaaaactaaacacgctaaatctaatacaaacgcaacaaatacgtcgctaaccgaataacacgctacctatcgtaaaaattaatacactanaaacgattaattatacatnncttctcntnnaactannaccgtnnaacaatcactaactataca

SEQ ID NO: 6733 - DNA, 718 bp, Artificial Sequence
  chemically treated genomic DNA (Homo sapiens) CpG-island No: 6733
attcgacgttagttttttttggttcgggcgtgagacgcgtttttttcgtgtttgttttttcgtttttttgcgttggatgttgtatagcgtaggtttttttttttttcgtttttcgtttttaaaattttattattgagaattcgatagttgtttcgagatgttgattttagtttacggagttagcgtgcgcgtttttaatgttcggtatatttatttttatttcgggattttttttttttttgcgggttttggattttcgggaggaagtttcgggtttttcggtttttcggagatatcggttgaggcgtttaggttagtgtagagtcgtcgtattgggatttaggcgttttttataggtgtacgtagggtatggtttaacggtttttcggatgggcggggaaatagtttcgggcggagtaattcgattattttattatgtttttgcggatgtttagaaaagttacgaggttcgggggatcgttttagtagtggtttggaaaggagagggcgcggcgaggggcgtatttcgcgtttagggtttacgtcgtttaggtttcgtgtttgttttttcgttattttaatttcgtattcgggattgttggtggttttttttttttttcgtcgttttcgtcgggttgtttagtttttttagggttatagatgcgtttttttttttttagtttcgcgggatacggaggtgagagtattgagatgggga

SEQ ID NO: 6734 - DNA, 718 bp, Artificial Sequence
  chemically treated genomic DNA (Homo sapiens) CpG-island No: 6734
tccccatctcaatactctcacctccgtatcccgcgaaactaaaaaaaaaaaaacgcatctataaccctaaaaaaactaaacaacccgacgaaaacgacgaaaaaaaaaaaaaaccaccaacaatcccgaatacgaaattaaaataacgaaaaaacaaacacgaaacctaaacgacgtaaaccctaaacgcgaaatacgcccctcgccgcgccctctcctttccaaaccactactaaaacgatcccccgaacctcgtaacttttctaaacatccgcaaaaacataataaaataatcgaattactccgcccgaaactatttccccgcccatccgaaaaaccgttaaaccataccctacgtacacctataaaaaacgcctaaatcccaatacgacgactctacactaacctaaacgcctcaaccgatatctccgaaaaaccgaaaaacccgaaacttcctcccgaaaatccaaaacccgcaaaaaaaaaaaaaatcccgaaataaaaataaatataccgaacattaaaaacgcgcacgctaactccgtaaactaaaatcaacatctcgaaacaactatcgaattctcaataataaaattttaaaaacgaaaaacgaaaaaaaaaaaaacctacgctatacaacatccaacgcaaaaaaacgaaaaaacaaacacgaaaaaaacgcgtctcacgcccgaaccaaaaaaaactaacgtcgaat

SEQ ID NO: 6735 - DNA, 718 bp, Artificial Sequence
  chemically treated genomic DNA (Homo sapiens) CpG-island No: 6735
tttttattttagtgtttttattttcgtatttcgcggggttggggggaggagggcgtatttgtggttttaaagagattaggtagttcggcgagaacggcggaaagagaagggaattattagtagtttcgggtgcggagttagggtgacggggaggtaggtacggggtttgggcggcgtgggttttgggcgcgaggtgcgtttttcgtcgcgtttttttttttttagattattgttggggcggtttttcgggtttcgtggtttttttgggtattcgtaggggtataatggggtgatcgaattgtttcgttcggggttgttttttcgtttattcgaggggtcgttgggttatgttttacgtgtatttgtgaggggcgtttgggttttagtgcggcgattttgtattggtttaagcgttttagtcggtgttttcggggagtcggagggttcgaggttttttttcgggagtttagagttcgtaggaaaaaaaagggtttcgaaatggagatgagtgtgtcgggtattagggacgcgtacgttggtttcgtgaattgggattagtatttcggggtaattgtcgaatttttaatgataaggttttgggaacgagaggcggggagggaaggggtttgcgttatataatatttagcgtagagggacggaagagtagatacgagaagggcgcgttttacgttcgggttagaggaaattggcgtcgaat

SEQ ID NO: 6736 - DNA, 718 bp, Artificial Sequence
  chemically treated genomic DNA (Homo sapiens) CpG-island No: 6736
attcgacgccaatttcctctaacccgaacgtaaaacgcgcccttctcgtatctactcttccgtccctctacgctaaatattatataacgcaaaccccttccctccccgcctctcgttcccaaaaccttatcattaaaaattcgacaattaccccgaaatactaatcccaattcacgaaaccaacgtacgcgtccctaatacccgacacactcatctccatttcgaaacccttttttttcctacgaactctaaactcccgaaaaaaaacctcgaaccctccgactccccgaaaacaccgactaaaacgcttaaaccaatacaaaatcgccgcactaaaacccaaacgcccctcacaaatacacgtaaaacataacccaacgacccctcgaataaacgaaaaaacaaccccgaacgaaacaattcgatcaccccattatacccctacgaatacccaaaaaaaccacgaaacccgaaaaaccgccccaacaataatctaaaaaaaaaaaaacgcgacgaaaaacgcacctcgcgcccaaaacccacgccgcccaaaccccgtacctacctccccgtcaccctaactccgcacccgaaactactaataattcccttctctttccgccgttctcgccgaactacctaatctctttaaaaccacaaatacgccctcctccccccaaccccgcgaaatacgaaaataaaaacactaaaataaaaa

SEQ ID NO: 6737 - DNA, 621 bp, Artificial Sequence
  chemically treated genomic DNA (Homo sapiens) CpG-island No: 6737
ttgttagaatagcgattatttagaatagcgcgtgtagtttaagtttgtgagtgatgatcgggttaagtattatcgtaattggtaaaggtaatgttaaagtttacgtcgataaacgttatcgttttggtgcggtttcgttcgcgcgtgatatcggaaagtagcgttataacggcggcggtaattgttttagagttttgttagcgttcggtttagaataattttttagatggagtcggaaagcgtagcgataacgttatcggcggtaaatatcgttagtttatcgataattaatggtatgcgattaatgcggtcggaaagtacgttaaacggaatttgataaacggtttgagttcgattatataaattaagggtatattcgtttaatgtttttttgtttatgtaaggtttatgcgtatttggtcgtatcgttaattataaaatgttagtagcgtaagagaatacgtttaatttaggcggttttatttaagacgttataaatcgtttatattttgataattcgatagtaacggtagacggtatttttaatagaaattcgggagtttgttatagtttttattaataggttgtttatcgcgattagttattttttgagtaggaaat

SEQ ID NO: 6738 - DNA, 621 bp, Artificial Sequence
  chemically treated genomic DNA (Homo sapiens) CpG-island No: 6738
atttcctactcaaaaaataactaatcgcgataaacaacctattaataaaaactataacaaactcccgaatttctattaaaaataccgtctaccgttactatcgaattatcaaaatataaacgatttataacgtcttaaataaaaccgcctaaattaaacgtattctcttacgctactaacattttataattaacgatacgaccaaatacgcataaaccttacataaacaaaaaaacattaaacgaatatacccttaatttatataatcgaactcaaaccgtttatcaaattccgtttaacgtactttccgaccgcattaatcgcataccattaattatcgataaactaacgatatttaccgccgataacgttatcgctacgctttccgactccatctaaaaaattattctaaaccgaacgctaacaaaactctaaaacaattaccgccgccgttataacgctactttccgatatcacgcgcgaacgaaaccgcaccaaaacgataacgtttatcgacgtaaactttaacattacctttaccaattacgataatacttaacccgatcatcactcacaaacttaaactacacgcgctattctaaataatcgctattctaacaa

SEQ ID NO: 6739 - DNA, 621 bp, Artificial Sequence
  chemically treated genomic DNA (Homo sapiens) CpG-island No: 6739
gttttttgtttaaggagtggttgatcgcggtggatagtttgttagtgggggttgtagtagattttcggatttttattgaggatgtcgtttgtcgttgttatcggattgttagggtgtaggcggtttatggcgttttgaatggggtcgtttgggttaggcgtatttttttgcgttgttggtattttatggttggcggtgcggttaagtgcgtatgggttttgtatgggtagggaagtattgagcgggtatgtttttggtttgtatggtcggatttaggtcgtttgttagatttcgtttggcgtgtttttcgatcgtattggtcgtatattattagttgtcggtgggttggcggtgtttgtcgtcggtagcgttatcgttgcgtttttcgattttatttggggaattattttgggtcgggcgttagtaaggttttggagtaattgtcgtcgtcgttatggcgttgtttttcgatgttacgcgcgaacgaaatcgtattaaagcgatggcgtttatcggcgtgagttttggtattatttttgttagttgcgatggtgtttggttcgattattatttataaatttgggttgtacgcgttgttttggatgatcgttattttggtaa

SEQ ID NO: 6740 - DNA, 621 bp, Artificial Sequence
  chemically treated genomic DNA (Homo sapiens) CpG-island No: 6740
ttaccaaaataacgatcatccaaaacaacgcgtacaacccaaatttataaataataatcgaaccaaacaccatcgcaactaacaaaaataataccaaaactcacgccgataaacgccatcgctttaatacgatttcgttcgcgcgtaacatcgaaaaacaacgccataacgacgacgacaattactccaaaaccttactaacgcccgacccaaaataattccccaaataaaatcgaaaaacgcaacgataacgctaccgacgacaaacaccgccaacccaccgacaactaataatatacgaccaatacgatcgaaaaacacgccaaacgaaatctaacaaacgacctaaatccgaccatacaaaccaaaaacatacccgctcaatacttccctacccatacaaaacccatacgcacttaaccgcaccgccaaccataaaataccaacaacgcaaaaaaatacgcctaacccaaacgaccccattcaaaacgccataaaccgcctacaccctaacaatccgataacaacgacaaacgacatcctcaataaaaatccgaaaatctactacaacccccactaacaaactatccaccgcgatcaaccactccttaaacaaaaaac

SEQ ID NO: 6741 - DNA, 740 bp, Artificial Sequence
  chemically treated genomic DNA (Homo sapiens) CpG-island No: 6741
gtcgagtcgtcgattattttcgttataaacggcgttagttgtatggcgggcgtaagttgaataatggcgtaattaatgacgtcgagaatataatcgtcggttaggtgtgcgtcgaaagtgagcgtagtaatgcgcgtagtgataacggttaacgggtaattatttattcgtatcggtgaagtggttttttttatttttttattggtcggtaatataacgcgcgtttcgtttgagaagtcgaaagggtagttattaatattcgcgagtcgtcgatatattattttattcgatgacgattcgttttttagattaggatagcgttttcgatttatagtttacggttttcgtatatacgtttataatacgattatcgcgggtcgatttcggagttttattttagtaggttatttcgtaattaataagcggcgtaaagtcgggggaagtttatagcgcgcgtttattttcgcgttagttatttttttacgttttatttacgttacgatcgattattatatttattcgattattcggacgtcgacgacgtttcgattattttatttattattatttttaatttttttgtatttcgtttttttattttttcgttttttttttttttattttttatttttttttttttattatttgttacgttattcgattattatatttatatatatttttttatattatttttcgtaattcgtttttttttatttatttttttattattattttat

SEQ ID NO: 6742 - DNA, 740 bp, Artificial Sequence
  chemically treated genomic DNA (Homo sapiens) CpG-island No: 6742
ataaaataataataaaaaaataaataaaaaaaaacgaattacgaaaaataatataaaaaaatatatataaatataataatcgaataacgtaacaaataataaaaaaaaaaaaataaaaaataaaaaaaaaaaaaacgaaaaaataaaaaaacgaaatacaaaaaaattaaaaataataataaataaaataatcgaaacgtcgtcgacgtccgaataatcgaataaatataataatcgatcgtaacgtaaataaaacgtaaaaaaataactaacgcgaaaataaacgcgcgctataaacttcccccgactttacgccgcttattaattacgaaataacctactaaaataaaactccgaaatcgacccgcgataatcgtattataaacgtatatacgaaaaccgtaaactataaatcgaaaacgctatcctaatctaaaaaacgaatcgtcatcgaataaaataatatatcgacgactcgcgaatattaataactaccctttcgacttctcaaacgaaacgcgcgttatattaccgaccaataaaaaaataaaaaaaaccacttcaccgatacgaataaataattacccgttaaccgttatcactacgcgcattactacgctcactttcgacgcacacctaaccgacgattatattctcgacgtcattaattacgccattattcaacttacgcccgccatacaactaacgccgtttataacgaaaataatcgacgactcgac

SEQ ID NO: 6743 - DNA, 740 bp, Artificial Sequence
  chemically treated genomic DNA (Homo sapiens) CpG-island No: 6743
gtagggtggtgatgagggggtaggtggggggaggcgggttgcggggagtggtgtgaagggatgtgtgtgggtgtggtagtcgggtggcgtagtaggtggtggggagaggggggtgggagatgggggggggaggagcggggaggtgaggaggcgggatgtaggggagttagaggtagtggtgggtgaggtggtcggggcgtcgtcggcgttcgggtggtcgagtgggtgtggtggtcggtcgtggcgtgggtggggcgtgggggagtggttggcgcggggatgagcgcgcgttgtgagtttttttcggttttacgtcgtttgttggttgcgagatggtttgttagaatggaatttcggggtcggttcgcggtgatcgtgttgtgggcgtgtgtgcgggggtcgtgggttgtaggtcgaagacgttgttttagtttgaggaacgggtcgttatcgggtggagtgatgtgtcggcggttcgcggatgttggtggttgttttttcggttttttaggcgagacgcgcgttgtattgtcggttaatgaaggggtagggagaattattttatcggtgcgaatggatgattgttcgttaatcgttgttattgcgcgtattgttgcgtttattttcggcgtatatttgatcgacggttatgttttcggcgttattggttacgttattatttagtttacgttcgttatgtaattgacgtcgtttatggcgggaatgatcggcggttcggt

SEQ ID NO: 6744 - DNA, 740 bp, Artificial Sequence
  chemically treated genomic DNA (Homo sapiens) CpG-island No: 6744
accgaaccgccgatcattcccgccataaacgacgtcaattacataacgaacgtaaactaaataataacgtaaccaataacgccgaaaacataaccgtcgatcaaatatacgccgaaaataaacgcaacaatacgcgcaataacaacgattaacgaacaatcatccattcgcaccgataaaataattctccctaccccttcattaaccgacaatacaacgcgcgtctcgcctaaaaaaccgaaaaaacaaccaccaacatccgcgaaccgccgacacatcactccacccgataacgacccgttcctcaaactaaaacaacgtcttcgacctacaacccacgacccccgcacacacgcccacaacacgatcaccgcgaaccgaccccgaaattccattctaacaaaccatctcgcaaccaacaaacgacgtaaaaccgaaaaaaactcacaacgcgcgctcatccccgcgccaaccactcccccacgccccacccacgccacgaccgaccaccacacccactcgaccacccgaacgccgacgacgccccgaccacctcacccaccactacctctaactcccctacatcccgcctcctcacctccccgctcctcccccccccatctcccacccccctctccccaccacctactacgccacccgactaccacacccacacacatcccttcacaccactccccgcaacccgcctccccccacctaccccctcatcaccaccctac

SEQ ID NO: 6745 - DNA, 607 bp, Artificial Sequence
  chemically treated genomic DNA (Homo sapiens) CpG-island No: 6745
agtgggtcgtttcgcgttttttataaacggtagatgatcgtaggcgtgattgcgcgttgagcgaataaacgttttcgtaattggttgacgttgttcgttatcgcgtacggcggcgtatagtcggttttataagttttcgtttagggttttggttattattagattttggcgtttaaaattttttattatttaatgcggtagcgcggtaatatttattcgcgcggtaattatttgaattaataataaggtgttatcgacgttttttagtgacgggttgacgtttgtcggttgaagaaaatgtcgttagatatttagtcgattacgttgtatcggataaattaatagcgtttcgttggcgagatttttcggtgtaattcgcgttttcgtcgttagtggatggttaggtgttaatattagacgtattttatagtcgaatatcggcgaataatgtaggttattgcgcggtagaatatcggacgttattattagatttagttttttttgttgtaaggcgggttgcgggttaaatgttacgttcgatttaaaatttatttttatttgcggttagtttttatggaaattttttaacgcgggtgttagttaattg

SEQ ID NO: 6746 - DNA, 607 bp, Artificial Sequence
  chemically treated genomic DNA (Homo sapiens) CpG-island No: 6746
caattaactaacacccgcgttaaaaaatttccataaaaactaaccgcaaataaaaataaattttaaatcgaacgtaacatttaacccgcaacccgccttacaacaaaaaaaactaaatctaataataacgtccgatattctaccgcgcaataacctacattattcgccgatattcgactataaaatacgtctaatattaacacctaaccatccactaacgacgaaaacgcgaattacaccgaaaaatctcgccaacgaaacgctattaatttatccgatacaacgtaatcgactaaatatctaacgacattttcttcaaccgacaaacgtcaacccgtcactaaaaaacgtcgataacaccttattattaattcaaataattaccgcgcgaataaatattaccgcgctaccgcattaaataataaaaaattttaaacgccaaaatctaataataaccaaaaccctaaacgaaaacttataaaaccgactatacgccgccgtacgcgataacgaacaacgtcaaccaattacgaaaacgtttattcgctcaacgcgcaatcacgcctacgatcatctaccgtttataaaaaacgcgaaacgacccact

SEQ ID NO: 6747 - DNA, 607 bp, Artificial Sequence
  chemically treated genomic DNA (Homo sapiens) CpG-island No: 6747
tagttggttgatattcgcgttagaaaatttttataagaattggtcgtaggtagagatggattttaaatcgggcgtgatatttgattcgtagttcgttttgtaatagggagagttggatttggtaatgacgttcgatattttgtcgcgtagtggtttgtattattcgtcgatgttcgattatgaagtgcgtttggtgttagtatttgattatttattggcggcgaaaacgcgaattatatcggaagatttcgttagcgagacgttattaatttattcggtgtagcgtagtcgattggatgtttggcggtattttttttagtcggtaggcgttagttcgttattgaaaagcgtcgataatattttattgttgatttagatggttgtcgcgcggatgggtattgtcgcgttatcgtattgggtagtagagagttttgagcgttagggtttggtggtgattaaaattttgggcgaaggtttgtggagtcgattgtacgtcgtcgtgcgcgatggcgagtagcgttagttagttacggaagcgtttattcgtttagcgcgtaattacgtttgcgattatttgtcgtttgtgaagagcgcggagcgatttatt

SEQ ID NO: 6748 - DNA, 607 bp, Artificial Sequence
  chemically treated genomic DNA (Homo sapiens) CpG-island No: 6748
aataaatcgctccgcgctcttcacaaacgacaaataatcgcaaacgtaattacgcgctaaacgaataaacgcttccgtaactaactaacgctactcgccatcgcgcacgacgacgtacaatcgactccacaaaccttcgcccaaaattttaatcaccaccaaaccctaacgctcaaaactctctactacccaatacgataacgcgacaatacccatccgcgcgacaaccatctaaatcaacaataaaatattatcgacgcttttcaataacgaactaacgcctaccgactaaaaaaaataccgccaaacatccaatcgactacgctacaccgaataaattaataacgtctcgctaacgaaatcttccgatataattcgcgttttcgccgccaataaataatcaaatactaacaccaaacgcacttcataatcgaacatcgacgaataatacaaaccactacgcgacaaaatatcgaacgtcattaccaaatccaactctccctattacaaaacgaactacgaatcaaatatcacgcccgatttaaaatccatctctacctacgaccaattcttataaaaattttctaacgcgaatatcaaccaacta

SEQ ID NO: 6749 - DNA, 593 bp, Artificial Sequence
  chemically treated genomic DNA (Homo sapiens) CpG-island No: 6749
ggatgggggcgttcgagaggggcgaagaaaggggggggtagcggggtagcgagagggagcgggcggcggtcggtggaggagagagggatcggaggcgtagaaggggttcggataggaggttgggggggggagaggcgtacgttaggagaggaggtggagaaggcgcgagggggaagaggggggggaggggtagggggggggaggaggggagagaggcgaggagaggcggtaggcgacggagggaagcgaggggacgagcggcgagggtcgttaggagggggcgagatcggggaggggagggggcggaggggggggggcggcggatacgaagggggggtgtggggagggagggggggtcgggagcggaggggggggcgggaggggggcgcgcgggggtggtaggagttgggggcgcggggagaaaggaagaaggggttagagggataacgagcgcgtaggaagggagagggggggaaggggagagagggggtaggggtgcgtaggcggggtagggagggagggaggggagggagggagaggggggcgtgggggttgggtgcggggtaggggggggggagaggggggagttagtg

SEQ ID NO: 6750 - DNA, 593 bp, Artificial Sequence
  chemically treated genomic DNA (Homo sapiens) CpG-island No: 6750
cactaactcccccctctcccccccccctaccccgcacccaacccccacgcccccctctccctccctcccctccctccctccctaccccgcctacgcacccctaccccctctctccccttccccccctctcccttcctacgcgctcgttatccctctaaccccttcttcctttctccccgcgcccccaactcctaccacccccgcgcgcccccctcccgcccccccctccgctcccgaccccccctccctccccacacccccccttcgtatccgccgcccccccccctccgccccctcccctccccgatctcgccccctcctaacgaccctcgccgctcgtcccctcgcttccctccgtcgcctaccgcctctcctcgcctctctcccctcctccccccccctacccctcccccccctcttccccctcgcgccttctccacctcctctcctaacgtacgcctctcccccccccaacctcctatccgaaccccttctacgcctccgatccctctctcctccaccgaccgccgcccgctccctctcgctaccccgctacccccccctttcttcgcccctctcgaacgcccccatcc

SEQ ID NO: 6751 - DNA, 593 bp, Artificial Sequence
  chemically treated genomic DNA (Homo sapiens) CpG-island No: 6751
tattggttttttttttttttttttttttgtttcgtatttaatttttacgttttttttttttttttttttttttttttttttttgtttcgtttgcgtatttttattttttttttttttttttttttttttttttttttgcgcgttcgttatttttttggtttttttttttttttttttcgcgtttttagtttttgttattttcgcgcgtttttttttcgttttttttttcgttttcgattttttttttttttttatatttttttttcgtgttcgtcgttttttttttttcgttttttttttttttcggtttcgtttttttttggcgattttcgtcgttcgttttttcgttttttttcgtcgtttgtcgttttttttcgtttttttttttttttttttttttttgtttttttttttttttttttttttcgcgttttttttatttttttttttagcgtgcgttttttttttttttagttttttgttcgagttttttttacgttttcgattttttttttttttatcggtcgtcgttcgttttttttcgttgtttcgttgttttttttttttttcgtttttttcgggcgtttttattt

SEQ ID NO: 6752 - DNA, 593 bp, Artificial Sequence
  chemically treated genomic DNA (Homo sapiens) CpG-island No: 6752
aaataaaaacgcccgaaaaaaacgaaaaaaaaaaaaaacaacgaaacaacgaaaaaaaacgaacgacgaccgataaaaaaaaaaaaaatcgaaaacgtaaaaaaaactcgaacaaaaaactaaaaaaaaaaaaaacgcacgctaaaaaaaaaaataaaaaaaacgcgaaaaaaaaaaaaaaaaaaaaaaacaaaaaaaaaaaaaaaaaaaaaaaaacgaaaaaaaacgacaaacgacgaaaaaaaacgaaaaaacgaacgacgaaaatcgccaaaaaaaaacgaaaccgaaaaaaaaaaaaaacgaaaaaaaaaaaacgacgaacacgaaaaaaaaatataaaaaaaaaaaaaaaatcgaaaacgaaaaaaaaaacgaaaaaaaaacgcgcgaaaataacaaaaactaaaaacgcgaaaaaaaaaaaaaaaaaaaccaaaaaaataacgaacgcgcaaaaaaaaaaaaaaaaaaaaaaaaaaaaaaaaaataaaaatacgcaaacgaaacaaaaaaaaaaaaaaaaaaaaaaaaaaaaaaaaaacgtaaaaattaaatacgaaacaaaaaaaaaaaaaaaaaaaaaaccaata

SEQ ID NO: 6753 - DNA, 639 bp, Artificial Sequence
  chemically treated genomic DNA (Homo sapiens) CpG-island No: 6753
cgcgttgttattaatggtgaataggttacgcgttatatttatcgttagtttcgggtagtcgttaaatatgcgtgggttattaaggaacgtcggtagtttttggtatatacgtatatcgcgtagcggattattttttttatgttgacgatttttcgtcgttttttgtttttcgaaatcgtcgttttttttttttgaacgtttcgtttcgttgggtttttcggcgcgtttttcgtttttatcggagcggaatcgggtttttatttcgggttcggtattatttcggttatttttcgggttgtggcgttttcgatcgcgatttttttgggtcgtatcgttgcgcgtttgttatatatcgcgttcggagtatattcgtgtgtttacgttcgtggttatttcgtattgttcgtgtgtttgtatgtttcgtcgtgcgtcgcggcgtcgtttgttttttattttcgtaattatagtcgcgcgtcgaattagcggaattagttatatcgttatatatatacgtacgtcgtattcgttttttattcgttatatttacgttttcgtttagtatcgcgtttcgagcgtattattttcgcgttttttttcgtttcgttacgattcgtacgcggttcgtatcgttaagtcgtt

SEQ ID NO: 6754 - DNA, 639 bp, Artificial Sequence
  chemically treated genomic DNA (Homo sapiens) CpG-island No: 6754
aacgacttaacgatacgaaccgcgtacgaatcgtaacgaaacgaaaaaaaacgcgaaaataatacgctcgaaacgcgatactaaacgaaaacgtaaatataacgaataaaaaacgaatacgacgtacgtatatatataacgatataactaattccgctaattcgacgcgcgactataattacgaaaataaaaaacaaacgacgccgcgacgcacgacgaaacatacaaacacacgaacaatacgaaataaccacgaacgtaaacacacgaatatactccgaacgcgatatataacaaacgcgcaacgatacgacccaaaaaaatcgcgatcgaaaacgccacaacccgaaaaataaccgaaataataccgaacccgaaataaaaacccgattccgctccgataaaaacgaaaaacgcgccgaaaaacccaacgaaacgaaacgttcaaaaaaaaaaaacgacgatttcgaaaaacaaaaaacgacgaaaaatcgtcaacataaaaaaaataatccgctacgcgatatacgtatataccaaaaactaccgacgttccttaataacccacgcatatttaacgactacccgaaactaacgataaatataacgcgtaacctattcaccattaataacaacgcg

SEQ ID NO: 6755 - DNA, 639 bp, Artificial Sequence
  chemically treated genomic DNA (Homo sapiens) CpG-island No: 6755
ggcgatttggcggtgcgggtcgcgtgcgggtcgtggcggggcgggggggggcgcgggggtggtgcgttcggggcgcggtgttgggcggaggcgtgggtgtggcgggtggggggcgggtacggcgtgcgtgtgtgtgtggcggtgtggttagtttcgttggttcggcgcgcggttgtggttgcgggggtgggggataggcggcgtcgcggcgtacggcggggtatataggtatacggataatgcggggtaattacgggcgtaaatatacgggtgtatttcggacgcgatgtgtagtaggcgcgtagcggtgcggtttagggggatcgcggtcgaagacgttatagttcggggggtggtcgggatagtgtcgggttcgggatggaagttcggtttcgtttcggtgaggacgggaggcgcgtcgggaagtttagcgagacggggcgtttagggagggagagcgacgatttcggagagtagagggcggcggaagatcgttagtatggggagagtggttcgttgcgcgatatgcgtatgtattagaaattatcggcgttttttgataatttacgtatgtttagcggttattcggagttggcggtgggtgtggcgcgtgatttgtttattattgatggtagcgcg

SEQ ID NO: 6756 - DNA, 639 bp, Artificial Sequence
  chemically treated genomic DNA (Homo sapiens) CpG-island No: 6756
cgcgctaccatcaataataaacaaatcacgcgccacacccaccgccaactccgaataaccgctaaacatacgtaaattatcaaaaaacgccgataatttctaatacatacgcatatcgcgcaacgaaccactctccccatactaacgatcttccgccgccctctactctccgaaatcgtcgctctccctccctaaacgccccgtctcgctaaacttcccgacgcgcctcccgtcctcaccgaaacgaaaccgaacttccatcccgaacccgacactatcccgaccaccccccgaactataacgtcttcgaccgcgatccccctaaaccgcaccgctacgcgcctactacacatcgcgtccgaaatacacccgtatatttacgcccgtaattaccccgcattatccgtatacctatataccccgccgtacgccgcgacgccgcctatcccccacccccgcaaccacaaccgcgcgccgaaccaacgaaactaaccacaccgccacacacacacgcacgccgtacccgccccccacccgccacacccacgcctccgcccaacaccgcgccccgaacgcaccacccccgcgcccccccccgccccgccacgacccgcacgcgacccgcaccgccaaatcgcc

SEQ ID NO: 6757 - DNA, 753 bp, Artificial Sequence
  chemically treated genomic DNA (Homo sapiens) CpG-island No: 6757
gatttcggtttgtaattttatttgtatatcgttgttttacgtcgataggttgtcgatattcgggtagagttggaattacggattgttgagatagtgcgcgtattttagcgttttgttgatggagtttattaacggataatttatgatttttatcgttagcgttatttgcgcgcggtttgttattttaacgttttttttttggtcgttacggttacgacgacgcgtttcgttattggttttttgattgttttcgttttagttcgttagttggattacgcgattatcggtattttgggcgagttggtttgttttcgtttgagttttttgttttgcgttcgttcgggtttttttttggttattggtacgacgttgttttaggtttttgtcggttgttcgtcggtttttacgcgtggtacgtcgattgtcgttcgttcgtttaaggtatttcgttttttcgttgtacgattagttgcgcggttattttcggggttcgtcggttgtttttttcgcggtttttcgcgttttattgtgttttttggttttttttgtgttttttttttttcgtttttcgtcgttttttcgttttcgtttttgttttttcgttttttcgtttttttttgttcgtggtgcgcgtttgttcgttcgttcgttttcgtttttgttgtttcgtttttttggcggtgttttcgtcgttcgtttttttgcgtgtttttattcgttttcgtcgtttttttcggttcgtcgtcgcgtttt

SEQ ID NO: 6758 - DNA, 753 bp, Artificial Sequence
  chemically treated genomic DNA (Homo sapiens) CpG-island No: 6758
aaaacgcgacgacgaaccgaaaaaaacgacgaaaacgaataaaaacacgcaaaaaaacgaacgacgaaaacaccgccaaaaaaacgaaacaacaaaaacgaaaacgaacgaacgaacaaacgcgcaccacgaacaaaaaaaaacgaaaaaacgaaaaaacaaaaacgaaaacgaaaaaacgacgaaaaacgaaaaaaaaaaaacacaaaaaaaaccaaaaaacacaataaaacgcgaaaaaccgcgaaaaaaacaaccgacgaaccccgaaaataaccgcgcaactaatcgtacaacgaaaaaacgaaataccttaaacgaacgaacgacaatcgacgtaccacgcgtaaaaaccgacgaacaaccgacaaaaacctaaaacaacgtcgtaccaataaccaaaaaaaaacccgaacgaacgcaaaacaaaaaactcaaacgaaaacaaaccaactcgcccaaaataccgataatcgcgtaatccaactaacgaactaaaacgaaaacaatcaaaaaaccaataacgaaacgcgtcgtcgtaaccgtaacgaccaaaaaaaaaacgttaaaataacaaaccgcgcgcaaataacgctaacgataaaaatcataaattatccgttaataaactccatcaacaaaacgctaaaatacgcgcactatctcaacaatccgtaattccaactctacccgaatatcgacaacctatcgacgtaaaacaacgatatacaaataaaattacaaaccgaaatc

SEQ ID NO: 6759 - DNA, 753 bp, Artificial Sequence
  chemically treated genomic DNA (Homo sapiens) CpG-island No: 6759
ggggcgcgacggcgggtcggaggagacggcgagggcgagtggagatacgtaggggggcgggcggcgagagtatcgttagagaggcgagatagtagaggcgaagacgagcgagcggataggcgcgtattacgagtaaggggaggcgggagggcgggggggtaaggacggaagcggggagacggcggggaacgaggggaggaaaatataagggagattagggaatataatgaggcgcgaagaatcgcggaggaggtaatcgacgagtttcgggggtgatcgcgtaattagtcgtgtagcggaaggacgaggtgttttgggcgaacggacgatagtcggcgtgttacgcgtgggaatcggcgggtaatcggtaagggtttaggataacgtcgtattaatggttagggggggattcgggcggacgtaaggtagaggatttaggcgaaaataaattagttcgtttaggatgtcggtaatcgcgtgatttagttggcgggttaggacggggatagttaggaagttaataacgagacgcgtcgtcgtggtcgtgacggttagaaagagagcgttgagatggtaagtcgcgcgtaggtgacgttggcgatggagattatggattattcgttgatgagttttattagtaaggcgttgggatacgcgtattattttaataattcgtggttttagttttattcggatatcggtaatttgtcggcgtgggataacgatgtgtagatggagttgtaggtcggaatt

SEQ ID NO: 6760 - DNA, 753 bp, Artificial Sequence
  chemically treated genomic DNA (Homo sapiens) CpG-island No: 6760
aattccgacctacaactccatctacacatcgttatcccacgccgacaaattaccgatatccgaataaaactaaaaccacgaattattaaaataatacgcgtatcccaacgccttactaataaaactcatcaacgaataatccataatctccatcgccaacgtcacctacgcgcgacttaccatctcaacgctctctttctaaccgtcacgaccacgacgacgcgtctcgttattaacttcctaactatccccgtcctaacccgccaactaaatcacgcgattaccgacatcctaaacgaactaatttattttcgcctaaatcctctaccttacgtccgcccgaatccccccctaaccattaatacgacgttatcctaaacccttaccgattacccgccgattcccacgcgtaacacgccgactatcgtccgttcgcccaaaacacctcgtccttccgctacacgactaattacgcgatcacccccgaaactcgtcgattacctcctccgcgattcttcgcgcctcattatattccctaatctcccttatattttcctcccctcgttccccgccgtctccccgcttccgtccttacccccccgccctcccgcctccccttactcgtaatacgcgcctatccgctcgctcgtcttcgcctctactatctcgcctctctaacgatactctcgccgcccgcccccctacgtatctccactcgccctcgccgtctcctccgacccgccgtcgcgcccc

SEQ ID NO: 6761 - DNA, 874 bp, Artificial Sequence
  chemically treated genomic DNA (Homo sapiens) CpG-island No: 6761
gagatttattttttatgcggatagtcgtttgacgttttttgttcgggagttgttggaaagtcgcgtatttgcgtattaagtttattgacgagtagggtcgtttgtttgttgacgatgaatagtagtagtcgtagttcgtttatgggttgattagtagcgatgaatattcgtaggcgtgttgcgaattgtgtcgttagtcggtggtaaaaaagtcggatacgttgatttatttgtcggcggaaaaaatggtcgttaaaagcgattcgcgtttgggttttcgcgcggttttcgatagtattattgcgttggtagtgtggttgtaaattgaattggcggaatcgtggtagtcgtggttggcggatattcgttcgcgttttggtaatattatgcgcgtcgatgcgttgggggaatcgttgggttgttaggcgattgtcgggttttttgacgaagatttgtatcggtttttttattagtcgttgcgttatttcgattacgattatttggtgtcggaagttagttacgggcgcgatgttgcgttgtttaatttgttacgtattaaagtgcgggaaatcgaaatcgtagcggcgtaggtttttattattcgtagttttgaagtattacgttcggatatttgtaggcgttgaatcggttttcgagtacggtttacgtgatgatgattttgagcgtaacgaagtagcgttaacggtgagtagatttagacgattgggggatcgtatgatttggacgtcgcgtgtttgggttggaggtcgtcgagggttatcggaggtaattacgtggcgaacggatatatttatagggggatttttgggtttacgagaattggatggttatagggagaggtaggtatcgggtt

SEQ ID NO: 6762 - DNA, 874 bp, Artificial Sequence
  chemically treated genomic DNA (Homo sapiens) CpG-island No: 6762
aacccgatacctacctctccctataaccatccaattctcgtaaacccaaaaatccccctataaatatatccgttcgccacgtaattacctccgataaccctcgacgacctccaacccaaacacgcgacgtccaaatcatacgatcccccaatcgtctaaatctactcaccgttaacgctacttcgttacgctcaaaatcatcatcacgtaaaccgtactcgaaaaccgattcaacgcctacaaatatccgaacgtaatacttcaaaactacgaataataaaaacctacgccgctacgatttcgatttcccgcactttaatacgtaacaaattaaacaacgcaacatcgcgcccgtaactaacttccgacaccaaataatcgtaatcgaaataacgcaacgactaataaaaaaaccgatacaaatcttcgtcaaaaaacccgacaatcgcctaacaacccaacgattcccccaacgcatcgacgcgcataatattaccaaaacgcgaacgaatatccgccaaccacgactaccacgattccgccaattcaatttacaaccacactaccaacgcaataatactatcgaaaaccgcgcgaaaacccaaacgcgaatcgcttttaacgaccattttttccgccgacaaataaatcaacgtatccgacttttttaccaccgactaacgacacaattcgcaacacgcctacgaatattcatcgctactaatcaacccataaacgaactacgactactactattcatcgtcaacaaacaaacgaccctactcgtcaataaacttaatacgcaaatacgcgactttccaacaactcccgaacaaaaaacgtcaaacgactatccgcataaaaaataaatctc

SEQ ID NO: 6763 - DNA, 874 bp, Artificial Sequence
  chemically treated genomic DNA (Homo sapiens) CpG-island No: 6763
ggttcgatatttgtttttttttgtggttatttagttttcgtgggtttaagggtttttttgtgagtatgttcgttcgttacgtggttattttcggtaattttcggcggtttttaatttaggtacgcgacgtttaaattatgcggttttttagtcgtttggatttgtttatcgttagcgttgtttcgttacgtttaggattattattacgtagatcgtgttcgaaagtcggtttagcgtttgtaaatgttcgggcgtaatattttaaagttgcgggtgataaagatttgcgtcgttacggtttcggtttttcgtattttggtgcgtagtagattgagtaacgtagtatcgcgttcgtggttggttttcggtattagatgatcgtggtcgagatagcgtagcggttgatgagaaagtcgatgtagattttcgttagaaagttcgataatcgtttggtagtttagcggtttttttagcgtatcggcgcgtataatgttgttaagacgcgaacggatattcgttagttacggttgttacggtttcgttagtttaatttgtagttatattgttagcgtaatggtgttgtcgagaatcgcgcgaaaatttagacgcggatcgtttttggcgattatttttttcgtcgataggtgagttagcgtattcggtttttttgttatcggttggcgatatagttcgtagtacgtttgcggatgtttatcgttattggttagtttatgaacgggttgcggttgttgttgtttatcgttaataaataggcggttttgttcgttaataaatttgatgcgtagatgcgcggttttttagtaattttcgggtagagggcgttaggcgattgttcgtatgggagatggatttt

SEQ ID NO: 6764 - DNA, 874 bp, Artificial Sequence
  chemically treated genomic DNA (Homo sapiens) CpG-island No: 6764
aaaatccatctcccatacgaacaatcgcctaacgccctctacccgaaaattactaaaaaaccgcgcatctacgcatcaaatttattaacgaacaaaaccgcctatttattaacgataaacaacaacaaccgcaacccgttcataaactaaccaataacgataaacatccgcaaacgtactacgaactatatcgccaaccgataacaaaaaaaccgaatacgctaactcacctatcgacgaaaaaaataatcgccaaaaacgatccgcgtctaaattttcgcgcgattctcgacaacaccattacgctaacaatataactacaaattaaactaacgaaaccgtaacaaccgtaactaacgaatatccgttcgcgtcttaacaacattatacgcgccgatacgctaaaaaaaccgctaaactaccaaacgattatcgaactttctaacgaaaatctacatcgactttctcatcaaccgctacgctatctcgaccacgatcatctaataccgaaaaccaaccacgaacgcgatactacgttactcaatctactacgcaccaaaatacgaaaaaccgaaaccgtaacgacgcaaatctttatcacccgcaactttaaaatattacgcccgaacatttacaaacgctaaaccgactttcgaacacgatctacgtaataataatcctaaacgtaacgaaacaacgctaacgataaacaaatccaaacgactaaaaaaccgcataatttaaacgtcgcgtacctaaattaaaaaccgccgaaaattaccgaaaataaccacgtaacgaacgaacatactcacaaaaaaacccttaaacccacgaaaactaaataaccacaaaaaaaaacaaatatcgaacc

SEQ ID NO: 6765 - DNA, 857 bp, Artificial Sequence
  chemically treated genomic DNA (Homo sapiens) CpG-island No: 6765
gtaatcggcgtatttaataagttataattagtttgaatataattaggttgttgtagtaattcgcgtattttttcgtcgttgagttggcgcgtttaggcgaaattcgtaaggttaatcgcgtcgcgttttagatgaatagataacgtatcggtatcgttttgcgttcgtgtaagagacgttagttattgtagatatttcggtttacgtttatcgcgacgcggcgggttaagtattacgacgcgcgtttcggttagcgtgttgcgggtagagatatcgcgtaatattaggcggtcgttatttgttagttataacggggtgtcgaagattagtttagtaaggttattttttagtagtgaaacgcgtttcgtgacgtggttggcggcgtggtgaatatgtagcggttgttattgggttagcggtgtatgggtttgaagttcgataattattcgtgtgaacggttttggcggtatatcggtaagtagttagtcgttacggttaatttgtttttttttcgtattattcgcgatgttaagcgcgatacgttgttcggtattggcgggttttgttggttggttttgcgtatgtagcgtacgtttacgtatcggtttatttatattagttagttagagtgaatcgtttaattttattttttcgtttaaagtcgattcggtgacgatagtcgggattttttacggtaatgcgcggtaaacgcgagcggaatttgttggtgggtgtcgcgttcgggattgataatgtcgttagggttatttcgatacggggtcgggaaaaaatgttgcgatacgatatcgaatattttagggggatattaattatgtagagatggaagagatagtaaa

SEQ ID NO: 6766 - DNA, 857 bp, Artificial Sequence
  chemically treated genomic DNA (Homo sapiens) CpG-island No: 6766
tttactatctcttccatctctacataattaatatccccctaaaatattcgatatcgtatcgcaacattttttcccgaccccgtatcgaaataaccctaacgacattatcaatcccgaacgcgacacccaccaacaaattccgctcgcgtttaccgcgcattaccgtaaaaaatcccgactatcgtcaccgaatcgactttaaacgaaaaaataaaattaaacgattcactctaactaactaatataaataaaccgatacgtaaacgtacgctacatacgcaaaaccaaccaacaaaacccgccaataccgaacaacgtatcgcgcttaacatcgcgaataatacgaaaaaaaaacaaattaaccgtaacgactaactacttaccgatataccgccaaaaccgttcacacgaataattatcgaacttcaaacccatacaccgctaacccaataacaaccgctacatattcaccacgccgccaaccacgtcacgaaacgcgtttcactactaaaaaataaccttactaaactaatcttcgacaccccgttataactaacaaataacgaccgcctaatattacgcgatatctctacccgcaacacgctaaccgaaacgcgcgtcgtaatacttaacccgccgcgtcgcgataaacgtaaaccgaaatatctacaataactaacgtctcttacacgaacgcaaaacgataccgatacgttatctattcatctaaaacgcgacgcgattaaccttacgaatttcgcctaaacgcgccaactcaacgacgaaaaaatacgcgaattactacaacaacctaattatattcaaactaattataacttattaaatacgccgattac

SEQ ID NO: 6767 - DNA, 857 bp, Artificial Sequence
  chemically treated genomic DNA (Homo sapiens) CpG-island No: 6767
tttattgttttttttatttttgtatagttgatatttttttaagatgttcggtatcgtgtcgtagtattttttttcgatttcgtgtcgggatgattttggcgatattgttagtttcggacgcgatatttattaataagtttcgttcgcgtttgtcgcgtattatcgtaaaaggtttcggttgtcgttatcggatcggttttaagcggggaagtgaagttaggcgatttattttggttgattggtgtaaataaatcgatgcgtgaacgtgcgttgtatgcgtaaaattagttaatagaattcgttaatgtcgggtagcgtatcgcgtttaatatcgcgggtgatgcggaaaaagagtagattaatcgtggcgattggttgtttgtcgatgtgtcgttagagtcgtttatacgggtgattgtcgagttttaaatttatatatcgttgatttagtggtagtcgttgtatatttattacgtcgttagttacgttacgggacgcgttttattgttggaagataattttgttgaattggttttcgatatttcgttatggttggtagataacgatcgtttggtattgcgcgatatttttgttcgtaatacgttggtcggagcgcgcgtcgtgatgtttaattcgtcgcgtcgcggtaaacgtaagtcggaatatttgtaatggttggcgttttttgtacgggcgtagagcgatgtcgatgcgttatttgtttatttggaacgcggcgcggttaattttgcggatttcgtttgggcgcgttagtttaacggcgaagggatgcgcgaattgttgtaatagtttggttatatttaggttggttatagtttgttgaatgcgtcggttgt

SEQ ID NO: 6768 - DNA, 857 bp, Artificial Sequence
  chemically treated genomic DNA (Homo sapiens) CpG-island No: 6768
acaaccgacgcattcaacaaactataaccaacctaaatataaccaaactattacaacaattcgcgcatcccttcgccgttaaactaacgcgcccaaacgaaatccgcaaaattaaccgcgccgcgttccaaataaacaaataacgcatcgacatcgctctacgcccgtacaaaaaacgccaaccattacaaatattccgacttacgtttaccgcgacgcgacgaattaaacatcacgacgcgcgctccgaccaacgtattacgaacaaaaatatcgcgcaataccaaacgatcgttatctaccaaccataacgaaatatcgaaaaccaattcaacaaaattatcttccaacaataaaacgcgtcccgtaacgtaactaacgacgtaataaatatacaacgactaccactaaatcaacgatatataaatttaaaactcgacaatcacccgtataaacgactctaacgacacatcgacaaacaaccaatcgccacgattaatctactctttttccgcatcacccgcgatattaaacgcgatacgctacccgacattaacgaattctattaactaattttacgcatacaacgcacgttcacgcatcgatttatttacaccaatcaaccaaaataaatcgcctaacttcacttccccgcttaaaaccgatccgataacgacaaccgaaaccttttacgataatacgcgacaaacgcgaacgaaacttattaataaatatcgcgtccgaaactaacaatatcgccaaaatcatcccgacacgaaatcgaaaaaaaatactacgacacgataccgaacatcttaaaaaaatatcaactatacaaaaataaaaaaaacaataaa

SEQ ID NO: 6769 - DNA, 514 bp, Artificial Sequence
  chemically treated genomic DNA (Homo sapiens) CpG-island No: 6769
tcgcgtttcgcgaagttttaatgagcgttttggcgtagattcgcgagtaaggttacgttttggatagcgaagagaacgagtagggcgtgcgttgcgtggcggtgtcggtgtggaattacgagtttcgcgttatcgtcgttttgagtttgtcgacgttgatttttcgcgtggacgacgcggagttggttaattttcgcgagtagttttagtaggtcgggttcgcgttttcgcgcgcgttgggttattcggtttgagtcgttagatcgggtcgtaggtgaagtagttaaagttcgcgtagtagtcgtcgtcggtgatgtttcgtagtgtaggttataaagcgtcgttgagaagcgcgtcgcgatttatcgtcgaagtttagtttattgttttcgtcgttggttcgtttttttaagaattttacggtaatcgttaacgtttcggggaagttcgatttcggcggatggttttacgttaggcgtgggtcggatatgatcgttcgtatacgttattgtgt

SEQ ID NO: 6770 - DNA, 514 bp, Artificial Sequence
  chemically treated genomic DNA (Homo sapiens) CpG-island No: 6770
acacaataacgtatacgaacgatcatatccgacccacgcctaacgtaaaaccatccgccgaaatcgaacttccccgaaacgttaacgattaccgtaaaattcttaaaaaaacgaaccaacgacgaaaacaataaactaaacttcgacgataaatcgcgacgcgcttctcaacgacgctttataacctacactacgaaacatcaccgacgacgactactacgcgaactttaactacttcacctacgacccgatctaacgactcaaaccgaataacccaacgcgcgcgaaaacgcgaacccgacctactaaaactactcgcgaaaattaaccaactccgcgtcgtccacgcgaaaaatcaacgtcgacaaactcaaaacgacgataacgcgaaactcgtaattccacaccgacaccgccacgcaacgcacgccctactcgttctcttcgctatccaaaacgtaaccttactcgcgaatctacgccaaaacgctcattaaaacttcgcgaaacgcga

SEQ ID NO: 6771 - DNA, 514 bp, Artificial Sequence
  chemically treated genomic DNA (Homo sapiens) CpG-island No: 6771
atataatggcgtgtgcgggcggttatattcggtttacgtttggcgtaagattattcgtcgaaatcgggttttttcgggacgttagcggttatcgtaagatttttgaggaaacgagttaacggcggggataataggttgaatttcgacgataaatcgcggcgcgttttttaacggcgttttgtggtttgtattgcgggatattatcggcgacggttgttacgcggattttgattattttatttacgattcggtttaacggtttaggtcgggtagtttagcgcgcgcgagagcgcgagttcggtttgttgaagttgttcgcggaaattagttagtttcgcgtcgtttacgcgggaggttagcgtcgataggtttagggcggcgatgacgcgggattcgtggttttatatcggtatcgttacgtagcgtacgttttgttcgtttttttcgttgtttagggcgtagttttgttcgcgggtttgcgttagggcgtttattaaggtttcgcgagacgcga

SEQ ID NO: 6772 - DNA, 514 bp, Artificial Sequence
  chemically treated genomic DNA (Homo sapiens) CpG-island No: 6772
tcgcgtctcgcgaaaccttaataaacgccctaacgcaaacccgcgaacaaaactacgccctaaacaacgaaaaaaacgaacaaaacgtacgctacgtaacgataccgatataaaaccacgaatcccgcgtcatcgccgccctaaacctatcgacgctaacctcccgcgtaaacgacgcgaaactaactaatttccgcgaacaacttcaacaaaccgaactcgcgctctcgcgcgcgctaaactacccgacctaaaccgttaaaccgaatcgtaaataaaataatcaaaatccgcgtaacaaccgtcgccgataatatcccgcaatacaaaccacaaaacgccgttaaaaaacgcgccgcgatttatcgtcgaaattcaacctattatccccgccgttaactcgtttcctcaaaaatcttacgataaccgctaacgtcccgaaaaaacccgatttcgacgaataatcttacgccaaacgtaaaccgaatataaccgcccgcacacgccattatat

SEQ ID NO: 6773 - DNA, 592 bp, Artificial Sequence
  chemically treated genomic DNA (Homo sapiens) CpG-island No: 6773
tagtttttgtaggaggcgtatcgttttcgtttcggttaatatttgatttttatagttagttttgatggtgaagaattacgtcgttgttattttattttgtcgtatttatttgtttggcgaatattattgtggcggcgaaagttattgaagcgcggacgtttttttcgttatgttcgcgatatatattcgttagcgtatgacgtttggtacgttatgttgtcgtagggtttttttcgttattagtcgtaagtcgaacgttaagcgcgttatttggttaatcgttagttacgattcgttattatttatttgggaatattttattataataaattatacgaaaatttatattcgtattagtaatcgtttattatatttatttttttacgtcgcgtaattttagtatttttttcgtttcgtcggtttttacgacgatttcgaagagtcgaacgtttatcgtaatcgtttttgtttattacgttaatagttttggtcgaaatatataatttatattaatttcgttcgcgtttatgtatgtcgtgttttcgggagcgtcgtattatttttatacgcgttattatatttatacgtttcg

SEQ ID NO: 6774 - DNA, 592 bp, Artificial Sequence
  chemically treated genomic DNA (Homo sapiens) CpG-island No: 6774
cgaaacgtataaatataataacgcgtataaaaataatacgacgctcccgaaaacacgacatacataaacgcgaacgaaattaatataaattatatatttcgaccaaaactattaacgtaataaacaaaaacgattacgataaacgttcgactcttcgaaatcgtcgtaaaaaccgacgaaacgaaaaaaatactaaaattacgcgacgtaaaaaaataaatataataaacgattactaatacgaatataaattttcgtataatttattataataaaatattcccaaataaataataacgaatcgtaactaacgattaaccaaataacgcgcttaacgttcgacttacgactaataacgaaaaaaaccctacgacaacataacgtaccaaacgtcatacgctaacgaatatatatcgcgaacataacgaaaaaaacgtccgcgcttcaataactttcgccgccacaataatattcgccaaacaaataaatacgacaaaataaaataacaacgacgtaattcttcaccatcaaaactaactataaaaatcaaatattaaccgaaacgaaaacgatacgcctcctacaaaaacta

SEQ ID NO: 6775 - DNA, 592 bp, Artificial Sequence
  chemically treated genomic DNA (Homo sapiens) CpG-island No: 6775
cgggacgtgtgggtgtggtggcgcgtgtgggggtggtgcggcgttttcgaggatacgatatgtatgggcgcgagcggagttagtgtgagttgtatatttcggttaaggttgttagcgtgatgggtagaggcggttgcggtaggcgttcgatttttcgggatcgtcgtaggggtcggcggagcgggaggaatgttggggttgcgcggcgtgggaaggtgggtgtggtggacggttgttggtgcgggtgtgagttttcgtgtggtttgttgtggtggggtgtttttagatgggtggtggcgggtcgtggttggcgattggttaggtagcgcgtttggcgttcggtttgcggttgatagcggggagggttttgcggtagtatgacgtgttaggcgttatacgttggcggatgtgtgtcgcgggtatagcgggagaaacgttcgcgttttaatggttttcgtcgttatagtggtgttcgttaggtagataggtgcggtaaagtggagtaataacggcgtaattttttattattaaagttggttgtgaaggttaaatgttgatcggggcgaaagcgatacgttttttgtaaaggttg

SEQ ID NO: 6776 - DNA, 592 bp, Artificial Sequence
  chemically treated genomic DNA (Homo sapiens) CpG-island No: 6776
caacctttacaaaaaacgtatcgctttcgccccgatcaacatttaaccttcacaaccaactttaataataaaaaattacgccgttattactccactttaccgcacctatctacctaacgaacaccactataacgacgaaaaccattaaaacgcgaacgtttctcccgctatacccgcgacacacatccgccaacgtataacgcctaacacgtcatactaccgcaaaaccctccccgctatcaaccgcaaaccgaacgccaaacgcgctacctaaccaatcgccaaccacgacccgccaccacccatctaaaaacaccccaccacaacaaaccacacgaaaactcacacccgcaccaacaaccgtccaccacacccaccttcccacgccgcgcaaccccaacattcctcccgctccgccgacccctacgacgatcccgaaaaatcgaacgcctaccgcaaccgcctctacccatcacgctaacaaccttaaccgaaatatacaactcacactaactccgctcgcgcccatacatatcgtatcctcgaaaacgccgcaccacccccacacgcgccaccacacccacacgtcccg

SEQ ID NO: 6777 - DNA, 871 bp, Artificial Sequence
  chemically treated genomic DNA (Homo sapiens) CpG-island No: 6777
ttttattttaattttttttttagaggggcgaggggatcgatcgcgtttaatgttgcgatcggtttgttttattttttgcgtaataattttaacgtattcgttgttattagtatcgtcgttttcgtatttgttagtattgttagttataattcggttatttttaatagcgtggtgacgaggaagattttttttagttttagcgtaatagtgatgttttggcggatattggcgtgagtggcgcgtgttagtttaattatttgtattaggtcgcgtaggtggttatgggttaatgttgcgtcggcggtttttagcgttacgtttgtgtcgttatttattgtaatttcgatggcggtagtttttatcgttggcgcgtcgttaatatcgttatcgattatcgttagcggcgtatgttgatttagttcggttatcgttttgattttatttttcggtaataggttcgttttaaattttagttttagtttttcggtaattgtcgtcgttgcgcgtggattatcgtcggtgaggattatttttttgacgtttagcgcgtttagttttattgatggtagttgtcgtatcggcgcgtagggtattttgtaacgttatggatattaagtacgttacgttcgtttattaggatatcgttgttcgggttttttatcgtattgaatagaatgttttcggaatttcgggggtaatataggttacgtgatacgtattaattaataatcgttattgtgggtaaggtatcgtgtatgcgtgcgcggtagttttttcggggggggcgtattacgggcgtgtgttgttgtacgcgattatttatcgtttttttttgggttcgttttttttttttgcgttgttttttttgttt

SEQ ID NO: 6778 - DNA, 871 bp, Artificial Sequence
  chemically treated genomic DNA (Homo sapiens) CpG-island No: 6778
aaacaaaaaaaacaacgcaaaaaaaaaaaacgaacccaaaaaaaaacgataaataatcgcgtacaacaacacacgcccgtaatacgccccccccgaaaaaactaccgcgcacgcatacacgataccttacccacaataacgattattaattaatacgtatcacgtaacctatattacccccgaaattccgaaaacattctattcaatacgataaaaaacccgaacaacgatatcctaataaacgaacgtaacgtacttaatatccataacgttacaaaataccctacgcgccgatacgacaactaccatcaataaaactaaacgcgctaaacgtcaaaaaaataatcctcaccgacgataatccacgcgcaacgacgacaattaccgaaaaactaaaactaaaatttaaaacgaacctattaccgaaaaataaaatcaaaacgataaccgaactaaatcaacatacgccgctaacgataatcgataacgatattaacgacgcgccaacgataaaaactaccgccatcgaaattacaataaataacgacacaaacgtaacgctaaaaaccgccgacgcaacattaacccataaccacctacgcgacctaatacaaataattaaactaacacgcgccactcacgccaatatccgccaaaacatcactattacgctaaaactaaaaaaaatcttcctcgtcaccacgctattaaaaataaccgaattataactaacaatactaacaaatacgaaaacgacgatactaataacaacgaatacgttaaaattattacgcaaaaaataaaacaaaccgatcgcaacattaaacgcgatcgatcccctcgcccctctaaaaaaaaaattaaaataaaa

SEQ ID NO: 6779 - DNA, 871 bp, Artificial Sequence
  chemically treated genomic DNA (Homo sapiens) CpG-island No: 6779
aaataagaaaaataacgtagaaaagaaggacgggtttaaaaggaggcggtgaatagtcgcgtgtagtagtatacgttcgtggtgcgtttttttcgagagggttgtcgcgtacgtatatacggtgttttatttataataacggttgttggttgatacgtgttacgtggtttatattgttttcggaatttcggaggtattttgtttaatgcgatgggaagttcgggtaacggtattttggtagacgaacgtgacgtgtttggtgtttatggcgttataggatattttgcgcgtcgatgcggtaattgttattagtgaaattgaacgcgttgggcgttaaaggggtgatttttatcggcgataatttacgcgtagcggcggtaattgtcggggagttggggttggagtttaaagcgggtttgttgtcggaagataaagttaaagcggtgatcgagttgaattaatatgcgtcgttggcgatggtcggtgacggtattaacgacgcgttagcgatgaaagttgtcgttatcgggattgtaatgggtagcggtatagacgtggcgttggaaatcgtcgacgtagtattaatttataattatttgcgcggtttggtgtaaatgattgaattggtacgcgttatttacgttaatattcgttagaatattattattgcgttggggttgaaagggatttttttcgttattacgttgttagggatgatcgggttgtggttggtagtgttggtagatacgggggcgacggtgttggtgatagcgaatgcgttaagattgttgcgtaggagataaggtaaatcgatcgtaatattgagcgcgatcggttttttcgtttttttggggagagggttagggtgagg

SEQ ID NO: 6780 - DNA, 871 bp, Artificial Sequence
  chemically treated genomic DNA (Homo sapiens) CpG-island No: 6780
cctcaccctaaccctctccccaaaaaaacgaaaaaaccgatcgcgctcaatattacgatcgatttaccttatctcctacgcaacaatcttaacgcattcgctatcaccaacaccgtcgcccccgtatctaccaacactaccaaccacaacccgatcatccctaacaacgtaataacgaaaaaaatccctttcaaccccaacgcaataataatattctaacgaatattaacgtaaataacgcgtaccaattcaatcatttacaccaaaccgcgcaaataattataaattaatactacgtcgacgatttccaacgccacgtctataccgctacccattacaatcccgataacgacaactttcatcgctaacgcgtcgttaataccgtcaccgaccatcgccaacgacgcatattaattcaactcgatcaccgctttaactttatcttccgacaacaaacccgctttaaactccaaccccaactccccgacaattaccgccgctacgcgtaaattatcgccgataaaaatcacccctttaacgcccaacgcgttcaatttcactaataacaattaccgcatcgacgcgcaaaatatcctataacgccataaacaccaaacacgtcacgttcgtctaccaaaataccgttacccgaacttcccatcgcattaaacaaaatacctccgaaattccgaaaacaatataaaccacgtaacacgtatcaaccaacaaccgttattataaataaaacaccgtatatacgtacgcgacaaccctctcgaaaaaaacgcaccacgaacgtatactactacacgcgactattcaccgcctccttttaaacccgtccttcttttctacgttatttttcttattt

SEQ ID NO: 6781 - DNA, 532 bp, Artificial Sequence
  chemically treated genomic DNA (Homo sapiens) CpG-island No: 6781
gcgttcgcgtgaggatgttttcggcgttatcgcgtggtcgcgtgattgagatgtcgttacggagagtacgcggttatgtttgaagcgtttggcgcgagcgtgatttcgcgtagtttttggtagtcgggcgtttggcggaaagcgtggttagagtgtttgattgtagtagggcgtgtgtcgtgatgtcgtcgaattggaacgttcgtagcgttcgttgcgtgtcgcgtttgtttgtgtaagttatatgcgttcgatgagcgcggcgaatgtgcgtcgatacgttgcgtatggtcgagttgtttagaatgtatacgttaagtgttgttattgtcgtcgtagcgtgatgtttagatgtgtagataaacggttagttttgacgtattggttgtttatttgttgttgaaagaagcgggtatcgggtttgcgatgtcggttgtttcgttgtttgaaattttcgatgatttgaataacgttaacgatgttatgatttagttgtttaatattgattggtatcgtggtttgatttaggtgt

SEQ ID NO: 6782 - DNA, 532 bp, Artificial Sequence
  chemically treated genomic DNA (Homo sapiens) CpG-island No: 6782
acacctaaatcaaaccacgataccaatcaatattaaacaactaaatcataacatcgttaacgttattcaaatcatcgaaaatttcaaacaacgaaacaaccgacatcgcaaacccgatacccgcttctttcaacaacaaataaacaaccaatacgtcaaaactaaccgtttatctacacatctaaacatcacgctacgacgacaataacaacacttaacgtatacattctaaacaactcgaccatacgcaacgtatcgacgcacattcgccgcgctcatcgaacgcatataacttacacaaacaaacgcgacacgcaacgaacgctacgaacgttccaattcgacgacatcacgacacacgccctactacaatcaaacactctaaccacgctttccgccaaacgcccgactaccaaaaactacgcgaaatcacgctcgcgccaaacgcttcaaacataaccgcgtactctccgtaacgacatctcaatcacgcgaccacgcgataacgccgaaaacatcctcacgcgaacgc

SEQ ID NO: 6783 - DNA, 532 bp, Artificial Sequence
  chemically treated genomic DNA (Homo sapiens) CpG-island No: 6783
gtatttgaattaggttacgatattagttaatattgagtagttgggttatgatatcgttggcgttgtttagattatcgagggttttaaatagcggagtaatcggtatcgtaaattcgatattcgttttttttagtagtaggtggatagttagtacgttaggattggtcgtttatttgtatatttgagtattacgttacggcggtaatggtagtatttgacgtgtgtattttgagtaattcgattatgcgtagcgtatcgacgtatattcgtcgcgtttatcgagcgtatatggtttgtatagatagacgcggtacgtagcggacgttacggacgttttagttcgacggtattacggtatacgttttgttatagttaggtattttgattacgtttttcgttagacgttcgattattagaggttacgcgggattacgttcgcgttagacgttttaggtatgatcgcgtgtttttcgtgacggtattttaattacgcgattacgcggtaacgtcggaaatatttttacgcgagcgt

SEQ ID NO: 6784 - DNA, 532 bp, Artificial Sequence
  chemically treated genomic DNA (Homo sapiens) CpG-island No: 6784
acgctcgcgtaaaaatatttccgacgttaccgcgtaatcgcgtaattaaaataccgtcacgaaaaacacgcgatcatacctaaaacgtctaacgcgaacgtaatcccgcgtaacctctaataatcgaacgtctaacgaaaaacgtaatcaaaatacctaactataacaaaacgtataccgtaataccgtcgaactaaaacgtccgtaacgtccgctacgtaccgcgtctatctatacaaaccatatacgctcgataaacgcgacgaatatacgtcgatacgctacgcataatcgaattactcaaaatacacacgtcaaatactaccattaccgccgtaacgtaatactcaaatatacaaataaacgaccaatcctaacgtactaactatccacctactactaaaaaaaacgaatatcgaatttacgataccgattactccgctatttaaaaccctcgataatctaaacaacgccaacgatatcataacccaactactcaatattaactaatatcgtaacctaattcaaatac

SEQ ID NO: 6785 - DNA, 506 bp, Artificial Sequence
  chemically treated genomic DNA (Homo sapiens) CpG-island No: 6785
cgtttacgtttagttcgcgtaatgtgcggaaatcgttgatttgcggtagttgtatattatttgttttatcgaggatcgttcgtgttagcggatggttggaattttgttttagtgtcgtcgttagacgtaatgttagcgttgtttaatatttttagcgttaattaggttggtggtggtaatagcgttagtatttattagtggcgaaagcggtttgtcgttatgtaattttaaggcgataattgagttaaagggtaattcggtcgggttagcgttaattttgttttgtatcggttgcgggtcgatattttttaacgttaggggttacgtatatattttcgatagggttttagggaataggcgaattcgggtatttcggtataaatcgtttattcgggaaaaatacggtcgttagaaagttcggaaacgtttaaagggagaatcgcgttggttcggtaagcgtttggggagtcgtacgcgcgaatttgttttaatggatttaaaacggg

SEQ ID NO: 6786 - DNA, 506 bp, Artificial Sequence
  chemically treated genomic DNA (Homo sapiens) CpG-island No: 6786
cccgttttaaatccattaaaacaaattcgcgcgtacgactccccaaacgcttaccgaaccaacgcgattctccctttaaacgtttccgaactttctaacgaccgtatttttcccgaataaacgatttataccgaaatacccgaattcgcctattccctaaaaccctatcgaaaatatatacgtaacccctaacgttaaaaaatatcgacccgcaaccgatacaaaacaaaattaacgctaacccgaccgaattaccctttaactcaattatcgccttaaaattacataacgacaaaccgctttcgccactaataaatactaacgctattaccaccaccaacctaattaacgctaaaaatattaaacaacgctaacattacgtctaacgacgacactaaaacaaaattccaaccatccgctaacacgaacgatcctcgataaaacaaataatatacaactaccgcaaatcaacgatttccgcacattacgcgaactaaacgtaaacg

SEQ ID NO: 6787 - DNA, 506 bp, Artificial Sequence
  chemically treated genomic DNA (Homo sapiens) CpG-island No: 6787
ttcgttttaggtttattggggtagattcgcgcgtgcggttttttaggcgtttgtcgggttaacgcgattttttttttgggcgttttcgggttttttggcggtcgtgtttttttcgggtggacggtttatgtcggggtgttcgggttcgtttgttttttgggattttgtcggaagtgtgtacgtagtttttggcgttagaagatgtcgattcgtagtcggtataggataaaattggcgttgattcgatcggattgttttttaatttagttatcgttttagagttgtatggcggtaaatcgttttcgttattggtaaatgttggcgttattgttattattagtttgattaacgttgaaaatgttgaataacgttggtattgcgtttggcggcggtattggagtaaggttttagttattcgttggtacgagcgattttcgataaagtaggtgatatgtagttatcgtaggttaacggttttcgtatattgcgcgggttgggcgtgagcg

SEQ ID NO: 6788 - DNA, 506 bp, Artificial Sequence
  chemically treated genomic DNA (Homo sapiens) CpG-island No: 6788
cgctcacgcccaacccgcgcaatatacgaaaaccgttaacctacgataactacatatcacctactttatcgaaaatcgctcgtaccaacgaataactaaaaccttactccaataccgccgccaaacgcaataccaacgttattcaacattttcaacgttaatcaaactaataataacaataacgccaacatttaccaataacgaaaacgatttaccgccatacaactctaaaacgataactaaattaaaaaacaatccgatcgaatcaacgccaattttatcctataccgactacgaatcgacatcttctaacgccaaaaactacgtacacacttccgacaaaatcccaaaaaacaaacgaacccgaacaccccgacataaaccgtccacccgaaaaaaacacgaccgccaaaaaacccgaaaacgcccaaaaaaaaaatcgcgttaacccgacaaacgcctaaaaaaccgcacgcgcgaatctaccccaataaacctaaaacgaa

SEQ ID NO: 6789 - DNA, 525 bp, Artificial Sequence
  chemically treated genomic DNA (Homo sapiens) CpG-island No: 6789
tatttttgtcgttcgcgttgcggttacggcggtttgaatgttggtaatgatcgggcgagtggttgagatattaaattcggcgagatttaagtagtcgtttggcgtggtataagcgttttgtatatttattacgattagcgtattttgttgcggatcgaaggtaatggttttcggtcgagcggttaaggtcgttattatgttattttttgagttagcgtaggtagatgggcgcggtattgtattagtggttgaatgcgttcgtcgaaggtttcgattttcgatagaaaatcgtcgaaggttaatagtacgttttcggcgataggtacgttgcgattttatttaaatgcgcgcgaattggcggtagaacgattaagttttatttgagtttacggtaatgggacggtatttagaattgggtttacggcgggtattcgaatgcgcgtttaaattttatagtttttgtgaaaatttcggagaaaacggtagtgtagttagataaagaaaaatatcgagaataaaatcggt

SEQ ID NO: 6790 - DNA, 525 bp, Artificial Sequence
  chemically treated genomic DNA (Homo sapiens) CpG-island No: 6790
accgattttattctcgatatttttctttatctaactacactaccgttttctccgaaattttcacaaaaactataaaatttaaacgcgcattcgaatacccgccgtaaacccaattctaaataccgtcccattaccgtaaactcaaataaaacttaatcgttctaccgccaattcgcgcgcatttaaataaaatcgcaacgtacctatcgccgaaaacgtactattaaccttcgacgattttctatcgaaaatcgaaaccttcgacgaacgcattcaaccactaatacaataccgcgcccatctacctacgctaactcaaaaaataacataataacgaccttaaccgctcgaccgaaaaccattaccttcgatccgcaacaaaatacgctaatcgtaataaatatacaaaacgcttataccacgccaaacgactacttaaatctcgccgaatttaatatctcaaccactcgcccgatcattaccaacattcaaaccgccgtaaccgcaacgcgaacgacaaaaata

SEQ ID NO: 6791 - DNA, 525 bp, Artificial Sequence
  chemically treated genomic DNA (Homo sapiens) CpG-island No: 6791
gtcggttttgttttcgatgtttttttttgtttgattgtattgtcgtttttttcggggtttttataggggttgtgagatttgggcgcgtattcgagtattcgtcgtggatttagttttaagtgtcgttttattgtcgtaaatttaaatgggatttagtcgttttatcgttagttcgcgcgtatttagatgaagtcgtagcgtgtttgtcgtcgaaggcgtgttgttaattttcgacgattttttgtcgggaatcgaaattttcggcgagcgtatttaattattgatgtaatgtcgcgtttatttatttgcgttgatttaggaggtggtatgatgacgattttaatcgttcgatcggaagttattattttcgattcgtagtaaagtgcgttgatcgtggtggatatgtaaaacgtttatgttacgttaggcggttatttagatttcgtcgggtttgatgttttaattattcgttcggttattgttaatatttaaatcgtcgtgatcgtagcgcgagcggtagggatg

SEQ ID NO: 6792 - DNA, 525 bp, Artificial Sequence
  chemically treated genomic DNA (Homo sapiens) CpG-island No: 6792
catccctaccgctcgcgctacgatcacgacgatttaaatattaacaataaccgaacgaataattaaaacatcaaacccgacgaaatctaaataaccgcctaacgtaacataaacgttttacatatccaccacgatcaacgcactttactacgaatcgaaaataataacttccgatcgaacgattaaaatcgtcatcataccacctcctaaatcaacgcaaataaataaacgcgacattacatcaataattaaatacgctcgccgaaaatttcgattcccgacaaaaaatcgtcgaaaattaacaacacgccttcgacgacaaacacgctacgacttcatctaaatacgcgcgaactaacgataaaacgactaaatcccatttaaatttacgacaataaaacgacacttaaaactaaatccacgacgaatactcgaatacgcgcccaaatctcacaacccctataaaaaccccgaaaaaaacgacaatacaatcaaacaaaaaaaaacatcgaaaacaaaaccgac

SEQ ID NO: 6793 - DNA, 867 bp, Artificial Sequence
  chemically treated genomic DNA (Homo sapiens) CpG-island No: 6793
tcgcgttaggataaagtgattatttttatttttatttattttatgaacgaagcggaacgttgcgatcgtattttattgatgtacgtcggaaaagtgtttgttagcggtatatcgtaggaattggttgagaaacgcggagtcgttagtttggaagaggtatttatcgtttatttgtaggaagcggtagggtagagtaacgaagtcgaagcgtcgttcgtggtatacgatattatttacgcgtcgcgttagggatttagtttgcgtcgtttgtttagttatagtcgtcgcgaagcgttggaattgcgacgcgatttagtacgttcgacgttggcgttgatgggaacggtgattttgatgttgataatgggttacggtattagtatggatgtggaaaatttgcgttttgcggtgttcgatcgcgattagatcgttagtagttaggcgtggatatttaattttttcggttttcgttattttatcgaatagtcgtcgtttattagttatgacgagtttgatcgtcggatgcgtgcgggcgatattacggtggcgattgagatttcgtttaatttcgggcgcgatatcgcgcgtggtacgtttgtggaattcggcgtttggatcgacggagtcgatgtcgagtcgtgttggaacggttaagcgtacgtgtaggttatgttttacgagttgttataggatgtgggaagttgataacggtattcgtatagtaaagcgcgttattaaatgtgaacgcgtaacgagatagtcgagagaaaagtcggtacgaagtttcgcgggaattttttttttgtaaaattcggatgttatcgtttcgggcggcgatatacgtgcgagatttattagagttatcgt

SEQ ID NO: 6794 - DNA, 867 bp, Artificial Sequence
  chemically treated genomic DNA (Homo sapiens) CpG-island No: 6794
acgataactctaataaatctcgcacgtatatcgccgcccgaaacgataacatccgaattttacaaaaaaaaaattcccgcgaaacttcgtaccgacttttctctcgactatctcgttacgcgttcacatttaataacgcgctttactatacgaataccgttatcaacttcccacatcctataacaactcgtaaaacataacctacacgtacgcttaaccgttccaacacgactcgacatcgactccgtcgatccaaacgccgaattccacaaacgtaccacgcgcgatatcgcgcccgaaattaaacgaaatctcaatcgccaccgtaatatcgcccgcacgcatccgacgatcaaactcgtcataactaataaacgacgactattcgataaaataacgaaaaccgaaaaaattaaatatccacgcctaactactaacgatctaatcgcgatcgaacaccgcaaaacgcaaattttccacatccatactaataccgtaacccattatcaacatcaaaatcaccgttcccatcaacgccaacgtcgaacgtactaaatcgcgtcgcaattccaacgcttcgcgacgactataactaaacaaacgacgcaaactaaatccctaacgcgacgcgtaaataatatcgtataccacgaacgacgcttcgacttcgttactctaccctaccgcttcctacaaataaacgataaatacctcttccaaactaacgactccgcgtttctcaaccaattcctacgatataccgctaacaaacacttttccgacgtacatcaataaaatacgatcgcaacgttccgcttcgttcataaaataaataaaaataaaaataatcactttatcctaacgcga

SEQ ID NO: 6795 - DNA, 867 bp, Artificial Sequence
  chemically treated genomic DNA (Homo sapiens) CpG-island No: 6795
gcggtggttttagtggatttcgtacgtgtgtcgtcgttcggagcggtaatattcgggttttatagaggaggggttttcgcggagtttcgtgtcggtttttttttcggttatttcgttgcgcgtttatatttgatagcgcgttttgttgtgcgggtgtcgttgttagttttttatattttgtaatagttcgtggggtatggtttgtacgtacgtttgatcgttttagtacggttcggtatcggtttcgtcgatttagacgtcgagttttataggcgtattacgcgcgatatcgcgttcgagattgggcgggattttaatcgttatcgtgatatcgttcgtacgtattcgacgattaagttcgttataattggtgagcggcggttgttcgataaagtaacgggaatcggagaggttgagtgtttacgtttggttattgacggtttggtcgcggtcgagtatcgtaaagcgtaggttttttatatttatattgatgtcgtaatttattattagtattaggattatcgtttttattagcgttagcgtcgaacgtattggatcgcgtcgtagttttagcgtttcgcggcggttgtagttaaatagacggcgtaggttaaatttttgacgcggcgcgtgggtggtgtcgtgtattacgggcggcgtttcggtttcgttgttttgttttgtcgttttttgtaaataggcgataaatgttttttttagattggcggtttcgcgttttttaattagtttttgcggtgtatcgttggtaagtattttttcggcgtgtattagtgagatgcggtcgtaacgtttcgtttcgtttataaagtgggtggagatgaagatagttattttgttttggcgcga

SEQ ID NO: 6796 - DNA, 867 bp, Artificial Sequence
  chemically treated genomic DNA (Homo sapiens) CpG-island No: 6796
tcgcgccaaaacaaaataactatcttcatctccacccactttataaacgaaacgaaacgttacgaccgcatctcactaatacacgccgaaaaaatacttaccaacgatacaccgcaaaaactaattaaaaaacgcgaaaccgccaatctaaaaaaaacatttatcgcctatttacaaaaaacgacaaaacaaaacaacgaaaccgaaacgccgcccgtaatacacgacaccacccacgcgccgcgtcaaaaatttaacctacgccgtctatttaactacaaccgccgcgaaacgctaaaactacgacgcgatccaatacgttcgacgctaacgctaataaaaacgataatcctaatactaataataaattacgacatcaatataaatataaaaaacctacgctttacgatactcgaccgcgaccaaaccgtcaataaccaaacgtaaacactcaacctctccgattcccgttactttatcgaacaaccgccgctcaccaattataacgaacttaatcgtcgaatacgtacgaacgatatcacgataacgattaaaatcccgcccaatctcgaacgcgatatcgcgcgtaatacgcctataaaactcgacgtctaaatcgacgaaaccgataccgaaccgtactaaaacgatcaaacgtacgtacaaaccataccccacgaactattacaaaatataaaaaactaacaacgacacccgcacaacaaaacgcgctatcaaatataaacgcgcaacgaaataaccgaaaaaaaaaccgacacgaaactccgcgaaaacccctcctctataaaacccgaatattaccgctccgaacgacgacacacgtacgaaatccactaaaaccaccgc

SEQ ID NO: 6797 - DNA, 543 bp, Artificial Sequence
  chemically treated genomic DNA (Homo sapiens) CpG-island No: 6797
gatcgaaggggatttcgggacgagattatttcgggttcggaaacggggggcgtcggattattttatcgtttcggggacgggggagggcggacgagattattttaagttagggggttttttcgagataaagttgcgttatcgattttagattttcgcgcggcgggttttatcgttagcgttagttggtggatgcgttcggagtagttatttagtagtagtattagaagtagtcgttgtttttatttcgcggggttttcgcggtcgagtttttttttttcgtttattgttatttttggagttatttttttttcgatttcgtttttggcgtttaagttcgtttatcgatgagttaatcgtcgtacggcggggttcggtttttcggagtttttagttcgttaattaattagtaattgttttttcgtaagttcgtttgtttgcgttatcgacggatagtatcggtttcgaatgggagagtcgataacgtttaatttttagtttatttttattaatcgttataaagattgttcggatgtgatttaatga

SEQ ID NO: 6798 - DNA, 543 bp, Artificial Sequence
  chemically treated genomic DNA (Homo sapiens) CpG-island No: 6798
tcattaaatcacatccgaacaatctttataacgattaataaaaataaactaaaaattaaacgttatcgactctcccattcgaaaccgatactatccgtcgataacgcaaacaaacgaacttacgaaaaaacaattactaattaattaacgaactaaaaactccgaaaaaccgaaccccgccgtacgacgattaactcatcgataaacgaacttaaacgccaaaaacgaaatcgaaaaaaaaataactccaaaaataacaataaacgaaaaaaaaaaactcgaccgcgaaaaccccgcgaaataaaaacaacgactacttctaatactactactaaataactactccgaacgcatccaccaactaacgctaacgataaaacccgccgcgcgaaaatctaaaatcgataacgcaactttatctcgaaaaaaccccctaacttaaaataatctcgtccgccctcccccgtccccgaaacgataaaataatccgacgccccccgtttccgaacccgaaataatctcgtcccgaaatccccttcgatc

SEQ ID NO: 6799 - DNA, 543 bp, Artificial Sequence
  chemically treated genomic DNA (Homo sapiens) CpG-island No: 6799
ttattaaattatattcggataatttttatagcgattggtgagagtgagttgggggttaagcgttatcggtttttttattcggaatcggtgttgttcgtcggtgacgtaagtaggcgggtttgcggagaggtaattgttgattggttggcggattggaaatttcgaaaggtcgggtttcgtcgtgcggcgattggtttatcggtgggcgggtttgggcgttagaggcggagtcggggaggaggtggttttagagatggtagtgagcgagaggagggggttcggtcgcgggagtttcgcggagtgggggtagcggttatttttggtgttgttgttgggtggttgtttcgggcgtatttattagttggcgttgacggtgaggttcgtcgcgcgagggtttggggtcggtggcgtaattttgtttcggagaagttttttggtttggagtggtttcgttcgttttttttcgttttcgaggcggtggagtggttcggcgtttttcgttttcgggttcggagtggtttcgtttcgggatttttttcggtt

SEQ ID NO: 6800 - DNA, 543 bp, Artificial Sequence
  chemically treated genomic DNA (Homo sapiens) CpG-island No: 6800
aaccgaaaaaaatcccgaaacgaaaccactccgaacccgaaaacgaaaaacgccgaaccactccaccgcctcgaaaacgaaaaaaaacgaacgaaaccactccaaaccaaaaaacttctccgaaacaaaattacgccaccgaccccaaaccctcgcgcgacgaacctcaccgtcaacgccaactaataaatacgcccgaaacaaccacccaacaacaacaccaaaaataaccgctacccccactccgcgaaactcccgcgaccgaaccccctcctctcgctcactaccatctctaaaaccacctcctccccgactccgcctctaacgcccaaacccgcccaccgataaaccaatcgccgcacgacgaaacccgacctttcgaaatttccaatccgccaaccaatcaacaattacctctccgcaaacccgcctacttacgtcaccgacgaacaacaccgattccgaataaaaaaaccgataacgcttaacccccaactcactctcaccaatcgctataaaaattatccgaatataatttaataa

SEQ ID NO: 6801 - DNA, 724 bp, Artificial Sequence
  chemically treated genomic DNA (Homo sapiens) CpG-island No: 6801
  misc_feature (673)..(673): n is either a, c, g or t
  misc_feature (676)..(677): n is either a, c, g or t
gcgtttcggggcgataattattcggtaatgcgcgcgttggtcgttttgggtgagtgttagcgtgtgataatttttcggtagtttcgtcggtagattgaacgttttgtttttcgttatatggtttttgtattgcgtttttttttcggtggttagtagttagttatattcgtcgttgttttttattattatcggtatttttttgtcgttggtataaattatgatattcgggattggcgttatcgttattttcgtggcggtacgttgatgtatcgcgttaagtaaacgtcgtttggtttcggcgttaatcgattgcggtttatcgtgggtattgatgtaattggggttaattttcgtcgttagcgcggtattatttagacgtttgttttttatcgagtttttttagcgttttgtttgtagattcgagtttgataatcgcgtatagagcgattcgagttagatattcgtacgcggcggattgaggatttttcgcgagttcggtttcggttgcgttcgtttttttttgtttggggtttattagggtgagtcggtttcgattcgtgcggcgttgcgtttggttattgggggtgtttcgcggggtacgttttttatggtcgtttttttcgttcgtacggaatttacggttaatttttgtttcgggttcgggtcgtgacgnttnngagagaaagaaagataagaaggaagaaagaagggagagtaaaattaa

SEQ ID NO: 6802 - DNA, 724 bp, Artificial Sequence
  chemically treated genomic DNA (Homo sapiens) CpG-island No: 6802
  misc_feature (48)..(49): n is either a, c, g or t
  misc_feature (52)..(52): n is either a, c, g or t
ttaattttactctcccttctttcttccttcttatctttctttctctcnnaancgtcacgacccgaacccgaaacaaaaattaaccgtaaattccgtacgaacgaaaaaaacgaccataaaaaacgtaccccgcgaaacacccccaataaccaaacgcaacgccgcacgaatcgaaaccgactcaccctaataaaccccaaacaaaaaaaaacgaacgcaaccgaaaccgaactcgcgaaaaatcctcaatccgccgcgtacgaatatctaactcgaatcgctctatacgcgattatcaaactcgaatctacaaacaaaacgctaaaaaaactcgataaaaaacaaacgtctaaataataccgcgctaacgacgaaaattaaccccaattacatcaatacccacgataaaccgcaatcgattaacgccgaaaccaaacgacgtttacttaacgcgatacatcaacgtaccgccacgaaaataacgataacgccaatcccgaatatcataatttataccaacgacaaaaaaataccgataataataaaaaacaacgacgaatataactaactactaaccaccgaaaaaaaaacgcaatacaaaaaccatataacgaaaaacaaaacgttcaatctaccgacgaaactaccgaaaaattatcacacgctaacactcacccaaaacgaccaacgcgcgcattaccgaataattatcgccccgaaacgc

SEQ ID NO: 6803 - DNA, 724 bp, Artificial Sequence
  chemically treated genomic DNA (Homo sapiens) CpG-island No: 6803
  misc_feature (48)..(49): n is either a, c, g or t
  misc_feature (52)..(52): n is either a, c, g or t
ttggttttgtttttttttttttttttttttttgttttttttttttttnngancgttacggttcgggttcggagtaagaattggtcgtaagtttcgtacggacggaaaaagcgattataaaggacgtatttcgcggaatatttttagtggttagacgtaacgtcgtacgaatcggagtcgatttattttagtaggttttaaatagggaaggacggacgtaatcggagtcggattcgcgggggatttttaattcgtcgcgtgcggatgtttagttcggatcgttttatgcgcgattattaggttcgaatttgtaggtaaaacgttaaggaagttcgatggaaagtaaacgtttggataatgtcgcgttggcggcggggattagttttaattatattaatgtttacggtaaatcgtagtcgattagcgtcgaaattaaacggcgtttgtttgacgcgatgtattaacgtatcgttacgaaagtggcggtaacgttagtttcgaatgttatggtttatattagcggtaaaaaaatgtcgatggtggtggagggtagcggcgaatatagttggttgttgattatcgaagaaggaacgtagtataaaggttatgtaacggggggtaaagcgtttaatttatcgacgaagttgtcggaaggttattatacgttgatatttatttaggacgattagcgcgcgtattgtcgggtgattgtcgtttcgaaacgt

SEQ ID NO: 6804 - DNA, 724 bp, Artificial Sequence
  chemically treated genomic DNA (Homo sapiens) CpG-island No: 6804
  misc_feature (673)..(673): n is either a, c, g or t
  misc_feature (676)..(677): n is either a, c, g or t
acgtttcgaaacgacaatcacccgacaatacgcgcgctaatcgtcctaaataaatatcaacgtataataaccttccgacaacttcgtcgataaattaaacgctttaccccccgttacataacctttatactacgttccttcttcgataatcaacaaccaactatattcgccgctaccctccaccaccatcgacatttttttaccgctaatataaaccataacattcgaaactaacgttaccgccactttcgtaacgatacgttaatacatcgcgtcaaacaaacgccgtttaatttcgacgctaatcgactacgatttaccgtaaacattaatataattaaaactaatccccgccgccaacgcgacattatccaaacgtttactttccatcgaacttccttaacgttttacctacaaattcgaacctaataatcgcgcataaaacgatccgaactaaacatccgcacgcgacgaattaaaaatcccccgcgaatccgactccgattacgtccgtccttccctatttaaaacctactaaaataaatcgactccgattcgtacgacgttacgtctaaccactaaaaatattccgcgaaatacgtcctttataatcgctttttccgtccgtacgaaacttacgaccaattcttactccgaacccgaaccgtaacgntcnnaaaaaaaaaaaaaacaaaaaaaaaaaaaaaaaaaaaaacaaaaccaa

SEQ ID NO: 6805 - DNA, 709 bp, Artificial Sequence
  chemically treated genomic DNA (Homo sapiens) CpG-island No: 6805
acgtttttttgttattgcggtaattattagattcgtattacgtacggcgttattattagcgaagattttcggattggtggtttggtaacggtattggttttttatattcgcgatgatgcggttttatttgtttatcgttatatcgtgcgattttagttacggtatttcgtgcggattgaagttaaacgttataattatcgcgtcggttggtatgataaatttattgttttttatcggtattggacgtcgacgtttttgggtattcggttttttaagacgcgtgcgtaggaaacgaatttcgtagacgtgattttgtttatttagtttaagcgttatcggttggacgttaaattcgaagttggtttttttttcgcgggcgttttttattttttttttcgagtttggtatgttagttttattacgacgataagcgtaggtgacgttattcgcgtcgtggcgtagtgcggtacgtatatagtttatcgcggtgtcgtcgtcgtttagtattacgacgttaagttcggcggtattgataaacggttttttcggtagtttttcgagttttattatttgtttagtgttggtaatgaggaacggtagcgcgttataaacgttcggggtattttttttgggtaaattcgtttttttggatcggtagtgtttaggtaaggaaaattcgtttttagtttttaagggttttagagaattt

SEQ ID NO: 6806 - DNA, 709 bp, Artificial Sequence
  chemically treated genomic DNA (Homo sapiens) CpG-island No: 6806
aaattctctaaaacccttaaaaactaaaaacgaattttccttacctaaacactaccgatccaaaaaaacgaatttacccaaaaaaaataccccgaacgtttataacgcgctaccgttcctcattaccaacactaaacaaataataaaactcgaaaaactaccgaaaaaaccgtttatcaataccgccgaacttaacgtcgtaatactaaacgacgacgacaccgcgataaactatatacgtaccgcactacgccacgacgcgaataacgtcacctacgcttatcgtcgtaataaaactaacataccaaactcgaaaaaaaaaataaaaaacgcccgcgaaaaaaaaaccaacttcgaatttaacgtccaaccgataacgcttaaactaaataaacaaaatcacgtctacgaaattcgtttcctacgcacgcgtcttaaaaaaccgaatacccaaaaacgtcgacgtccaataccgataaaaaacaataaatttatcataccaaccgacgcgataattataacgtttaacttcaatccgcacgaaataccgtaactaaaatcgcacgatataacgataaacaaataaaaccgcatcatcgcgaatataaaaaaccaataccgttaccaaaccaccaatccgaaaatcttcgctaataataacgccgtacgtaatacgaatctaataattaccgcaataacaaaaaaacgt

SEQ ID NO: 6807 - DNA, 709 bp, Artificial Sequence
  chemically treated genomic DNA (Homo sapiens) CpG-island No: 6807
agattttttggaatttttgggaattaaagacgggttttttttgtttaggtattatcggtttaggaaagcgggtttatttaaagaaaatgtttcgggcgtttatgacgcgttgtcgttttttattgttaatattaaataggtgatggggttcgaagagttatcggaagagtcgtttattaatatcgtcggatttaacgtcgtggtattgggcggcggcgatatcgcgatggattgtgtgcgtatcgtattgcgttacggcgcgagtaacgttatttgcgtttatcgtcgtgatgaagttaatatgttaggttcgaagaaagaagtgaagaacgttcgcgaagagggggttaatttcgaatttaacgtttagtcggtggcgtttgagttgaatgaataaggttacgtttgcgggattcgttttttgcgtacgcgttttggagagtcggatgtttaggggcgtcggcgtttagtgtcggtggaaggtagtgaatttgttatgttagtcgacgcggtgattatggcgtttggttttaattcgtacgggatgtcgtggttggagtcgtacggtgtaacggtagataaatggggtcgtattatcgcggatgtggaaagttagtatcgttattagattattaattcgaaaattttcgttggtggtgacgtcgtgcgtggtgcggatttggtggttatcgtaatggtagaaggacgt

SEQ ID NO: 6808 - DNA, 709 bp, Artificial Sequence
  chemically treated genomic DNA (Homo sapiens) CpG-island No: 6808
acgtccttctaccattacgataaccaccaaatccgcaccacgcacgacgtcaccaccaacgaaaattttcgaattaataatctaataacgatactaactttccacatccgcgataatacgaccccatttatctaccgttacaccgtacgactccaaccacgacatcccgtacgaattaaaaccaaacgccataatcaccgcgtcgactaacataacaaattcactaccttccaccgacactaaacgccgacgcccctaaacatccgactctccaaaacgcgtacgcaaaaaacgaatcccgcaaacgtaaccttattcattcaactcaaacgccaccgactaaacgttaaattcgaaattaaccccctcttcgcgaacgttcttcacttctttcttcgaacctaacatattaacttcatcacgacgataaacgcaaataacgttactcgcgccgtaacgcaatacgatacgcacacaatccatcgcgatatcgccgccgcccaataccacgacgttaaatccgacgatattaataaacgactcttccgataactcttcgaaccccatcacctatttaatattaacaataaaaaacgacaacgcgtcataaacgcccgaaacattttctttaaataaacccgctttcctaaaccgataatacctaaacaaaaaaaacccgtctttaattcccaaaaattccaaaaaatct

SEQ ID NO: 6809 - DNA, 667 bp, Artificial Sequence
  chemically treated genomic DNA (Homo sapiens) CpG-island No: 6809
gtgggggatggtacgtaggataatttgtcgggttgtgaaaaagcggtgtaggtaaaagtgaaagttttgtttgatgtttagttcgaagtggtttatttattggcgaagtggaaacgttagattttagggtaatacgattttagcgcgggcgaagggttgtatacgtatatgaaagtttttcgtttcgatgaagatcgttttttttcgttgtattcggtttatgttgattagtgggattgggaacgcgtaatgggcgacggtgagcgttaattttcgattttgaaaagtacggtagaggcgatttgggcgggaattaaagtaatcgaagttgcggttagcgaagagtttggtttggtatcgtttttgtcggattagatttatttcgtatatagttaggagttattgtttcgttattcggattttgatgttaagggcgtgagcgggcgatagcgaaagattttggcgcggtattttttgtcgggattggcggtaagttgaacgatggttattttacgacgtgtgcgttcggattttgttttggagttttcggttagttggttttggggtttaagaatttcggttgattcgtgtggtttcggtgacgtttttagggttttttttttacgtttcgttatggtacggaatattttagagcggtcgttgtcgt

SEQ ID NO: 6810 - DNA, 667 bp, Artificial Sequence
  chemically treated genomic DNA (Homo sapiens) CpG-island No: 6810
acgacaacgaccgctctaaaatattccgtaccataacgaaacgtaaaaaaaaaaccctaaaaacgtcaccgaaaccacacgaatcaaccgaaattcttaaaccccaaaaccaactaaccgaaaactccaaaacaaaatccgaacgcacacgtcgtaaaataaccatcgttcaacttaccgccaatcccgacaaaaaataccgcgccaaaatctttcgctatcgcccgctcacgcccttaacatcaaaatccgaataacgaaacaataactcctaactatatacgaaataaatctaatccgacaaaaacgataccaaaccaaactcttcgctaaccgcaacttcgattactttaattcccgcccaaatcgcctctaccgtacttttcaaaatcgaaaattaacgctcaccgtcgcccattacgcgttcccaatcccactaatcaacataaaccgaatacaacgaaaaaaaacgatcttcatcgaaacgaaaaactttcatatacgtatacaacccttcgcccgcgctaaaatcgtattaccctaaaatctaacgtttccacttcgccaataaataaaccacttcgaactaaacatcaaacaaaactttcacttttacctacaccgctttttcacaacccgacaaattatcctacgtaccatcccccac

SEQ ID NO: 6811 - DNA, 667 bp, Artificial Sequence
  chemically treated genomic DNA (Homo sapiens) CpG-island No: 6811
acgatagcgatcgttttaggatgtttcgtgttatagcgaagcgtggaaaaagaattttgagaacgttatcgaggttatacgggttaatcgaaatttttagattttagggttaattgatcgggggttttagaataaaattcgggcgtatacgtcgtgggatgattatcgtttagtttgtcgttaatttcgataaggaatatcgcgttaagatttttcgttatcgttcgtttacgtttttggtattaagattcggataacgagatagtaatttttggttgtgtacgaagtggatttgattcggtaggaacggtgttaggttaaatttttcgttaatcgtagtttcggttgttttaattttcgtttagatcgtttttatcgtgttttttagagtcgagaattgacgtttatcgtcgtttattacgcgtttttagttttattggttaatatagatcgagtgtaacggagaaagacggtttttatcggggcgaagggtttttatgtgcgtgtatagtttttcgttcgcgttgaagtcgtgttgttttaaggtttgacgtttttatttcgttagtgaatgaattatttcgaattgggtattaggtagagtttttatttttatttgtatcgtttttttatagttcgataagttattttgcgtgttattttttat

SEQ ID NO: 6812 - DNA, 667 bp, Artificial Sequence
  chemically treated genomic DNA (Homo sapiens) CpG-island No: 6812
ataaaaaataacacgcaaaataacttatcgaactataaaaaaacgatacaaataaaaataaaaactctacctaatacccaattcgaaataattcattcactaacgaaataaaaacgtcaaaccttaaaacaacacgacttcaacgcgaacgaaaaactatacacgcacataaaaacccttcgccccgataaaaaccgtctttctccgttacactcgatctatattaaccaataaaactaaaaacgcgtaataaacgacgataaacgtcaattctcgactctaaaaaacacgataaaaacgatctaaacgaaaattaaaacaaccgaaactacgattaacgaaaaatttaacctaacaccgttcctaccgaatcaaatccacttcgtacacaaccaaaaattactatctcgttatccgaatcttaataccaaaaacgtaaacgaacgataacgaaaaatcttaacgcgatattccttatcgaaattaacgacaaactaaacgataatcatcccacgacgtatacgcccgaattttattctaaaacccccgatcaattaaccctaaaatctaaaaatttcgattaacccgtataacctcgataacgttctcaaaattctttttccacgcttcgctataacacgaaacatcctaaaacgatcgctatcgt

SEQ ID NO: 6813 - DNA, 566 bp, Artificial Sequence
  chemically treated genomic DNA (Homo sapiens) CpG-island No: 6813
gcgggtttttattaaggttttgcgtaataagaggtttaatttcggacggttttcggatatttttcggtttatattttaggggtttttatttacgtttagtttttttttttatttggttcgtatatattggtattaattttcggtttttaattaaattttttcgattataaaatttataacggaacgtttagggaaagtttattacgttgggcggtataaggttatcgatttatatttacgtcgagggatcgaacgtcgttcgattagttattttcgtcgagtacgtatcgggttttaacgtagaaacgatatacgtattaagataaaaagcgtagcggtatattcgatatagacggatatatttagcgaatagttagacggattagtatacgagattcgttagtagacgtattataacgtcgttatttttacgattggatcgaatttataggtcgtttataacgaaaacgcgcggtaaatattcgagttattattttattattatatttttaatagcgtataagagagaaaaataaaaataagtgataagtaatatgatttttagg

SEQ ID NO: 6814 - DNA, 566 bp, Artificial Sequence
  chemically treated genomic DNA (Homo sapiens) CpG-island No: 6814
cctaaaaatcatattacttatcacttatttttatttttctctcttatacgctattaaaaatataataataaaataataactcgaatatttaccgcgcgttttcgttataaacgacctataaattcgatccaatcgtaaaaataacgacgttataatacgtctactaacgaatctcgtatactaatccgtctaactattcgctaaatatatccgtctatatcgaatataccgctacgctttttatcttaatacgtatatcgtttctacgttaaaacccgatacgtactcgacgaaaataactaatcgaacgacgttcgatccctcgacgtaaatataaatcgataaccttataccgcccaacgtaataaactttccctaaacgttccgttataaattttataatcgaaaaaatttaattaaaaaccgaaaattaataccaatatatacgaaccaaataaaaaaaaaaactaaacgtaaataaaaacccctaaaatataaaccgaaaaatatccgaaaaccgtccgaaattaaacctcttattacgcaaaaccttaataaaaacccgc

SEQ ID NO: 6815 - DNA, 566 bp, Artificial Sequence
  chemically treated genomic DNA (Homo sapiens) CpG-island No: 6815
tttagaagttatgttatttgttatttgtttttgttttttttttttgtgcgttgttgagggtgtggtggtggggtggtggttcgggtgtttgtcgcgcgttttcgttgtgggcggtttgtgggttcggtttagtcgtgggggtggcggcgttgtggtgcgtttgttggcgggtttcgtgtgttggttcgtttggttgttcgttgggtgtgttcgtttgtgtcgggtgtgtcgttgcgttttttgttttggtgcgtgtgtcgtttttgcgttggggttcggtgcgtgttcggcgggggtggttggtcgggcggcgttcgatttttcggcgtgggtgtgggtcggtggttttgtgtcgtttaacgtaatgggttttttttgggcgtttcgttatgggttttgtggtcgggaaaatttggttggaagtcggggattgatattaatgtgtgcgagttaggtaggggaaagagttaggcgtagatgggagtttttggagtgtgagtcggaaagtgttcgaaggtcgttcggggttagattttttgttgcgtagggttttggtgggggttcgt

SEQ ID NO: 6816 - DNA, 566 bp, Artificial Sequence
  chemically treated genomic DNA (Homo sapiens) CpG-island No: 6816
acgaacccccaccaaaaccctacgcaacaaaaaatctaaccccgaacgaccttcgaacactttccgactcacactccaaaaactcccatctacgcctaactctttcccctacctaactcgcacacattaatatcaatccccgacttccaaccaaattttcccgaccacaaaacccataacgaaacgcccaaaaaaaacccattacgttaaacgacacaaaaccaccgacccacacccacgccgaaaaatcgaacgccgcccgaccaaccacccccgccgaacacgcaccgaaccccaacgcaaaaacgacacacgcaccaaaacaaaaaacgcaacgacacacccgacacaaacgaacacacccaacgaacaaccaaacgaaccaacacacgaaacccgccaacaaacgcaccacaacgccgccacccccacgactaaaccgaacccacaaaccgcccacaacgaaaacgcgcgacaaacacccgaaccaccaccccaccaccacaccctcaacaacgcacaaaaaaaaaaaacaaaaacaaataacaaataacataacttctaaa

SEQ ID NO: 6817 - DNA, 507 bp, Artificial Sequence
  chemically treated genomic DNA (Homo sapiens) CpG-island No: 6817
ggtatttcgtttttgttcgcgtcgtgcgtttaacgtgaaggggatttagttttaggttcgcgattttcgtttcggagttcgggttcgtcgtcgtcgtcgtcgtcgttttatttcgtcggtttcgggtttagatcgcgaacgggttcgtttttcgggttttcgcgggtttttaggttagttcgtttttttcgagtttttttaggacgtaggtgaggagtttcgggttttcgattcgttgtttattacgaggagtagtgagttcggagtcgcggtagttttaatttagttatcgtcgttattttcgggtcgtttcggcgttttcggcgttttttcgtaggtttcgttttttaaaggggtcgtatcggaagggttgaagattcgttcggaattatcgtattttcgtttttttttgtcgattatttataggtttttgaggtcgtggagagtaggggatgcgggcgttaaaggggttggttatttttgggtgttcgtttgggagtcgttttt

SEQ ID NO: 6818 - DNA, 507 bp, Artificial Sequence
  chemically treated genomic DNA (Homo sapiens) CpG-island No: 6818
aaaaacgactcccaaacgaacacccaaaaataaccaacccctttaacgcccgcatcccctactctccacgacctcaaaaacctataaataatcgacaaaaaaaaacgaaaatacgataattccgaacgaatcttcaacccttccgatacgacccctttaaaaaacgaaacctacgaaaaaacgccgaaaacgccgaaacgacccgaaaataacgacgataactaaattaaaactaccgcgactccgaactcactactcctcgtaataaacaacgaatcgaaaacccgaaactcctcacctacgtcctaaaaaaactcgaaaaaaacgaactaacctaaaaacccgcgaaaacccgaaaaacgaacccgttcgcgatctaaacccgaaaccgacgaaataaaacgacgacgacgacgacgacgaacccgaactccgaaacgaaaatcgcgaacctaaaactaaatccccttcacgttaaacgcacgacgcgaacaaaaacgaaatacc

SEQ ID NO: 6819 - DNA, 507 bp, Artificial Sequence
  chemically treated genomic DNA (Homo sapiens) CpG-island No: 6819
agaggcggtttttaagcggatatttaggagtggttaatttttttaacgttcgtattttttgttttttacgattttaaaggtttgtaagtggtcgataaaaaggggcggggatgcggtggtttcgggcgggtttttagttttttcggtgcggtttttttaagaggcggggtttgcgggggggcgtcgagaacgtcggggcggttcgaagatggcggcggtggttggattggggttgtcgcggtttcgagtttattgtttttcgtggtgggtagcgagtcgggagttcggggttttttatttacgttttggaggagttcgaaagaggcgggttggtttgggggttcgcgggagttcgggaggcgggttcgttcgcggtttgggttcggggtcggcggggtggggcggcggcggcggcggcggcggattcgggtttcggggcgggggtcgcgggtttggggttgggttttttttacgttaggcgtacgacgcgggtaaaggcggggtgtt

SEQ ID NO: 6820 - DNA, 507 bp, Artificial Sequence
  chemically treated genomic DNA (Homo sapiens) CpG-island No: 6820
aacaccccgcctttacccgcgtcgtacgcctaacgtaaaaaaaacccaaccccaaacccgcgacccccgccccgaaacccgaatccgccgccgccgccgccgccgccccaccccgccgaccccgaacccaaaccgcgaacgaacccgcctcccgaactcccgcgaacccccaaaccaacccgcctctttcgaactcctccaaaacgtaaataaaaaaccccgaactcccgactcgctacccaccacgaaaaacaataaactcgaaaccgcgacaaccccaatccaaccaccgccgccatcttcgaaccgccccgacgttctcgacgcccccccgcaaaccccgcctcttaaaaaaaccgcaccgaaaaaactaaaaacccgcccgaaaccaccgcatccccgcccctttttatcgaccacttacaaacctttaaaatcgtaaaaaacaaaaaatacgaacgttaaaaaaattaaccactcctaaatatccgcttaaaaaccgcctct

SEQ ID NO: 6821 - DNA, 594 bp, Artificial Sequence
  chemically treated genomic DNA (Homo sapiens) CpG-island No: 6821
gtcgttttcgtgtacgttcggttttaggttaggagacgggggatttgggagcggtttttattttcgtttgcggatttttaattattatttggaggggaagtcggggcgtttatcgcgtagttttaattttttgttttttatttttgcgtttcgtcgcgtttttgtttttcgtagtcgtcggggttgtagggtacgtgcgcgtgggaggttgcgcgggttagggtattttagggggtttcgggggtaatatttattttttgagttcgggtcgagtttcgcgttcgtcgttatcgcggtttggtcgttgatatcggagttcgtttcgttttttttttcgcggcgcggcgcggttgtcggcgggtttcgttttcggggcgtggtttagaaagttttattttcgcgacggcgttaggaggtagggcgggttttgatttcgcgcgttttttattgggttatttaggcgtttagtttcgttagtttagcgcgttattggtttagtcgaagattaggtttttttttatgtttttttttttacgtattcgtagtttatttgtataatttaaagagataggcgttattttttcgtttgagatt

SEQ ID NO: 6822 - DNA, 594 bp, Artificial Sequence
  chemically treated genomic DNA (Homo sapiens) CpG-island No: 6822
aatctcaaacgaaaaaataacgcctatctctttaaattatacaaataaactacgaatacgtaaaaaaaaaaacataaaaaaaaacctaatcttcgactaaaccaataacgcgctaaactaacgaaactaaacgcctaaataacccaataaaaaacgcgcgaaatcaaaacccgccctacctcctaacgccgtcgcgaaaataaaactttctaaaccacgccccgaaaacgaaacccgccgacaaccgcgccgcgccgcgaaaaaaaaaacgaaacgaactccgatatcaacgaccaaaccgcgataacgacgaacgcgaaactcgacccgaactcaaaaaataaatattacccccgaaaccccctaaaataccctaacccgcgcaacctcccacgcgcacgtaccctacaaccccgacgactacgaaaaacaaaaacgcgacgaaacgcaaaaataaaaaacaaaaaattaaaactacgcgataaacgccccgacttcccctccaaataataattaaaaatccgcaaacgaaaataaaaaccgctcccaaatcccccgtctcctaacctaaaaccgaacgtacacgaaaacgac

SEQ ID NO: 6823 - DNA, 594 bp, Artificial Sequence
  chemically treated genomic DNA (Homo sapiens) CpG-island No: 6823
agttttaggcgaaagagtggcgtttgtttttttaaattatgtaaatagattgcgggtgcgtaagggggggaatataaaaaggagtttagttttcggttggattaatagcgcgttgagttggcggagttgggcgtttaaatggtttaatggggggcgcgcgggattagagttcgttttgttttttggcgtcgtcgcgggggtgggattttttaggttacgtttcgggggcggagttcgtcggtagtcgcgtcgcgtcgcggagggaggggcggggcgggtttcggtgttagcgattaagtcgcggtggcggcgagcgcggggttcggttcgagtttaggaggtgagtgttgttttcggaattttttgggatattttggttcgcgtagttttttacgcgtacgtgttttgtagtttcggcggttgcggagggtaaaggcgcggcgggacgtagggatggagagtagggggttggggttacgcggtgggcgtttcggttttttttttaagtggtaattgggggttcgtaggcgaaaatggggatcgtttttaaatttttcgttttttggtttagaatcgagcgtgtacgggggcggt

SEQ ID NO: 6824 - DNA, 594 bp, Artificial Sequence
  chemically treated genomic DNA (Homo sapiens) CpG-island No: 6824
accgcccccgtacacgctcgattctaaaccaaaaaacgaaaaatttaaaaacgatccccattttcgcctacgaacccccaattaccacttaaaaaaaaaaccgaaacgcccaccgcgtaaccccaaccccctactctccatccctacgtcccgccgcgcctttaccctccgcaaccgccgaaactacaaaacacgtacgcgtaaaaaactacgcgaaccaaaatatcccaaaaaattccgaaaacaacactcacctcctaaactcgaaccgaaccccgcgctcgccgccaccgcgacttaatcgctaacaccgaaacccgccccgcccctccctccgcgacgcgacgcgactaccgacgaactccgcccccgaaacgtaacctaaaaaatcccacccccgcgacgacgccaaaaaacaaaacgaactctaatcccgcgcgccccccattaaaccatttaaacgcccaactccgccaactcaacgcgctattaatccaaccgaaaactaaactcctttttatattcccccccttacgcacccgcaatctatttacataatttaaaaaaacaaacgccactctttcgcctaaaact

SEQ ID NO: 6825 - DNA, 626 bp, Artificial Sequence
  chemically treated genomic DNA (Homo sapiens) CpG-island No: 6825
gtcgggaatagttagtcggtgtttaacgcgagtgtatttcgagagagaagcgattaatagttgtcggtttgcgtttgcgcgcggcgggggcgtggttcggggcgagtggggtaaaggaggtagtcgggagcggcgggcgtaggtgttattggttgcgtcgggttacgtgggcgcgtaggcgtagcgcggtgtagttcgttcgtttatataaagtttagacgcggagaaaatggcggtaggggtcgaagcggcggcggaggtggcggcgacggagattaaaatggaggaagagagcggcgcgttcggcgtgtcgagcggtaacggggtttcgggttttaaggggtgagtattttacggttttttgttacgggtaagggttttttttcgcggtcgacgcgggcggcggtttcgttaggtttgttggcggtttagtttcggcgcggtttcggtttcgtgttgttttcgtatcgtttgtttagggtagcggcgtttagggtcgtgagcggggagtcgggggagtttttagaatcgttttttatatcgggtttcgagtttcgttatttttagtttttttaggtcggggttaatttcgtagtcgaggttttaggtttagttgttgcgtatgg

SEQ ID NO: 6826 - DNA, 626 bp, Artificial Sequence
  chemically treated genomic DNA (Homo sapiens) CpG-island No: 6826
ccatacgcaacaactaaacctaaaacctcgactacgaaattaaccccgacctaaaaaaactaaaaataacgaaactcgaaacccgatataaaaaacgattctaaaaactcccccgactccccgctcacgaccctaaacgccgctaccctaaacaaacgatacgaaaacaacacgaaaccgaaaccgcgccgaaactaaaccgccaacaaacctaacgaaaccgccgcccgcgtcgaccgcgaaaaaaaacccttacccgtaacaaaaaaccgtaaaatactcaccccttaaaacccgaaaccccgttaccgctcgacacgccgaacgcgccgctctcttcctccattttaatctccgtcgccgccacctccgccgccgcttcgacccctaccgccattttctccgcgtctaaactttatataaacgaacgaactacaccgcgctacgcctacgcgcccacgtaacccgacgcaaccaataacacctacgcccgccgctcccgactacctcctttaccccactcgccccgaaccacgcccccgccgcgcgcaaacgcaaaccgacaactattaatcgcttctctctcgaaatacactcgcgttaaacaccgactaactattcccgac

SEQ ID NO: 6827 - DNA, 626 bp, Artificial Sequence
  chemically treated genomic DNA (Homo sapiens) CpG-island No: 6827
ttatgcgtagtagttgggtttgaggtttcgattacggggttggtttcggtttggagggattgagggtggcgaggttcgaggttcggtgtaggggacgattttggaggttttttcggtttttcgtttacggttttggacgtcgttattttgagtaggcggtacgggaatagtacggggtcgaggtcgcgtcggggttaggtcgttaatagatttaacggagtcgtcgttcgcgtcggtcgcggagaggaatttttattcgtggtaaaggatcgtgggatatttattttttagggttcggagtttcgttgtcgttcggtacgtcgggcgcgtcgttttttttttttattttgattttcgtcgtcgttattttcgtcgtcgtttcgatttttgtcgttatttttttcgcgtttgggttttgtgtgagcgaacgggttgtatcgcgttgcgtttgcgcgtttacgtgattcgacgtaattagtaatatttgcgttcgtcgttttcggttgttttttttgttttattcgtttcgggttacgttttcgtcgcgcgtaggcgtagatcggtagttgttgatcgtttttttttcgagatatattcgcgttaggtatcgattggttgttttcggt

SEQ ID NO: 6828 - DNA, 626 bp, Artificial Sequence
  chemically treated genomic DNA (Homo sapiens) CpG-island No: 6828
accgaaaacaaccaatcgatacctaacgcgaatatatctcgaaaaaaaaacgatcaacaactaccgatctacgcctacgcgcgacgaaaacgtaacccgaaacgaataaaacaaaaaaaacaaccgaaaacgacgaacgcaaatattactaattacgtcgaatcacgtaaacgcgcaaacgcaacgcgatacaacccgttcgctcacacaaaacccaaacgcgaaaaaaataacgacaaaaatcgaaacgacgacgaaaataacgacgacgaaaatcaaaataaaaaaaaaaaacgacgcgcccgacgtaccgaacgacaacgaaactccgaaccctaaaaaataaatatcccacgatcctttaccacgaataaaaattcctctccgcgaccgacgcgaacgacgactccgttaaatctattaacgacctaaccccgacgcgacctcgaccccgtactattcccgtaccgcctactcaaaataacgacgtccaaaaccgtaaacgaaaaaccgaaaaaacctccaaaatcgtcccctacaccgaacctcgaacctcgccaccctcaatccctccaaaccgaaaccaaccccgtaatcgaaacctcaaacccaactactacgcataa

SEQ ID NO: 6829 - DNA, 549 bp, Artificial Sequence
  chemically treated genomic DNA (Homo sapiens) CpG-island No: 6829
atggcgcgggttcggatcggagagttttcgaggtttattcgatcgtttttcgggagggtgatttcgggggtcgggttttagtttttcgtttttttttttttcggggtttgttttttgattcgtaacgtggggggaggagagggggtgcgcgttcgggaggtttcgcgcgtagttagttcgagttaacggtaatcgagcgagggaagcgttaggaagggtcgcgaagtcgggtcggggggttttttttttgtttcgttttttagttttcgcgcgtcgatcgcgtttcgcgggaagtgtttttttcggaatcgtttttcgttttacgttttggttttggtttaagtttttcgtcgtttttcgtttttttttttcgggtgcgtcgtaggtattagtggagagatgggatttgttgtttagcgtttattttcggaagtagatagatacgaagtcgggggaggaattttttttttttcgtgtttcggggaagttgttttgttaggaggcgggtttatttatttttagattttattagtttttcgagttttgttt

SEQ ID NO: 6830 - DNA, 549 bp, Artificial Sequence
  chemically treated genomic DNA (Homo sapiens) CpG-island No: 6830
aaacaaaactcgaaaaactaataaaatctaaaaataaataaacccgcctcctaacaaaacaacttccccgaaacacgaaaaaaaaaaaattcctcccccgacttcgtatctatctacttccgaaaataaacgctaaacaacaaatcccatctctccactaatacctacgacgcacccgaaaaaaaaaaacgaaaaacgacgaaaaacttaaaccaaaaccaaaacgtaaaacgaaaaacgattccgaaaaaaacacttcccgcgaaacgcgatcgacgcgcgaaaactaaaaaacgaaacaaaaaaaaaaccccccgacccgacttcgcgacccttcctaacgcttccctcgctcgattaccgttaactcgaactaactacgcgcgaaacctcccgaacgcgcaccccctctcctccccccacgttacgaatcaaaaaacaaaccccgaaaaaaaaaaaaacgaaaaactaaaacccgacccccgaaatcaccctcccgaaaaacgatcgaataaacctcgaaaactctccgatccgaacccgcgccat

SEQ ID NO: 6831 - DNA, 549 bp, Artificial Sequence
  chemically treated genomic DNA (Homo sapiens) CpG-island No: 6831
aagtaggattcgaaaagttgatgaagtttggaagtaaatgaattcgttttttgatagaatagttttttcgaaatacgggaaaaaggggatttttttttcgatttcgtatttgtttgttttcgagggtgaacgttaagtagtagattttatttttttattaatatttgcggcgtattcggggaggaggagcgggaaacggcgagggatttgagttagggttagagcgtggggcgaggggcggtttcgagggaggtatttttcgcggagcgcggtcggcgcgcggggattaaggggcggggtaggaggggagtttttcgattcggtttcgcggttttttttgacgtttttttcgttcggttatcgttgattcgggttgattgcgcgcgaggtttttcgggcgcgtatttttttttttttttttacgttacggattagaaaatagatttcgggaggagaggggacggggggttgaaattcggttttcgaggttattttttcggggagcggtcgggtaggtttcggaggtttttcggttcgggttcgcgttat

SEQ ID NO: 6832 - DNA, 549 bp, Artificial Sequence
  chemically treated genomic DNA (Homo sapiens) CpG-island No: 6832
ataacgcgaacccgaaccgaaaaacctccgaaacctacccgaccgctccccgaaaaaataacctcgaaaaccgaatttcaaccccccgtcccctctcctcccgaaatctattttctaatccgtaacgtaaaaaaaaaaaaaaaaatacgcgcccgaaaaacctcgcgcgcaatcaacccgaatcaacgataaccgaacgaaaaaaacgtcaaaaaaaaccgcgaaaccgaatcgaaaaactcccctcctaccccgccccttaatccccgcgcgccgaccgcgctccgcgaaaaatacctccctcgaaaccgcccctcgccccacgctctaaccctaactcaaatccctcgccgtttcccgctcctcctccccgaatacgccgcaaatattaataaaaaaataaaatctactacttaacgttcaccctcgaaaacaaacaaatacgaaatcgaaaaaaaaatcccctttttcccgtatttcgaaaaaactattctatcaaaaaacgaattcatttacttccaaacttcatcaacttttcgaatcctactt

SEQ ID NO: 6833 - DNA, 579 bp, Artificial Sequence
  chemically treated genomic DNA (Homo sapiens) CpG-island No: 6833
tggagcgtatgggcgcgggtttgggttacggtatggatcgcgtgggtttcgagatcgagcgtatgggtttggttatggatcgtatgggtttcgtggagcgtatgggtttcggtattgagcgtatgggttcgttgggtttcgattatatggtttttagtattgagcgtatgggttagattatggagcgtattggttttggcgtggagcgtatgggtgtcggtatgggtttcggttttgagcgtatggtcgtttttatcgatcgtgtgggttagattattgagcgtatgggttttggcgtggagcgtatgggttttgttatcgagcgtatgggtttgagtatggagcgtatggtgttcgtaggtatgggagttggtttggagcgtatgggtttcgtgatggatcgtatggttatcggtttggagcgtatgggcgttaataatttggagcggatgggtttggagcgtatgggcgttaatagtttcgagcgtatgggtttggagcgtatgggtgttaatagtttcgagcgtatgggtttcgttatgggttcggttttgggcgttggtattgagcgtatgggtt

SEQ ID NO: 6834 - DNA, 579 bp, Artificial Sequence
  chemically treated genomic DNA (Homo sapiens) CpG-island No: 6834
aacccatacgctcaataccaacgcccaaaaccgaacccataacgaaacccatacgctcgaaactattaacacccatacgctccaaacccatacgctcgaaactattaacgcccatacgctccaaacccatccgctccaaattattaacgcccatacgctccaaaccgataaccatacgatccatcacgaaacccatacgctccaaaccaactcccatacctacgaacaccatacgctccatactcaaacccatacgctcgataacaaaacccatacgctccacgccaaaacccatacgctcaataatctaacccacacgatcgataaaaacgaccatacgctcaaaaccgaaacccataccgacacccatacgctccacgccaaaaccaatacgctccataatctaacccatacgctcaatactaaaaaccatataatcgaaacccaacgaacccatacgctcaataccgaaacccatacgctccacgaaacccatacgatccataaccaaacccatacgctcgatctcgaaacccacgcgatccataccgtaacccaaacccgcgcccatacgctcca

SEQ ID NO: 6835 - DNA, 579 bp, Artificial Sequence
  chemically treated genomic DNA (Homo sapiens) CpG-island No: 6835
ggtttatgcgtttaatgttagcgtttagggtcgggtttatggcggggtttatgcgttcgaggttgttggtatttatgcgttttaggtttatgcgttcgaggttgttggcgtttatgcgttttaggtttattcgttttagattgttggcgtttatgcgttttaggtcggtggttatgcgatttattacggggtttatgcgttttaggttagtttttatatttgcgggtattatgcgttttatgtttaggtttatgcgttcgatggtagggtttatgcgttttacgttagagtttatgcgtttaatggtttggtttatacggtcgatgggagcggttatgcgtttaaggtcgaagtttatgtcggtatttatgcgttttacgttagagttaatgcgttttatggtttggtttatgcgtttaatgttggaggttatgtggtcgaggtttagcgggtttatgcgtttaatgtcggagtttatgcgttttacggagtttatgcggtttatgattaggtttatgcgttcgatttcggagtttacgcgatttatgtcgtggtttaggttcgcgtttatgcgtttta

SEQ ID NO: 6836 - DNA, 579 bp, Artificial Sequence
  chemically treated genomic DNA (Homo sapiens) CpG-island No: 6836
taaaacgcataaacgcgaacctaaaccacgacataaatcgcgtaaactccgaaatcgaacgcataaacctaatcataaaccgcataaactccgtaaaacgcataaactccgacattaaacgcataaacccgctaaacctcgaccacataacctccaacattaaacgcataaaccaaaccataaaacgcattaactctaacgtaaaacgcataaataccgacataaacttcgaccttaaacgcataaccgctcccatcgaccgtataaaccaaaccattaaacgcataaactctaacgtaaaacgcataaaccctaccatcgaacgcataaacctaaacataaaacgcataatacccgcaaatataaaaactaacctaaaacgcataaaccccgtaataaatcgcataaccaccgacctaaaacgcataaacgccaacaatctaaaacgaataaacctaaaacgcataaacgccaacaacctcgaacgcataaacctaaaacgcataaataccaacaacctcgaacgcataaaccccgccataaacccgaccctaaacgctaacattaaacgcataaacc

SEQ ID NO: 6837 - DNA, 663 bp, Artificial Sequence
  chemically treated genomic DNA (Homo sapiens) CpG-island No: 6837
  misc_feature (362)..(362): n is either a, c, g or t
tcgagaagttgtcgtttatgtttagtacgcgttatttcggttcgtcgggtaattttttcggttaaatagcgttatggcgtttttttgtttggcggtttcgatgtcggttttttcggtttttatcggggtgtttttgcgaatttcggcgttgacgatgttttttagggtttttaattgtttaggtttgaatcgggttttcgaaatgattgaagttaaaacgtaggcgttggttatttattaacgaatttttttgttgtatatgtttatttaatatttgacgtaacgcggcgtgtagtaagtgagtggtcgacgtggtttaacgcggttgtatgtcgtacgtcggtatttatttgaagtgtttnatcggcgcgttcgacggttaggttatttagtattagtacgtcgtgatgtaggaacgtatcgtcggttttggtggtgtcgcgtattttaaaacgatcggaggtggagtttaggaaatcgtagttatcgatttggtcgtcggatttagcgtagaacggggtttgatttaggattataacgttttcgttattttcgtttagtacgtcgatcgatttgttttttttatagatagttacgattttggtcgagttaacggtggttttataattaatgaacgaagtcgttatattaatttttattagg

SEQ ID NO: 6838 - DNA, 663 bp, Artificial Sequence
  chemically treated genomic DNA (Homo sapiens) CpG-island No: 6838
  misc_feature (302)..(302): n is either a, c, g or t
cctaataaaaattaatataacgacttcgttcattaattataaaaccaccgttaactcgaccaaaatcgtaactatctataaaaaaaacaaatcgatcgacgtactaaacgaaaataacgaaaacgttataatcctaaatcaaaccccgttctacgctaaatccgacgaccaaatcgataactacgatttcctaaactccacctccgatcgttttaaaatacgcgacaccaccaaaaccgacgatacgttcctacatcacgacgtactaatactaaataacctaaccgtcgaacgcgccgatnaaacacttcaaataaataccgacgtacgacatacaaccgcgttaaaccacgtcgaccactcacttactacacgccgcgttacgtcaaatattaaataaacatatacaacaaaaaaattcgttaataaataaccaacgcctacgttttaacttcaatcatttcgaaaacccgattcaaacctaaacaattaaaaaccctaaaaaacatcgtcaacgccgaaattcgcaaaaacaccccgataaaaaccgaaaaaaccgacatcgaaaccgccaaacaaaaaaacgccataacgctatttaaccgaaaaaattacccgacgaaccgaaataacgcgtactaaacataaacgacaacttctcga

SEQ ID NO: 6839 - DNA, 663 bp, Artificial Sequence
  chemically treated genomic DNA (Homo sapiens) CpG-island No: 6839
  misc_feature (302)..(302): n is either a, c, g or t
tttggtaaaggttgatgtagcgatttcgtttattggttatgaagttatcgttggttcggttaagatcgtggttatttataaggaaggtaagtcggtcgacgtgttgaacgaaggtgacgagggcgttgtagttttggattagatttcgttttacgttgaattcggcggttaggtcggtgattgcggttttttgagttttattttcggtcgttttgaagtgcgcgatattattaagatcggcggtgcgtttttgtattacggcgtgttggtgttgggtaatttgatcgtcgggcgcgtcggtnggatattttaggtagatgtcgacgtacggtatgtaatcgcgttgaattacgtcggttatttatttgttgtacgtcgcgttgcgttaggtgttgggtgagtatgtgtagtagaagggttcgttggtggatagttagcgtttgcgttttgattttagttatttcgagggttcgatttaagtttgagtagttgaaggttttggaagatatcgttaacgtcgagattcgtaagaatatttcggtggaaatcgaagaaatcgatatcgagatcgttaagtaaaaaggcgttatggcgttgtttggtcgaggaagttattcggcggatcgaagtggcgcgtattgagtatgggcggtagtttttcgg

SEQ ID NO: 6840 - DNA, 663 bp, Artificial Sequence
  chemically treated genomic DNA (Homo sapiens) CpG-island No: 6840
  misc_feature (362)..(362): n is either a, c, g or t
ccgaaaaactaccgcccatactcaatacgcgccacttcgatccgccgaataacttcctcgaccaaacaacgccataacgcctttttacttaacgatctcgatatcgatttcttcgatttccaccgaaatattcttacgaatctcgacgttaacgatatcttccaaaaccttcaactactcaaacttaaatcgaaccctcgaaataactaaaatcaaaacgcaaacgctaactatccaccaacgaacccttctactacacatactcacccaacacctaacgcaacgcgacgtacaacaaataaataaccgacgtaattcaacgcgattacataccgtacgtcgacatctacctaaaatatccnaccgacgcgcccgacgatcaaattacccaacaccaacacgccgtaatacaaaaacgcaccgccgatcttaataatatcgcgcacttcaaaacgaccgaaaataaaactcaaaaaaccgcaatcaccgacctaaccgccgaattcaacgtaaaacgaaatctaatccaaaactacaacgccctcgtcaccttcgttcaacacgtcgaccgacttaccttccttataaataaccacgatcttaaccgaaccaacgataacttcataaccaataaacgaaatcgctacatcaacctttaccaaa

SEQ ID NO: 6841 - DNA, 624 bp, Artificial Sequence
  chemically treated genomic DNA (Homo sapiens) CpG-island No: 6841
ttcgagcgatgattgttttttcgaatttgattatgagcgtggtgtttttgtgttagtgcgtcgtgattttggtagggaagtcgttgtgtgtgagtatcgtttttacgatgttcgtcgtgaagttggcgtagttgagcgtgttgttttttttgggtacggagatgtaggtgttgatgagcggttcgcgttcgatgatgtagaaggtgcgcgcgttatcgttggtttgttttagtttgttcgtttttttgtcgaagagcgttttttatacggcgtttttgacgaagagtaacgcgtttagtattttggttttacgtcgggtatttttttcgcgcgttattagcgtatttagtacgcgcgcgtttatttggcggtttagcgcggttaggcgcgattgtagttcggttacggagaagacgcggttttggtagtgttgtattagttcggagaatagtagtgcgaaggcgtttaggtttatttcggtgcgcggtcgcgttagcgcgcgttttagtagcgtcgatttttcgcgcgtgaagcgcgtttttatgtcgtcgttattttgcggggagattaggaagtgtaggtgttaggggtaatgggaaggggagtaggtcgggaggaaaggag

SEQ ID NO: 6842 - DNA, 624 bp, Artificial Sequence
  chemically treated genomic DNA (Homo sapiens) CpG-island No: 6842
ctcctttcctcccgacctactccccttcccattacccctaacacctacacttcctaatctccccgcaaaataacgacgacataaaaacgcgcttcacgcgcgaaaaatcgacgctactaaaacgcgcgctaacgcgaccgcgcaccgaaataaacctaaacgccttcgcactactattctccgaactaatacaacactaccaaaaccgcgtcttctccgtaaccgaactacaatcgcgcctaaccgcgctaaaccgccaaataaacgcgcgcgtactaaatacgctaataacgcgcgaaaaaaatacccgacgtaaaaccaaaatactaaacgcgttactcttcgtcaaaaacgccgtataaaaaacgctcttcgacaaaaaaacgaacaaactaaaacaaaccaacgataacgcgcgcaccttctacatcatcgaacgcgaaccgctcatcaacacctacatctccgtacccaaaaaaaacaacacgctcaactacgccaacttcacgacgaacatcgtaaaaacgatactcacacacaacgacttccctaccaaaatcacgacgcactaacacaaaaacaccacgctcataatcaaattcgaaaaaacaatcatcgctcgaa

SEQ ID NO: 6843 - DNA, 624 bp, Artificial Sequence
  chemically treated genomic DNA (Homo sapiens) CpG-island No: 6843
ttttttttttttcggtttgtttttttttttattgtttttgatatttgtattttttggttttttcgtagggtggcggcggtatggaggcgcgttttacgcgcgggaagtcggcgttgttggagcgcgcgttggcgcggtcgcgtatcgaggtgagtttgagcgttttcgtattgttgtttttcgagttggtatagtattgttagagtcgcgtttttttcgtggtcgagttgtagtcgcgtttggtcgcgttgggtcgttaggtgggcgcgcgcgtgttggatgcgttggtggcgcgcgaaaagggtgttcggcgtgagattaaggtgttaggcgcgttgtttttcgttaagggcgtcgtgtggaaggcgtttttcggtaaggaggcggataagttggagtaggttaacgatgacgcgcgtattttttatattatcgagcgcgagtcgtttattaatatttatattttcgtgtttaaggagaatagtacgtttaattgcgttagttttacggcgggtatcgtggaggcggtgtttatatatagcggtttttttgttaaggttacggcgtattggtataagggtattacgtttatgattaagttcgaggaggtagttatcgttcgag

SEQ ID NO: 6844 - DNA, 624 bp, Artificial Sequence
  chemically treated genomic DNA (Homo sapiens) CpG-island No: 6844
ctcgaacgataactacctcctcgaacttaatcataaacgtaatacccttataccaatacgccgtaaccttaacaaaaaaaccgctatatataaacaccgcctccacgatacccgccgtaaaactaacgcaattaaacgtactattctccttaaacacgaaaatataaatattaataaacgactcgcgctcgataatataaaaaatacgcgcgtcatcgttaacctactccaacttatccgcctccttaccgaaaaacgccttccacacgacgcccttaacgaaaaacaacgcgcctaacaccttaatctcacgccgaacacccttttcgcgcgccaccaacgcatccaacacgcgcgcgcccacctaacgacccaacgcgaccaaacgcgactacaactcgaccacgaaaaaaacgcgactctaacaatactataccaactcgaaaaacaacaatacgaaaacgctcaaactcacctcgatacgcgaccgcgccaacgcgcgctccaacaacgccgacttcccgcgcgtaaaacgcgcctccataccgccgccaccctacgaaaaaaccaaaaaatacaaatatcaaaaacaataaaaaaaaaaacaaaccgaaaaaaaaaaaa

SEQ ID NO: 6845 - DNA, 508 bp, Artificial Sequence
  chemically treated genomic DNA (Homo sapiens) CpG-island No: 6845
gacggggtgtatgatcggggtcgggggttagtatttaggacggggtcggggtcgggggacgcggttagggtttagggtcggggtcgcgtcgggtttttatcgcgtttacgtagttttcgtagggcgtttttttgttttattagtttcgtttgcgtttttttaagtttcgcgcgcgtggtttgtagttgcgtttgcgttttcgagtttgggagtcgtagggtgagaggggcgagggcggcgaggatggggcgggatttcggagattagttttcgtttcgtattattcgtcgtaggttttcgtttcggttttttttttatcgcggtcgtaagattttatttttgcgtttatagtttcgatcgcgtttttttatagtagttgtggtagttttcgatttttttttttagggtatttagcgtcgtcgtttgtttcgaggttggaacgattttcgttttaaaatgtatgtttttcgggttatttgggaggatttaggggatttttttttagttt

SEQ ID NO: 6846 - DNA, 508 bp, Artificial Sequence
  chemically treated genomic DNA (Homo sapiens) CpG-island No: 6846
aaactaaaaaaaaatcccctaaatcctcccaaataacccgaaaaacatacattttaaaacgaaaatcgttccaacctcgaaacaaacgacgacgctaaataccctaaaaaaaaaaatcgaaaactaccacaactactataaaaaaacgcgatcgaaactataaacgcaaaaataaaatcttacgaccgcgataaaaaaaaaaccgaaacgaaaacctacgacgaataatacgaaacgaaaactaatctccgaaatcccgccccatcctcgccgccctcgcccctctcaccctacgactcccaaactcgaaaacgcaaacgcaactacaaaccacgcgcgcgaaacttaaaaaaacgcaaacgaaactaataaaacaaaaaaacgccctacgaaaactacgtaaacgcgataaaaacccgacgcgaccccgaccctaaaccctaaccgcgtcccccgaccccgaccccgtcctaaatactaacccccgaccccgatcatacaccccgtc

SEQ ID NO: 6847 - DNA, 508 bp, Artificial Sequence
  chemically treated genomic DNA (Homo sapiens) CpG-island No: 6847
aggttggaagggggttttttgagtttttttaagtgattcgaggggtatgtattttggggcgggggtcgttttagtttcgaagtagacggcggcgttgggtgttttgaaggaggaggtcggagattgttatagttgttgtgagggggcgcggtcgaggttgtgggcgtagggatggggttttgcggtcgcgatgggaggggggtcggggcggaggtttgcggcgggtggtgcggggcgggggttggttttcgaagtttcgttttattttcgtcgttttcgttttttttattttgcggtttttaggttcggggacgtaggcgtagttgtagattacgcgcgcggagtttggggaggcgtaggcgaagttgatggagtaggagagcgttttgcgggaattgcgtgagcgcggtgagggttcgacgcgatttcggttttgagttttggtcgcgtttttcgatttcgatttcgttttgagtgttgattttcgatttcgattatgtatttcgtt

SEQ ID NO: 6848 - DNA, 508 bp, Artificial Sequence
  chemically treated genomic DNA (Homo sapiens) CpG-island No: 6848
aacgaaatacataatcgaaatcgaaaatcaacactcaaaacgaaatcgaaatcgaaaaacgcgaccaaaactcaaaaccgaaatcgcgtcgaaccctcaccgcgctcacgcaattcccgcaaaacgctctcctactccatcaacttcgcctacgcctccccaaactccgcgcgcgtaatctacaactacgcctacgtccccgaacctaaaaaccgcaaaataaaaaaaacgaaaacgacgaaaataaaacgaaacttcgaaaaccaacccccgccccgcaccacccgccgcaaacctccgccccgacccccctcccatcgcgaccgcaaaaccccatccctacgcccacaacctcgaccgcgccccctcacaacaactataacaatctccgacctcctccttcaaaacacccaacgccgccgtctacttcgaaactaaaacgacccccgccccaaaatacatacccctcgaatcacttaaaaaaactcaaaaaacccccttccaacct

SEQ ID NO: 6849 - DNA, 1164 bp, Artificial Sequence
  chemically treated genomic DNA (Homo sapiens) CpG-island No: 6849
gttcgtagcgcggttagggtcgacgcggggtgtgtgttggggtttgggggtcgtgcggtggtggagatcggagcgttcgagattttttagcgaggtcggggtttgggtttttagggtgtgtggcgggggaagagatcgagaggagattttcgtaggggcgtgatgtgtgtaaaagagaagaaggcgtgtaagggaaggttttgggggtgcgggaggcgggaacgagaggttcgtacggggagattttattcggttcgtagatttcgttcggtttatttggaggtttggacgtcggggattttcgcgcggagttgggtcgcgggttttatttttatcgcgttttcgtagtcggcggggtaaagtttatcgttcgggtcgagtaggaagttcggaggtttcggcgcggtaggggttcgagttcggggattttcggcggtcggcgttattgtttttacggttttttgttttttcggttcggcgtttcgtttttttttagtatttgtcgcgttcggttcgtcgttttcgatttcggtttttcgagtttcggtatttgcgttttcgaacgcggttcgtagtatttacgttaggttggtcgtcgttttggttcgcgagaaatcgtattggtttagcgatttgatttcgggtattagaaaggtttttcgtagcggtttcgggttcggggggcgtcgtttttattatggcggcgtcgggattgcgggcgtcgggttcgcgttcggattgggtttgggttgggttgcgtcgcgttcgcgttttagtcgggttcgttgttgttatcgtcgttgtcgtcgtcgtcgtcgtcgtcgttgttgagttaggtgcggtcgtttgcgttggcgacgttgcgtcgggttcgtttcggggaggagtttaggtgcgtttcgttttcgaattcggattcggattttggcgcgtttttgcgtttcgttcgggttttttattgtagtgtgtacggagtagtaggggcggggcggaggggggcggtttggattgcggcgatggtggagggagtttgcggaggattgagtgtgtatgtgtgcgcgcgcgcgtgtgtgagtgtgtgcgcgcgcgtttagtttattggaaaggattagggattttttgtgtgtgttagttttagtgtttatttttaggcgtaggagtttt

SEQ ID NO: 6850 - DNA, 1164 bp, Artificial Sequence
  chemically treated genomic DNA (Homo sapiens) CpG-island No: 6850
aaaactcctacgcctaaaaataaacactaaaactaacacacacaaaaaatccctaatcctttccaataaactaaacgcgcgcgcacacactcacacacgcgcgcgcgcacacatacacactcaatcctccgcaaactccctccaccatcgccgcaatccaaaccgcccccctccgccccgcccctactactccgtacacactacaataaaaaacccgaacgaaacgcaaaaacgcgccaaaatccgaatccgaattcgaaaacgaaacgcacctaaactcctccccgaaacgaacccgacgcaacgtcgccaacgcaaacgaccgcacctaactcaacaacgacgacgacgacgacgacgacaacgacgataacaacaacgaacccgactaaaacgcgaacgcgacgcaacccaacccaaacccaatccgaacgcgaacccgacgcccgcaatcccgacgccgccataataaaaacgacgccccccgaacccgaaaccgctacgaaaaacctttctaatacccgaaatcaaatcgctaaaccaatacgatttctcgcgaaccaaaacgacgaccaacctaacgtaaatactacgaaccgcgttcgaaaacgcaaataccgaaactcgaaaaaccgaaatcgaaaacgacgaaccgaacgcgacaaatactaaaaaaaaacgaaacgccgaaccgaaaaaacaaaaaaccgtaaaaacaataacgccgaccgccgaaaatccccgaactcgaacccctaccgcgccgaaacctccgaacttcctactcgacccgaacgataaactttaccccgccgactacgaaaacgcgataaaaataaaacccgcgacccaactccgcgcgaaaatccccgacgtccaaacctccaaataaaccgaacgaaatctacgaaccgaataaaatctccccgtacgaacctctcgttcccgcctcccgcacccccaaaaccttcccttacacgccttcttctcttttacacacatcacgcccctacgaaaatctcctctcgatctcttcccccgccacacaccctaaaaacccaaaccccgacctcgctaaaaaatctcgaacgctccgatctccaccaccgcacgacccccaaaccccaacacacaccccgcgtcgaccctaaccgcgctacgaac

SEQ ID NO: 6851 - DNA, 1164 bp, Artificial Sequence
  chemically treated genomic DNA (Homo sapiens) CpG-island No: 6851
ggagtttttacgtttaagggtagatattggggttggtatatatagagggtttttaattttttttagtaagttaggcgcgcgcgtatatatttatatacgcgcgcgcgtatatatatatatttagtttttcgtaagttttttttattatcgtcgtagtttaggtcgttttttttcgtttcgtttttgttgtttcgtgtatattgtagtgaggggttcgggcggggcgtaggggcgcgttagggttcgggttcgggttcgggggcggggcgtatttgggttttttttcggggcgggttcgacgtagcgtcgttagcgtaagcggtcgtatttggtttagtagcggcggcggcggcggcggcggtagcggcggtagtagtagcgggttcggttggggcgcgagcgcggcgtagtttagtttaggtttagttcgagcgcggattcggcgttcgtagtttcggcgtcgttatggtggaggcggcgtttttcgggttcgggatcgttgcggaggatttttttagtgttcgagattaagtcgttggattagtacgatttttcgcgggttaaggcggcggttagtttggcgtgggtgttgcgggtcgcgttcgggggcgtaggtatcggggttcgggggatcggggtcgggggcggcgggtcgggcgcggtaggtgttgggggggggcggggcgtcgggtcgggaaggtagggggtcgtgggaataatagcgtcggtcgtcgggggttttcgggttcgggtttttgtcgcgtcggggttttcgagttttttgttcggttcgggcggtggattttgtttcgtcggttgcgggagcgcggtgggggtggggttcgcggtttagtttcgcgcgggggttttcggcgtttaagtttttaggtgagtcgggcggggtttgcgggtcgggtggggttttttcgtgcggatttttcgttttcgtttttcgtatttttaaggtttttttttgtacgttttttttttttttatatatattacgtttttgcgaggattttttttcggttttttttttcgttatatattttggagatttagatttcgatttcgttggggggtttcgagcgtttcggtttttattatcgtacgatttttaggttttaatatatatttcgcgtcggttttggtcgcgttgcgggt

SEQ ID NO: 6852 - DNA, 1164 bp, Artificial Sequence
  chemically treated genomic DNA (Homo sapiens) CpG-island No: 6852
acccgcaacgcgaccaaaaccgacgcgaaatatatattaaaacctaaaaatcgtacgataataaaaaccgaaacgctcgaaaccccccaacgaaatcgaaatctaaatctccaaaatatataacgaaaaaaaaaaccgaaaaaaaatcctcgcaaaaacgtaatatatataaaaaaaaaaaaaacgtacaaaaaaaaaccttaaaaatacgaaaaacgaaaacgaaaaatccgcacgaaaaaaccccacccgacccgcaaaccccgcccgactcacctaaaaacttaaacgccgaaaacccccgcgcgaaactaaaccgcgaaccccacccccaccgcgctcccgcaaccgacgaaacaaaatccaccgcccgaaccgaacaaaaaactcgaaaaccccgacgcgacaaaaacccgaacccgaaaacccccgacgaccgacgctattattcccacgaccccctaccttcccgacccgacgccccgcccccccccaacacctaccgcgcccgacccgccgcccccgaccccgatcccccgaaccccgatacctacgcccccgaacgcgacccgcaacacccacgccaaactaaccgccgccttaacccgcgaaaaatcgtactaatccaacgacttaatctcgaacactaaaaaaatcctccgcaacgatcccgaacccgaaaaacgccgcctccaccataacgacgccgaaactacgaacgccgaatccgcgctcgaactaaacctaaactaaactacgccgcgctcgcgccccaaccgaacccgctactactaccgccgctaccgccgccgccgccgccgccgctactaaaccaaatacgaccgcttacgctaacgacgctacgtcgaacccgccccgaaaaaaaacccaaatacgccccgcccccgaacccgaacccgaaccctaacgcgcccctacgccccgcccgaacccctcactacaatatacacgaaacaacaaaaacgaaacgaaaaaaaacgacctaaactacgacgataataaaaaaaacttacgaaaaactaaatatatatatatacgcgcgcgcgtatataaatatatacgcgcgcgcctaacttactaaaaaaaattaaaaaccctctatatataccaaccccaatatctacccttaaacgtaaaaactcc

SEQ ID NO: 6853 - DNA, 737 bp, Artificial Sequence
  chemically treated genomic DNA (Homo sapiens) CpG-island No: 6853
  misc_feature (660)..(660): n is either a, c, g or t
cgcgttggtggaaatcgttataattgcgtatatcgttaagtgaggtcgcgatgaaatttttatttttattttttttttatgttgatgcgttcgtagtggtgttgatttcgggttttgggggtagcggtagttattggttatcgtaattggcggtgttggagtaggagtattaggtagtttgttacgattagcgcggtatcggtaataatttcgatacgttggtagaagattatagtatcgtttagatggtagcggaattgtattaggcgttggtagtcgtagggattgagtattacgtagtggtcggttatgcgttcggtgcgttggtgggaatgtagttggcgttggattatttcgcgtcggtaattgtgttgattagcgttaacggttggttacgaataaacgtttatacgcgtcgttgtttttaggttcgcgaacgattattgtatagcggcggcgcgtaggtatgggtggaagcgtagtcgttgtttttttatttcgtcgattggatggcggttcgcgtatttcgtttggaggtagaagacgcgttggtattggcgtatttttagggtaaaaataatttattgcgtcgatttaacgtttttaaacgcgttgattttagttattatgcggatcgtattcgttgttcggtgtaaatantttgcgttagtgatgatttgttggtgttaatagtatgttttagtgaattttatgtcgttttgttcgatagttagaaa

SEQ ID NO: 6854 - DNA, 737 bp, Artificial Sequence
  chemically treated genomic DNA (Homo sapiens) CpG-island No: 6854
  misc_feature (78)..(78): n is either a, c, g or t
tttctaactatcgaacaaaacgacataaaattcactaaaacatactattaacaccaacaaatcatcactaacgcaaantatttacaccgaacaacgaatacgatccgcataataactaaaatcaacgcgtttaaaaacgttaaatcgacgcaataaattatttttaccctaaaaatacgccaataccaacgcgtcttctacctccaaacgaaatacgcgaaccgccatccaatcgacgaaataaaaaaacaacgactacgcttccacccatacctacgcgccgccgctatacaataatcgttcgcgaacctaaaaacaacgacgcgtataaacgtttattcgtaaccaaccgttaacgctaatcaacacaattaccgacgcgaaataatccaacgccaactacattcccaccaacgcaccgaacgcataaccgaccactacgtaatactcaatccctacgactaccaacgcctaatacaattccgctaccatctaaacgatactataatcttctaccaacgtatcgaaattattaccgataccgcgctaatcgtaacaaactacctaatactcctactccaacaccgccaattacgataaccaataactaccgctacccccaaaacccgaaatcaacaccactacgaacgcatcaacataaaaaaaaaataaaaataaaaatttcatcgcgacctcacttaacgatatacgcaattataacgatttccaccaacgcg

SEQ ID NO: 6855 - DNA, 737 bp, Artificial Sequence
  chemically treated genomic DNA (Homo sapiens) CpG-island No: 6855
  misc_feature (78)..(78): n is either a, c, g or t
tttttggttatcgggtagggcggtatgaagtttattggaatatgttgttggtattagtagattattattggcgtagantatttgtatcgggtagcggatgcgattcgtatggtgattaaagttagcgcgtttgagggcgttaagtcgacgtagtaaattatttttgttttgaaaatgcgttagtgttagcgcgttttttgtttttaggcgaggtgcgcgggtcgttatttagtcggcgggatagaggaataacggttgcgtttttatttatgtttgcgcgtcgtcgttatatagtaatcgttcgcgaatttgaaaatagcggcgcgtatgggcgtttattcgtagttagtcgttaacgttgattagtatagttatcgacgcgggataatttagcgttagttgtatttttattagcgtatcgagcgtatggtcgattattgcgtaatgtttaatttttgcggttattagcgtttgatgtagtttcgttgttatttgggcgatattgtaattttttgttagcgtgtcgggattattgtcggtgtcgcgttggtcgtaatagattatttgatatttttgttttagtatcgttagttgcggtaattagtaattgtcgttatttttaagattcgaaattaatattattacgggcgtattagtataagggggaggtgagagtgaaagttttatcgcggttttatttggcgatatgcgtaattgtggcgatttttattagcgcg

SEQ ID NO: 6856 - DNA, 737 bp, Artificial Sequence
  chemically treated genomic DNA (Homo sapiens) CpG-island No: 6856
  misc_feature (660)..(660): n is either a, c, g or t
cgcgctaataaaaatcgccacaattacgcatatcgccaaataaaaccgcgataaaactttcactctcacctcccccttatactaatacgcccgtaataatattaatttcgaatcttaaaaataacgacaattactaattaccgcaactaacgatactaaaacaaaaatatcaaataatctattacgaccaacgcgacaccgacaataatcccgacacgctaacaaaaaattacaatatcgcccaaataacaacgaaactacatcaaacgctaataaccgcaaaaattaaacattacgcaataatcgaccatacgctcgatacgctaataaaaatacaactaacgctaaattatcccgcgtcgataactatactaatcaacgttaacgactaactacgaataaacgcccatacgcgccgctattttcaaattcgcgaacgattactatataacgacgacgcgcaaacataaataaaaacgcaaccgttattcctctatcccgccgactaaataacgacccgcgcacctcgcctaaaaacaaaaaacgcgctaacactaacgcattttcaaaacaaaaataatttactacgtcgacttaacgccctcaaacgcgctaactttaatcaccatacgaatcgcatccgctacccgatacaaatantctacgccaataataatctactaataccaacaacatattccaataaacttcataccgccctacccgataaccaaaaa

SEQ ID NO: 6857 - DNA, 734 bp, Artificial Sequence
  chemically treated genomic DNA (Homo sapiens) CpG-island No: 6857
  misc_feature (475)..(476): n is either a, c, g or t
gtttcgtagagttgatcgaaaaattggttgcggttattaagagcggtaaatacgatattattatttgtaattattcgaacggcgatatggtaggttatatcggggtgatggaagcggcggttaaagcggttgaagcgttggattattgcgtggaagaagtcgcgaaagcggttgagttcgtgggtggataattgttgattatcgttgattacggtaacgttgagtagatgcgcgattcggtaacgggttaggtatatacggtatatattaatttgttagtttcgttgatttacgttggtgataagaacgtgaaagcggttgaaggcggtaaattttttgatatcgcgtcgattatgttgtcgttgatgggtatggaaatttcgtaagagatgattggtaagtcgttgtttatcgtggaataatttttttttatgaggggaaaggcgattaatattatgatacgggtcgtgaaatnncgcgtaggtttgtaattagggttattatttacgttagcgtttttagcgttggcgtattgttgtgcgtttttttcgcgtacgcggatgagcgtgattaatttaaatttatttaggttgatatcgtcgtaaaagagcgcgcggtacgttaaaagtaataataacgcgtaagtttgttcgtataattgaaaaagtaggaagaagcgatttttgaagttattcgtaagttgcgcgaaacgtaaaatacgtttaattaattta

SEQ ID NO: 6858 - DNA, 734 bp, Artificial Sequence
  chemically treated genomic DNA (Homo sapiens) CpG-island No: 6858
  misc_feature (259)..(260): n is either a, c, g or t
taaattaattaaacgtattttacgtttcgcgcaacttacgaataacttcaaaaatcgcttcttcctactttttcaattatacgaacaaacttacgcgttattattacttttaacgtaccgcgcgctcttttacgacgatatcaacctaaataaatttaaattaatcacgctcatccgcgtacgcgaaaaaaacgcacaacaatacgccaacgctaaaaacgctaacgtaaataataaccctaattacaaacctacgcgnnatttcacgacccgtatcataatattaatcgcctttcccctcataaaaaaaaattattccacgataaacaacgacttaccaatcatctcttacgaaatttccatacccatcaacgacaacataatcgacgcgatatcaaaaaatttaccgccttcaaccgctttcacgttcttatcaccaacgtaaatcaacgaaactaacaaattaatatataccgtatatacctaacccgttaccgaatcgcgcatctactcaacgttaccgtaatcaacgataatcaacaattatccacccacgaactcaaccgctttcgcgacttcttccacgcaataatccaacgcttcaaccgctttaaccgccgcttccatcaccccgatataacctaccatatcgccgttcgaataattacaaataataatatcgtatttaccgctcttaataaccgcaaccaatttttcgatcaactctacgaaac

SEQ ID NO: 6859 - DNA, 734 bp, Artificial Sequence
  chemically treated genomic DNA (Homo sapiens) CpG-island No: 6859
  misc_feature (259)..(260): n is either a, c, g or t
tgagttgattgagcgtgttttgcgtttcgcgtagtttacgggtggttttagagatcgtttttttttgtttttttaattgtgcgagtaggtttgcgcgttgttgttgtttttggcgtatcgcgcgtttttttgcggcgatgttagtttgaatagatttgagttggttacgtttattcgcgtgcgcggaaaaggcgtataataatacgttagcgttaagaacgttggcgtagatgatggttttgattgtaaatttgcgcgnngttttacggttcgtgttatggtattaatcgtttttttttttatggggagggattattttacgatgaatagcggtttattagttattttttgcgggatttttatatttattagcgataatatggtcggcgcgatgttagaaagtttgtcgtttttaatcgtttttacgtttttattattaacgtaaattagcggaattggtaggttggtgtgtgtcgtgtgtgtttgattcgttgtcggatcgcgtatttgtttagcgttatcgtggttagcggtgattagtagttgtttatttacggatttaatcgttttcgcgattttttttacgtagtgatttagcgttttaatcgttttaatcgtcgtttttattatttcggtgtgatttattatgtcgtcgttcggatagttatagatgatggtgtcgtatttgtcgtttttgatggtcgtaattagtttttcggttagttttgcggagt

SEQ ID NO: 6860 - DNA, 734 bp, Artificial Sequence
  chemically treated genomic DNA (Homo sapiens) CpG-island No: 6860
  misc_feature (475)..(476): n is either a, c, g or t
actccgcaaaactaaccgaaaaactaattacgaccatcaaaaacgacaaatacgacaccatcatctataactatccgaacgacgacataataaatcacaccgaaataataaaaacgacgattaaaacgattaaaacgctaaatcactacgtaaaaaaaatcgcgaaaacgattaaatccgtaaataaacaactactaatcaccgctaaccacgataacgctaaacaaatacgcgatccgacaacgaatcaaacacacacgacacacaccaacctaccaattccgctaatttacgttaataataaaaacgtaaaaacgattaaaaacgacaaactttctaacatcgcgccgaccatattatcgctaataaatataaaaatcccgcaaaaaataactaataaaccgctattcatcgtaaaataatccctccccataaaaaaaaaaacgattaataccataacacgaaccgtaaaacnncgcgcaaatttacaatcaaaaccatcatctacgccaacgttcttaacgctaacgtattattatacgccttttccgcgcacgcgaataaacgtaaccaactcaaatctattcaaactaacatcgccgcaaaaaaacgcgcgatacgccaaaaacaacaacaacgcgcaaacctactcgcacaattaaaaaaacaaaaaaaaacgatctctaaaaccacccgtaaactacgcgaaacgcaaaacacgctcaatcaactca

SEQ ID NO: 6861 - DNA, 610 bp, Artificial Sequence
  chemically treated genomic DNA (Homo sapiens) CpG-island No: 6861
  misc_feature (7)..(7): n is either a, c, g or t
  misc_feature (142)..(142): n is either a, c, g or t
tagaagntacgtttggtatcgttcgcgttatttttttaatttgtttagttatcgcgtcgatattcgttagtatagtgtcggaaatttaatgtcgatggggtttttaatgtcggttgagagtaaatcgatacggttacgaatnggcggtatttatagattcgttagtttcggtagtcgtacggtgttatttagttttttaatgattttgtttatcgttatgtttggtcgttattgtttttgcggtttaagttggatggtcgtttttattatttttagcggagtagaatcggtggcggttttcgttttttcggttttgttaaatattcgcgttattttaggtacgtttataattagtttgtcggttttttgtagtatattcgtcgtttttgttgcggaaattttcggtagcgtcgatggtatatataataagtcgtttttattgatttgcggtaaaaatttttcgttaattttattgagcggttagagaatcgttagtatcgaaagcgtcgttattagtagcgtggttttcggttagtgtagtatttttagtaatagcggatgataaatacgaattaaaaagcgattgagcgggttattgtttttcggcgga

SEQ ID NO: 6862 - DNA, 610 bp, Artificial Sequence
  chemically treated genomic DNA (Homo sapiens) CpG-island No: 6862
  misc_feature (469)..(469): n is either a, c, g or t
  misc_feature (604)..(604): n is either a, c, g or t
tccgccgaaaaacaataacccgctcaatcgctttttaattcgtatttatcatccgctattactaaaaatactacactaaccgaaaaccacgctactaataacgacgctttcgatactaacgattctctaaccgctcaataaaattaacgaaaaatttttaccgcaaatcaataaaaacgacttattatatataccatcgacgctaccgaaaatttccgcaacaaaaacgacgaatatactacaaaaaaccgacaaactaattataaacgtacctaaaataacgcgaatatttaacaaaaccgaaaaaacgaaaaccgccaccgattctactccgctaaaaataataaaaacgaccatccaacttaaaccgcaaaaacaataacgaccaaacataacgataaacaaaatcattaaaaaactaaataacaccgtacgactaccgaaactaacgaatctataaataccgccnattcgtaaccgtatcgatttactctcaaccgacattaaaaaccccatcgacattaaatttccgacactatactaacgaatatcgacgcgataactaaacaaattaaaaaaataacgcgaacgataccaaacgtancttcta

SEQ ID NO: 6863 - DNA, 610 bp, Artificial Sequence
  chemically treated genomic DNA (Homo sapiens) CpG-island No: 6863
  misc_feature (469)..(469): n is either a, c, g or t
  misc_feature (604)..(604): n is either a, c, g or t
ttcgtcggaaagtagtaattcgtttaatcgttttttgattcgtgtttattattcgttgttgttgaaagtattgtattggtcgaaaattacgttgttggtggcggcgttttcggtgttgacggttttttggtcgtttaataaagttggcggggaatttttatcgtagattaatgaaggcgatttgttgtatatgttatcgacgttgtcggggattttcgtagtagaggcggcgagtatgttgtaaaaaatcgataagttaattatgagcgtatttgaagtggcgcgggtatttggtaaaatcgggaaagcggaaatcgttatcgattttgtttcgttggagatggtagaaacgattatttagtttaagtcgtaggagtagtggcggttaggtatgacgatggataaaattattgaggaattggataatatcgtgcggttgtcggggttggcgaatttgtgggtgtcgttnattcgtaatcgtatcgatttgtttttaatcggtattaaaagttttatcggtattaagttttcggtattgtgttggcggatatcgacgcgatggttgagtaaattgaagaagtagcgcgaacggtgttaggcgtantttttg

SEQ ID NO: 6864 - DNA, 610 bp, Artificial Sequence
  chemically treated genomic DNA (Homo sapiens) CpG-island No: 6864
  misc_feature (7)..(7): n is either a, c, g or t
  misc_feature (142)..(142): n is either a, c, g or t
caaaaantacgcctaacaccgttcgcgctacttcttcaatttactcaaccatcgcgtcgatatccgccaacacaataccgaaaacttaataccgataaaacttttaataccgattaaaaacaaatcgatacgattacgaatnaacgacacccacaaattcgccaaccccgacaaccgcacgatattatccaattcctcaataattttatccatcgtcatacctaaccgccactactcctacgacttaaactaaataatcgtttctaccatctccaacgaaacaaaatcgataacgatttccgctttcccgattttaccaaatacccgcgccacttcaaatacgctcataattaacttatcgattttttacaacatactcgccgcctctactacgaaaatccccgacaacgtcgataacatatacaacaaatcgccttcattaatctacgataaaaattccccgccaactttattaaacgaccaaaaaaccgtcaacaccgaaaacgccgccaccaacaacgtaattttcgaccaatacaatactttcaacaacaacgaataataaacacgaatcaaaaaacgattaaacgaattactactttccgacgaa

SEQ ID NO: 6865 - DNA, 769 bp, Artificial Sequence
  chemically treated genomic DNA (Homo sapiens) CpG-island No: 6865
  misc_feature (31)..(31): n is either a, c, g or t
  misc_feature (167)..(167): n is either a, c, g or t
gtaagtgggggttgtatattggcgcgacgtntgaaaaatagtgcgagcgcggtttgttggcgaaagatttttttttatttattgtgattcgtattagcgcggtattcgatgcgcgtatgggcggcgttacgttttcggttatgagtaatttcggttcgggtaattangggattatcgtaataatgtttgtggtggtggtagtagaatatttcggagcggatgatgaacggttggcgcgtgcgttgatgttttcgtatttgagcgtaatttatatttataattagttatcgcgtttgtttgcgttgtgtgtcgtaacgatcgtagtaatgggggtcgtcgtcgggatggtatggttggtggatgggcgttatgaaattatttcgatggcgattagtagtatgatcggcgatgttagcggtatgatttgcgatggtgcgtcgaatagttgcgcgatgaaggtttcgattagtgtttcggttgcgtggaaagcggtgttaatggcgttggatgatatcgtcgtgatcggtaatgaagggattgtggcgtatgatgttgagtagtcgattgttaatttgtgtgcgttagtaagttattcgatgtagtaaacggatcggtagattatcgagattatggcgagtaaggttagataaacgttaggttttggggatcgtgtcggatgcgatgttggcgtattttgttcggtttacgggttgtttaattcgttaatgttgttggattttgtaggtcggataaggcgttttcgtcgtat

SEQ ID NO: 6866 - DNA, 769 bp, Artificial Sequence
  chemically treated genomic DNA (Homo sapiens) CpG-island No: 6866
  misc_feature (603)..(603): n is either a, c, g or t
  misc_feature (739)..(739): n is either a, c, g or t
atacgacgaaaacgccttatccgacctacaaaatccaacaacattaacgaattaaacaacccgtaaaccgaacaaaatacgccaacatcgcatccgacacgatccccaaaacctaacgtttatctaaccttactcgccataatctcgataatctaccgatccgtttactacatcgaataacttactaacgcacacaaattaacaatcgactactcaacatcatacgccacaatcccttcattaccgatcacgacgatatcatccaacgccattaacaccgctttccacgcaaccgaaacactaatcgaaaccttcatcgcgcaactattcgacgcaccatcgcaaatcataccgctaacatcgccgatcatactactaatcgccatcgaaataatttcataacgcccatccaccaaccataccatcccgacgacgacccccattactacgatcgttacgacacacaacgcaaacaaacgcgataactaattataaatataaattacgctcaaatacgaaaacatcaacgcacgcgccaaccgttcatcatccgctccgaaatattctactaccaccaccacaaacattattacgataatcccntaattacccgaaccgaaattactcataaccgaaaacgtaacgccgcccatacgcgcatcgaataccgcgctaatacgaatcacaataaataaaaaaaaatctttcgccaacaaaccgcgctcgcactatttttcanacgtcgcgccaatatacaacccccacttac

SEQ ID NO: 6867 - DNA, 769 bp, Artificial Sequence
  chemically treated genomic DNA (Homo sapiens) CpG-island No: 6867
  misc_feature (603)..(603): n is either a, c, g or t
  misc_feature (739)..(739): n is either a, c, g or t
atgcggcgaaaacgttttattcggtttataaaatttaataatattaacgaattaaataattcgtaggtcggataagatgcgttagtatcgtattcggtacgatttttaaaatttggcgtttatttggttttgttcgttataatttcgataatttgtcgattcgtttgttgtatcgaatggtttgttaacgtatataggttggtaatcgattgtttaatattatgcgttataatttttttattgtcggttacggcggtattatttagcgttattaatatcgttttttacgtagtcgaagtattggtcgaaatttttatcgcgtagttgttcgacgtattatcgtaaattatgtcgttgatatcgtcgattatattgttgatcgttatcgagatggttttataacgtttatttattagttatgttatttcggcggcggtttttattgttgcggtcgttgcggtatatagcgtagataaacgcggtaattggttatggatgtaaattgcgtttaaatgcgaaagtattagcgtacgcgttagtcgtttattattcgtttcgaagtgttttgttattattattataggtattgttgcggtaattttntggttattcgagtcggagttatttatagtcggaagcgtagcgtcgtttatacgcgtatcggatgtcgcgttggtacgaattataatggatgaagagagatttttcgttagtaaatcgcgttcgtattgttttttangcgtcgcgttaatatgtagtttttatttat

SEQ ID NO: 6868 - DNA, 769 bp, Artificial Sequence
  chemically treated genomic DNA (Homo sapiens) CpG-island No: 6868
  misc_feature (31)..(31): n is either a, c, g or t
  misc_feature (167)..(167): n is either a, c, g or t
ataaataaaaactacatattaacgcgacgcntaaaaaacaatacgaacgcgatttactaacgaaaaatctctcttcatccattataattcgtaccaacgcgacatccgatacgcgtataaacgacgctacgcttccgactataaataactccgactcgaataaccanaaaattaccgcaacaatacctataataataataacaaaacacttcgaaacgaataataaacgactaacgcgtacgctaatactttcgcatttaaacgcaatttacatccataaccaattaccgcgtttatctacgctatataccgcaacgaccgcaacaataaaaaccgccgccgaaataacataactaataaataaacgttataaaaccatctcgataacgatcaacaatataatcgacgatatcaacgacataatttacgataatacgtcgaacaactacgcgataaaaatttcgaccaatacttcgactacgtaaaaaacgatattaataacgctaaataataccgccgtaaccgacaataaaaaaattataacgcataatattaaacaatcgattaccaacctatatacgttaacaaaccattcgatacaacaaacgaatcgacaaattatcgaaattataacgaacaaaaccaaataaacgccaaattttaaaaatcgtaccgaatacgatactaacgcatcttatccgacctacgaattatttaattcgttaatattattaaattttataaaccgaataaaacgttttcgccgcat

SEQ ID NO: 6869 - DNA, 644 bp, Artificial Sequence
  chemically treated genomic DNA (Homo sapiens) CpG-island No: 6869
  misc_feature (144)..(144): n is either a, c, g or t
  misc_feature (181)..(181): n is either a, c, g or t
ggcgggtagcgtattgttggttttacgtttgatggtattgtttaatttgaaaacgggcgatattattgacgtgggcgatgttattttgcggattgtcggagaagtgatttaggaatcggatttcggttttaattttttttagantgtttcgcgtttgatgatgaatttggcggatgtcgantaaatcggagtcgtgtagtcggggagtcgggttatttggcgttataaattcggcggtaacgagaattagttcgacggttatgagaaatggttgttattttagtttaaattcgaataacgttggtacggtttggaataggacgaaggcgcgttggggcgatcgatggaacgttcgtaatagtttttgttgttttcggcgtttttgattttgttgttggtagtggtagcggtggcggtagcgatgaattattattgtcgtagtcgttacgatttggtggcgatttttaaaacgttgggggtagggcgagcgtaattgcgtaagttaatcgtcggttagtggttgatggtgttgacgtttttagtcgttatcggtggggttataggtttgttgttcgaaaacgtgttgatggtgttgtttaagttcgttttgtttgttgtattatcgttagttagtttttggtcgt

SEQ ID NO: 6870 - DNA, 644 bp, Artificial Sequence
  chemically treated genomic DNA (Homo sapiens) CpG-island No: 6870
  misc_feature (464)..(464): n is either a, c, g or t
  misc_feature (501)..(501): n is either a, c, g or t
acgaccaaaaactaactaacgataatacaacaaacaaaacgaacttaaacaacaccatcaacacgttttcgaacaacaaacctataaccccaccgataacgactaaaaacgtcaacaccatcaaccactaaccgacgattaacttacgcaattacgctcgccctacccccaacgttttaaaaatcgccaccaaatcgtaacgactacgacaataataattcatcgctaccgccaccgctaccactaccaacaacaaaatcaaaaacgccgaaaacaacaaaaactattacgaacgttccatcgatcgccccaacgcgccttcgtcctattccaaaccgtaccaacgttattcgaatttaaactaaaataacaaccatttctcataaccgtcgaactaattctcgttaccgccgaatttataacgccaaataacccgactccccgactacacgactccgatttantcgacatccgccaaattcatcatcaaacgcgaaacantctaaaaaaaattaaaaccgaaatccgattcctaaatcacttctccgacaatccgcaaaataacatcgcccacgtcaataatatcgcccgttttcaaattaaacaataccatcaaacgtaaaaccaacaatacgctacccgcc

SEQ ID NO: 6871 - DNA, 644 bp, Artificial Sequence
  chemically treated genomic DNA (Homo sapiens) CpG-island No: 6871
  misc_feature (464)..(464): n is either a, c, g or t
  misc_feature (501)..(501): n is either a, c, g or t
acggttagaggttggttggcggtagtgtagtaggtagaacgggtttgagtagtattattaatacgttttcgaataataggtttatggttttatcggtaacggttgaaagcgttagtattattaattattgatcgacgattagtttacgtagttgcgttcgttttgtttttagcgttttgaggatcgttattagatcgtagcgattgcgatagtaatgatttatcgttatcgttatcgttgttattgttagtagtaaggttagaagcgtcgaaagtagtaggaattgttgcgagcgttttatcgatcgttttagcgcgttttcgttttgttttagatcgtattagcgttgttcgggtttaagttgaggtaataattattttttatagtcgtcgagttggttttcgttgtcgtcgaatttataacgttaggtgattcgatttttcggttgtacggtttcggtttantcgatattcgttagatttattattagacgcggagtantttggaaggggttaaaatcggaattcggtttttgaattattttttcggtaattcgtaaggtggtatcgtttacgttaatggtgtcgttcgtttttaggttaagtagtgttattaggcgtggggttagtaatacgttgttcgtt

SEQ ID NO: 6872 - DNA, 644 bp, Artificial Sequence
  chemically treated genomic DNA (Homo sapiens) CpG-island No: 6872
  misc_feature (144)..(144): n is either a, c, g or t
  misc_feature (181)..(181): n is either a, c, g or t
aacgaacaacgtattactaaccccacgcctaataacactacttaacctaaaaacgaacgacaccattaacgtaaacgataccaccttacgaattaccgaaaaaataattcaaaaaccgaattccgattttaaccccttccaaantactccgcgtctaataataaatctaacgaatatcgantaaaccgaaaccgtacaaccgaaaaatcgaatcacctaacgttataaattcgacgacaacgaaaaccaactcgacgactataaaaaataattattacctcaacttaaacccgaacaacgctaatacgatctaaaacaaaacgaaaacgcgctaaaacgatcgataaaacgctcgcaacaattcctactactttcgacgcttctaaccttactactaacaataacaacgataacgataacgataaatcattactatcgcaatcgctacgatctaataacgatcctcaaaacgctaaaaacaaaacgaacgcaactacgtaaactaatcgtcgatcaataattaataatactaacgctttcaaccgttaccgataaaaccataaacctattattcgaaaacgtattaataatactactcaaacccgttctacctactacactaccgccaaccaacctctaaccgt

SEQ ID NO: 6873 - DNA, 954 bp, Artificial Sequence
  chemically treated genomic DNA (Homo sapiens) CpG-island No: 6873
cgtatagacgtcgacgttgcgaagtttttcgcgtttttgttcgttcgtttcgttcgagtttcggttttcggttattgggatcgtttacgttttaggtggtatagtttggacgtaggtttgtgtttttttttttcgttttcggtttcggtttcgtcggaagcgtatttatagtggattgggtttgtattcgagacgtggtggttggcgcgtcggtcggcgcggagggatgacgcgaggaggtagcgattaatgggaaacggcgtagatcggggcgtttgttttttcgtttagtttcgttttcgttcggcgtcgggtcgtcggacgggttggaaggggcggtcgttcgggtaggatggcggcggtcgcggtgggcgcgggttacggcgcggggggttcgggcgtagcgagtagtagtggtggggcgcgcgagggcgcgcgggtggcggcgttgtgtttgttgtggtacgcgttgagcgcgggcggtaacgtggttaataaggtgattttgagcgttttttcgttttcggtgatcgtgtcgttgtgttatattttggttttgtgcgttgggttttcgtcgttgttgcgcgtttggcgcgtgtttttcgcgtcgttcgtttcgggtttcggatttagttcgtattcgtcgttcggttcgttgttgtcgtcgcgtttttattcgcgttacgtgttatcgttcgttttcggtaagtatttcgcgttcgtgttagcgtacgttagtatttggaaggtgttcgtgttttatgtatatatcggtaggtttcgcgttcggtttcgggggcggcggtcgggttcgtcgtttcgggtttgggcgtatggataggagtgcgtcgttcggggcgcgtttcgtcggattgagaagttagtagaggggttgttaagggtttggtaggggagggatacgtacggggtttttagggagaagaggagttgaga

SEQ ID NO: 6874 - DNA, 954 bp, Artificial Sequence
  chemically treated genomic DNA (Homo sapiens) CpG-island No: 6874
tctcaactcctcttctccctaaaaaccccgtacgtatccctcccctaccaaacccttaacaacccctctactaacttctcaatccgacgaaacgcgccccgaacgacgcactcctatccatacgcccaaacccgaaacgacgaacccgaccgccgcccccgaaaccgaacgcgaaacctaccgatatatacataaaacacgaacaccttccaaatactaacgtacgctaacacgaacgcgaaatacttaccgaaaacgaacgataacacgtaacgcgaataaaaacgcgacgacaacaacgaaccgaacgacgaatacgaactaaatccgaaacccgaaacgaacgacgcgaaaaacacgcgccaaacgcgcaacaacgacgaaaacccaacgcacaaaaccaaaatataacacaacgacacgatcaccgaaaacgaaaaaacgctcaaaatcaccttattaaccacgttaccgcccgcgctcaacgcgtaccacaacaaacacaacgccgccacccgcgcgccctcgcgcgccccaccactactactcgctacgcccgaaccccccgcgccgtaacccgcgcccaccgcgaccgccgccatcctacccgaacgaccgccccttccaacccgtccgacgacccgacgccgaacgaaaacgaaactaaacgaaaaaacaaacgccccgatctacgccgtttcccattaatcgctacctcctcgcgtcatccctccgcgccgaccgacgcgccaaccaccacgtctcgaatacaaacccaatccactataaatacgcttccgacgaaaccgaaaccgaaaacgaaaaaaaaaaacacaaacctacgtccaaactataccacctaaaacgtaaacgatcccaataaccgaaaaccgaaactcgaacgaaacgaacgaacaaaaacgcgaaaaacttcgcaacgtcgacgtctatacg

SEQ ID NO: 6875 - DNA, 954 bp, Artificial Sequence
  chemically treated genomic DNA (Homo sapiens) CpG-island No: 6875
ttttagttttttttttttttgagaatttcgtgcgtgttttttttttattaaatttttggtagtttttttgttgattttttagttcggcgggacgcgtttcgggcggcgtatttttatttatgcgtttaaattcgaagcggcgggttcggtcgtcgttttcgaggtcgggcgcggaatttatcggtgtgtgtataggatacgggtattttttagatgttgacgtgcgttgatacggacgcgaagtatttgtcgaaggcgagcggtagtacgtagcgcgggtagaagcgcggcggtagtagcgggtcggacgacggatgcggattgggttcggggttcgagacgggcggcgcggggggtacgcgttaggcgcgtagtagcggcgggagtttagcgtatagagttaggatgtggtatagcgatacggttatcgggaacgggaaggcgtttaggattattttgttgattacgttgtcgttcgcgtttagcgcgtattatagtaggtatagcgtcgttattcgcgcgttttcgcgcgttttattattgttgttcgttgcgttcgggtttttcgcgtcgtggttcgcgtttatcgcggtcgtcgttattttgttcgagcggtcgttttttttagttcgttcgacggttcgacgtcgggcgggggcggggttgggcgggggggtaggcgtttcggtttacgtcgttttttattggtcgttgttttttcgcgttattttttcgcgtcggtcgacgcgttagttattacgtttcgagtgtaggtttagtttattgtagatgcgttttcggcggagtcgaggtcggaagcggaagaaggggatatagatttgcgtttaagttgtgttatttgagacgtgggcggttttagtgatcgggagtcggagttcgaacgggacgggcgaatagaagcgcggagggtttcgtagcgtcggcgtttgtgcg

SEQ ID NO: 6876 - DNA, 954 bp, Artificial Sequence
  chemically treated genomic DNA (Homo sapiens) CpG-island No: 6876
cgcacaaacgccgacgctacgaaaccctccgcgcttctattcgcccgtcccgttcgaactccgactcccgatcactaaaaccgcccacgtctcaaataacacaacttaaacgcaaatctatatccccttcttccgcttccgacctcgactccgccgaaaacgcatctacaataaactaaacctacactcgaaacgtaataactaacgcgtcgaccgacgcgaaaaaataacgcgaaaaaacaacgaccaataaaaaacgacgtaaaccgaaacgcctacccccccgcccaaccccgcccccgcccgacgtcgaaccgtcgaacgaactaaaaaaaacgaccgctcgaacaaaataacgacgaccgcgataaacgcgaaccacgacgcgaaaaacccgaacgcaacgaacaacaataataaaacgcgcgaaaacgcgcgaataacgacgctatacctactataatacgcgctaaacgcgaacgacaacgtaatcaacaaaataatcctaaacgccttcccgttcccgataaccgtatcgctataccacatcctaactctatacgctaaactcccgccgctactacgcgcctaacgcgtaccccccgcgccgcccgtctcgaaccccgaacccaatccgcatccgtcgtccgacccgctactaccgccgcgcttctacccgcgctacgtactaccgctcgccttcgacaaatacttcgcgtccgtatcaacgcacgtcaacatctaaaaaatacccgtatcctatacacacaccgataaattccgcgcccgacctcgaaaacgacgaccgaacccgccgcttcgaatttaaacgcataaataaaaatacgccgcccgaaacgcgtcccgccgaactaaaaaatcaacaaaaaaactaccaaaaatttaataaaaaaaaaacacgcacgaaattctcaaaaaaaaaaaaaactaaaa

SEQ ID NO: 6877 - DNA, 821 bp, Artificial Sequence
  chemically treated genomic DNA (Homo sapiens) CpG-island No: 6877
tgcgacgtcgattaaggggtacgtttcgcgtttttcggtttcgattaatatttattcgcgtcgttttagttttttcgcggcgtcgcgcgacggggatttattttgcgaaagtgttaggaaatttttgcgcgtgcgcgtcgttagtttttttcgcgcgttaggtatcgcgcggttttttttcgtttgtttttcgtttttattttcggagttttttagcgacggtcgtaagtggcgggcggaagcggttttagaagttcgtcgtaaacggttttttcgcgttattttcggtcggttttcgtagacggcgttggtggtcgatcgtgtggcgtcggaggacgtttttcgcggtcggagttatggagatgtcgttgtttttcgatggtgagatttaaatcggtcgagagatcgttttttttttttcggaattttttattggtcggtttcgtttttcggagttttcgggtttgggagggggcggggttcggtttcgcggtttcgtttgcggtttttttcgtgggttttcgtattttcggcgagcgtgtggtttttatcgggattcgtataagggcggttttttcggggtttatttttttggggttttcggtaaggcggacgggggttggggcgtcgagtttttcggttttgggcggttttcgttgacgtttcgcgtggtttttttttcgttttttagattaggagtttcgaaatgttatcgataagttcgtttagttcgtggttcgtaatgggttcgagtttgagaagatgattatggagaagtagaaggataattttaaattttcgttttttttcggaggcgaatt

SEQ ID NO: 6878 - DNA, 821 bp, Artificial Sequence
  chemically treated genomic DNA (Homo sapiens) CpG-island No: 6878
aattcgcctccgaaaaaaaacgaaaatttaaaattatccttctacttctccataatcatcttctcaaactcgaacccattacgaaccacgaactaaacgaacttatcgataacatttcgaaactcctaatctaaaaaacgaaaaaaaaaccacgcgaaacgtcaacgaaaaccgcccaaaaccgaaaaactcgacgccccaacccccgtccgccttaccgaaaaccccaaaaaaataaaccccgaaaaaaccgcccttatacgaatcccgataaaaaccacacgctcgccgaaaatacgaaaacccacgaaaaaaaccgcaaacgaaaccgcgaaaccgaaccccgccccctcccaaacccgaaaactccgaaaaacgaaaccgaccaataaaaaattccgaaaaaaaaaaaacgatctctcgaccgatttaaatctcaccatcgaaaaacaacgacatctccataactccgaccgcgaaaaacgtcctccgacgccacacgatcgaccaccaacgccgtctacgaaaaccgaccgaaaataacgcgaaaaaaccgtttacgacgaacttctaaaaccgcttccgcccgccacttacgaccgtcgctaaaaaactccgaaaataaaaacgaaaaacaaacgaaaaaaaaccgcgcgatacctaacgcgcgaaaaaaactaacgacgcgcacgcgcaaaaatttcctaacactttcgcaaaataaatccccgtcgcgcgacgccgcgaaaaaactaaaacgacgcgaataaatattaatcgaaaccgaaaaacgcgaaacgtaccccttaatcgacgtcgca

SEQ ID NO: 6879 - DNA, 821 bp, Artificial Sequence
  chemically treated genomic DNA (Homo sapiens) CpG-island No: 6879
aattcgttttcgaaaagaaacgagaatttggggttgtttttttgtttttttatagttatttttttaaattcgggtttattgcgagttacgaattgggcgagtttgtcgatgatatttcgaagtttttggtttggaggacggagaaaaggttacgcggggcgttagcgaggatcgtttaaagtcgggggattcggcgttttagttttcgttcgttttgtcggggattttaagggggtgggtttcgaagaggtcgtttttgtacgggtttcgataggggttatacgttcgtcgggaatgcggggatttacgggagaggtcgtaggcgaagtcgcgaggtcgagtttcgtttttttttagattcggggatttcgggaggcggggtcggttaataggaggtttcggggagagagaaacggtttttcggtcggtttgggttttattatcggggggtagcggtatttttatggtttcggtcgcggggaacgtttttcggcgttatacgatcgattattagcgtcgtttgcggaagtcggtcggaagtggcgcgagggagtcgtttacggcgggtttttagggtcgttttcgttcgttatttacggtcgtcgttgggaaatttcggaagtgagagcgggaggtaggcgggaagaagtcgcgcgatgtttggcgcgcgggaggggttagcgacgcgtacgcgtagaagttttttgatattttcgtagagtgggttttcgtcgcgcggcgtcgcggaaaggttggaacggcgcgggtgggtgttagtcgagatcggggggcgcggggcgtgttttttggtcggcgtcgta

SEQ ID NO: 6880 - DNA, 821 bp, Artificial Sequence
  chemically treated genomic DNA (Homo sapiens) CpG-island No: 6880
tacgacgccgaccaaaaaacacgccccgcgccccccgatctcgactaacacccacccgcgccgttccaacctttccgcgacgccgcgcgacgaaaacccactctacgaaaatatcaaaaaacttctacgcgtacgcgtcgctaacccctcccgcgcgccaaacatcgcgcgacttcttcccgcctacctcccgctctcacttccgaaatttcccaacgacgaccgtaaataacgaacgaaaacgaccctaaaaacccgccgtaaacgactccctcgcgccacttccgaccgacttccgcaaacgacgctaataatcgatcgtataacgccgaaaaacgttccccgcgaccgaaaccataaaaataccgctaccccccgataataaaacccaaaccgaccgaaaaaccgtttctctctccccgaaacctcctattaaccgaccccgcctcccgaaatccccgaatctaaaaaaaaacgaaactcgacctcgcgacttcgcctacgacctctcccgtaaatccccgcattcccgacgaacgtataacccctatcgaaacccgtacaaaaacgacctcttcgaaacccacccccttaaaatccccgacaaaacgaacgaaaactaaaacgccgaatcccccgactttaaacgatcctcgctaacgccccgcgtaaccttttctccgtcctccaaaccaaaaacttcgaaatatcatcgacaaactcgcccaattcgtaactcgcaataaacccgaatttaaaaaaataactataaaaaaacaaaaaaacaaccccaaattctcgtttcttttcgaaaacgaatt

SEQ ID NO: 6881 - DNA, 590 bp, Artificial Sequence
  chemically treated genomic DNA (Homo sapiens) CpG-island No: 6881
gaatttgaggatatagagaggcgttcggagacgtacgatttgcgttcggtgtaggggtggcggaagtagtttttaaggaggtaggggattagtttgagatcgtattgttgttgacgggttcgggtttcggcgggattttgttcgttcgggcgtcgggatcggagggagataaagattcgttgggtcgtcgcgtcgatagaaacgttcgtatttttcgtttattttttcgggatgtagtttagcgttttcgcgggttttcggtttgggagttttagcggcggtagggttcgggttttgggcggagaggatacgcgttgcgtattttttcgtttcgtcggtgttcgcgagggtcgttcgggtacgggaggtcgcgggtttcggtttgttatttttagggtcgtttgttattcgttcgtcgtaagttttttagtacgcgtcgtttcgtcgtcgttgttgagttttttagcgttttagttttcgatcgttcgtttcgcgtttcgtatttcggcgtcgtttttaggatcgttcggatcgtatttgttggagagagggggatgagcggcgcgatattttttcgtaggatttaggag

SEQ ID NO: 6882 - DNA, 590 bp, Artificial Sequence
  chemically treated genomic DNA (Homo sapiens) CpG-island No: 6882
ctcctaaatcctacgaaaaaatatcgcgccgctcatccccctctctccaacaaatacgatccgaacgatcctaaaaacgacgccgaaatacgaaacgcgaaacgaacgatcgaaaactaaaacgctaaaaaactcaacaacgacgacgaaacgacgcgtactaaaaaacttacgacgaacgaataacaaacgaccctaaaaataacaaaccgaaacccgcgacctcccgtacccgaacgaccctcgcgaacaccgacgaaacgaaaaaatacgcaacgcgtatcctctccgcccaaaacccgaaccctaccgccgctaaaactcccaaaccgaaaacccgcgaaaacgctaaactacatcccgaaaaaataaacgaaaaatacgaacgtttctatcgacgcgacgacccaacgaatctttatctccctccgatcccgacgcccgaacgaacaaaatcccgccgaaacccgaacccgtcaacaacaatacgatctcaaactaatcccctacctccttaaaaactacttccgccacccctacaccgaacgcaaatcgtacgtctccgaacgcctctctatatcctcaaattc

SEQ ID NO: 6883 - DNA, 590 bp, Artificial Sequence
  chemically treated genomic DNA (Homo sapiens) CpG-island No: 6883
tttttgagttttgcgggaagatgtcgcgtcgtttatttttttttttttagtaggtacggttcgggcggttttgggggcggcgtcggggtgcggggcgcgaggcgagcggtcgggagttgaggcgttgggagatttagtagcggcggcggggcggcgcgtgttgaagggtttgcggcgggcgggtggtaggcggttttgaaggtgataggtcgggattcgcggtttttcgtgttcgagcgattttcgcgggtatcggcgaggcgaggaggtgcgtagcgcgtgtttttttcgtttagggttcggattttgtcgtcgttgaagtttttaggtcggggattcgcggaggcgttgggttgtatttcggaggggtgggcgaggggtgcgagcgtttttgtcggcgcggcggtttagcgagtttttgttttttttcggtttcggcgttcgggcgggtagggtttcgtcggagttcggattcgttagtagtagtgcgattttagattgattttttgtttttttggaagttgttttcgttatttttgtatcgggcgtagatcgtacgttttcgggcgtttttttgtgtttttaaattt

SEQ ID NO: 6884 - DNA, 590 bp, Artificial Sequence
  chemically treated genomic DNA (Homo sapiens) CpG-island No: 6884
aaatttaaaaacacaaaaaaacgcccgaaaacgtacgatctacgcccgatacaaaaataacgaaaacaacttccaaaaaaacaaaaaatcaatctaaaatcgcactactactaacgaatccgaactccgacgaaaccctacccgcccgaacgccgaaaccgaaaaaaaacaaaaactcgctaaaccgccgcgccgacaaaaacgctcgcacccctcgcccacccctccgaaatacaacccaacgcctccgcgaatccccgacctaaaaacttcaacgacgacaaaatccgaaccctaaacgaaaaaaacacgcgctacgcacctcctcgcctcgccgatacccgcgaaaatcgctcgaacacgaaaaaccgcgaatcccgacctatcaccttcaaaaccgcctaccacccgcccgccgcaaacccttcaacacgcgccgccccgccgccgctactaaatctcccaacgcctcaactcccgaccgctcgcctcgcgccccgcaccccgacgccgcccccaaaaccgcccgaaccgtacctactaaaaaaaaaaaaataaacgacgcgacatcttcccgcaaaactcaaaaa

SEQ ID NO: 6885 - DNA, 692 bp, Artificial Sequence
  chemically treated genomic DNA (Homo sapiens) CpG-island No: 6885
aacggtgatgtagcggtaatagaacgcgagttgtagtatattagcgaagtgttggggttgaattacgataagtcgtaggtagtagatagtacgtcgaaatcgtagttgaaatcgtaattcgtttaaaaagaagtggcggatattgcgttgtaatgatacgttatattcggtatggtatgtcggatgtggcgtatgttgataagacgcgttagcgtcgtattaggtaatcggttcgggcgttagatgttggatgcggcgtaatcgttttatttaatttacggggtggagtattttatagcggtgtaggtttgataagacgcgttagcgtcgtattaggtaatcggtttgggcgttagatgtcggatgcggcgtaatcgttttattcgatttacggggtggagtattttatagcggtgtaggtttgataagacgcgttagcgtcgtattaggtaatcggttcggacgttggatgtcggatgcggcgtaatcgttttatttaatttacggggtggagtattttatagcggtgtaggtttgataagacgcgttagcgtcgtattaggcgtagattgtcggatgcggcgtgaacgttttagttcggtttacgtaagtttgtgataacgttaagtattcgatattattttttaattaaaagaatacgatatatatcgcgagtcgttataataagagcg

SEQ ID NO: 6886 - DNA, 692 bp, Artificial Sequence
  chemically treated genomic DNA (Homo sapiens) CpG-island No: 6886
cgctcttattataacgactcgcgatatatatcgtattcttttaattaaaaaataatatcgaatacttaacgttatcacaaacttacgtaaaccgaactaaaacgttcacgccgcatccgacaatctacgcctaatacgacgctaacgcgtcttatcaaacctacaccgctataaaatactccaccccgtaaattaaataaaacgattacgccgcatccgacatccaacgtccgaaccgattacctaatacgacgctaacgcgtcttatcaaacctacaccgctataaaatactccaccccgtaaatcgaataaaacgattacgccgcatccgacatctaacgcccaaaccgattacctaatacgacgctaacgcgtcttatcaaacctacaccgctataaaatactccaccccgtaaattaaataaaacgattacgccgcatccaacatctaacgcccgaaccgattacctaatacgacgctaacgcgtcttatcaacatacgccacatccgacataccataccgaatataacgtatcattacaacgcaatatccgccacttctttttaaacgaattacgatttcaactacgatttcgacgtactatctactacctacgacttatcgtaattcaaccccaacacttcgctaatatactacaactcgcgttctattaccgctacatcaccgtt

SEQ ID NO: 6887 - DNA, 692 bp, Artificial Sequence
  chemically treated genomic DNA (Homo sapiens) CpG-island No: 6887
cgtttttattgtggcggttcgcggtgtatgtcgtgtttttttaattgaggaatagtgtcggatgtttggcgttgttatagatttgcgtaggtcgaattaaggcgtttacgtcgtattcggtaatttacgtttgatgcgacgttggcgcgttttattaggtttatatcgttgtgaagtgttttatttcgtaggttggataaggcggttacgtcgtattcgatatttaacgttcgagtcggttgtttgatgcgacgttggcgcgttttattaggtttatatcgttgtgaagtgttttatttcgtaggtcggataaggcggttacgtcgtattcgatatttaacgtttaagtcggttgtttgatgcgacgttggcgcgttttattaggtttatatcgttgtgaagtgttttatttcgtaggttggataaggcggttacgtcgtatttaatatttaacgttcgagtcggttgtttgatgcgacgttggcgcgttttattagtatacgttatattcggtatattatgtcggatgtggcgtattattataacgtaatattcgttatttttttttgaacgggttgcggttttaattgcggtttcggcgtattatttgttgtttgcggtttgtcgtagtttaattttagtatttcgttggtgtattgtaattcgcgttttgttgtcgttatattatcgtt

SEQ ID NO: 6888 - DNA, 692 bp, Artificial Sequence
  chemically treated genomic DNA (Homo sapiens) CpG-island No: 6888
aacgataatataacgacaacaaaacgcgaattacaatacaccaacgaaatactaaaattaaactacgacaaaccgcaaacaacaaataatacgccgaaaccgcaattaaaaccgcaacccgttcaaaaaaaaataacgaatattacgttataataatacgccacatccgacataatataccgaatataacgtatactaataaaacgcgccaacgtcgcatcaaacaaccgactcgaacgttaaatattaaatacgacgtaaccgccttatccaacctacgaaataaaacacttcacaacgatataaacctaataaaacgcgccaacgtcgcatcaaacaaccgacttaaacgttaaatatcgaatacgacgtaaccgccttatccgacctacgaaataaaacacttcacaacgatataaacctaataaaacgcgccaacgtcgcatcaaacaaccgactcgaacgttaaatatcgaatacgacgtaaccgccttatccaacctacgaaataaaacacttcacaacgatataaacctaataaaacgcgccaacgtcgcatcaaacgtaaattaccgaatacgacgtaaacgccttaattcgacctacgcaaatctataacaacgccaaacatccgacactattcctcaattaaaaaaacacgacatacaccgcgaaccgccacaataaaaacg

SEQ ID NO: 6889 - DNA, 539 bp, Artificial Sequence
  chemically treated genomic DNA (Homo sapiens) CpG-island No: 6889
ttgggaagatttttttttagagcgtcgcggggagcgtttcgggttgggtttacggggattgcggaatacggggatgaatttggtttggggtagttagtattttacggtagatgaataatcgggagtagatttgtgggcgtgcggggattttaggcggcgcgcgggggcggggggaggggttgagttacgggggttagaggtgtcgtttggacggtttgagttgggggcgttcgcgttattttttacgtgtgcgagtgatgtaaatgtagattcgcgaggggcgggcgggggtggcgggcgggggtaggcgacggagttttcgtttgggagcgcgcgtgtgtgcgttaaaagttttgggttgatggatgtttcgcggcgcgtttggcgcggagagcggcgatttagcggggtagaggggggcgggaggattgcggcggcgcggggcggcgaggaaagtttcgtacggtttgggttggcgggtagaggtagtagagaaagaaatagaggtagtagaataaaaaatttttatttgaagttaa

SEQ ID NO: 6890 - DNA, 539 bp, Artificial Sequence
  chemically treated genomic DNA (Homo sapiens) CpG-island No: 6890
ttaacttcaaataaaaattttttattctactacctctatttctttctctactacctctacccgccaacccaaaccgtacgaaactttcctcgccgccccgcgccgccgcaatcctcccgcccccctctaccccgctaaatcgccgctctccgcgccaaacgcgccgcgaaacatccatcaacccaaaacttttaacgcacacacgcgcgctcccaaacgaaaactccgtcgcctacccccgcccgccacccccgcccgcccctcgcgaatctacatttacatcactcgcacacgtaaaaaataacgcgaacgcccccaactcaaaccgtccaaacgacacctctaacccccgtaactcaacccctccccccgcccccgcgcgccgcctaaaatccccgcacgcccacaaatctactcccgattattcatctaccgtaaaatactaactaccccaaaccaaattcatccccgtattccgcaatccccgtaaacccaacccgaaacgctccccgcgacgctctaaaaaaaaatcttcccaa

SEQ ID NO: 6891 - DNA, 539 bp, Artificial Sequence
  chemically treated genomic DNA (Homo sapiens) CpG-island No: 6891
ttgattttaggtaaaagttttttattttgttgtttttgtttttttttttgttgtttttgttcgttagtttaggtcgtgcggggtttttttcgtcgtttcgcgtcgtcgtagttttttcgtttttttttgtttcgttgggtcgtcgtttttcgcgttaggcgcgtcgcggggtatttattaatttagagtttttgacgtatatacgcgcgtttttagacggagatttcgtcgtttgttttcgttcgttattttcgttcgtttttcgcgggtttgtatttgtattattcgtatacgtagaaggtgacgcgagcgtttttagtttaggtcgtttaggcggtatttttagttttcgtggtttagttttttttttcgttttcgcgcgtcgtttaaggttttcgtacgtttatagatttgttttcgattgtttatttgtcgtggggtgttggttgttttaagttaagtttattttcgtatttcgtagttttcgtgggtttagttcggggcgtttttcgcgacgttttggagaaaagtttttttag

SEQ ID NO: 6892 - DNA, 539 bp, Artificial Sequence
  chemically treated genomic DNA (Homo sapiens) CpG-island No: 6892
ctaaaaaaacttttctccaaaacgtcgcgaaaaacgccccgaactaaacccacgaaaactacgaaatacgaaaataaacttaacttaaaacaaccaacaccccacgacaaataaacaatcgaaaacaaatctataaacgtacgaaaaccttaaacgacgcgcgaaaacgaaaaaaaaaactaaaccacgaaaactaaaaataccgcctaaacgacctaaactaaaaacgctcgcgtcaccttctacgtatacgaataatacaaatacaaacccgcgaaaaacgaacgaaaataacgaacgaaaacaaacgacgaaatctccgtctaaaaacgcgcgtatatacgtcaaaaactctaaattaataaataccccgcgacgcgcctaacgcgaaaaacgacgacccaacgaaacaaaaaaaaacgaaaaaactacgacgacgcgaaacgacgaaaaaaaccccgcacgacctaaactaacgaacaaaaacaacaaaaaaaaaaacaaaaacaacaaaataaaaaacttttacctaaaatcaa

SEQ ID NO: 6893 - DNA, 617 bp, Artificial Sequence
  chemically treated genomic DNA (Homo sapiens) CpG-island No: 6893
  misc_feature (24)..(24): n is either a, c, g or t
gattttcgcgcgacgttttatttncgttttaaacgttttaatttttacgcgttttagcgtgtatttggttttggtatttttacgatcggttcgggttattttagttacgttgagttgttacgacggtttcggttatcgttagcgtatgttttagcggtagatagttaaatttattcgcggtgcgggcgtaggtttttttgttgtcgtgttcgaaggaaaagtttatcgtttattaataggttaaagtttattagtttgtcgttttcggcgatcgttacgaagtttatgtcgttggcgtgtagatcgatatcgttttgtggcgggattattatcgtggttttgaatttacgcggtaggtaggtttggtcgaggatcggttttttattagtagtggcgatttttttttggtcgagttagattttcgtatacgcgcgggtacgaggtaatagatgtttagaaatttttttcgtttattcgtacgttttcgcgtgtagttgcgattcgtaagggttcgaggtgtagagtacgttacggtttatgtcgttagttgtcgttagcgtattaagatcgatcgagtgtagtatttggtgtatcggtttgacgtttttttttagaat

SEQ ID NO: 6894 - DNA, 617 bp, Artificial Sequence
  chemically treated genomic DNA (Homo sapiens) CpG-island No: 6894
  misc_feature (594)..(594): n is either a, c, g or t
attctaaaaaaaaacgtcaaaccgatacaccaaatactacactcgatcgatcttaatacgctaacgacaactaacgacataaaccgtaacgtactctacacctcgaacccttacgaatcgcaactacacgcgaaaacgtacgaataaacgaaaaaaatttctaaacatctattacctcgtacccgcgcgtatacgaaaatctaactcgaccaaaaaaaaatcgccactactaataaaaaaccgatcctcgaccaaacctacctaccgcgtaaattcaaaaccacgataataatcccgccacaaaacgatatcgatctacacgccaacgacataaacttcgtaacgatcgccgaaaacgacaaactaataaactttaacctattaataaacgataaacttttccttcgaacacgacaacaaaaaaacctacgcccgcaccgcgaataaatttaactatctaccgctaaaacatacgctaacgataaccgaaaccgtcgtaacaactcaacgtaactaaaataacccgaaccgatcgtaaaaataccaaaaccaaatacacgctaaaacgcgtaaaaattaaaacgtttaaaacgnaaataaaacgtcgcgcgaaaatc

SEQ ID NO: 6895 - DNA, 617 bp, Artificial Sequence
  chemically treated genomic DNA (Homo sapiens) CpG-island No: 6895
  misc_feature (594)..(594): n is either a, c, g or t
attttgaaaaagaacgttaaatcggtgtattagatgttgtattcggtcggttttgatgcgttggcgatagttaacgatatgaatcgtaacgtattttgtatttcgaatttttacgagtcgtagttgtacgcggaagcgtacgagtgggcgaagaagatttttgagtatttgttgtttcgtattcgcgcgtatgcggagatttggttcgattaggaaaaagtcgttattattgatgaagaatcgattttcggttagatttatttgtcgcgtaaatttaaaattacggtagtgatttcgttatagaacgatatcgatttgtacgttaacgatatgaatttcgtggcgatcgtcgaaaacggtaaattggtgggttttaatttgttggtgggcggtgggtttttttttcgaatacggtaataagaaaatttacgttcgtatcgcgagtgagtttggttatttgtcgttggagtatacgttggcggtggtcgaagtcgtcgtgataatttagcgtgattggggtaattcgaatcgatcgtaaaaatgttaaaattaaatatacgttggagcgcgtgggggttgagacgtttaaagcgnaagtggagcgtcgcgcggggatt

SEQ ID NO: 6896 - DNA, 617 bp, Artificial Sequence
  chemically treated genomic DNA (Homo sapiens) CpG-island No: 6896
  misc_feature (24)..(24): n is either a, c, g or t
aatccccgcgcgacgctccacttncgctttaaacgtctcaacccccacgcgctccaacgtatatttaattttaacatttttacgatcgattcgaattaccccaatcacgctaaattatcacgacgacttcgaccaccgccaacgtatactccaacgacaaataaccaaactcactcgcgatacgaacgtaaattttcttattaccgtattcgaaaaaaaaacccaccgcccaccaacaaattaaaacccaccaatttaccgttttcgacgatcgccacgaaattcatatcgttaacgtacaaatcgatatcgttctataacgaaatcactaccgtaattttaaatttacgcgacaaataaatctaaccgaaaatcgattcttcatcaataataacgactttttcctaatcgaaccaaatctccgcatacgcgcgaatacgaaacaacaaatactcaaaaatcttcttcgcccactcgtacgcttccgcgtacaactacgactcgtaaaaattcgaaatacaaaatacgttacgattcatatcgttaactatcgccaacgcatcaaaaccgaccgaatacaacatctaatacaccgatttaacgttctttttcaaaat

SEQ ID NO: 6897 - DNA, 594 bp, Artificial Sequence
  chemically treated genomic DNA (Homo sapiens) CpG-island No: 6897
tttgcgcgatgtcgttcgtatagtaggcgggttggttgtcgtgggtgtggcgttggggttataatagtaaatcggacgcgtatttggcgtgcggttgcgttcgttcggagttataaacgagaacgtttttgttagtgtttgtgtgcgttgcggttagtgtgtttaggtttgtttttacgatattttaaaattggcgacgttggtttttggtttgtcggcgggtacgttatattttgtcgtacgggatattttttgcgaaatgtgtgaggatatttcgtgcgttaaagtgtgtttaagcggtgcgttggatcgtgagattgaatcgatcgacgacgcgcggatggggttggcggtattggtggattatgaaaattgttttaatttttaagggttgcgttgcgatgtttgttatcgcgaatgttcgaaaattgatgaagttattattttggagttggagcgtaatacgcgtatcggtaagtacgttcgttttttgtcgatagtttatagcgacgtttgtatcgggtgcggtaagtgcgaaatagtaatgaaacgattattgatacgattttttttttttttttgttattttgaaat

SEQ ID NO: 6898 - DNA, 594 bp, Artificial Sequence
  chemically treated genomic DNA (Homo sapiens) CpG-island No: 6898
atttcaaaataacaaaaaaaaaaaaaaaatcgtatcaataatcgtttcattactatttcgcacttaccgcacccgatacaaacgtcgctataaactatcgacaaaaaacgaacgtacttaccgatacgcgtattacgctccaactccaaaataataacttcatcaattttcgaacattcgcgataacaaacatcgcaacgcaacccttaaaaattaaaacaattttcataatccaccaataccgccaaccccatccgcgcgtcgtcgatcgattcaatctcacgatccaacgcaccgcttaaacacactttaacgcacgaaatatcctcacacatttcgcaaaaaatatcccgtacgacaaaatataacgtacccgccgacaaaccaaaaaccaacgtcgccaattttaaaatatcgtaaaaacaaacctaaacacactaaccgcaacgcacacaaacactaacaaaaacgttctcgtttataactccgaacgaacgcaaccgcacgccaaatacgcgtccgatttactattataaccccaacgccacacccacgacaaccaacccgcctactatacgaacgacatcgcgcaaa

SEQ ID NO: 6899 - DNA, 594 bp, Artificial Sequence
  chemically treated genomic DNA (Homo sapiens) CpG-island No: 6899
attttagaatggtagagagaaggggagggtcgtattaatggtcgttttattattatttcgtatttatcgtattcggtataggcgtcgttgtgaattgtcggtagaaagcgggcgtgtttatcggtacgcgtgttgcgttttagttttagggtgatggttttattaattttcgggtattcgcgataataaatatcgtagcgtagtttttgaaagttgagatagtttttatggtttattagtatcgttagttttattcgcgcgtcgtcgatcgatttaattttacgatttagcgtatcgtttgggtatattttggcgtacggaatgtttttatatatttcgtaaggaatatttcgtgcgataaaatatggcgtgttcgtcgatagattagaggttagcgtcgttagttttaaggtgtcgtaagggtaagtttgaatatattgatcgtaacgtatataggtattggtaaaggcgttttcgtttatggtttcgggcgggcgtaatcgtacgttagatgcgcgttcggtttgttgttgtaattttagcgttatatttacggtagttagttcgtttgttgtgcgaacgatatcgcgtaga

SEQ ID NO: 6900 - DNA, 594 bp, Artificial Sequence
  chemically treated genomic DNA (Homo sapiens) CpG-island No: 6900
tctacgcgatatcgttcgcacaacaaacgaactaactaccgtaaatataacgctaaaattacaacaacaaaccgaacgcgcatctaacgtacgattacgcccgcccgaaaccataaacgaaaacgcctttaccaatacctatatacgttacgatcaatatattcaaacttacccttacgacaccttaaaactaacgacgctaacctctaatctatcgacgaacacgccatattttatcgcacgaaatattccttacgaaatatataaaaacattccgtacgccaaaatatacccaaacgatacgctaaatcgtaaaattaaatcgatcgacgacgcgcgaataaaactaacgatactaataaaccataaaaactatctcaactttcaaaaactacgctacgatatttattatcgcgaatacccgaaaattaataaaaccatcaccctaaaactaaaacgcaacacgcgtaccgataaacacgcccgctttctaccgacaattcacaacgacgcctataccgaatacgataaatacgaaataataataaaacgaccattaatacgaccctccccttctctctaccattctaaaat

SEQ ID NO: 6901 - DNA, 540 bp, Artificial Sequence
  chemically treated genomic DNA (Homo sapiens) CpG-island No: 6901
attattacgattattataaagaagatggttaattcggtatttagacggttgttgaatattagttgcgttagttgtgatttagtatattgcgacggaatattgtcgttgtcgattattgtttggaatttattagtaatggttaggaagtcgattttcgtattcgggttaaacgttttttgttagtttgcggttagggtataaattagtagttaggtcgttggtattagcgttatttaggcgtaacgttgacgttttattttgaataatattacggtatagagtattagcgttatttttgttagtatttggttggtaatattaaatagcggttatagagtgttaatgtcgtttagcggatcgattacgttttgatggaggaagtagttttacgttagtacgtatagcgttgttgttagtaggttagtaggtagtgaatcggttcgtatcgaacgtagcgtagaaagcggtgtacggttattatcgttggcgatggtgattgattttgtattttgtggtgtttagatttagattataaggatt

SEQ ID NO: 6902 - DNA, 540 bp, Artificial Sequence
  chemically treated genomic DNA (Homo sapiens) CpG-island No: 6902
aatccttataatctaaatctaaacaccacaaaatacaaaatcaatcaccatcgccaacgataataaccgtacaccgctttctacgctacgttcgatacgaaccgattcactacctactaacctactaacaacaacgctatacgtactaacgtaaaactacttcctccatcaaaacgtaatcgatccgctaaacgacattaacactctataaccgctatttaatattaccaaccaaatactaacaaaaataacgctaatactctataccgtaatattattcaaaataaaacgtcaacgttacgcctaaataacgctaataccaacgacctaactactaatttataccctaaccgcaaactaacaaaaaacgtttaacccgaatacgaaaatcgacttcctaaccattactaataaattccaaacaataatcgacaacgacaatattccgtcgcaatatactaaatcacaactaacgcaactaatattcaacaaccgtctaaataccgaattaaccatcttctttataataatcgtaataat

SEQ ID NO: 6903 - DNA, 540 bp, Artificial Sequence
  chemically treated genomic DNA (Homo sapiens) CpG-island No: 6903
aatttttatagtttaaatttaggtattataggatgtagaattaattattatcgttagcggtggtaatcgtgtatcgttttttgcgttgcgttcggtacggatcgatttattgtttgttaatttgttggtaatagcgttgtgcgtattggcgtggggttattttttttattagggcgtggtcgattcgttgggcggtattaatattttgtggtcgttgtttggtattgttaattagatgttggtagggatggcgttgatgttttgtgtcgtggtgttgtttaagatgaaacgttaacgttacgtttgggtggcgttggtattaacggtttggttgttgatttgtattttgatcgtaggttggtagaaagcgtttagttcggatgcgaaagtcggttttttggttattgttaataagttttaggtaatgatcgatagcggtaatatttcgtcgtagtatattgagttatagttggcgtaattggtgtttaataatcgtttggatgtcgggttaattattttttttatggtggtcgtggtggt

SEQ ID NO: 6904 - DNA, 540 bp, Artificial Sequence
  chemically treated genomic DNA (Homo sapiens) CpG-island No: 6904
accaccacgaccaccataaaaaaaataattaacccgacatccaaacgattattaaacaccaattacgccaactataactcaatatactacgacgaaatattaccgctatcgatcattacctaaaacttattaacaataaccaaaaaaccgactttcgcatccgaactaaacgctttctaccaacctacgatcaaaatacaaatcaacaaccaaaccgttaataccaacgccacccaaacgtaacgttaacgtttcatcttaaacaacaccacgacacaaaacatcaacgccatccctaccaacatctaattaacaataccaaacaacgaccacaaaatattaataccgcccaacgaatcgaccacgccctaataaaaaaaataaccccacgccaatacgcacaacgctattaccaacaaattaacaaacaataaatcgatccgtaccgaacgcaacgcaaaaaacgatacacgattaccaccgctaacgataataattaattctacatcctataatacctaaatttaaactataaaaatt

SEQ ID NO: 6905 - DNA, 701 bp, Artificial Sequence
  chemically treated genomic DNA (Homo sapiens) CpG-island No: 6905
attagagggcgagtaaggggattcggtacgtaaatcggtaattaggtgtttgcgtttatcggtgtaaatcgtttatgcggcggcgcgtcggcgatattcgggtaaacgggtaattagcgttaataacggatttaaacgttggggattacgagtacgagatcgtggacggattgtttacgttacgatatgcgatcgcgacgtcggtaatattcggtagcgagggttacgtataattagattaaatttgggcgcgtatttgcggaaaattttattttagcgcgatacgtcggtaaacggtaacgcgcgcgaggaaagttagatattttcggcgggaaataggttgttgggttgaatggcgttacgaattttttatagggggttgaatgtaaaagattgaatgtgggcgcgagttaacggtatcggtaagataaaggggttcggttgcgttgaggggtaaatcgggaaattgtttacgaggtttcgagggcgggggttatggagtggtggtgggtgggttaggtcggatggataagtggggattacggcgaaattaggattataacgaggaaatgttcgggaaggacggtagtggaggtattacgaaagggatatagaaaagaatggagtaaacgtagataattgatcgcgcgagtagtttttgcgttagcgtgcgggggtattggatgataagtgagaagtaa

SEQ ID NO: 6906 - DNA, 701 bp, Artificial Sequence
  chemically treated genomic DNA (Homo sapiens) CpG-island No: 6906
ttacttctcacttatcatccaatacccccgcacgctaacgcaaaaactactcgcgcgatcaattatctacgtttactccattcttttctatatccctttcgtaatacctccactaccgtccttcccgaacatttcctcgttataatcctaatttcgccgtaatccccacttatccatccgacctaacccacccaccaccactccataacccccgccctcgaaacctcgtaaacaatttcccgatttacccctcaacgcaaccgaacccctttatcttaccgataccgttaactcgcgcccacattcaatcttttacattcaaccccctataaaaaattcgtaacgccattcaacccaacaacctatttcccgccgaaaatatctaactttcctcgcgcgcgttaccgtttaccgacgtatcgcgctaaaataaaattttccgcaaatacgcgcccaaatttaatctaattatacgtaaccctcgctaccgaatattaccgacgtcgcgatcgcatatcgtaacgtaaacaatccgtccacgatctcgtactcgtaatccccaacgtttaaatccgttattaacgctaattacccgtttacccgaatatcgccgacgcgccgccgcataaacgatttacaccgataaacgcaaacacctaattaccgatttacgtaccgaatccccttactcgccctctaat

SEQ ID NO: 6907 - DNA, 701 bp, Artificial Sequence
  chemically treated genomic DNA (Homo sapiens) CpG-island No: 6907
ttattttttatttgttatttagtgttttcgtacgttaacgtaaagattattcgcgcggttagttatttgcgtttgttttatttttttttgtgtttttttcgtagtgtttttattgtcgtttttttcgggtattttttcgttgtagttttggtttcgtcgtaatttttatttgtttattcggtttgatttatttattattattttataattttcgttttcgagatttcgtaagtagtttttcggtttgttttttagcgtagtcgggtttttttgttttatcggtatcgttgattcgcgtttatatttagttttttgtatttagttttttatagggggttcgtggcgttatttagtttagtagtttatttttcgtcggaggtatttggtttttttcgcgcgcgttgtcgtttatcggcgtatcgcgttaaagtaaagtttttcgtaggtacgcgtttaggtttagtttagttgtacgtggttttcgttatcgggtgttatcggcgtcgcggtcgtatatcgtggcgtaggtaattcgtttacggtttcgtgttcgtagtttttaacgtttaggttcgttgttagcgttaattattcgtttgttcgggtgtcgtcggcgcgtcgtcgtataggcggtttgtatcggtgggcgtaggtatttggttatcggtttacgtgtcgggtttttttattcgttttttagt

SEQ ID NO: 6908 - DNA, 701 bp, Artificial Sequence
  chemically treated genomic DNA (Homo sapiens) CpG-island No: 6908
actaaaaaacgaataaaaaaacccgacacgtaaaccgataaccaaatacctacgcccaccgatacaaaccgcctatacgacgacgcgccgacgacacccgaacaaacgaataattaacgctaacaacgaacctaaacgttaaaaactacgaacacgaaaccgtaaacgaattacctacgccacgatatacgaccgcgacgccgataacacccgataacgaaaaccacgtacaactaaactaaacctaaacgcgtacctacgaaaaactttactttaacgcgatacgccgataaacgacaacgcgcgcgaaaaaaaccaaatacctccgacgaaaaataaactactaaactaaataacgccacgaaccccctataaaaaactaaatacaaaaaactaaatataaacgcgaatcaacgataccgataaaacaaaaaaacccgactacgctaaaaaacaaaccgaaaaactacttacgaaatctcgaaaacgaaaattataaaataataataaataaatcaaaccgaataaacaaataaaaattacgacgaaaccaaaactacaacgaaaaaatacccgaaaaaaacgacaataaaaacactacgaaaaaaacacaaaaaaaaataaaacaaacgcaaataactaaccgcgcgaataatctttacgttaacgtacgaaaacactaaataacaaataaaaaataa

SEQ ID NO: 6909 - DNA, 587 bp, Artificial Sequence
  chemically treated genomic DNA (Homo sapiens) CpG-island No: 6909
cgtttatgcgattcgtcgagttaacgttttgtcgtaacggtaagtgtacgttagacgtttattagtattgtattgtttagtttggtgcgatgcgtttatatcggggcgggtcgttttcgtttcgtttcgttttgtttttttcgtttcggttcggggcgggcgttgggcgtcgtttcgggtcgggcgcgcgtcgcggcgcgggtcgcgcgtcgcgtcgcgggcgtcgcgcggcgttcgggtcgggtcgggtcgcgcggggtttgggggtacgggcggggtcggggcgcgggcggggaggattggaaaaggggaatttggggtagtacggatcgtgtaagttgggcggcgagaggtcgatcggggaggcggagacgggggattacgtgatgaaatataaagttcggtattgcgaagcggtggacgcgagattgtatgtgatagtagcggatatgtatacgtggatttgggtggcgcggggatagaagatttgtacgcggattggggattagagttattaaatcggcgtagaatttttatataagtggggtaagtagtagttgagaggattgttggatgatatagtagtt

SEQ ID NO: 6910 - DNA, 587 bp, Artificial Sequence
  chemically treated genomic DNA (Homo sapiens) CpG-island No: 6910
aactactatatcatccaacaatcctctcaactactacttaccccacttatataaaaattctacgccgatttaataactctaatccccaatccgcgtacaaatcttctatccccgcgccacccaaatccacgtatacatatccgctactatcacatacaatctcgcgtccaccgcttcgcaataccgaactttatatttcatcacgtaatcccccgtctccgcctccccgatcgacctctcgccgcccaacttacacgatccgtactaccccaaattccccttttccaatcctccccgcccgcgccccgaccccgcccgtacccccaaaccccgcgcgacccgacccgacccgaacgccgcgcgacgcccgcgacgcgacgcgcgacccgcgccgcgacgcgcgcccgacccgaaacgacgcccaacgcccgccccgaaccgaaacgaaaaaaacaaaacgaaacgaaacgaaaacgacccgccccgatataaacgcatcgcaccaaactaaacaatacaatactaataaacgtctaacgtacacttaccgttacgacaaaacgttaactcgacgaatcgcataaacg

SEQ ID NO: 6911 - DNA, 587 bp, Artificial Sequence
  chemically treated genomic DNA (Homo sapiens) CpG-island No: 6911
ggttattatgttatttagtaatttttttaattattatttattttatttatatggaggttttacgtcggtttagtagttttggtttttagttcgcgtgtaagttttttattttcgcgttatttaagtttacgtgtatatgttcgttattattatatataatttcgcgtttatcgtttcgtagtatcgggttttatgttttattacgtagtttttcgttttcgttttttcggtcggtttttcgtcgtttaatttatacggttcgtattgttttaggttttttttttttaatttttttcgttcgcgtttcggtttcgttcgtgtttttaggtttcgcgcggttcggttcggttcgggcgtcgcgcggcgttcgcggcgcggcgcgcggttcgcgtcgcggcgcgcgttcggttcggggcggcgtttagcgttcgtttcgggtcggggcggggggggtagggcggggcggggcgggggcggttcgtttcgatgtaaacgtatcgtattaggttaagtaatatagtattagtgagcgtttggcgtgtatttgtcgttgcggtaaagcgttagttcggcgggtcgtataggcg

SEQ ID NO: 6912 - DNA, 587 bp, Artificial Sequence
  chemically treated genomic DNA (Homo sapiens) CpG-island No: 6912
cgcctatacgacccgccgaactaacgctttaccgcaacgacaaatacacgccaaacgctcactaatactatattacttaacctaatacgatacgtttacatcgaaacgaaccgcccccgccccgccccgccctaccccccccgccccgacccgaaacgaacgctaaacgccgccccgaaccgaacgcgcgccgcgacgcgaaccgcgcgccgcgccgcgaacgccgcgcgacgcccgaaccgaaccgaaccgcgcgaaacctaaaaacacgaacgaaaccgaaacgcgaacgaaaaaaattaaaaaaaaaaaacctaaaacaatacgaaccgtataaattaaacgacgaaaaaccgaccgaaaaaacgaaaacgaaaaactacgtaataaaacataaaacccgatactacgaaacgataaacgcgaaattatatataataataacgaacatatacacgtaaacttaaataacgcgaaaataaaaaacttacacgcgaactaaaaaccaaaactactaaaccgacgtaaaacctccatataaataaaataaataataattaaaaaaattactaaataacataataacc

SEQ ID NO: 6913 - DNA, 654 bp, Artificial Sequence
  chemically treated genomic DNA (Homo sapiens) CpG-island No: 6913
agggattcgggagttggaggtcgtagtcgcgcgagaatcgtcgggttgtcggggcgacgttttcggttggcgcgcgtagtttcgggagtaggggagttgtgaaatgggcggttagatttgttcggcgttgtgaattcgttagcgggagcgcgttcgcggtcgcgcgtttttcgttttttcggtttcgtcgttgacgcgtcgtagacgttggggagcgggaaggtaacggtagcgggatcgggatgaatagcggcggcggtttcggtttgggtttaggtttcggttttatttttacgtcggtgatttaggtgacgaatttgtcgtcggcggtgattagcgagtagatgcggacgttttttttttttttaggagaaatcgaggagttgcggttttatttttcggagtaagtgttggagttcggttgggggaggggcgcgggcgttatagagatttcgggagtcgaggcgtggaggagagcgcggacgcgggcgcgcggtgtatgttacgtgatcgcgtcggtttattttggtgtttatatttgattagggtattcgggtttcgtcgttttgttttttttagtcggatttggggggttaattattgtacggagtttttattaaggatttagaatggttgttttttttgtgttttcgg

SEQ ID NO: 6914 - DNA, 654 bp, Artificial Sequence
  chemically treated genomic DNA (Homo sapiens) CpG-island No: 6914
ccgaaaacacaaaaaaaacaaccattctaaatccttaataaaaactccgtacaataattaaccccccaaatccgactaaaaaaaacaaaacgacgaaacccgaataccctaatcaaatataaacaccaaaataaaccgacgcgatcacgtaacatacaccgcgcgcccgcgtccgcgctctcctccacgcctcgactcccgaaatctctataacgcccgcgcccctcccccaaccgaactccaacacttactccgaaaaataaaaccgcaactcctcgatttctcctaaaaaaaaaaaaaacgtccgcatctactcgctaatcaccgccgacgacaaattcgtcacctaaatcaccgacgtaaaaataaaaccgaaacctaaacccaaaccgaaaccgccgccgctattcatcccgatcccgctaccgttaccttcccgctccccaacgtctacgacgcgtcaacgacgaaaccgaaaaaacgaaaaacgcgcgaccgcgaacgcgctcccgctaacgaattcacaacgccgaacaaatctaaccgcccatttcacaactcccctactcccgaaactacgcgcgccaaccgaaaacgtcgccccgacaacccgacgattctcgcgcgactacgacctccaactcccgaatccct

SEQ ID NO: 6915 - DNA, 654 bp, Artificial Sequence
  chemically treated genomic DNA (Homo sapiens) CpG-island No: 6915
tcggaggtatagaaagggtaattattttaaatttttggtaagggtttcgtgtagtagttaattttttaaattcgattaaggagagtaggacggcggaattcgggtgttttaattaaatatgggtattaaggtaagtcggcgcgattacgtgatatgtatcgcgcgttcgcgttcgcgtttttttttacgtttcggttttcgaggtttttatggcgttcgcgttttttttttagtcgagttttagtatttatttcggggggtagagtcgtagtttttcgattttttttaggaaggaaaaaagcgttcgtatttgttcgttggttatcgtcgacgatagattcgttatttgaattatcgacgtgggggtgaggtcgaagtttaagtttaaatcgaagtcgtcgtcgttgtttatttcgatttcgttgtcgttgttttttcgttttttaacgtttacgacgcgttagcgacggagtcgggaaagcggagaacgcgcggtcgcgagcgcgttttcgttggcgaatttatagcgtcgggtagatttagtcgtttattttataatttttttgttttcggggttgcgcgcgttagtcggaagcgtcgtttcggtaattcggcggttttcgcgcggttgcggtttttagttttcgggttttt

SEQ ID NO: 6916 - DNA, 654 bp, Artificial Sequence
  chemically treated genomic DNA (Homo sapiens) CpG-island No: 6916
aaaaacccgaaaactaaaaaccgcaaccgcgcgaaaaccgccgaattaccgaaacgacgcttccgactaacgcgcgcaaccccgaaaacaaaaaaattataaaataaacgactaaatctacccgacgctataaattcgccaacgaaaacgcgctcgcgaccgcgcgttctccgctttcccgactccgtcgctaacgcgtcgtaaacgttaaaaaacgaaaaaacaacgacaacgaaatcgaaataaacaacgacgacgacttcgatttaaacttaaacttcgacctcacccccacgtcgataattcaaataacgaatctatcgtcgacgataaccaacgaacaaatacgaacgcttttttccttcctaaaaaaaatcgaaaaactacgactctaccccccgaaataaatactaaaactcgactaaaaaaaaaacgcgaacgccataaaaacctcgaaaaccgaaacgtaaaaaaaaacgcgaacgcgaacgcgcgatacatatcacgtaatcgcgccgacttaccttaatacccatatttaattaaaacacccgaattccgccgtcctactctccttaatcgaatttaaaaaattaactactacacgaaacccttaccaaaaatttaaaataattaccctttctatacctccga

SEQ ID NO: 6917 - DNA, 621 bp, Artificial Sequence
  chemically treated genomic DNA (Homo sapiens) CpG-island No: 6917
ggcgggggtgaaaagcgtgtagtaggttcgtattcgtgtcgtttagtcgttgggtgttagtcgtgcgtaggtgttgtggtttgttattttgttcggtgcgttgtcggaaatttttatcggattacgtattggtttgggggtgggttggtttacgttggtggcggcggagttgattgtcgcgacgcgcggtttaggatttatggtttagttagcgggtgaatttttcgtaattgacgtggtgttggcggggatcgcggtgattgcgattatcgttttttttttagaattgggtttgcgcgcgttatagcgtcgtttgacgttttggtatggagaagtataatgagtgaacgtttgagtattatttcgttggggtcgtatatcggcgtataaatttcgggtgtcgatttgacgcgttcgttaagcgataattagtttgaatagttttattatgcggtgttgcgttattacggtggtgtttttacgcgattaagttattacgtcgtagtagtaacgcgcgttggtttagcgttttggcgaattgtatatttattttgtttattcgtatgtcgaaggggttgacgagattatcgtgttggatatttataacgataattcgttaga

SEQ ID NO: 6918 - DNA, 621 bp, Artificial Sequence
  chemically treated genomic DNA (Homo sapiens) CpG-island No: 6918
tctaacgaattatcgttataaatatccaacacgataatctcgtcaaccccttcgacatacgaataaacaaaataaatatacaattcgccaaaacgctaaaccaacgcgcgttactactacgacgtaataacttaatcgcgtaaaaacaccaccgtaataacgcaacaccgcataataaaactattcaaactaattatcgcttaacgaacgcgtcaaatcgacacccgaaatttatacgccgatatacgaccccaacgaaataatactcaaacgttcactcattatacttctccataccaaaacgtcaaacgacgctataacgcgcgcaaacccaattctaaaaaaaaaacgataatcgcaatcaccgcgatccccgccaacaccacgtcaattacgaaaaattcacccgctaactaaaccataaatcctaaaccgcgcgtcgcgacaatcaactccgccgccaccaacgtaaaccaacccacccccaaaccaatacgtaatccgataaaaatttccgacaacgcaccgaacaaaataacaaaccacaacacctacgcacgactaacacccaacgactaaacgacacgaatacgaacctactacacgcttttcacccccgcc

SEQ ID NO: 6919 - DNA, 621 bp, Artificial Sequence
  chemically treated genomic DNA (Homo sapiens) CpG-island No: 6919
tttggcggattatcgttatgggtatttagtacgatgatttcgttaattttttcggtatgcgggtaaatagggtgaatatgtaattcgttaaaacgttgggttagcgcgcgttgttgttgcggcgtaatagtttgatcgcgtagaaatattatcgtgatggcgtagtatcgtatggtaaagttgtttaaattgattatcgtttaacgggcgcgttaggtcggtattcgaaatttgtgcgtcgatatacggttttagcggggtaatgtttagacgtttatttattgtatttttttatgttagggcgttaggcggcgttgtaacgcgcgtagatttagttttaaaagaaaggcgataatcgtaattatcgcgattttcgttagtattacgttagttgcgagaaatttattcgttgattgaattataaattttaaatcgcgcgtcgcggtaattagtttcgtcgttattagcgtagattagtttatttttagattaatacgtaattcggtgaggattttcggtagcgtatcgggtaaaatgataaattatagtatttgcgtacggttggtatttagcgattgggcggtacgaatgcgaatttgttgtacgttttttattttcgtt

SEQ ID NO: 6920 - DNA, 621 bp, Artificial Sequence
  chemically treated genomic DNA (Homo sapiens) CpG-island No: 6920
aacgaaaataaaaaacgtacaacaaattcgcattcgtaccgcccaatcgctaaataccaaccgtacgcaaatactataatttatcattttacccgatacgctaccgaaaatcctcaccgaattacgtattaatctaaaaataaactaatctacgctaataacgacgaaactaattaccgcgacgcgcgatttaaaatttataattcaatcaacgaataaatttctcgcaactaacgtaatactaacgaaaatcgcgataattacgattatcgcctttcttttaaaactaaatctacgcgcgttacaacgccgcctaacgccctaacataaaaaaatacaataaataaacgtctaaacattaccccgctaaaaccgtatatcgacgcacaaatttcgaataccgacctaacgcgcccgttaaacgataatcaatttaaacaactttaccatacgatactacgccatcacgataatatttctacgcgatcaaactattacgccgcaacaacaacgcgcgctaacccaacgttttaacgaattacatattcaccctatttacccgcataccgaaaaaattaacgaaatcatcgtactaaatacccataacgataatccgccaaa

SEQ ID NO: 6921 - DNA, 510 bp, Artificial Sequence
  chemically treated genomic DNA (Homo sapiens) CpG-island No: 6921
  misc_feature (446)..(447): n is either a, c, g or t
  misc_feature (449)..(449): n is either a, c, g or t
  misc_feature (455)..(455): n is either a, c, g or t
  misc_feature (457)..(457): n is either a, c, g or t
  misc_feature (464)..(466): n is either a, c, g or t
  misc_feature (474)..(474): n is either a, c, g or t
agttcgtaatcgagtgtttttatgaaagtgatttgcgtcgggtaaagcgacgttggtatggcgtttttcgttcggtatgtcgattttaatttttgtttcggtaaaggcgtaaatatatttacggttttcgtttcgatcgttgcgcggatgaaataggtcgtagagtaaatcggacgcgacgttggtttttatgtgttgtttatggtgattgtcgatgaaatcgacgatgtcgttcgcgttaaatgggaatattataaagcgggcgcggatgaagaggcgtttagttggttaatcgaatataagttagaaagaatattcgtttcggtattgatattaacgttcgttagatggtcgattttatttcggcggtaaatattaatatggggacgttagtcggtttttacgttagtgtcgcgcgtatgttagatgaagtcgtaagcgtgttnntnggtgtntncgaaggnnngttgttgnttaatttgtcgacgagttttgttgttcgggatatgt

SEQ ID NO: 6922 - DNA, 510 bp, Artificial Sequence
  chemically treated genomic DNA (Homo sapiens) CpG-island No: 6922
  misc_feature (37)..(37): n is either a, c, g or t
  misc_feature (45)..(47): n is either a, c, g or t
  misc_feature (54)..(54): n is either a, c, g or t
  misc_feature (56)..(56): n is either a, c, g or t
  misc_feature (62)..(62): n is either a, c, g or t
  misc_feature (64)..(65): n is either a, c, g or t
acatatcccgaacaacaaaactcgtcgacaaattaancaacaacnnnccttcgnanacaccnannaacacgcttacgacttcatctaacatacgcgcgacactaacgtaaaaaccgactaacgtccccatattaatatttaccgccgaaataaaatcgaccatctaacgaacgttaatatcaataccgaaacgaatattctttctaacttatattcgattaaccaactaaacgcctcttcatccgcgcccgctttataatattcccatttaacgcgaacgacatcgtcgatttcatcgacaatcaccataaacaacacataaaaaccaacgtcgcgtccgatttactctacgacctatttcatccgcgcaacgatcgaaacgaaaaccgtaaatatatttacgcctttaccgaaacaaaaattaaaatcgacataccgaacgaaaaacgccataccaacgtcgctttacccgacgcaaatcactttcataaaaacactcgattacgaact

SEQ ID NO: 6923 - DNA, 510 bp, Artificial Sequence
  chemically treated genomic DNA (Homo sapiens) CpG-island No: 6923
  misc_feature (37)..(37): n is either a, c, g or t
  misc_feature (45)..(47): n is either a, c, g or t
  misc_feature (54)..(54): n is either a, c, g or t
  misc_feature (56)..(56): n is either a, c, g or t
  misc_feature (62)..(62): n is either a, c, g or t
  misc_feature (64)..(65): n is either a, c, g or t
gtatatttcggatagtaaaattcgtcgataggttaantagtagtnnnttttcgnangtattnannggtacgtttgcgattttatttaatatgcgcgcgatattggcgtaagaatcgattaacgtttttatattgatgtttatcgtcgaagtgggatcggttatttgacgaacgttggtgttagtatcggagcgggtattttttttgatttgtgttcggttagttagttgaacgtttttttattcgcgttcgttttgtagtgtttttatttggcgcgagcggtatcgtcggttttatcggtaattattataaataatatataagagttaacgtcgcgttcggtttgttttgcggtttgttttattcgcgtagcggtcggggcgaaagtcgtgggtgtatttacgtttttgtcgaaatagaagttgaaatcggtatatcgggcggagaacgttatgttagcgtcgttttgttcggcgtagattatttttatggggatattcggttgcggatt

SEQ ID NO: 6924 - DNA, 510 bp, Artificial Sequence
  chemically treated genomic DNA (Homo sapiens) CpG-island No: 6924
  misc_feature (446)..(447): n is either a, c, g or t
  misc_feature (449)..(449): n is either a, c, g or t
  misc_feature (455)..(455): n is either a, c, g or t
  misc_feature (457)..(457): n is either a, c, g or t
  misc_feature (464)..(466): n is either a, c, g or t
  misc_feature (474)..(474): n is either a, c, g or t
aatccgcaaccgaatatccccataaaaataatctacgccgaacaaaacgacgctaacataacgttctccgcccgatataccgatttcaacttctatttcgacaaaaacgtaaatacacccacgactttcgccccgaccgctacgcgaataaaacaaaccgcaaaacaaaccgaacgcgacgttaactcttatatattatttataataattaccgataaaaccgacgataccgctcgcgccaaataaaaacactacaaaacgaacgcgaataaaaaaacgttcaactaactaaccgaacacaaatcaaaaaaaatacccgctccgatactaacaccaacgttcgtcaaataaccgatcccacttcgacgataaacatcaatataaaaacgttaatcgattcttacgccaatatcgcgcgcatattaaataaaatcgcaaacgtaccnntnaatacntncgaaaannnactactanttaacctatcgacgaattttactatccgaaatatac

SEQ ID NO: 6925 - DNA, 646 bp, Artificial Sequence
  chemically treated genomic DNA (Homo sapiens) CpG-island No: 6925
cgagtaggaggtacgaagagaggattggttaattgcgagtgggtaaggtgtggggggtatgtagcggggataacgtaagacgtgggacggcgaacggatgtaggatggggggatattggcgggggagtttagtcgttgcgagttaatgtacgacggattagatgggacgaagggcggcgtaaggtgtaggattaatatgggtataaatgggggagcgcggtgcggtgtaagcgaggcggggtagagcgtttgagatgaagagggatagcgattgggggattagggtggggagaagttgggaacgtattgttgttgaggagggggcgaaacgtgttgacggtttgtacgtgaaagttttgtcggtgtggtttacggatatggggttgaagagatgcgaaaggggatttgtatatggggattagtgagtatcgacgaaatgaaagagtggagaatttcgcggtttgggttagagcgcgatcggggtgcgaaggattgatttggtgagtgtgggaaggatggatcggagtgtacggaaggagcggagggttcgggcgattgtgacgaagttaacgaacgaatgcgggggggttgaaacgtggggattggattataaatgacgagtgggtggttcgttattatataatta

SEQ ID NO: 6926 - DNA, 646 bp, Artificial Sequence
  chemically treated genomic DNA (Homo sapiens) CpG-island No: 6926
taattatataataacgaaccacccactcgtcatttataatccaatccccacgtttcaacccccccgcattcgttcgttaacttcgtcacaatcgcccgaaccctccgctccttccgtacactccgatccatccttcccacactcaccaaatcaatccttcgcaccccgatcgcgctctaacccaaaccgcgaaattctccactctttcatttcgtcgatactcactaatccccatatacaaatcccctttcgcatctcttcaaccccatatccgtaaaccacaccgacaaaactttcacgtacaaaccgtcaacacgtttcgccccctcctcaacaacaatacgttcccaacttctccccaccctaatcccccaatcgctatccctcttcatctcaaacgctctaccccgcctcgcttacaccgcaccgcgctcccccatttatacccatattaatcctacaccttacgccgcccttcgtcccatctaatccgtcgtacattaactcgcaacgactaaactcccccgccaatatccccccatcctacatccgttcgccgtcccacgtcttacgttatccccgctacataccccccacaccttacccactcgcaattaaccaatcctctcttcgtacctcctactcg

SEQ ID NO: 6927 - DNA, 646 bp, Artificial Sequence
  chemically treated genomic DNA (Homo sapiens) CpG-island No: 6927
taattatgtggtagcgggttatttattcgttatttatagtttaatttttacgttttagttttttcgtattcgttcgttaatttcgttataatcgttcgggtttttcgtttttttcgtatatttcggtttattttttttatatttattaagttagtttttcgtatttcggtcgcgttttagtttaggtcgcggaattttttatttttttatttcgtcggtatttattagtttttatatgtaagttttttttcgtatttttttagttttatattcgtgggttatatcggtaaaatttttacgtgtaaatcgttaatacgtttcgttttttttttagtagtaatgcgtttttagtttttttttattttaattttttagtcgttgtttttttttattttaaacgttttatttcgtttcgtttgtatcgtatcgcgtttttttatttatatttatattaattttatattttgcgtcgtttttcgttttatttaattcgtcgtatattagttcgtaacggttaagttttttcgttagtgtttttttattttgtattcgttcgtcgttttacgttttacgttattttcgttatatgttttttatattttgtttattcgtagttggttagtttttttttcgtgttttttattcg

SEQ ID NO: 6928 - DNA, 646 bp, Artificial Sequence
  chemically treated genomic DNA (Homo sapiens) CpG-island No: 6928
cgaataaaaaacacgaaaaaaaaactaaccaactacgaataaacaaaatataaaaaacatataacgaaaataacgtaaaacgtaaaacgacgaacgaatacaaaataaaaaaacactaacgaaaaaacttaaccgttacgaactaatatacgacgaattaaataaaacgaaaaacgacgcaaaatataaaattaatataaatataaataaaaaaacgcgatacgatacaaacgaaacgaaataaaacgtttaaaataaaaaaaaacaacgactaaaaaattaaaataaaaaaaaactaaaaacgcattactactaaaaaaaaaacgaaacgtattaacgatttacacgtaaaaattttaccgatataacccacgaatataaaactaaaaaaatacgaaaaaaaacttacatataaaaactaataaataccgacgaaataaaaaaataaaaaattccgcgacctaaactaaaacgcgaccgaaatacgaaaaactaacttaataaatataaaaaaaataaaccgaaatatacgaaaaaaacgaaaaacccgaacgattataacgaaattaacgaacgaatacgaaaaaactaaaacgtaaaaattaaactataaataacgaataaataacccgctaccacataatta

SEQ ID NO: 6929 - DNA, 506 bp, Artificial Sequence
  chemically treated genomic DNA (Homo sapiens) CpG-island No: 6929
  misc_feature (438)..(441): n is either a, c, g or t
  misc_feature (443)..(443): n is either a, c, g or t
ttatcgacggacggacggacggacggacggaataaaatgcgggttatttgatagtgggtgtcgagattttgtattatatgtaacgattttgcggattggcgtcgagggggagcggggagtttaggagacgatgtgggggttgaagtttgtaggggggtgggcggacgagggacgcgcggagcgtttaaggtttaaatcgttcggttttttatggagttaagagacgtgttttaagttttagatcgtcgtcgtttagggagtaaaagacgtcgtaatgataatgtgttcgatagttacgttttgtatttttatgttttcgtgcgttttaggcgggatttcgttttgattattcgcggaggtttaatggatatagtttcggaacgcgtcgagtttgttttatcgttcgttgatgtattatttatattttttgcgtttatnnnngngtgttggtcgcggcgttgtgtggcgttgcggtgtttttgtcgtggcgcgtcggtgtgtggtcg

SEQ ID NO: 6930 - DNA, 506 bp, Artificial Sequence
  chemically treated genomic DNA (Homo sapiens) CpG-island No: 6930
  misc_feature (64)..(64): n is either a, c, g or t
  misc_feature (66)..(69): n is either a, c, g or t
cgaccacacaccgacgcgccacgacaaaaacaccgcaacgccacacaacgccgcgaccaacacncnnnnataaacgcaaaaaatataaataatacatcaacgaacgataaaacaaactcgacgcgttccgaaactatatccattaaacctccgcgaataatcaaaacgaaatcccgcctaaaacgcacgaaaacataaaaatacaaaacgtaactatcgaacacattatcattacgacgtcttttactccctaaacgacgacgatctaaaacttaaaacacgtctcttaactccataaaaaaccgaacgatttaaaccttaaacgctccgcgcgtccctcgtccgcccacccccctacaaacttcaacccccacatcgtctcctaaactccccgctccccctcgacgccaatccgcaaaatcgttacatataatacaaaatctcgacacccactatcaaataacccgcattttattccgtccgtccgtccgtccgtccgtcgataa

SEQ ID NO: 6931 - DNA, 506 bp, Artificial Sequence
  chemically treated genomic DNA (Homo sapiens) CpG-island No: 6931
  misc_feature (64)..(64): n is either a, c, g or t
  misc_feature (66)..(69): n is either a, c, g or t
cgattatatatcgacgcgttacggtagagatatcgtagcgttatataacgtcgcgattagtatntnnnnataaacgtaaggggtgtaggtggtgtattaacgggcggtgaggtagattcggcgcgtttcgggattgtgtttattagattttcgcggatggttaggacgggatttcgtttgaaacgtacgagggtatgagggtgtaaggcgtgattatcgaatatattgttattgcgacgttttttattttttaagcggcggcgatttagggtttaaggtacgttttttaattttatgaagggtcggacgatttaggttttaggcgtttcgcgcgtttttcgttcgtttatttttttgtagattttaatttttatatcgttttttaggtttttcgttttttttcggcgttagttcgtagggtcgttgtatatagtataaggtttcggtatttattgttagatggttcgtattttgtttcgttcgttcgttcgttcgttcgtcggtgg

SEQ ID NO: 6932 - DNA, 506 bp, Artificial Sequence
  chemically treated genomic DNA (Homo sapiens) CpG-island No: 6932
  misc_feature (438)..(441): n is either a, c, g or t
  misc_feature (443)..(443): n is either a, c, g or t
ccaccgacgaacgaacgaacgaacgaacgaaacaaaatacgaaccatctaacaataaataccgaaaccttatactatatacaacgaccctacgaactaacgccgaaaaaaaacgaaaaacctaaaaaacgatataaaaattaaaatctacaaaaaaataaacgaacgaaaaacgcgcgaaacgcctaaaacctaaatcgtccgacccttcataaaattaaaaaacgtaccttaaaccctaaatcgccgccgcttaaaaaataaaaaacgtcgcaataacaatatattcgataatcacgccttacaccctcataccctcgtacgtttcaaacgaaatcccgtcctaaccatccgcgaaaatctaataaacacaatcccgaaacgcgccgaatctacctcaccgcccgttaatacaccacctacaccccttacgtttatnnnnanatactaatcgcgacgttatataacgctacgatatctctaccgtaacgcgtcgatatataatcg

SEQ ID NO: 6933 - DNA, 652 bp, Artificial Sequence
  chemically treated genomic DNA (Homo sapiens) CpG-island No: 6933
tcggggaaggttcgattgaggtttttatttaattttcgagttaaagtttgtttttttcgttttcgtaatacgttcgcgggcgttggtaattacgttattgattttatcgagtattttttgcgtcgggtcgatatattttattagcggcgagtgggaaagatagtgaagataagcgtgtatattaggttattttttcgatagaaacgtcggtattagggcgggttagcgttattatcgacgttagtttatttagggttttgtttagggtttgcggaatggcggtggcggtaataaagcgattcgggcgtattattattagcgaagtattgtgttgcgcgaattagttacgtaggcgattttgcgtatcgtttacgcgtagtacgtcgtcgtggttattttgtgcggtatgaatttgtattttcggtattatttgaatgaagcgtgtgtttaacgcgcgttattgttggatttgttcggcgtttattttttatagtggattgtatttttagttaattatcgcgaagttcgcgtcgatcgcgttatcgagtagcgttacgtcgttcggttttagcgtgatttttggttgaataaatattttgtcgatcggagagtggttcggttggttttacgtaggaggggatcgtcgggattt

SEQ ID NO: 6934 - DNA, 652 bp, Artificial Sequence
  chemically treated genomic DNA (Homo sapiens) CpG-island No: 6934
aaatcccgacgatcccctcctacgtaaaaccaaccgaaccactctccgatcgacaaaatatttattcaaccaaaaatcacgctaaaaccgaacgacgtaacgctactcgataacgcgatcgacgcgaacttcgcgataattaactaaaaatacaatccactataaaaaataaacgccgaacaaatccaacaataacgcgcgttaaacacacgcttcattcaaataataccgaaaatacaaattcataccgcacaaaataaccacgacgacgtactacgcgtaaacgatacgcaaaatcgcctacgtaactaattcgcgcaacacaatacttcgctaataataatacgcccgaatcgctttattaccgccaccgccattccgcaaaccctaaacaaaaccctaaataaactaacgtcgataataacgctaacccgccctaataccgacgtttctatcgaaaaaataacctaatatacacgcttatcttcactatctttcccactcgccgctaataaaatatatcgacccgacgcaaaaaatactcgataaaatcaataacgtaattaccaacgcccgcgaacgtattacgaaaacgaaaaaaacaaactttaactcgaaaattaaataaaaacctcaatcgaaccttccccga

SEQ ID NO: 6935 - DNA, 652 bp, Artificial Sequence
  chemically treated genomic DNA (Homo sapiens) CpG-island No: 6935
aaatttcggcggtttttttttgcgtaaggttaatcgaattatttttcggtcggtaagatgtttatttagttaaaagttacgttgaaatcgggcgacgtgacgttgttcgataacgcgatcggcgcgaatttcgcggtaattggttggggatgtaatttattgtgggggatgagcgtcgagtaaatttagtagtggcgcgcgttgggtatacgttttatttaggtggtgtcggaagtgtaaatttatatcgtataggataattacgacggcgtattacgcgtgggcgatacgtaaggtcgtttgcgtagttggttcgcgtaatataatgtttcgttggtggtgatgcgttcggatcgttttgttgtcgttatcgttatttcgtaaattttgggtaagattttgaataaattggcgtcggtgatgacgttgattcgttttgatgtcgacgtttttgtcgaaaaggtagtttgatatgtacgtttatttttattgttttttttattcgtcgttggtggggtatgtcgattcggcgtaagaggtgttcgatgaggttaatggcgtgattgttagcgttcgcgagcgtattgcgggggcgaaagagataggttttaattcgggggttagataaaggttttaatcggatttttttcgg

SEQ ID NO: 6936 - DNA, 652 bp, Artificial Sequence
  chemically treated genomic DNA (Homo sapiens) CpG-island No: 6936
ccgaaaaaaatccgattaaaacctttatctaacccccgaattaaaacctatctctttcgcccccgcaatacgctcgcgaacgctaacaatcacgccattaacctcatcgaacacctcttacgccgaatcgacataccccaccaacgacgaataaaaaaaacaataaaaataaacgtacatatcaaactaccttttcgacaaaaacgtcgacatcaaaacgaatcaacgtcatcaccgacgccaatttattcaaaatcttacccaaaatttacgaaataacgataacgacaacaaaacgatccgaacgcatcaccaccaacgaaacattatattacgcgaaccaactacgcaaacgaccttacgtatcgcccacgcgtaatacgccgtcgtaattatcctatacgatataaatttacacttccgacaccacctaaataaaacgtatacccaacgcgcgccactactaaatttactcgacgctcatcccccacaataaattacatccccaaccaattaccgcgaaattcgcgccgatcgcgttatcgaacaacgtcacgtcgcccgatttcaacgtaacttttaactaaataaacatcttaccgaccgaaaaataattcgattaaccttacgcaaaaaaaaaccgccgaaattt

SEQ ID NO: 6937 - DNA, 592 bp, Artificial Sequence
  chemically treated genomic DNA (Homo sapiens) CpG-island No: 6937
gtcgtttgcgttaattgtacgtttcggatgatttgtattgtattgtttattttgtcgcgttcgcgtatatatatgggagtgaggttgcgcgcgcgcgcgcgtgcggggagtgggagcggacgggataaacggggggaaggggggatgattggggagtgggttgtatacggacggggggtcggtcgttgtcgtgaatagacgaagttatttgcgaaggacgaggtttggtgcggatattagttcgatatcgcgttcgcgacgatgataagcgatgatttatggtggtattatatcgttgtatcggatcgtaaataacgaaaagggcgggattaagtgattttaggtatcgacggttttgcggtttcgttttattattcggtgattgttcgtagtatttcgtgcgggtcggtttgcggattttgttcgtagttttgtttgttcgttagggtcgagttgttcgttcgttttgttttgaggtttcggtttttcggtcggtttttggtttttggtgattttacgggttttgcgttgtcggggggggtttcgttagtttattttgaaagtgtattaattgttatttattaataatata

SEQ ID NO: 6938 - DNA, 592 bp, Artificial Sequence
  chemically treated genomic DNA (Homo sapiens) CpG-island No: 6938
tatattattaataaataacaattaatacactttcaaaataaactaacgaaaccccccccgacaacgcaaaacccgtaaaatcaccaaaaaccaaaaaccgaccgaaaaaccgaaacctcaaaacaaaacgaacgaacaactcgaccctaacgaacaaacaaaactacgaacaaaatccgcaaaccgacccgcacgaaatactacgaacaatcaccgaataataaaacgaaaccgcaaaaccgtcgatacctaaaatcacttaatcccgcccttttcgttatttacgatccgatacaacgatataataccaccataaatcatcgcttatcatcgtcgcgaacgcgatatcgaactaatatccgcaccaaacctcgtccttcgcaaataacttcgtctattcacgacaacgaccgaccccccgtccgtatacaacccactccccaatcatccccccttccccccgtttatcccgtccgctcccactccccgcacgcgcgcgcgcgcgcaacctcactcccatatatatacgcgaacgcgacaaaataaacaatacaatacaaatcatccgaaacgtacaattaacgcaaacgac

SEQ ID NO: 6939 - DNA, 592 bp, Artificial Sequence
  chemically treated genomic DNA (Homo sapiens) CpG-island No: 6939
tgtgttgttaataggtggtaattggtgtatttttaggataaattggcgggatttttttcgatagcgtaaagttcgtaaaattattaaagattaaaagtcgatcggaagatcgggattttaaggtaggacgaacgggtagttcggttttagcggatagataaggttacgaatagagttcgtaagtcggttcgtacgaggtattacggatagttatcgggtggtaaaacgaggtcgtagggtcgtcgatgtttggaattatttggtttcgtttttttcgttatttacgattcggtatagcgatgtggtattattatgggttatcgtttgttatcgtcgcgggcgcggtatcgggttaatgttcgtattaggtttcgtttttcgtaagtagtttcgtttatttacggtaacgatcggtttttcgttcgtgtgtaatttattttttagttattttttttttttttcgtttgtttcgttcgtttttatttttcgtacgcgcgcgcgcgcgtagttttatttttatatgtatacgcgagcgcgatagggtaagtaatatagtataagttattcgaagcgtgtagttggcgtaggcggt

SEQ ID NO: 6940 - DNA, 592 bp, Artificial Sequence
  chemically treated genomic DNA (Homo sapiens) CpG-island No: 6940
accgcctacgccaactacacgcttcgaataacttatactatattacttaccctatcgcgctcgcgtatacatataaaaataaaactacgcgcgcgcgcgcgtacgaaaaataaaaacgaacgaaacaaacgaaaaaaaaaaaaaataactaaaaaataaattacacacgaacgaaaaaccgatcgttaccgtaaataaacgaaactacttacgaaaaacgaaacctaatacgaacattaacccgataccgcgcccgcgacgataacaaacgataacccataataataccacatcgctataccgaatcgtaaataacgaaaaaaacgaaaccaaataattccaaacatcgacgaccctacgacctcgttttaccacccgataactatccgtaatacctcgtacgaaccgacttacgaactctattcgtaaccttatctatccgctaaaaccgaactacccgttcgtcctaccttaaaatcccgatcttccgatcgacttttaatctttaataattttacgaactttacgctatcgaaaaaaatcccgccaatttatcctaaaaatacaccaattaccacctattaacaacaca

SEQ ID NO: 6941 - DNA, 549 bp, Artificial Sequence
  chemically treated genomic DNA (Homo sapiens) CpG-island No: 6941
gcgaggtcgtggtttcggggacgcgtttttcgttcgagagcgcgtacgatttcgatgtgggaagtaattttttataaatttatgagttgagtcgaaatgaatattttgcgtttcgcgtgtagacgcgggaggatagtattaagtacgcggagttggtgttggagcgcgttttggatcgagaacgggagtttagtttttagttagtgttgacggcgttggacggagggattttagtttttttcgttagtttgtttatttatattaaggtgttggacgcgaatgataatgcgtttgtttttaattagtttttgtatcgggcgcgcgttttggaggatgtatttttcggtacgcgcgtggtataagtttttgtaacggatttggatgaaggttttaacggtgaaattatttattttttcggtagttataatcgcgtcggcgtgcggtaattattcgttttagattttgtaatcgggatgttgataattaagggtcggttggatttcgaggatattaaattttatgagatttatatttaggttaaagataagg

SEQ ID NO: 6942 - DNA, 549 bp, Artificial Sequence
  chemically treated genomic DNA (Homo sapiens) CpG-island No: 6942
ccttatctttaacctaaatataaatctcataaaatttaatatcctcgaaatccaaccgacccttaattatcaacatcccgattacaaaatctaaaacgaataattaccgcacgccgacgcgattataactaccgaaaaaataaataatttcaccgttaaaaccttcatccaaatccgttacaaaaacttataccacgcgcgtaccgaaaaatacatcctccaaaacgcgcgcccgatacaaaaactaattaaaaacaaacgcattatcattcgcgtccaacaccttaatataaataaacaaactaacgaaaaaaactaaaatccctccgtccaacgccgtcaacactaactaaaaactaaactcccgttctcgatccaaaacgcgctccaacaccaactccgcgtacttaatactatcctcccgcgtctacacgcgaaacgcaaaatattcatttcgactcaactcataaatttataaaaaattacttcccacatcgaaatcgtacgcgctctcgaacgaaaaacgcgtccccgaaaccacgacctcgc

SEQ ID NO: 6943 - DNA, 549 bp, Artificial Sequence
  chemically treated genomic DNA (Homo sapiens) CpG-island No: 6943
ttttgtttttggtttggatgtaaattttatggagtttggtgttttcgaagtttagtcgatttttgattgttagtatttcggttataaggtttaaggcgaatagttgtcgtacgtcggcgcggttgtggttgtcgaaggagtaaataattttatcgttggggtttttatttagattcgttgtaaggatttgtattacgcgcgtgtcggagggtgtattttttaggacgcgcgttcggtataaggattggttgaagataggcgtattgttattcgcgtttagtattttgatgtgaataggtaggttggcggagagagttggggttttttcgtttaacgtcgttagtattaattggagattaggttttcgttttcggtttagggcgcgttttaatattagtttcgcgtatttggtgttgttttttcgcgtttgtacgcgaagcgtaaagtatttatttcggtttagtttataggtttgtaaagagttgttttttatatcgggatcgtgcgcgttttcgagcggaaagcgcgttttcggagttacggtttcgt

SEQ ID NO: 6944 - DNA, 549 bp, Artificial Sequence
  chemically treated genomic DNA (Homo sapiens) CpG-island No: 6944
acgaaaccgtaactccgaaaacgcgctttccgctcgaaaacgcgcacgatcccgatataaaaaacaactctttacaaacctataaactaaaccgaaataaatactttacgcttcgcgtacaaacgcgaaaaaacaacaccaaatacgcgaaactaatattaaaacgcgccctaaaccgaaaacgaaaacctaatctccaattaatactaacgacgttaaacgaaaaaaccccaactctctccgccaacctacctattcacatcaaaatactaaacgcgaataacaatacgcctatcttcaaccaatccttataccgaacgcgcgtcctaaaaaatacaccctccgacacgcgcgtaatacaaatccttacaacgaatctaaataaaaaccccaacgataaaattatttactccttcgacaaccacaaccgcgccgacgtacgacaactattcgccttaaaccttataaccgaaatactaacaatcaaaaatcgactaaacttcgaaaacaccaaactccataaaatttacatccaaaccaaaaacaaaa

SEQ ID NO: 6945 - DNA, 745 bp, Artificial Sequence
  chemically treated genomic DNA (Homo sapiens) CpG-island No: 6945
ttgagtagtgtcgagatatcgtatagcggtgtgcggattttatggtttatcgtcgttagaaacgcgattttgtttggttggttttttttgttttcgttcgtgtttgtcggtgtttattattagtttttgtaatttagttgtacgcgttttgatttgcgtcgtcgttgttcgcggtggcgatttagtgtatgaatattgttgcgaaacgtattattagtcgttcgatggtatttagttttcgtacgttagcggttttcgggaaggggagttaatattatcgtttagtagtcgttgtagcgtttgcgtttgtcggtaagtggacgcgtgattgagcgataaattacgcgttagaggattagattagtgcgtaaagtgaaattatttttagtaataataggttgtattggcgcgtgtattcgttttttttagatgcgttagttcgtgttgattacgtaggttatggtgttgattagttgattgagttcggtattaaattgggcgaattggcgaaggtattttgtgttagcgattggtgggtaatgcgggagttttcggttggttgataataggtcgcgtaatgtttttttgtcggtttcggtttatattttgttttggtttcggaaacgcgttttttttttttttgtattttcgcgaatatatttcgttgtattattttatttttggttgttatgttatttttatttttcgattttagaggatttttttggtgatgcgtgtgaaagtg

SEQ ID NO: 6946 - DNA, 745 bp, Artificial Sequence
  chemically treated genomic DNA (Homo sapiens) CpG-island No: 6946
cactttcacacgcatcaccaaaaaaatcctctaaaatcgaaaaataaaaataacataacaaccaaaaataaaataatacaacgaaatatattcgcgaaaatacaaaaaaaaaaaaaacgcgtttccgaaaccaaaacaaaatataaaccgaaaccgacaaaaaaacattacgcgacctattatcaaccaaccgaaaactcccgcattacccaccaatcgctaacacaaaataccttcgccaattcgcccaatttaataccgaactcaatcaactaatcaacaccataacctacgtaatcaacacgaactaacgcatctaaaaaaaacgaatacacgcgccaatacaacctattattactaaaaataatttcactttacgcactaatctaatcctctaacgcgtaatttatcgctcaatcacgcgtccacttaccgacaaacgcaaacgctacaacgactactaaacgataatattaactccccttcccgaaaaccgctaacgtacgaaaactaaataccatcgaacgactaataatacgtttcgcaacaatattcatacactaaatcgccaccgcgaacaacgacgacgcaaatcaaaacgcgtacaactaaattacaaaaactaataataaacaccgacaaacacgaacgaaaacaaaaaaaaccaaccaaacaaaatcgcgtttctaacgacgataaaccataaaatccgcacaccgctatacgatatctcgacactactcaa

SEQ ID NO: 6947 - DNA, 745 bp, Artificial Sequence
  chemically treated genomic DNA (Homo sapiens) CpG-island No: 6947
tatttttatacgtattattagggggattttttagagtcgaagggtgggagtgatatgataattaggagtggagtaatatagcggggtgtgttcgcgggagtataaaaagaagagaggcgcgttttcgaggttagaataaagtgtgagtcggggtcgataaaagggtattgcgcggtttattattagttagtcgggaattttcgtattgtttattagtcgttggtatagaatattttcgttagttcgtttagtttagtatcgaatttagttagttggttaatattatggtttgcgtaattagtacggattggcgtatttggaaaaagcgagtgtacgcgttaatatagtttgttattgttggggatggttttattttgcgtattgatttgattttttggcgcgtggtttatcgtttagttacgcgtttatttgtcgataaacgtaggcgttgtaacggttgttggacggtgatattgattttttttttcggaaatcgttggcgtacgggagttggatattatcgggcggttgatgatgcgtttcgtagtaatgtttatgtattgaatcgttatcgcgaatagcggcggcgtaggttaaagcgcgtatagttgaattgtaggaattggtgataaatatcgataggtacgggcggaagtagaaaaagttagttaggtaaaatcgcgtttttggcggcgatgagttatgagattcgtatatcgttgtacggtatttcggtattgtttaa

SEQ ID NO: 6948 - DNA, 745 bp, Artificial Sequence
  chemically treated genomic DNA (Homo sapiens) CpG-island No: 6948
ttaaacaataccgaaataccgtacaacgatatacgaatctcataactcatcgccgccaaaaacgcgattttacctaactaactttttctacttccgcccgtacctatcgatatttatcaccaattcctacaattcaactatacgcgctttaacctacgccgccgctattcgcgataacgattcaatacataaacattactacgaaacgcatcatcaaccgcccgataatatccaactcccgtacgccaacgatttccgaaaaaaaaaatcaatatcaccgtccaacaaccgttacaacgcctacgtttatcgacaaataaacgcgtaactaaacgataaaccacgcgccaaaaaatcaaatcaatacgcaaaataaaaccatccccaacaataacaaactatattaacgcgtacactcgctttttccaaatacgccaatccgtactaattacgcaaaccataatattaaccaactaactaaattcgatactaaactaaacgaactaacgaaaatattctataccaacgactaataaacaatacgaaaattcccgactaactaataataaaccgcgcaatacccttttatcgaccccgactcacactttattctaacctcgaaaacgcgcctctcttctttttatactcccgcgaacacaccccgctatattactccactcctaattatcatatcactcccacccttcgactctaaaaaatccccctaataatacgtataaaaata

SEQ ID NO: 6949 - DNA, 866 bp, Artificial Sequence
  chemically treated genomic DNA (Homo sapiens) CpG-island No: 6949
  misc_feature (29)..(29): n is either a, c, g or t
ttgagtattcgcgttttaatgcgttaggntttatgtgttatttcgtttagcgcgacgcgtcgttgtcgttaggttgaataatcgtcgcgatcgatattagggtaaaggcgaggaggcgcgatcgcgtattttacggtagatatgtttttcgtcgagcggggaggtaacgttatcgtaacgataagtttatcgggaagtagggcggtttaatgtgcggcgtttttttcggagggtgataaaaattagttagtgtgatatgcgagttttttttttcggcgtgatggtttttattatcgtatttagtaacgtattgcgatcgttatatcgttcggatgggtggtaatgtaggtttcgttacgtttattatcgcgtgttgacggttaaagtttttaagcgtcgcgtagcgttttcgggtaggcgtttattgtagggttgattggtgtcgtaaaaatagggtagcgcgtgcgttggagtagattatttgcggtggttgtttgattattaattgattagacgcgttagcgagtagggcgcgggagagtatcgcgtaatacgacgtacgcgttcgtgagtcgttaggtcggtgtttcgtattagtgttcgatgcgtagtttattcgcgtcggttattttaattttatgcgagttttaggtcgtttatatcgataaggtgggtgggcgttttaatttttagttttataggtttagtagattggtttcgttcgcgataaattttgcgtcgggtacggttgagcgttaagtgtcgtttcggttggggtatttattcgtttataggtaacgtttttatgattttatttttttcgtagtatttttaatggcggtaagatgttagcgtatgtattatag

SEQ ID NO: 6950 - DNA, 866 bp, Artificial Sequence
  chemically treated genomic DNA (Homo sapiens) CpG-island No: 6950
  misc_feature (838)..(838): n is either a, c, g or t
ctataatacatacgctaacatcttaccgccattaaaaatactacgaaaaaaataaaatcataaaaacgttacctataaacgaataaataccccaaccgaaacgacacttaacgctcaaccgtacccgacgcaaaatttatcgcgaacgaaaccaatctactaaacctataaaactaaaaattaaaacgcccacccaccttatcgatataaacgacctaaaactcgcataaaattaaaataaccgacgcgaataaactacgcatcgaacactaatacgaaacaccgacctaacgactcacgaacgcgtacgtcgtattacgcgatactctcccgcgccctactcgctaacgcgtctaatcaattaataatcaaacaaccaccgcaaataatctactccaacgcacgcgctaccctatttttacgacaccaatcaaccctacaataaacgcctacccgaaaacgctacgcgacgcttaaaaactttaaccgtcaacacgcgataataaacgtaacgaaacctacattaccacccatccgaacgatataacgatcgcaatacgttactaaatacgataataaaaaccatcacgccgaaaaaaaaaactcgcatatcacactaactaatttttatcaccctccgaaaaaaacgccgcacattaaaccgccctacttcccgataaacttatcgttacgataacgttacctccccgctcgacgaaaaacatatctaccgtaaaatacgcgatcgcgcctcctcgcctttaccctaatatcgatcgcgacgattattcaacctaacgacaacgacgcgtcgcgctaaacgaaataacacataaancctaacgcattaaaacgcgaatactcaa

SEQ ID NO: 6951 - DNA, 866 bp, Artificial Sequence
  chemically treated genomic DNA (Homo sapiens) CpG-island No: 6951
  misc_feature (838)..(838): n is either a, c, g or t
ttgtggtgtatacgttaatattttgtcgttattgaagatgttgcgggggagataaaattatgaaggcgttatttatgaacgagtgaatattttagtcgaggcggtatttagcgtttagtcgtattcggcgtaaaatttatcgcgggcgggattaatttgttggatttgtgaagttggaaattgaaacgtttatttattttatcgatgtgaacggtttgggattcgtataagattgaagtgatcgacgcgggtgggttgcgtatcgggtattggtacggaatatcgatttggcggtttacgagcgcgtgcgtcgtgttacgcggtattttttcgcgttttgttcgttggcgcgtttggttagttagtaattaggtaattatcgtaggtaatttgttttagcgtacgcgttgttttatttttacgatattaattagttttgtaataagcgtttgttcgggagcgttgcgcggcgtttgaaggttttagtcgttagtacgcggtggtaggcgtagcgaagtttgtattgttatttattcgagcgatatggcggtcgtaatgcgttgttggatgcggtggtggaaattattacgtcggagggaaagattcgtatattatattggttgatttttattatttttcgggaaaaacgtcgtatattaaatcgttttgtttttcggtgagtttatcgttgcggtgacgttattttttcgttcggcggaaaatatatttatcgtaaggtgcgcgatcgcgttttttcgtttttgttttggtatcggtcgcggcgattatttagtttgacggtagcggcgcgtcgcgttgggcggagtagtatataagntttggcgtattgaggcgcggatgtttag

SEQ ID NO: 6952 - DNA, 866 bp, Artificial Sequence
  chemically treated genomic DNA (Homo sapiens) CpG-island No: 6952
  misc_feature (29)..(29): n is either a, c, g or t
ctaaacatccgcgcctcaatacgccaaancttatatactactccgcccaacgcgacgcgccgctaccgtcaaactaaataatcgccgcgaccgataccaaaacaaaaacgaaaaaacgcgatcgcgcaccttacgataaatatattttccgccgaacgaaaaaataacgtcaccgcaacgataaactcaccgaaaaacaaaacgatttaatatacgacgtttttcccgaaaaataataaaaatcaaccaatataatatacgaatctttccctccgacgtaataatttccaccaccgcatccaacaacgcattacgaccgccatatcgctcgaataaataacaatacaaacttcgctacgcctaccaccgcgtactaacgactaaaaccttcaaacgccgcgcaacgctcccgaacaaacgcttattacaaaactaattaatatcgtaaaaataaaacaacgcgtacgctaaaacaaattacctacgataattacctaattactaactaaccaaacgcgccaacgaacaaaacgcgaaaaaataccgcgtaacacgacgcacgcgctcgtaaaccgccaaatcgatattccgtaccaatacccgatacgcaacccacccgcgtcgatcacttcaatcttatacgaatcccaaaccgttcacatcgataaaataaataaacgtttcaatttccaacttcacaaatccaacaaattaatcccgcccgcgataaattttacgccgaatacgactaaacgctaaataccgcctcgactaaaatattcactcgttcataaataacgccttcataattttatctcccccgcaacatcttcaataacgacaaaatattaacgtatacaccacaa

SEQ ID NO: 6953 - DNA, 596 bp, Artificial Sequence
  chemically treated genomic DNA (Homo sapiens) CpG-island No: 6953
tcgcgattgggtttattcgagttttttcgatagggaaattttggtcgtagcgttatgtagttgtcgttagaaatcgtttacgtttagcgttgtattaaattggcgcgttggtaacgattgttcgtgcgtaaggcgggtaatgcgttatgttaaatcgtacggtatgttgtataattaggcggcgaagaagtataattggtagacgttatcgttagagcggtatacgtttgcgattagtattgattttcgtcgggttggcgggaagcgagttgattcgtgtaggaagtaatatggtttgataacgcgcgaggaagtgtttgtcgatcgcggttttaggttgacggttcgttggtgtcgcgaagttagttaggcgcgttgattaaaacgaagaataggcgttggcgtaaacgttggagatggtgtaatacggagagttaaaagtattatcggcgaatgggtaacggtcgcggcgtaaacggttgtttgtatggcgacggcgagtacgtattggcgttcgttcgtcgattagttttgtatttgtcgaaaaggggattgttgtcgtagtataatttcgattataaagaatgaaaaaagga

SEQ ID NO: 6954 - DNA, 596 bp, Artificial Sequence
  chemically treated genomic DNA (Homo sapiens) CpG-island No: 6954
tccttttttcattctttataatcgaaattatactacgacaacaatccccttttcgacaaatacaaaactaatcgacgaacgaacgccaatacgtactcgccgtcgccatacaaacaaccgtttacgccgcgaccgttacccattcgccgataatacttttaactctccgtattacaccatctccaacgtttacgccaacgcctattcttcgttttaatcaacgcgcctaactaacttcgcgacaccaacgaaccgtcaacctaaaaccgcgatcgacaaacacttcctcgcgcgttatcaaaccatattacttcctacacgaatcaactcgcttcccgccaacccgacgaaaatcaatactaatcgcaaacgtataccgctctaacgataacgtctaccaattatacttcttcgccgcctaattatacaacataccgtacgatttaacataacgcattacccgccttacgcacgaacaatcgttaccaacgcgccaatttaatacaacgctaaacgtaaacgatttctaacgacaactacataacgctacgaccaaaatttccctatcgaaaaaactcgaataaacccaatcgcga

SEQ ID NO: 6955 - DNA, 596 bp, Artificial Sequence
  chemically treated genomic DNA (Homo sapiens) CpG-island No: 6955
ttttttttttattttttataatcggggttatgttgcgataataatttttttttcggtaaatgtagagttagtcggcgggcgaacgttagtgcgtgttcgtcgtcgttatgtaggtagtcgtttgcgtcgcgatcgttgtttattcgtcggtgatatttttgatttttcgtgttgtattatttttagcgtttgcgttagcgtttgtttttcgttttaattaacgcgtttgattggtttcgcggtattagcgagtcgttagtttgaaatcgcgatcggtaaatattttttcgcgcgttgttagattatattgttttttgtacgaattagttcgtttttcgttagttcgacgagaattaatgttgatcgtaagcgtatatcgttttggcgatggcgtttgttagttgtgttttttcgtcgtttggttgtataatatgtcgtgcggtttgatatgacgtattattcgttttgcgtacgggtaatcgttgttagcgcgttaatttgatatagcgttgggcgtaaacggtttttggcggtagttgtatggcgttgcgattaaaatttttttgtcgggaaaattcgggtgagtttaatcgcga

SEQ ID NO: 6956 - DNA, 596 bp, Artificial Sequence
  chemically treated genomic DNA (Homo sapiens) CpG-island No: 6956
tcgcgattaaactcacccgaattttcccgacaaaaaaattttaatcgcaacgccatacaactaccgccaaaaaccgtttacgcccaacgctatatcaaattaacgcgctaacaacgattacccgtacgcaaaacgaataatacgtcatatcaaaccgcacgacatattatacaaccaaacgacgaaaaaacacaactaacaaacgccatcgccaaaacgatatacgcttacgatcaacattaattctcgtcgaactaacgaaaaacgaactaattcgtacaaaaaacaatataatctaacaacgcgcgaaaaaatatttaccgatcgcgatttcaaactaacgactcgctaataccgcgaaaccaatcaaacgcgttaattaaaacgaaaaacaaacgctaacgcaaacgctaaaaataatacaacacgaaaaatcaaaaatatcaccgacgaataaacaacgatcgcgacgcaaacgactacctacataacgacgacgaacacgcactaacgttcgcccgccgactaactctacatttaccgaaaaaaaaattattatcgcaacataaccccgattataaaaaataaaaaaaaaa

SEQ ID NO: 6957 - DNA, 916 bp, Artificial Sequence
  chemically treated genomic DNA (Homo sapiens) CpG-island No: 6957
cggcgggcgatagacgcggcgggtacgcgggagtcggggtgtaggttgtaaagcggggtttttcgttgtagaagtcgttttcgtgtgtcgttttatagttgcgtacgcgttagtaatatattttcgttgttcgtcgcggttttgcgttaaagttttttcgggtagtcgtatacgtttttcggattcggcggcgcgtacgtatttagtaatagtagagtatatcgagggttacgtacggtagtcgcgttttgttaaatatgtttttgttcgggttgttcggtaagggcgatggattgagttgcgggacggggtcgaggtttttgattttcgagttcgggtcggggttggcgacggttttagttacggttttttttagtcggaggaggagagtagtcgagggcgggttggatcgggcggcgtttttatcgttagtaatggcgttcggggtttattttttatagtatttcgcgaatattcggttagtgtcgaggcgttcgtgtgttagcgcggtagttttgtagttttaggatttttttagtcggtacggtttgttcggttgtttttcgttcggatttcggcgtttttttttataggcggggcgttagattttcgttttaaggatggggatcggtagggaggaggaacgcggggttagtttttttcgttgagtagcgtaggatcgggtagcgcgcgggttcgcggcggggggagtgtagtaggggcggggttagggaaattttaggtcgcggcgttagttaattagcgtcgtcggttttatttttttcgatttgcggtattttttagaagtgcggttttcggtagtcgggcggggcgtgggggcggttttttttcgatttagggggttttgttttggatcgtaattgtttaggtggtttcgaatttaggttttaggtat

SEQ ID NO: 6958 - DNA, 916 bp, Artificial Sequence
  chemically treated genomic DNA (Homo sapiens) CpG-island No: 6958
atacctaaaacctaaattcgaaaccacctaaacaattacgatccaaaacaaaaccccctaaatcgaaaaaaaaccgcccccacgccccgcccgactaccgaaaaccgcacttctaaaaaataccgcaaatcgaaaaaaataaaaccgacgacgctaattaactaacgccgcgacctaaaatttccctaaccccgcccctactacactccccccgccgcgaacccgcgcgctacccgatcctacgctactcaacgaaaaaaactaaccccgcgttcctcctccctaccgatccccatccttaaaacgaaaatctaacgccccgcctataaaaaaaaacgccgaaatccgaacgaaaaacaaccgaacaaaccgtaccgactaaaaaaatcctaaaactacaaaactaccgcgctaacacacgaacgcctcgacactaaccgaatattcgcgaaatactataaaaaataaaccccgaacgccattactaacgataaaaacgccgcccgatccaacccgccctcgactactctcctcctccgactaaaaaaaaccgtaactaaaaccgtcgccaaccccgacccgaactcgaaaatcaaaaacctcgaccccgtcccgcaactcaatccatcgcccttaccgaacaacccgaacaaaaacatatttaacaaaacgcgactaccgtacgtaaccctcgatatactctactattactaaatacgtacgcgccgccgaatccgaaaaacgtatacgactacccgaaaaaactttaacgcaaaaccgcgacgaacaacgaaaatatattactaacgcgtacgcaactataaaacgacacacgaaaacgacttctacaacgaaaaaccccgctttacaacctacaccccgactcccgcgtacccgccgcgtctatcgcccgccg

SEQ ID NO: 6959 - DNA, 916 bp, Artificial Sequence
  chemically treated genomic DNA (Homo sapiens) CpG-island No: 6959
gtatttgaggtttgagttcgagattatttgagtaattgcggtttagagtaaagttttttggatcggaagggagtcgtttttacgtttcgttcggttgtcgagagtcgtatttttgggggatgtcgtaggtcgggagggatgaggtcgacggcgttgattggttgacgtcgcggtttggggtttttttggtttcgtttttgttgtatttttttcgtcgcgaattcgcgcgttgttcggttttgcgttgtttagcgggaggggttgatttcgcgttttttttttttgtcggtttttatttttaaagcgagagtttgacgtttcgtttgtgggagagagcgtcgggattcggacggggagtaatcgggtaggtcgtgtcggttgaggaggttttgaggttatagagttgtcgcgttggtatacgagcgtttcggtattaatcgagtgttcgcggggtgttgtgggggatgggtttcgggcgttattgttggcggtgggagcgtcgttcggtttagttcgttttcggttgtttttttttttcggttgggaggggtcgtagttggggtcgtcgttagtttcggttcgggttcgagaattaagggtttcggtttcgtttcgtagtttagtttatcgtttttgtcgggtagttcgggtagagatatgtttgataagacgcggttgtcgtacgtggttttcgatgtgttttgttgttgttgggtacgtacgcgtcgtcgggttcgaggggcgtgtgcggttgttcgggagggttttagcgtagagtcgcgacgggtagcgggggtgtgttgttgacgcgtgcgtagttgtggggcgatatacgggggcggtttttgtagcgagggatttcgttttgtagtttgtatttcggttttcgcgtgttcgtcgcgtttgtcgttcgtcg

SEQ ID NO: 6960 - DNA, 916 bp, Artificial Sequence
  chemically treated genomic DNA (Homo sapiens) CpG-island No: 6960
cgacgaacgacaaacgcgacgaacacgcgaaaaccgaaatacaaactacaaaacgaaatccctcgctacaaaaaccgcccccgtatatcgccccacaactacgcacgcgtcaacaacacacccccgctacccgtcgcgactctacgctaaaaccctcccgaacaaccgcacacgcccctcgaacccgacgacgcgtacgtacccaacaacaacaaaacacatcgaaaaccacgtacgacaaccgcgtcttatcaaacatatctctacccgaactacccgacaaaaacgataaactaaactacgaaacgaaaccgaaacccttaattctcgaacccgaaccgaaactaacgacgaccccaactacgacccctcccaaccgaaaaaaaaaaacaaccgaaaacgaactaaaccgaacgacgctcccaccgccaacaataacgcccgaaacccatcccccacaacaccccgcgaacactcgattaataccgaaacgctcgtataccaacgcgacaactctataacctcaaaacctcctcaaccgacacgacctacccgattactccccgtccgaatcccgacgctctctcccacaaacgaaacgtcaaactctcgctttaaaaataaaaaccgacaaaaaaaaaaaacgcgaaatcaacccctcccgctaaacaacgcaaaaccgaacaacgcgcgaattcgcgacgaaaaaaatacaacaaaaacgaaaccaaaaaaaccccaaaccgcgacgtcaaccaatcaacgccgtcgacctcatccctcccgacctacgacatcccccaaaaatacgactctcgacaaccgaacgaaacgtaaaaacgactcccttccgatccaaaaaactttactctaaaccgcaattactcaaataatctcgaactcaaacctcaaatac

SEQ ID NO: 6961 - DNA, 595 bp, Artificial Sequence
  chemically treated genomic DNA (Homo sapiens) CpG-island No: 6961
tacgggattgggaaggtttagtgaacgcgagtgtgaaagagttagtgggaagttggggtaaggcggtatatgcggagaattgaacgacgcggatacgtaaatgattgttgtagtatttttatatcgacgggattagaggttgaagtaggggtggatacgcgaagatatgacggtaacggatatcgtgagtagtgggattgttagtaggaattgtgtggcgcgtgatagtgtgggatttattgtggttgaagaaattgagggacggggttttcgacgtagaatatgcggcggcggtggggacgatagaatgagacgtgcgttagtagaattgttgttgacgacggataggcgggagaggaacgtacggggggagatggttttgcggcgaaggatagatttgaggagaaaaaggggttaggggggtggttggtacgggtgagagagaaaaagcgcgagtgagattgttattaagggtcgagatcgggggtgggttagttcgggttagggagagcggaatgttattaaatgggcgaatatggacgattgttataatgtaacggagcggaatagcgaatgagtaattttaaaagaagat

SEQ ID NO: 6962 - DNA, 595 bp, Artificial Sequence
  chemically treated genomic DNA (Homo sapiens) CpG-island No: 6962
atcttcttttaaaattactcattcgctattccgctccgttacattataacaatcgtccatattcgcccatttaataacattccgctctccctaacccgaactaacccacccccgatctcgacccttaataacaatctcactcgcgctttttctctctcacccgtaccaaccacccccctaacccctttttctcctcaaatctatccttcgccgcaaaaccatctccccccgtacgttcctctcccgcctatccgtcgtcaacaacaattctactaacgcacgtctcattctatcgtccccaccgccgccgcatattctacgtcgaaaaccccgtccctcaatttcttcaaccacaataaatcccacactatcacgcgccacacaattcctactaacaatcccactactcacgatatccgttaccgtcatatcttcgcgtatccacccctacttcaacctctaatcccgtcgatataaaaatactacaacaatcatttacgtatccgcgtcgttcaattctccgcatataccgccttaccccaacttcccactaactctttcacactcgcgttcactaaaccttcccaatcccgta

SEQ ID NO: 6963 - DNA, 595 bp, Artificial Sequence
  chemically treated genomic DNA (Homo sapiens) CpG-island No: 6963
gtttttttttaaagttgtttattcgttgtttcgtttcgttgtattgtggtaatcgtttatattcgtttatttagtggtatttcgttttttttggttcgggttagtttattttcggtttcgatttttggtgatagttttattcgcgtttttttttttttattcgtgttagttatttttttagtttttttttttttttaggtttatttttcgtcgtagggttattttttttcgtgcgtttttttttcgtttgttcgtcgttagtagtagttttattaacgtacgttttattttgtcgtttttatcgtcgtcgtatgttttacgtcgaaaatttcgttttttagtttttttagttatagtaagttttatattgttacgcgttatataatttttgttagtagttttattatttacggtgttcgttgtcgttatattttcgcgtatttatttttgttttaatttttggtttcgtcggtgtgggggtgttataataattatttgcgtgttcgcgtcgtttagtttttcgtatatgtcgttttgttttagttttttattaatttttttatattcgcgtttattaggtttttttagtttcgtg

SEQ ID NO: 6964 - DNA, 595 bp, Artificial Sequence
  chemically treated genomic DNA (Homo sapiens) CpG-island No: 6964
cacgaaactaaaaaaacctaataaacgcgaatataaaaaaattaataaaaaactaaaacaaaacgacatatacgaaaaactaaacgacgcgaacacgcaaataattattataacacccccacaccgacgaaaccaaaaattaaaacaaaaataaatacgcgaaaatataacgacaacgaacaccgtaaataataaaactactaacaaaaattatataacgcgtaacaatataaaacttactataactaaaaaaactaaaaaacgaaattttcgacgtaaaacatacgacgacgataaaaacgacaaaataaaacgtacgttaataaaactactactaacgacgaacaaacgaaaaaaaaacgcacgaaaaaaaataaccctacgacgaaaaataaacctaaaaaaaaaaaaaaactaaaaaaataactaacacgaataaaaaaaaaaaaacgcgaataaaactatcaccaaaaatcgaaaccgaaaataaactaacccgaaccaaaaaaaacgaaataccactaaataaacgaatataaacgattaccacaatacaacgaaacgaaacaacgaataaacaactttaaaaaaaaac

SEQ ID NO: 6965 - DNA, 606 bp, Artificial Sequence
  chemically treated genomic DNA (Homo sapiens) CpG-island No: 6965
cgtgataagttagaaatgcgcgtcgtttttacgttcggtgttaggtttaatttaaagcgagtgataatcggtttcggagagtaattgacgatatcggttttaatacggaaattagttagacgcgtttttattaggcgagttatttgtttaagcgtaaaggtatttatcggttttatttcgttcggcggcggtgttagtaaatttagagaaggtagcggcgtcgtcggtttatgtaacggacggttgtcgttattacgtattaatagcggatgaagtagggtattttgcggttgtggcgtaattggttgttgtggttgttgatattgttgttgcggcgtaatcggttgttgcggttgttgatattgttgttgtggcgtaatcggttgttgcggttgttgatattgtggttgcggcgtaatcggttgttgtggttgttgatattgcggttgcggcggaattggttgttgcggttgttgatattgttgttgcggtgtaatcggttgttgcggttgttgtataggtttaataattggcgtaaataacggttcgtgtggattattatttatacgttttgggattattttattacgaattacgacgagaacg

SEQ ID NO: 6966 - DNA, 606 bp, Artificial Sequence
  chemically treated genomic DNA (Homo sapiens) CpG-island No: 6966
cgttctcgtcgtaattcgtaataaaataatcccaaaacgtataaataataatccacacgaaccgttatttacgccaattattaaacctatacaacaaccgcaacaaccgattacaccgcaacaacaatatcaacaaccgcaacaaccaattccgccgcaaccgcaatatcaacaaccacaacaaccgattacgccgcaaccacaatatcaacaaccgcaacaaccgattacgccacaacaacaatatcaacaaccgcaacaaccgattacgccgcaacaacaatatcaacaaccacaacaaccaattacgccacaaccgcaaaataccctacttcatccgctattaatacgtaataacgacaaccgtccgttacataaaccgacgacgccgctaccttctctaaatttactaacaccgccgccgaacgaaataaaaccgataaatacctttacgcttaaacaaataactcgcctaataaaaacgcgtctaactaatttccgtattaaaaccgatatcgtcaattactctccgaaaccgattatcactcgctttaaattaaacctaacaccgaacgtaaaaacgacgcgcatttctaacttatcacg

SEQ ID NO: 6967 - DNA, 606 bp, Artificial Sequence
  chemically treated genomic DNA (Homo sapiens) CpG-island No: 6967
cgttttcgtcgtggttcgtagtgagatgattttagagcgtgtggatgatggtttatacgaatcgttgtttacgttaattgttgaatttgtatagtagtcgtaataatcggttgtatcgtagtagtaatattagtagtcgtaataattagtttcgtcgtagtcgtagtattagtagttataatagtcggttgcgtcgtagttataatattagtagtcgtaataatcggttgcgttatagtagtaatattagtagtcgtaataatcggttgcgtcgtagtagtagtattagtagttataatagttagttgcgttataatcgtaggatattttgttttattcgttgttgatgcgtaatggcgatagtcgttcgttgtataaatcgacgacgtcgttgttttttttggatttgttgatatcgtcgtcgagcgaagtggagtcggtagatatttttgcgtttgaataaatggttcgtttggtggaagcgcgtttggttgattttcgtattaaagtcgatgtcgttaattatttttcggggtcggttattattcgttttgaattgaatttggtatcgggcgtaaaagcggcgcgtatttttaatttgttacg

SEQ ID NO: 6968 - DNA, 606 bp, Artificial Sequence
  chemically treated genomic DNA (Homo sapiens) CpG-island No: 6968
cgtaacaaattaaaaatacgcgccgcttttacgcccgataccaaattcaattcaaaacgaataataaccgaccccgaaaaataattaacgacatcgactttaatacgaaaatcaaccaaacgcgcttccaccaaacgaaccatttattcaaacgcaaaaatatctaccgactccacttcgctcgacgacgatatcaacaaatccaaaaaaaacaacgacgtcgtcgatttatacaacgaacgactatcgccattacgcatcaacaacgaataaaacaaaatatcctacgattataacgcaactaactattataactactaatactactactacgacgcaaccgattattacgactactaatattactactataacgcaaccgattattacgactactaatattataactacgacgcaaccgactattataactactaatactacgactacgacgaaactaattattacgactactaatattactactacgatacaaccgattattacgactactatacaaattcaacaattaacgtaaacaacgattcgtataaaccatcatccacacgctctaaaatcatctcactacgaaccacgacgaaaacg

SEQ ID NO: 6969 - DNA, 788 bp, Artificial Sequence
  chemically treated genomic DNA (Homo sapiens) CpG-island No: 6969
  misc_feature (209)..(209): n is either a, c, g or t
cgttgattaaatttgtcgatgtattggttcggtatggatcggtaatttgttttcgtttttgtttattattatcgtttgtggcgcggtgtttggtttttatgcgttgattttttttgggattacgtcgaagatttggcgaacgaagggtaggcgtgttttatcggttacggtgggatgttaatggaatttttcgtggcgattatggcgtntgttttcgtttgtattatcgattcgggcgtgtattttgttatgaatagttcgattgcggtgttggtttcggtagggacggcggatgtggtcgtttttgtcgcgtaggttgtgagtagttgggttttagtattatattagatacgtttaattagattgttagcgaagtgggtgaatagtcgattatttttcgtgcgggcggtgcgtcgacgttggcggtggggatggtttatattttgtacggcgcgttgggcggtatgatggatgtggcgttttggtattatttcgttattttgtttgaagtattgtttattttgacggcggtggatgtaggtacgcgtgttgcgcgttttatgttgtaggatttgttgggcgtggtgttttttggttttgaatgcggatcgatttattgtttgttaatttgttggtaatagcgttgtgcgtattggcgtggggttattttttttattagggcgtggtcgattcgttgggcggttattaatattttgtggtcgttgtttggtattgttaattagatgttggtagggatggcgttgatgttttgtgtcgtggtgttgttt

SEQ ID NO: 6970 - DNA, 788 bp, Artificial Sequence
  chemically treated genomic DNA (Homo sapiens) CpG-island No: 6970
  misc_feature (580)..(580): n is either a, c, g or t
aaacaacaccacgacacaaaacatcaacgccatccctaccaacatctaattaacaataccaaacaacgaccacaaaatattaataaccgcccaacgaatcgaccacgccctaataaaaaaaataaccccacgccaatacgcacaacgctattaccaacaaattaacaaacaataaatcgatccgcattcaaaaccaaaaaacaccacgcccaacaaatcctacaacataaaacgcgcaacacgcgtacctacatccaccgccgtcaaaataaacaatacttcaaacaaaataacgaaataataccaaaacgccacatccatcataccgcccaacgcgccgtacaaaatataaaccatccccaccgccaacgtcgacgcaccgcccgcacgaaaaataatcgactattcacccacttcgctaacaatctaattaaacgtatctaatataatactaaaacccaactactcacaacctacgcgacaaaaacgaccacatccgccgtccctaccgaaaccaacaccgcaatcgaactattcataacaaaatacacgcccgaatcgataatacaaacgaaaacanacgccataatcgccacgaaaaattccattaacatcccaccgtaaccgataaaacacgcctacccttcgttcgccaaatcttcgacgtaatcccaaaaaaaatcaacgcataaaaaccaaacaccgcgccacaaacgataataataaacaaaaacgaaaacaaattaccgatccataccgaaccaatacatcgacaaatttaatcaacg

SEQ ID NO: 6971 - DNA, 788 bp, Artificial Sequence
  chemically treated genomic DNA (Homo sapiens) CpG-island No: 6971
  misc_feature (580)..(580): n is either a, c, g or t
gaataatattacggtatagagtattagcgttatttttgttagtatttggttggtaatattaaatagcggttatagagtgttaatagtcgtttagcggatcgattacgttttgatggaggaagtagttttacgttagtacgtatagcgttgttgttagtaggttagtaggtagtgaatcggttcgtatttaggattaggagatattacgtttagtagattttgtaatataaagcgcgtagtacgcgtatttgtatttatcgtcgttagaataaatagtgttttaaataaaatggcgaagtgatattagaacgttatatttattatgtcgtttagcgcgtcgtgtagaatgtaggttatttttatcgttagcgtcggcgtatcgttcgtacgggaaatgatcgattgtttatttatttcgttggtaatttggttaagcgtatttggtgtaatgttaaagtttagttatttataatttgcgcggtagaagcgattatattcgtcgtttttgtcggagttagtatcgtaatcgggttgtttatggtaaaatatacgttcggatcgatgatataggcggaaatangcgttataatcgttacgaaggattttattaatattttatcgtagtcgataaagtacgtttgtttttcgttcgttagattttcggcgtggttttagaagagattagcgtatggaagttagatatcgcgttataggcgatggtgataaataggaacgggaataggttatcggtttatatcgggttagtgtatcgataaatttggttagcg

SEQ ID NO: 6972 - DNA, 788 bp, Artificial Sequence
  chemically treated genomic DNA (Homo sapiens) CpG-island No: 6972
  misc_feature (209)..(209): n is either a, c, g or t
cgctaaccaaatttatcgatacactaacccgatataaaccgataacctattcccgttcctatttatcaccatcgcctataacgcgatatctaacttccatacgctaatctcttctaaaaccacgccgaaaatctaacgaacgaaaaacaaacgtactttatcgactacgataaaatattaataaaatccttcgtaacgattataacgcntatttccgcctatatcatcgatccgaacgtatattttaccataaacaacccgattacgatactaactccgacaaaaacgacgaatataatcgcttctaccgcgcaaattataaataactaaactttaacattacaccaaatacgcttaaccaaattaccaacgaaataaataaacaatcgatcatttcccgtacgaacgatacgccgacgctaacgataaaaataacctacattctacacgacgcgctaaacgacataataaatataacgttctaatatcacttcgccattttatttaaaacactatttattctaacgacgataaatacaaatacgcgtactacgcgctttatattacaaaatctactaaacgtaatatctcctaatcctaaatacgaaccgattcactacctactaacctactaacaacaacgctatacgtactaacgtaaaactacttcctccatcaaaacgtaatcgatccgctaaacgactattaacactctataaccgctatttaatattaccaaccaaatactaacaaaaataacgctaatactctataccgtaatattattc

SEQ ID NO: 6973 - DNA, 511 bp, Artificial Sequence
  chemically treated genomic DNA (Homo sapiens) CpG-island No: 6973
gaattggcgcggcgtgaagattggcgtggtttgttagtttttagttcggaaaagttcggaattatcgaagcgtaatgtaattattattatgcgaaatggaatatcgggtagagtgaagaagtttggtaaggggcgaaagagttgtggttaatcggtaagagttagtttaacgtttgtgataagttatttagcgtttggcgtgcgttaggtaaataagattcgttggcgtatttagagcgtattcgtttggcgatgaaagcgggtaatataggtttggtaatagtgttggtagggtagatgtttgtcgattattagattatcgtttcggtaattattttattggcgaataattttaatatcgtattgattttcgcgcgtataattggcgcgatcgattttattcgttaaatggttgggggggcgttttgtaatgtggcgcggtaggatgtttaaatgtatagttatgattttaatcgttggttaggcgtaataatttaatgaagattagatt

SEQ ID NO: 6974 - DNA, 511 bp, Artificial Sequence
  chemically treated genomic DNA (Homo sapiens) CpG-island No: 6974
aatctaatcttcattaaattattacgcctaaccaacgattaaaatcataactatacatttaaacatcctaccgcgccacattacaaaacgcccccccaaccatttaacgaataaaatcgatcgcgccaattatacgcgcgaaaatcaatacgatattaaaattattcgccaataaaataattaccgaaacgataatctaataatcgacaaacatctaccctaccaacactattaccaaacctatattacccgctttcatcgccaaacgaatacgctctaaatacgccaacgaatcttatttacctaacgcacgccaaacgctaaataacttatcacaaacgttaaactaactcttaccgattaaccacaactctttcgccccttaccaaacttcttcactctacccgatattccatttcgcataataataattacattacgcttcgataattccgaacttttccgaactaaaaactaacaaaccacgccaatcttcacgccgcgccaattc

SEQ ID NO: 6975 - DNA, 511 bp, Artificial Sequence
  chemically treated genomic DNA (Homo sapiens) CpG-island No: 6975
aatttgatttttattaagttgttgcgtttggttaacgattgggattataattgtgtatttaagtattttgtcgcgttatattgtaaaacgtttttttagttatttgacgggtaaaatcggtcgcgttagttgtacgcgcgaaggttagtacggtattagggttgttcgttagtgaaatgattgtcgaggcgatagtttggtaatcggtaggtatttgttttgttagtattgttattaggtttgtgttattcgtttttatcgttagacggatacgttttaaatacgttagcggattttgtttatttgacgtacgttagacgttaaataatttgttataggcgttaggttggtttttgtcggttagttatagttttttcgttttttgttaggtttttttattttgttcggtgttttatttcgtatagtagtaattatattgcgtttcggtagtttcgggttttttcgggttaaaggttaataagttacgttagtttttacgtcgcgttagttt

SEQ ID NO: 6976 - DNA, 511 bp, Artificial Sequence
  chemically treated genomic DNA (Homo sapiens) CpG-island No: 6976
aaactaacgcgacgtaaaaactaacgtaacttattaacctttaacccgaaaaaacccgaaactaccgaaacgcaatataattactactatacgaaataaaacaccgaacaaaataaaaaaacctaacaaaaaacgaaaaaactataactaaccgacaaaaaccaacctaacgcctataacaaattatttaacgtctaacgtacgtcaaataaacaaaatccgctaacgtatttaaaacgtatccgtctaacgataaaaacgaataacacaaacctaataacaatactaacaaaacaaatacctaccgattaccaaactatcgcctcgacaatcatttcactaacgaacaaccctaataccgtactaaccttcgcgcgtacaactaacgcgaccgattttacccgtcaaataactaaaaaaacgttttacaatataacgcgacaaaatacttaaatacacaattataatcccaatcgttaaccaaacgcaacaacttaataaaaatcaaatt

SEQ ID NO: 6977 - DNA, 1109 bp, Artificial Sequence
  chemically treated genomic DNA (Homo sapiens) CpG-island No: 6977
gcgcggtttcgtttttcgtttcgtcgaggtttcgttttttatattaaggtttcgttttttttttgtttttttcggttaaggtttattttttttttacgcggttcgttttttttttcgttaagttttcgttttttttttgcgcggttcgttttttttttcgttaaggtttcgtttttttttttcggggtttcgttttttatttcgtcgaggtttatatttttatttcggtagcggttttattatcggtatagagtttattcgttagttatatgtagaagacggcggtcgtcggtattagttttcgtcgcgttttcgtttgtcgtagtttgcgtcgtttgtcgttatcgcgcgtttttattgatttatattatcgtcgtcgtacgtacgtacgatcgtcgggttcgttggttggttcggtgcgggcggcggatttatcgtcggagaggattgttagcgtcgtcgtcgtacgtcgtttcggttcgggttcgggtttcgatttcgtttcgggttttagcgtcggtcgttcgttcggtcgggcgatgaagtgttattatgaggcgttgggggtgcggcgcgacgttagcgaggaggagtttaagaaggtttatcggaagttggttttgaaatggtattcgggtaagtatttgtttcgtagttttcgcggttattcggagaagttcggtttttttcgatttttttttttttcgggcggatttcgcggagttagtagagagggatttggcggtttaggagttttttgtttcgttcggttagtgttcggagtcgttttgttcgtttcggtgggcgaagcgttttgttttggcgtatttcggtttatattttatttttttatattcgcgatttcggtttcgtatcgttattgtagggggaaaattgtagtttaataattttatttgttttcgttatcgggtcgtagatattacgagggagtagtcgggaattcggaatttagatttgttttaggtttgtttttttttgcgttttttgtagcgtagtttttcggtgtttttttttcgttgttttttatttcgttcgggaattttagatattttaatttgatgtatggtttttttcgttttttagttaag

SEQ ID NO: 6978 - DNA, 1109 bp, Artificial Sequence
  chemically treated genomic DNA (Homo sapiens) CpG-island No: 6978
cttaactaaaaaacgaaaaaaaccatacatcaaattaaaatatctaaaattcccgaacgaaataaaaaacaacgaaaaaaaaacaccgaaaaactacgctacaaaaaacgcaaaaaaaaacaaacctaaaacaaatctaaattccgaattcccgactactccctcgtaatatctacgacccgataacgaaaacaaataaaattattaaactacaattttccccctacaataacgatacgaaaccgaaatcgcgaatataaaaaaataaaatataaaccgaaatacgccaaaacaaaacgcttcgcccaccgaaacgaacaaaacgactccgaacactaaccgaacgaaacaaaaaactcctaaaccgccaaatccctctctactaactccgcgaaatccgcccgaaaaaaaaaaaaatcgaaaaaaaccgaacttctccgaataaccgcgaaaactacgaaacaaatacttacccgaataccatttcaaaaccaacttccgataaaccttcttaaactcctcctcgctaacgtcgcgccgcacccccaacgcctcataataacacttcatcgcccgaccgaacgaacgaccgacgctaaaacccgaaacgaaatcgaaacccgaacccgaaccgaaacgacgtacgacgacgacgctaacaatcctctccgacgataaatccgccgcccgcaccgaaccaaccaacgaacccgacgatcgtacgtacgtacgacgacgataatataaatcaataaaaacgcgcgataacgacaaacgacgcaaactacgacaaacgaaaacgcgacgaaaactaataccgacgaccgccgtcttctacatataactaacgaataaactctataccgataataaaaccgctaccgaaataaaaatataaacctcgacgaaataaaaaacgaaaccccgaaaaaaaaaaacgaaaccttaacgaaaaaaaaaacgaaccgcgcaaaaaaaaaacgaaaacttaacgaaaaaaaaaacgaaccgcgtaaaaaaaaaataaaccttaaccgaaaaaaacaaaaaaaaaacgaaaccttaatataaaaaacgaaacctcgacgaaacgaaaaacgaaaccgcgc

SEQ ID NO: 6979 - DNA, 1109 bp, Artificial Sequence
  chemically treated genomic DNA (Homo sapiens) CpG-island No: 6979
tttaattaagaaacgaaaagagttatatattaggttgaagtatttgggattttcggacgaggtggagggtagcggaggaaaaatatcgagaggttgcgttgtaagggacgtagggaaaagtaagtttggggtaggtttgagtttcgagttttcgattgttttttcgtggtgtttgcgattcggtagcgggagtaagtgaggttgttggattgtagttttttttttatagtggcgatgcggggtcggggtcgcgggtatgaggagatggggtgtgagtcggggtgcgttagggtagagcgtttcgtttatcgagacgggtagggcggtttcgggtattggtcgggcggggtaaggagtttttaggtcgttaggtttttttttgttggtttcgcggagttcgttcgggggaagggaaggtcggggagggtcgggttttttcgagtggtcgcgggggttgcgggataggtatttattcgggtgttattttagggttagttttcgataggtttttttgagttttttttcgttggcgtcgcgtcgtatttttagcgttttatagtgatattttatcgttcgatcgggcgggcggtcggcgttggggttcgggacggggtcggggttcgggttcgggtcgaagcggcgtgcggcggcggcgttggtagtttttttcggcggtgagttcgtcgttcgtatcgggttagttagcgagttcggcggtcgtgcgtgcgtgcggcggcggtggtgtaggttagtgaaggcgcgcggtggcggtagacgacgtaggttgcggtaagcgggagcgcggcgggggttggtgtcggcggtcgtcgttttttgtatgtggttagcgggtgggttttgtgtcggtaatagggtcgttgtcgggatgggggtgtgggtttcggcggggtgagaggcgaggtttcgaggaaggaaggcggggttttggcgaggagagaggcgggtcgcgtaggagaaaggcgggagtttggcggggaaagaggcgggtcgcgtgggaggaaggtaggttttggtcgggaagaataggaggaaggcgggattttggtgtgagaggcggggtttcggcggggcgagaggcggggtcgcgt

SEQ ID NO: 6980 - DNA, 1109 bp, Artificial Sequence
  chemically treated genomic DNA (Homo sapiens) CpG-island No: 6980
acgcgaccccgcctctcgccccgccgaaaccccgcctctcacaccaaaatcccgccttcctcctattcttcccgaccaaaacctaccttcctcccacgcgacccgcctctttccccgccaaactcccgcctttctcctacgcgacccgcctctctcctcgccaaaaccccgccttccttcctcgaaacctcgcctctcaccccgccgaaacccacacccccatcccgacaacgaccctattaccgacacaaaacccacccgctaaccacatacaaaaaacgacgaccgccgacaccaacccccgccgcgctcccgcttaccgcaacctacgtcgtctaccgccaccgcgcgccttcactaacctacaccaccgccgccgcacgcacgcacgaccgccgaactcgctaactaacccgatacgaacgacgaactcaccgccgaaaaaaactaccaacgccgccgccgcacgccgcttcgacccgaacccgaaccccgaccccgtcccgaaccccaacgccgaccgcccgcccgatcgaacgataaaatatcactataaaacgctaaaaatacgacgcgacgccaacgaaaaaaaactcaaaaaaacctatcgaaaactaaccctaaaataacacccgaataaatacctatcccgcaacccccgcgaccactcgaaaaaacccgaccctccccgaccttcccttcccccgaacgaactccgcgaaaccaacaaaaaaaaacctaacgacctaaaaactccttaccccgcccgaccaatacccgaaaccgccctacccgtctcgataaacgaaacgctctaccctaacgcaccccgactcacaccccatctcctcatacccgcgaccccgaccccgcatcgccactataaaaaaaaaactacaatccaacaacctcacttactcccgctaccgaatcgcaaacaccacgaaaaaacaatcgaaaactcgaaactcaaacctaccccaaacttacttttccctacgtcccttacaacgcaacctctcgatatttttcctccgctaccctccacctcgtccgaaaatcccaaatacttcaacctaatatataactcttttcgtttcttaattaaa

SEQ ID NO: 6981 - DNA, 537 bp, Artificial Sequence
  chemically treated genomic DNA (Homo sapiens) CpG-island No: 6981
agttagttagttagagaattagtaggagaggaaaaagggtgggcgcgcgggtgggttcgggaggcggagattttcgggaagttggggttacgcggcggtgtaggcgacgggattgtagtgttatttttttcgagaaatttatacgttcgtacgttcgcgcgcgtacgtacgtgtatacggtgggtagggagaaaacgagagagtttgagtgttgggcgcgttttagcgatggtttttgtttttaatagtaaaattaattcgttcggtatttgttagggttttaaagtcgacggtggcgtcggttggagaatggattgtgatttttagatgtacgtgaaaatgtgtaagaagatcgtttagtttattaaggtaaggtggggcgtagcgggttagcgagttgtacgttcggggcgttcgagtcgggagttagtgcggatgcgtttttcgggaggttcgggttaaatttagatagaaattttgtttcggaggttaatcgggaagggaagcggttttaaatttgggtgatttgatttttta

SEQ ID NO: 6982 - DNA, 537 bp, Artificial Sequence
  chemically treated genomic DNA (Homo sapiens) CpG-island No: 6982
taaaaaatcaaatcacccaaatttaaaaccgcttcccttcccgattaacctccgaaacaaaatttctatctaaatttaacccgaacctcccgaaaaacgcatccgcactaactcccgactcgaacgccccgaacgtacaactcgctaacccgctacgccccaccttaccttaataaactaaacgatcttcttacacattttcacgtacatctaaaaatcacaatccattctccaaccgacgccaccgtcgactttaaaaccctaacaaataccgaacgaattaattttactattaaaaacaaaaaccatcgctaaaacgcgcccaacactcaaactctctcgttttctccctacccaccgtatacacgtacgtacgcgcgcgaacgtacgaacgtataaatttctcgaaaaaaataacactacaatcccgtcgcctacaccgccgcgtaaccccaacttcccgaaaatctccgcctcccgaacccacccgcgcgcccaccctttttcctctcctactaattctctaactaactaact

SEQ ID NO: 6983 - DNA, 537 bp, Artificial Sequence
  chemically treated genomic DNA (Homo sapiens) CpG-island No: 6983
tagaaggttaagttatttagatttaggatcgttttttttttcggttggttttcgagataaagtttttgtttggatttggttcgggtttttcgggaggcgtattcgtattgattttcggttcgggcgtttcgggcgtgtagttcgttggttcgttgcgttttattttattttggtgagttgggcgatttttttgtatatttttacgtgtatttggggattatagtttattttttagtcggcgttatcgtcggttttggagttttggtaagtgtcgggcgggttaattttgttgttgagagtagaagttatcgttaaaacgcgtttagtatttagattttttcgttttttttttgtttatcgtgtgtacgtgcgtgcgcgcgcgggcgtgcgagcgtgtgggtttttcgggagaggtggtattgtagtttcgtcgtttgtatcgtcgcgtggttttagtttttcgaaggttttcgtttttcgggtttattcgcgcgtttattttttttttttttttgttggttttttggttggttggtt

SEQ ID NO: 6984 - DNA, 537 bp, Artificial Sequence
  chemically treated genomic DNA (Homo sapiens) CpG-island No: 6984
aaccaaccaaccaaaaaaccaacaaaaaaaaaaaaaaaataaacgcgcgaataaacccgaaaaacgaaaaccttcgaaaaactaaaaccacgcgacgatacaaacgacgaaactacaataccacctctcccgaaaaacccacacgctcgcacgcccgcgcgcgcacgcacgtacacacgataaacaaaaaaaaaacgaaaaaatctaaatactaaacgcgttttaacgataacttctactctcaacaacaaaattaacccgcccgacacttaccaaaactccaaaaccgacgataacgccgactaaaaaataaactataatccccaaatacacgtaaaaatatacaaaaaaatcgcccaactcaccaaaataaaataaaacgcaacgaaccaacgaactacacgcccgaaacgcccgaaccgaaaatcaatacgaatacgcctcccgaaaaacccgaaccaaatccaaacaaaaactttatctcgaaaaccaaccgaaaaaaaaaacgatcctaaatctaaataacttaaccttcta

SEQ ID NO: 6985 - DNA, 1318 bp, Artificial Sequence
  chemically treated genomic DNA (Homo sapiens) CpG-island No: 6985
tttttttcgtttcggatttttcggggttattagacggtcgtttttttcgtttgggttcgggtttgggggaattgtttttagcgtttcggggttcgtttttcgtcggagtagtttggtttttttttttcggtttcgttagcgtcgtttttcgttttcggttttttcggtagggttgttcgaagttgtttcgggagttttttcggtgcggttcggaggaatttcgtaggatttcgggagacgtcgtcgtcgttgttcggcgggtttagggatcggtttttaggtttttaagtttttttcggggattttttgtcgtcgattttttttcggattcgtaggatattttttttcggaggtcgggtttggttcgttcgttcgtcgttttcgtttcgtttcgcgcgtcgcgtcgggagtttcgagttcgatttttttttcggacgttcggttcgttcgcgggacggaggcggcgatggtgattgggtagcggcgcggggtcggggtttgggtagggcggttcggtcgtttttttttttcgttgttttcgtttttttttttttttttttttttcgagtgttagttcgggcggtcgtcgagtttggcgttttttcgtttcgttgttttttttttcgcgtcgcggattttttttttttttttgcgttgtttttttttttcgtcgttttttttcgtttttttttcgtttttttttcgttttttttttttaggcgcggttagcgggggtaagagcgaggtggttgcgaggaggcgttattgaaagttttgatttggggaaggttgcgggttcggagtcggagacgtcgagttggggtcgggtgagtggtaggcgtcgggttcgcgcgcgttgcgggaggggagagtcggtgggttcggttaggtgggcgtttcgcgcgggcgtatggggagtcgttgcggtcggtcgagtattggttgtttgagtcgcggttggcgcgggaatttcgtttcggcgtttttgggagatcgcgtcgagcggtcggaggtgttgcgggatgggcgttgggtgttgggaatgggaagggaatagttgttttttagcgtcgtcggcggtcgtagaagtggaaaaaagttgtgtcgggaatagcgttttttcgggaagtcggcgcgagttttgttttttgggcgtcgttggcgggtttcggacggcggcgcgtgggttttaggcgtagttgggcgtcgggttttagcgcgtttggtatcgttttttgggggtcgtttcgtggtcgtttttgttgtttttggttcgtggcgtgtgggttattttggttatagacgttagttgtttttt

SEQ ID NO: 6986 - DNA, 1318 bp, Artificial Sequence
  chemically treated genomic DNA (Homo sapiens) CpG-island No: 6986
aaaaaacaactaacgtctataaccaaaataacccacacgccacgaaccaaaaacaacaaaaacgaccacgaaacgacccccaaaaaacgataccaaacgcgctaaaacccgacgcccaactacgcctaaaacccacgcgccgccgtccgaaacccgccaacgacgcccaaaaaacaaaactcgcgccgacttcccgaaaaaacgctattcccgacacaacttttttccacttctacgaccgccgacgacgctaaaaaacaactattcccttcccattcccaacacccaacgcccatcccgcaacacctccgaccgctcgacgcgatctcccaaaaacgccgaaacgaaattcccgcgccaaccgcgactcaaacaaccaatactcgaccgaccgcaacgactccccatacgcccgcgcgaaacgcccacctaaccgaacccaccgactctcccctcccgcaacgcgcgcgaacccgacgcctaccactcacccgaccccaactcgacgtctccgactccgaacccgcaaccttccccaaatcaaaactttcaataacgcctcctcgcaaccacctcgctcttacccccgctaaccgcgcctaaaaaaaaaaaacgaaaaaaaaacgaaaaaaaaacgaaaaaaaacgacgaaaaaaaaaaacaacgcaaaaaaaaaaaaaaaatccgcgacgcgaaaaaaaaaacaacgaaacgaaaaaacgccaaactcgacgaccgcccgaactaacactcgaaaaaaaaaaaaaaaaaaaaaaacgaaaacaacgaaaaaaaaaaacgaccgaaccgccctacccaaaccccgaccccgcgccgctacccaatcaccatcgccgcctccgtcccgcgaacgaaccgaacgtccgaaaaaaaaatcgaactcgaaactcccgacgcgacgcgcgaaacgaaacgaaaacgacgaacgaacgaaccaaacccgacctccgaaaaaaaatatcctacgaatccgaaaaaaaatcgacgacaaaaaatccccgaaaaaaacttaaaaacctaaaaaccgatccctaaacccgccgaacaacgacgacgacgtctcccgaaatcctacgaaattcctccgaaccgcaccgaaaaaactcccgaaacaacttcgaacaaccctaccgaaaaaaccgaaaacgaaaaacgacgctaacgaaaccgaaaaaaaaaaaccaaactactccgacgaaaaacgaaccccgaaacgctaaaaacaattcccccaaacccgaacccaaacgaaaaaaacgaccgtctaataaccccgaaaaatccgaaacgaaaaaaa

SEQ ID NO: 6987 - DNA, 1318 bp, Artificial Sequence
  chemically treated genomic DNA (Homo sapiens) CpG-island No: 6987
gagaagtagttgacgtttgtggttagagtgatttatacgttacggattagggatagtaggggcgattacggggcggtttttagggagcggtgttaggcgcgttggaattcggcgtttagttgcgtttgggatttacgcgtcgtcgttcgaagttcgttagcgacgtttagagagtagggttcgcgtcggtttttcgaggagacgttgttttcggtataatttttttttatttttgcggtcgtcggcggcgttgagaagtagttgttttttttttatttttagtatttaacgtttatttcgtagtattttcgatcgttcggcgcggttttttaggggcgtcgaagcgaagttttcgcgttagtcgcggtttaagtagttagtgttcggtcggtcgtaacggttttttatgcgttcgcgcggggcgtttatttggtcgggtttatcggtttttttttttcgtagcgcgcgcgggttcgacgtttgttatttattcggttttagttcggcgttttcggtttcgagttcgtagttttttttaagttagggtttttagtgacgttttttcgtagttatttcgtttttgttttcgttggtcgcgtttggaagaaggaggcgggaggagagcgagaggagagcgggaggaggcggcgggagaggggggtaacgtaagggaggggagagggttcgcggcgcgggggaggaggtagcgaggcgagagagcgttaagttcggcggtcgttcgggttagtattcggggagagggaggaggaggaggggcgggggtagcgagagaaagaggcggtcgagtcgttttgtttaggtttcggtttcgcgtcgttgtttagttattatcgtcgttttcgtttcgcgagcgggtcgggcgttcgggggaggggtcgggttcggggttttcggcgcggcgcgcggggcgggacgggggcggcgggcgggcggattaggttcggttttcggaggggagtgttttgcgggttcgggagggagtcggcgataggggattttcgagaggggtttgggggtttgggaatcggtttttgagttcgtcgggtagcggcggcggcgtttttcggggttttgcgaggttttttcgggtcgtatcggggaagttttcggagtagtttcgagtagttttgtcgggagggtcggaggcggagagcggcgttgacggagtcgggggagagaggttaggttgtttcggcggagagcgggtttcggggcgttaggagtagtttttttagattcgggtttaagcggaaagaacggtcgtttggtgatttcggagagttcgaaacgggaaagg

SEQ ID NO: 6988 - DNA, 1318 bp, Artificial Sequence
  chemically treated genomic DNA (Homo sapiens) CpG-island No: 6988
cctttcccgtttcgaactctccgaaatcaccaaacgaccgttctttccgcttaaacccgaatctaaaaaaactactcctaacgccccgaaacccgctctccgccgaaacaacctaacctctctcccccgactccgtcaacgccgctctccgcctccgaccctcccgacaaaactactcgaaactactccgaaaacttccccgatacgacccgaaaaaacctcgcaaaaccccgaaaaacgccgccgccgctacccgacgaactcaaaaaccgattcccaaacccccaaacccctctcgaaaatcccctatcgccgactccctcccgaacccgcaaaacactcccctccgaaaaccgaacctaatccgcccgcccgccgcccccgtcccgccccgcgcgccgcgccgaaaaccccgaacccgacccctcccccgaacgcccgacccgctcgcgaaacgaaaacgacgataataactaaacaacgacgcgaaaccgaaacctaaacaaaacgactcgaccgcctctttctctcgctacccccgcccctcctcctcctccctctccccgaatactaacccgaacgaccgccgaacttaacgctctctcgcctcgctacctcctcccccgcgccgcgaaccctctcccctcccttacgttacccccctctcccgccgcctcctcccgctctcctctcgctctcctcccgcctccttcttccaaacgcgaccaacgaaaacaaaaacgaaataactacgaaaaaacgtcactaaaaaccctaacttaaaaaaaactacgaactcgaaaccgaaaacgccgaactaaaaccgaataaataacaaacgtcgaacccgcgcgcgctacgaaaaaaaaaaaccgataaacccgaccaaataaacgccccgcgcgaacgcataaaaaaccgttacgaccgaccgaacactaactacttaaaccgcgactaacgcgaaaacttcgcttcgacgcccctaaaaaaccgcgccgaacgatcgaaaatactacgaaataaacgttaaatactaaaaataaaaaaaaaacaactacttctcaacgccgccgacgaccgcaaaaataaaaaaaaattataccgaaaacaacgtctcctcgaaaaaccgacgcgaaccctactctctaaacgtcgctaacgaacttcgaacgacgacgcgtaaatcccaaacgcaactaaacgccgaattccaacgcgcctaacaccgctccctaaaaaccgccccgtaatcgcccctactatccctaatccgtaacgtataaatcactctaaccacaaacgtcaactacttctc

SEQ ID NO: 6989 - DNA, 547 bp, Artificial Sequence
  chemically treated genomic DNA (Homo sapiens) CpG-island No: 6989
  misc_feature (440)..(440): n is either a, c, g or t
gcggtttcgaatcggtatggttttagtaaatcgttggtatggtggacggcgtaagattttgttttttgtttaattatcggtagttcgttggttaggcgtgttatttgttttgtaaaatcggtttgtatatcgttatatgtttgattcgtatcgataatgatacgtattaggtttaagtcgttgcggtatatatcgtagatgatgtcgtattttattttacgaatgcgtttaacggtttttttggtgtcgttattgattattaattttagtaaattaggtggggttgttagatttgtaacgcgttcggtaattttaagtagttcgataatgtttaagaacgtcgcgattgacgggttattttttatattagttttgtttttgatcgcgcgaagagtcgcgtcgataatatttttaaatcgtttatttttatcgtatatcgnttgattggtgtagataacggcggcgtcgtatttcggcgcgattacgttattattattgaatttttattttcgattttaatagttattagattgttagtatacgagtg

SEQ ID NO: 6990 - DNA, 547 bp, Artificial Sequence
  chemically treated genomic DNA (Homo sapiens) CpG-island No: 6990
  misc_feature (108)..(108): n is either a, c, g or t
cactcgtatactaacaatctaataactattaaaatcgaaaataaaaattcaataataataacgtaatcgcgccgaaatacgacgccgccgttatctacaccaatcaancgatatacgataaaaataaacgatttaaaaatattatcgacgcgactcttcgcgcgatcaaaaacaaaactaatataaaaaataacccgtcaatcgcgacgttcttaaacattatcgaactacttaaaattaccgaacgcgttacaaatctaacaaccccacctaatttactaaaattaataatcaataacgacaccaaaaaaaccgttaaacgcattcgtaaaataaaatacgacatcatctacgatatataccgcaacgacttaaacctaatacgtatcattatcgatacgaatcaaacatataacgatatacaaaccgattttacaaaacaaataacacgcctaaccaacgaactaccgataattaaacaaaaaacaaaatcttacgccgtccaccataccaacgatttactaaaaccataccgattcgaaaccgc

SEQ ID NO: 6991 - DNA, 547 bp, Artificial Sequence
  chemically treated genomic DNA (Homo sapiens) CpG-island No: 6991
  misc_feature (108)..(108): n is either a, c, g or t
tattcgtatattggtagtttgatagttattgaggtcgaagataggaatttaatagtaatagcgtggtcgcgtcgaggtacgacgtcgtcgttgtttatattaattagncggtgtgcgatgaaggtgaacggtttgagaatattgtcgacgcgatttttcgcgcgattaaaggtagggttggtgtagagaatgattcgttaatcgcggcgtttttgagtattgtcgaattgtttgaagttatcgagcgcgttatagatttgataattttatttggtttgttggaattggtggttagtggcgatattaaaaaagtcgttgagcgtattcgtgaggtggaatacggtattatttgcgatatgtgtcgtagcgatttagatttggtgcgtattattgtcgatgcgggttaggtatgtgacggtgtgtaagtcggttttgtagggtaagtggtacgtttggttaacgagttgtcgatgattaaataggaggtaaaattttacgtcgtttattatgttaacgatttattggagttatatcggttcgaagtcgt

SEQ ID NO: 6992 - DNA, 547 bp, Artificial Sequence
  chemically treated genomic DNA (Homo sapiens) CpG-island No: 6992
  misc_feature (440)..(440): n is either a, c, g or t
acgacttcgaaccgatataactccaataaatcgttaacataataaacgacgtaaaattttacctcctatttaatcatcgacaactcgttaaccaaacgtaccacttaccctacaaaaccgacttacacaccgtcacatacctaacccgcatcgacaataatacgcaccaaatctaaatcgctacgacacatatcgcaaataataccgtattccacctcacgaatacgctcaacgacttttttaatatcgccactaaccaccaattccaacaaaccaaataaaattatcaaatctataacgcgctcgataacttcaaacaattcgacaatactcaaaaacgccgcgattaacgaatcattctctacaccaaccctacctttaatcgcgcgaaaaatcgcgtcgacaatattctcaaaccgttcaccttcatcgcacaccgnctaattaatataaacaacgacgacgtcgtacctcgacgcgaccacgctattactattaaattcctatcttcgacctcaataactatcaaactaccaatatacgaata

SEQ ID NO: 6993 - DNA, 555 bp, Artificial Sequence
  chemically treated genomic DNA (Homo sapiens) CpG-island No: 6993
cggatagtagtaaaattaacgcggtcgttaaagagatggcgaatttgcgttagtcgttagatgagttacgggtgaaacgcgatatcgcgatggttgaagcgggtattcgcgcggagcgaattggggtatgggttatcgcggttgcggtggtggcggttatatgggtatgggttattggtaaattagaacgttttttcgtcgggttgtagcgatagatattagagtttgttattaatagtaattgcgaattttcgggcgtttttagttatgttacgttgattattatagaagagcggttttggcggcgttcgatatgcgttatcgtttgcgaatttaaattaggttttatgggttgtttttcgtaggtggttacggtttgttttatcgtatgttagggtttttcgaggtacggttgtattttcggttttttatcgtttaatgttggttggtgttcgtattaggtgattttatacgtcggtattcgtttatatcgtttatcgtgtttattggtaatgataacgttaatttgtaacgtgtcggaatcgatttggcgat

SEQ ID NO: 6994 - DNA, 555 bp, Artificial Sequence
  chemically treated genomic DNA (Homo sapiens) CpG-island No: 6994
atcgccaaatcgattccgacacgttacaaattaacgttatcattaccaataaacacgataaacgatataaacgaataccgacgtataaaatcacctaatacgaacaccaaccaacattaaacgataaaaaaccgaaaatacaaccgtacctcgaaaaaccctaacatacgataaaacaaaccgtaaccacctacgaaaaacaacccataaaacctaatttaaattcgcaaacgataacgcatatcgaacgccgccaaaaccgctcttctataataatcaacgtaacataactaaaaacgcccgaaaattcgcaattactattaataacaaactctaatatctatcgctacaacccgacgaaaaaacgttctaatttaccaataacccatacccatataaccgccaccaccgcaaccgcgataacccataccccaattcgctccgcgcgaatacccgcttcaaccatcgcgatatcgcgtttcacccgtaactcatctaacgactaacgcaaattcgccatctctttaacgaccgcgttaattttactactatccg

SEQ ID NO: 6995 - DNA, 555 bp, Artificial Sequence
  chemically treated genomic DNA (Homo sapiens) CpG-island No: 6995
atcgttaaatcgatttcggtacgttgtagattgacgttgttattattagtgagtacggtgagcgatatagacggatatcggcgtgtaaagttatttaatgcgggtattaattagtattgggcgatagagggtcgggaatatagtcgtgtttcgaggggttttggtatgcgatgaagtagatcgtagttatttgcgaagggtaatttataaaatttgatttagattcgtaggcgatagcgtatatcgagcgtcgttagagtcgtttttttgtgatggttagcgtggtatggttggaagcgttcgaaggttcgtagttattgttagtggtaaattttgatgtttgtcgttgtaattcgacgagaaagcgttttgatttattagtggtttatatttatatgatcgttattatcgtagtcgcggtagtttatgttttagttcgtttcgcgcgaatattcgttttagttatcgcgatatcgcgttttattcgtaatttatttaacgattgacgtaaattcgttatttttttggcgatcgcgttaattttgttgttattcg

SEQ ID NO: 6996 - DNA, 555 bp, Artificial Sequence
  chemically treated genomic DNA (Homo sapiens) CpG-island No: 6996
cgaataacaacaaaattaacgcgatcgccaaaaaaataacgaatttacgtcaatcgttaaataaattacgaataaaacgcgatatcgcgataactaaaacgaatattcgcgcgaaacgaactaaaacataaactaccgcgactacgataataacgatcatataaatataaaccactaataaatcaaaacgctttctcgtcgaattacaacgacaaacatcaaaatttaccactaacaataactacgaaccttcgaacgcttccaaccataccacgctaaccatcacaaaaaaacgactctaacgacgctcgatatacgctatcgcctacgaatctaaatcaaattttataaattacccttcgcaaataactacgatctacttcatcgcataccaaaacccctcgaaacacgactatattcccgaccctctatcgcccaatactaattaatacccgcattaaataactttacacgccgatatccgtctatatcgctcaccgtactcactaataataacaacgtcaatctacaacgtaccgaaatcgatttaacgat

SEQ ID NO: 6997 - DNA, 519 bp, Artificial Sequence
  chemically treated genomic DNA (Homo sapiens) CpG-island No: 6997
gtttatttttcggagttattatacgtttatttagttgtcgttaaaggatatagaggtcggggtagtggggtgaatagcgggcgggatgtgcgaggtgtgggtgggatcgggtgtgattttatttgatcgatttagaggatggagaatacggggacgttgagaatttggggttgatagtgggaaacgattggaatttgatggttagttgttgatgaatagtggcggtagcgggggggggtggattagggggatgagatcggttggggggcgtttgtgagtttgggttggcgtaggttgggggcggtgggatatcgtttgagtgaagatacgtaatgggtagagaagaggcgttgtgtatgttggggtgcgattagtattagagggggtgtttgagagcgttggatcggtgcggagcgggttagcgggagggtttgggagtaagtgtatggtgagataaacgtggggtggtgggggtgagggtatttcgggtcgggtttagaaaggtgggattattatcga

SEQ ID NO: 6998 - DNA, 519 bp, Artificial Sequence
  chemically treated genomic DNA (Homo sapiens) CpG-island No: 6998
tcgataataatcccacctttctaaacccgacccgaaataccctcacccccaccaccccacgtttatctcaccatacacttactcccaaaccctcccgctaacccgctccgcaccgatccaacgctctcaaacaccccctctaatactaatcgcaccccaacatacacaacgcctcttctctacccattacgtatcttcactcaaacgatatcccaccgcccccaacctacgccaacccaaactcacaaacgccccccaaccgatctcatccccctaatccacccccccccgctaccgccactattcatcaacaactaaccatcaaattccaatcgtttcccactatcaaccccaaattctcaacgtccccgtattctccatcctctaaatcgatcaaataaaatcacacccgatcccacccacacctcgcacatcccgcccgctattcaccccactaccccgacctctatatcctttaacgacaactaaataaacgtataataactccgaaaaataaac

SEQ ID NO: 6999 - DNA, 519 bp, Artificial Sequence
  chemically treated genomic DNA (Homo sapiens) CpG-island No: 6999
tcggtagtggttttatttttttaaattcggttcggggtgtttttatttttattattttacgtttattttattatgtatttatttttaagttttttcgttaattcgtttcgtatcggtttaacgtttttaggtattttttttggtattggtcgtattttaatatgtataacgttttttttttatttattacgtatttttatttaggcggtattttatcgtttttagtttacgttagtttaagtttataaacgttttttaatcggttttatttttttaatttattttttttcgttatcgttattatttattaataattggttattaaattttagtcgttttttattattagttttaagtttttaacgttttcgtgttttttattttttgggtcggttaagtgaaattatattcggttttatttatatttcgtatatttcgttcgttatttattttattatttcggtttttatattttttggcgataattggatagacgtatgatgatttcggaggatgggt

SEQ ID NO: 7000 - DNA, 519 bp, Artificial Sequence
  chemically treated genomic DNA (Homo sapiens) CpG-island No: 7000
acccatcctccgaaatcatcatacgtctatccaattatcgccaaaaaatataaaaaccgaaataataaaataaataacgaacgaaatatacgaaatataaataaaaccgaatataatttcacttaaccgacccaaaaaataaaaaacacgaaaacgttaaaaacttaaaactaataataaaaaacgactaaaatttaataaccaattattaataaataataacgataacgaaaaaaaataaattaaaaaaataaaaccgattaaaaaacgtttataaacttaaactaacgtaaactaaaaacgataaaataccgcctaaataaaaatacgtaataaataaaaaaaaaacgttatacatattaaaatacgaccaataccaaaaaaaatacctaaaaacgttaaaccgatacgaaacgaattaacgaaaaaacttaaaaataaatacataataaaataaacgtaaaataataaaaataaaaacaccccgaaccgaatttaaaaaaataaaaccactaccga

SEQ ID NO: 7001 - DNA, 530 bp, Artificial Sequence
  chemically treated genomic DNA (Homo sapiens) CpG-island No: 7001
  misc_feature (276)..(276): n is either a, c, g or t
  misc_feature (278)..(279): n is either a, c, g or t
ttacgcgtttcgttaattgtacggttggagatgggtggacggattgcgtacgttggcgttttcgatgatatggggggggggggggggggacgggacgatagataagtagaggggatgtatggatttggcgtaagaagcgttcggttgagtaagggattaagggttaacggaataacgggtatttgggtgggtggtgggtgcgggattaacgggtatcgggagtagttgatcgatggatgcggagatttggggtgttagtcgataggagagagggantnntcggagcgcgcgggggtttggtttaaagatgcgatatatttaggcgtagtgttgagcggatgttttcgcgggggttaagagggataggtcggatattcggaggaaaagttatattatgttttaagcgtcgtgatgcgcggaatgaggagcgcgggtttatacgagaggtggtagagtcgggcggggtgatattaagttgtatggattaagaaggagaagtacgtaataaaaattaagtaggaataaacgga

SEQ ID NO: 7002 - DNA, 530 bp, Artificial Sequence
  chemically treated genomic DNA (Homo sapiens) CpG-island No: 7002
  misc_feature (252)..(253): n is either a, c, g or t
  misc_feature (255)..(255): n is either a, c, g or t
tccgtttattcctacttaatttttattacgtacttctccttcttaatccatacaacttaatatcaccccgcccgactctaccacctctcgtataaacccgcgctcctcattccgcgcatcacgacgcttaaaacataatataacttttcctccgaatatccgacctatccctcttaacccccgcgaaaacatccgctcaacactacgcctaaatatatcgcatctttaaaccaaacccccgcgcgctccgannantccctctctcctatcgactaacaccccaaatctccgcatccatcgatcaactactcccgatacccgttaatcccgcacccaccacccacccaaatacccgttattccgttaacccttaatcccttactcaaccgaacgcttcttacgccaaatccatacatcccctctacttatctatcgtcccgtccccccccccccccccccatatcatcgaaaacgccaacgtacgcaatccgtccacccatctccaaccgtacaattaacgaaacgcgtaa

SEQ ID NO: 7003 - DNA, 530 bp, Artificial Sequence
  chemically treated genomic DNA (Homo sapiens) CpG-island No: 7003
  misc_feature (252)..(253): n is either a, c, g or t
  misc_feature (255)..(255): n is either a, c, g or t
ttcgtttatttttgtttggtttttattgcgtgttttttttttttaatttatataatttggtgttatttcgttcggttttgttatttttcgtatagattcgcgttttttatttcgcgtattacgacgtttaaagtatagtgtagtttttttttcgggtgttcgatttgttttttttaattttcgcggagatattcgtttaatattacgtttaaatgtatcgtatttttaggttaggttttcgcgcgtttcggnngnttttttttttttgtcgattggtattttaggttttcgtatttatcggttaattgttttcggtattcgttagtttcgtatttattatttatttagatattcgttgtttcgttaatttttaattttttatttaatcgaacgttttttacgttaagtttatgtattttttttatttatttatcgtttcgtttttttttttttttttttatattatcgagagcgttagcgtacgtaattcgtttatttatttttaatcgtgtagttggcggagcgcgtaa

SEQ ID NO: 7004 - DNA, 530 bp, Artificial Sequence
  chemically treated genomic DNA (Homo sapiens) CpG-island No: 7004
  misc_feature (276)..(276): n is either a, c, g or t
  misc_feature (278)..(279): n is either a, c, g or t
ttacgcgctccgccaactacacgattaaaaataaataaacgaattacgtacgctaacgctctcgataatataaaaaaaaaaaaaaaaaaacgaaacgataaataaataaaaaaaatacataaacttaacgtaaaaaacgttcgattaaataaaaaattaaaaattaacgaaacaacgaatatctaaataaataataaatacgaaactaacgaataccgaaaacaattaaccgataaatacgaaaacctaaaataccaatcgacaaaaaaaaaaaancnnccgaaacgcgcgaaaacctaacctaaaaatacgatacatttaaacgtaatattaaacgaatatctccgcgaaaattaaaaaaaacaaatcgaacacccgaaaaaaaaactacactatactttaaacgtcgtaatacgcgaaataaaaaacgcgaatctatacgaaaaataacaaaaccgaacgaaataacaccaaattatataaattaaaaaaaaaaaacacgcaataaaaaccaaacaaaaataaacgaa

SEQ ID NO: 7005 - DNA, 945 bp, Artificial Sequence
  chemically treated genomic DNA (Homo sapiens) CpG-island No: 7005
  misc_feature (895)..(895): n is either a, c, g or t
  misc_feature (908)..(909): n is either a, c, g or t
  misc_feature (916)..(916): n is either a, c, g or t
  misc_feature (918)..(919): n is either a, c, g or t
  misc_feature (933)..(933): n is either a, c, g or t
  misc_feature (936)..(936): n is either a, c, g or t
  misc_feature (943)..(944): n is either a, c, g or t
gcggcgcggcggtcgtgtttagttgatgaggcgagcgttgcgggaggacgggacggcggggacgagggggcgaagtggggagggggggatgtaaaaaagggggggacgggatgttggtaaaagttagcgtaggcgggggggcgcggcgtttgggaggtaggggagcgcgacggggggcgcgtgaagaggttggagtatcgcgggaatgggtcgtgaagcggttagtatacgttggtagagatttggagggaagcggggttagggcgggagcgagggaattagcggggagtggttagttggcgaacggttgaggcgggattggggttacggtgcgtaggagttgttaggacgcgaacggtttaggagggggtatattcgttgggcggggttatgcggtttggatttaatgattacggaaaagtacggtggaagggcggcggtaggagttggattaggaaggtagaattgggaggagcgtcggcgttcggagtaattgggtatgaattgcgttttggagaagtttacgagtcggggttgcgttggcgtgtgatggggggggggggggggcgggttagtgttttggagattaattacggtgaacgattggggattatggtggggagtagttgggtacgaaatgttggtgtgaaggggcgtggagtgatgacgttggtattcgaaagataagcgggattggtcgtttagggtgattttgggacggatggatacgagagatgcgatggcgcggacggcgtgggggttgagacgatgaaatggtattattacgggggttgaaacgagggaatggtgatttaattgacgagggggtttatgggggtacgtagtgcggcggtgagttatggagtggaggggtttgagagacgtgcgtatgtgnttagtagtatganngttcggnannttttcgtgggtgtngtncggtgtnnt

SEQ ID NO: 7006 - DNA, 945 bp, Artificial Sequence
  chemically treated genomic DNA (Homo sapiens) CpG-island No: 7006
  misc_feature (2)..(3): n is either a, c, g or t
  misc_feature (10)..(10): n is either a, c, g or t
  misc_feature (13)..(13): n is either a, c, g or t
  misc_feature (27)..(28): n is either a, c, g or t
  misc_feature (30)..(30): n is either a, c, g or t
  misc_feature (37)..(38): n is either a, c, g or t
  misc_feature (51)..(51): n is either a, c, g or t
annacaccgnacnacacccacgaaaanntnccgaacnntcatactactaancacatacgcacgtctctcaaacccctccactccataactcaccgccgcactacgtacccccataaaccccctcgtcaattaaatcaccattccctcgtttcaacccccgtaataataccatttcatcgtctcaacccccacgccgtccgcgccatcgcatctctcgtatccatccgtcccaaaatcaccctaaacgaccaatcccgcttatctttcgaataccaacgtcatcactccacgccccttcacaccaacatttcgtacccaactactccccaccataatccccaatcgttcaccgtaattaatctccaaaacactaacccgccccccccccccccccatcacacgccaacgcaaccccgactcgtaaacttctccaaaacgcaattcatacccaattactccgaacgccgacgctcctcccaattctaccttcctaatccaactcctaccgccgcccttccaccgtacttttccgtaatcattaaatccaaaccgcataaccccgcccaacgaatataccccctcctaaaccgttcgcgtcctaacaactcctacgcaccgtaaccccaatcccgcctcaaccgttcgccaactaaccactccccgctaattccctcgctcccgccctaaccccgcttccctccaaatctctaccaacgtatactaaccgcttcacgacccattcccgcgatactccaacctcttcacgcgccccccgtcgcgctcccctacctcccaaacgccgcgcccccccgcctacgctaacttttaccaacatcccgtcccccccttttttacatccccccctccccacttcgccccctcgtccccgccgtcccgtcctcccgcaacgctcgcctcatcaactaaacacgaccgccgcgccgc

SEQ ID NO: 7007 - DNA, 945 bp, Artificial Sequence
  chemically treated genomic DNA (Homo sapiens) CpG-island No: 7007
  misc_feature (2)..(3): n is either a, c, g or t
  misc_feature (10)..(10): n is either a, c, g or t
  misc_feature (13)..(13): n is either a, c, g or t
  misc_feature (27)..(28): n is either a, c, g or t
  misc_feature (30)..(30): n is either a, c, g or t
  misc_feature (37)..(38): n is either a, c, g or t
  misc_feature (51)..(51): n is either a, c, g or t
anngtatcgnatnatatttacgagggnntntcgaatnnttatattgttagntatatacgtacgttttttaagtttttttattttataatttatcgtcgtattgcgtatttttataaattttttcgttaattaaattattattttttcgttttagttttcgtagtggtattattttatcgttttaatttttacgtcgttcgcgttatcgtatttttcgtgtttattcgttttagagttattttggacggttagtttcgtttatttttcgggtgttaacgttattattttacgtttttttatattagtatttcgtatttagttattttttattataatttttagtcgtttatcgtagttaatttttaaggtattagttcgttttttttttttttttattatacgttaacgtaatttcgattcgtaaatttttttagggcgtaatttatatttaattatttcgggcgtcggcgttttttttaattttatttttttaatttaatttttatcgtcgtttttttatcgtattttttcgtagttattaggtttaaatcgtatagtttcgtttagcgaatatgtttttttttgagtcgttcgcgttttggtagtttttacgtatcgtaattttaatttcgttttaatcgttcgttaattaattatttttcgttaattttttcgttttcgttttaatttcgtttttttttaagtttttattagcgtgtattagtcgttttacggtttattttcgcggtattttaatttttttacgcgtttttcgtcgcgtttttttgttttttaaacgtcgcgttttttcgtttacgttagtttttattagtatttcgttttttttttttttgtatttttttttttttatttcgttttttcgttttcgtcgtttcgttttttcgtagcgttcgttttattaattggatacggtcgtcgcgtcgt

SEQ ID NO: 7008 - DNA, 945 bp, Artificial Sequence
  chemically treated genomic DNA (Homo sapiens) CpG-island No: 7008
  misc_feature (895)..(895): n is either a, c, g or t
  misc_feature (908)..(909): n is either a, c, g or t
  misc_feature (916)..(916): n is either a, c, g or t
  misc_feature (918)..(919): n is either a, c, g or t
  misc_feature (933)..(933): n is either a, c, g or t
  misc_feature (936)..(936): n is either a, c, g or t
  misc_feature (943)..(944): n is either a, c, g or t
acgacgcgacgaccgtatccaattaataaaacgaacgctacgaaaaaacgaaacgacgaaaacgaaaaaacgaaataaaaaaaaaaaaatacaaaaaaaaaaaaaacgaaatactaataaaaactaacgtaaacgaaaaaacgcgacgtttaaaaaacaaaaaaacgcgacgaaaaacgcgtaaaaaaattaaaataccgcgaaaataaaccgtaaaacgactaatacacgctaataaaaacttaaaaaaaaacgaaattaaaacgaaaacgaaaaaattaacgaaaaataattaattaacgaacgattaaaacgaaattaaaattacgatacgtaaaaactaccaaaacgcgaacgactcaaaaaaaaacatattcgctaaacgaaactatacgatttaaacctaataactacgaaaaaatacgataaaaaaacgacgataaaaattaaattaaaaaaataaaattaaaaaaaacgccgacgcccgaaataattaaatataaattacgccctaaaaaaatttacgaatcgaaattacgttaacgtataataaaaaaaaaaaaaaaacgaactaataccttaaaaattaactacgataaacgactaaaaattataataaaaaataactaaatacgaaatactaatataaaaaaacgtaaaataataacgttaacacccgaaaaataaacgaaactaaccgtccaaaataactctaaaacgaataaacacgaaaaatacgataacgcgaacgacgtaaaaattaaaacgataaaataataccactacgaaaactaaaacgaaaaaataataatttaattaacgaaaaaatttataaaaatacgcaatacgacgataaattataaaataaaaaaacttaaaaaacgtacgtatatanctaacaatataannattcganannccctcgtaaatatnatncgatacnnt

SEQ ID NO: 7009 - DNA, 514 bp, Artificial Sequence
  chemically treated genomic DNA (Homo sapiens) CpG-island No: 7009
tcgtacggttgtatttagttgtttcggggttcgcggaattttatagagtttttgtgggtttgagatcggttttttcgtcgggtttttttaaatttgtacgttcgatcggtcgcggaggcgttatttggggacgttaatttatacgtcgcggacgtattagtagtcgaggatttcgtaagggttagagtatgtggcggtataagagggggttttttatagttggcgttttcgattcgtttcggtttgttgtcgtttgtcgtttttagtcgttattttatcgcgttgtggtttttttttattattttttagattttttatgttagtcgcggggcggttcgtcgttttatattggagcgttcgagcgggtatcgcggtcgttgttttagaaaatttattaaaagcgttatacggtaattttttgtcgttggaagcggcggaataagcgttcggtattattttgtttaattagtgtattaataattgttgattgatttgataacggttaagttttttt

SEQ ID NO: 7010 - DNA, 514 bp, Artificial Sequence
  chemically treated genomic DNA (Homo sapiens) CpG-island No: 7010
aaaaaaacttaaccgttatcaaatcaatcaacaattattaatacactaattaaacaaaataataccgaacgcttattccgccgcttccaacgacaaaaaattaccgtataacgcttttaataaattttctaaaacaacgaccgcgatacccgctcgaacgctccaatataaaacgacgaaccgccccgcgactaacataaaaaatctaaaaaataataaaaaaaaaccacaacgcgataaaataacgactaaaaacgacaaacgacaacaaaccgaaacgaatcgaaaacgccaactataaaaaaccccctcttataccgccacatactctaacccttacgaaatcctcgactactaatacgtccgcgacgtataaattaacgtccccaaataacgcctccgcgaccgatcgaacgtacaaatttaaaaaaacccgacgaaaaaaccgatctcaaacccacaaaaactctataaaattccgcgaaccccgaaacaactaaatacaaccgtacga

SEQ ID NO: 7011 - DNA, 514 bp, Artificial Sequence
  chemically treated genomic DNA (Homo sapiens) CpG-island No: 7011
ggaaggatttagtcgttattaaattaattagtagttattaatgtattggttgagtaggatgatgtcgaacgtttgtttcgtcgtttttagcggtaggggattatcgtatggcgtttttggtgaattttttggaatagcggtcgcggtgttcgttcgggcgttttagtgtggggcgacgggtcgtttcgcggttagtatgggggatttaagaggtggtaaaggagggttatagcgcgatagaatggcggttgggaacggtaaacgataataggtcggggcgagtcggagacgttaattatggggggtttttttttgtgtcgttatatattttagtttttgcggggttttcggttattaatacgttcgcggcgtgtagattagcgtttttagatggcgttttcgcgatcggtcgggcgtataggtttgggaggattcgacggggaggtcggttttaaatttataagagttttatggggtttcgcggatttcggagtaattgagtgtaatcgtgcga

SEQ ID NO: 7012 - DNA, 514 bp, Artificial Sequence
  chemically treated genomic DNA (Homo sapiens) CpG-island No: 7012
tcgcacgattacactcaattactccgaaatccgcgaaaccccataaaactcttataaatttaaaaccgacctccccgtcgaatcctcccaaacctatacgcccgaccgatcgcgaaaacgccatctaaaaacgctaatctacacgccgcgaacgtattaataaccgaaaaccccgcaaaaactaaaatatataacgacacaaaaaaaaaccccccataattaacgtctccgactcgccccgacctattatcgtttaccgttcccaaccgccattctatcgcgctataaccctcctttaccacctcttaaatcccccatactaaccgcgaaacgacccgtcgccccacactaaaacgcccgaacgaacaccgcgaccgctattccaaaaaattcaccaaaaacgccatacgataatcccctaccgctaaaaacgacgaaacaaacgttcgacatcatcctactcaaccaatacattaataactactaattaatttaataacgactaaatccttcc

SEQ ID NO: 7013 - DNA, 533 bp, Artificial Sequence
  chemically treated genomic DNA (Homo sapiens) CpG-island No: 7013
tgtgtaggcgcgttcgaaatcgtgcgtttacgcggttaggttatggagcgttatacgttgtattttagggtaagattatcgtcgaaggtcgtgttatcggttatcgtatcggtggggttcggtgaaagttatttatgatattagcgaaatgaatcgtatcgaattggcgacgtgttggttattgatatgatcgattcggattgggaatcgatatgaagaaagtatttgttatcgttataaacgtggcggtcgttttgttagggcgatatcgtcgtgaacgggtattcggggaatgggttgtgggattgataacggttaaaacggagacgttcgtgttgtgcgaggtgtcggtagtatagagggggaatacgggaagttcgttaatacggttcgagacgttttgtattgtcgagggttagtgcgtttaataggggcgttcgaatattcgatggttttagtgtatagcgtcgaaattttagattcgttattataggtagatattatcgtaaaatttagttagtaggaagaatatg

SEQ ID NO: 7014 - DNA, 533 bp, Artificial Sequence
  chemically treated genomic DNA (Homo sapiens) CpG-island No: 7014
catattcttcctactaactaaattttacgataatatctacctataataacgaatctaaaatttcgacgctatacactaaaaccatcgaatattcgaacgcccctattaaacgcactaaccctcgacaatacaaaacgtctcgaaccgtattaacgaacttcccgtattccccctctatactaccgacacctcgcacaacacgaacgtctccgttttaaccgttatcaatcccacaacccattccccgaatacccgttcacgacgatatcgccctaacaaaacgaccgccacgtttataacgataacaaatactttcttcatatcgattcccaatccgaatcgatcatatcaataaccaacacgtcgccaattcgatacgattcatttcgctaatatcataaataactttcaccgaaccccaccgatacgataaccgataacacgaccttcgacgataatcttaccctaaaatacaacgtataacgctccataacctaaccgcgtaaacgcacgatttcgaacgcgcctacaca

SEQ ID NO: 7015 - DNA, 533 bp, Artificial Sequence
  chemically treated genomic DNA (Homo sapiens) CpG-island No: 7015
tatattttttttattaattggattttacggtggtgtttgtttgtgatagcggatttggggtttcggcgttatatattgggattatcgggtattcgggcgtttttgttgagcgtattagttttcgatagtgtaaaacgtttcgaatcgtgttaacgggtttttcgtattttttttttatattatcgatatttcgtatagtacgagcgttttcgttttaatcgttgttaattttatagtttatttttcggatgttcgtttacggcgatatcgttttgataggacgatcgttacgtttgtgacgatggtagatgttttttttatatcggtttttagttcgggtcggttatgttagtaattagtacgtcgttagttcgatgcggtttatttcgttgatgttatggatgatttttatcggattttatcgatgcgatgatcgatagtacggttttcggcgataattttattttggaatgtagcgtataacgttttatgatttgatcgcgtgagcgtacggtttcggacgcgtttgtata

SEQ ID NO: 7016 - DNA, 533 bp, Artificial Sequence
  chemically treated genomic DNA (Homo sapiens) CpG-island No: 7016
tatacaaacgcgtccgaaaccgtacgctcacgcgatcaaatcataaaacgttatacgctacattccaaaataaaattatcgccgaaaaccgtactatcgatcatcgcatcgataaaatccgataaaaatcatccataacatcaacgaaataaaccgcatcgaactaacgacgtactaattactaacataaccgacccgaactaaaaaccgatataaaaaaaacatctaccatcgtcacaaacgtaacgatcgtcctatcaaaacgatatcgccgtaaacgaacatccgaaaaataaactataaaattaacaacgattaaaacgaaaacgctcgtactatacgaaatatcgataatataaaaaaaaaatacgaaaaacccgttaacacgattcgaaacgttttacactatcgaaaactaatacgctcaacaaaaacgcccgaatacccgataatcccaatatataacgccgaaaccccaaatccgctatcacaaacaaacaccaccgtaaaatccaattaataaaaaaaatata

SEQ ID NO: 7017 - DNA, 587 bp, Artificial Sequence
  chemically treated genomic DNA (Homo sapiens) CpG-island No: 7017
agagtcggcgtttagagttagcggtttttcgaggatttattattaagttcgcggtataggtttcgattttatatttaacgttgttaaagtggtagagtcggcggggttgggatagaggcggtattgaggtcggcgttgtcggtggttgagaggttataagtttcggttcgttatattaggggcgacgttttttagaggtttcgcggtttattcgggcgggattggttttattgtttgcgcgttttgagaatagattacggtgttttagggtttatagtttcgcgtaggggagtttagttaggttttgtacgagcggtttttcgcgagtttagttttgagagattgggacgtaatttggtgttgagaagaatcgaatcgtttcgttgttttttgcgttaattatattttttagaggttttcgcggttttattttttcgattttattttaaaaaggtattttttttttatagtcggttggagttgtaggttcgtaagttcgtgaaggaagttcggtttagtgtgtttagtttcgtttttttgggttttatttgaggttagaatatagcggggtgaaggtggtgagagtt

SEQ ID NO: 7018 - DNA, 587 bp, Artificial Sequence
  chemically treated genomic DNA (Homo sapiens) CpG-island No: 7018
aactctcaccaccttcaccccgctatattctaacctcaaataaaacccaaaaaaacgaaactaaacacactaaaccgaacttccttcacgaacttacgaacctacaactccaaccgactataaaaaaaaaatacctttttaaaataaaatcgaaaaaataaaaccgcgaaaacctctaaaaaatataattaacgcaaaaaacaacgaaacgattcgattcttctcaacaccaaattacgtcccaatctctcaaaactaaactcgcgaaaaaccgctcgtacaaaacctaactaaactcccctacgcgaaactataaaccctaaaacaccgtaatctattctcaaaacgcgcaaacaataaaaccaatcccgcccgaataaaccgcgaaacctctaaaaaacgtcgcccctaatataacgaaccgaaacttataacctctcaaccaccgacaacgccgacctcaataccgcctctatcccaaccccgccgactctaccactttaacaacgttaaatataaaatcgaaacctataccgcgaacttaataataaatcctcgaaaaaccgctaactctaaacgccgactct

SEQ ID NO: 7019 - DNA, 587 bp, Artificial Sequence
  chemically treated genomic DNA (Homo sapiens) CpG-island No: 7019
agtttttattatttttatttcgttgtattttagttttaggtaggatttaaaaagacggaattaaatatattgagtcgggttttttttacggatttgcgaatttgtagttttagtcgattgtaagaaggaagtgtttttttgaggtggggtcggggaagtagggtcgcgaaggtttttgggaaatgtagttggcgtaggaagtagcggaacgattcgattttttttagtattaagttgcgttttaattttttagagttgggttcgcgggaggtcgttcgtgtaaaatttggttgagtttttttgcgcggagttgtgagttttggaatatcgtggtttgtttttaggacgcgtaaatagtgaagttagtttcgttcgggtgagtcgcggggtttttgggaagcgtcgtttttggtgtaacggatcgagatttgtggttttttagttatcgatagcgtcggttttagtgtcgtttttgttttagtttcgtcggttttgttattttggtagcgttaagtgtggaatcggggtttgtgtcgcgggtttggtggtgagttttcgggaaatcgttagttttgagcgtcgatttt

SEQ ID NO: 7020 - DNA, 587 bp, Artificial Sequence
  chemically treated genomic DNA (Homo sapiens) CpG-island No: 7020
aaaatcgacgctcaaaactaacgatttcccgaaaactcaccaccaaacccgcgacacaaaccccgattccacacttaacgctaccaaaataacaaaaccgacgaaactaaaacaaaaacgacactaaaaccgacgctatcgataactaaaaaaccacaaatctcgatccgttacaccaaaaacgacgcttcccaaaaaccccgcgactcacccgaacgaaactaacttcactatttacgcgtcctaaaaacaaaccacgatattccaaaactcacaactccgcgcaaaaaaactcaaccaaattttacacgaacgacctcccgcgaacccaactctaaaaaattaaaacgcaacttaatactaaaaaaaatcgaatcgttccgctacttcctacgccaactacatttcccaaaaaccttcgcgaccctacttccccgaccccacctcaaaaaaacacttccttcttacaatcgactaaaactacaaattcgcaaatccgtaaaaaaaacccgactcaatatatttaattccgtctttttaaatcctacctaaaactaaaatacaacgaaataaaaataataaaaact

SEQ ID NO: 7021 - DNA, 529 bp, Artificial Sequence
  chemically treated genomic DNA (Homo sapiens) CpG-island No: 7021
ttttggcgcggtcgggttattcggagttcgtttttgatttttcgttttcgtcggggttcggttttatttatttttcggcgtcgcgggttttgtaaacggtttcgcgatcgagattcgcgacgttattttttagaatttttcgcgaggagagcgaggcgaggattgaggtatgtaggattttgagttttgcgagatttaattagcgatatcgcgttttttatggatttcgcgaattacgagttttagacgttttgcgttacggtcgttatcgttgaattatattttttagagaattcgcggttttttttattgcgcgtttgcgttacgggggtaggtatcggagaggttgtgtgcggtcgtaggttttttagtgattttgagttgttgtgttgggaaagcggttaggttgcgcgcggggttgattggttgaatgtttgggtgtgtggttcgtgtgtgattgttgttgtatatttttatgtttgtcgacgaaagagcggcggattttgttagtgtagggagtttttgtatt

SEQ ID NO: 7022 - DNA, 529 bp, Artificial Sequence
  chemically treated genomic DNA (Homo sapiens) CpG-island No: 7022
aatacaaaaactccctacactaacaaaatccgccgctctttcgtcgacaaacataaaaatatacaacaacaatcacacacgaaccacacacccaaacattcaaccaatcaaccccgcgcgcaacctaaccgctttcccaacacaacaactcaaaatcactaaaaaacctacgaccgcacacaacctctccgatacctacccccgtaacgcaaacgcgcaataaaaaaaaccgcgaattctctaaaaaatataattcaacgataacgaccgtaacgcaaaacgtctaaaactcgtaattcgcgaaatccataaaaaacgcgatatcgctaattaaatctcgcaaaactcaaaatcctacatacctcaatcctcgcctcgctctcctcgcgaaaaattctaaaaaataacgtcgcgaatctcgatcgcgaaaccgtttacaaaacccgcgacgccgaaaaataaataaaaccgaaccccgacgaaaacgaaaaatcaaaaacgaactccgaataacccgaccgcgccaaaa

SEQ ID NO: 7023 - DNA, 529 bp, Artificial Sequence
  chemically treated genomic DNA (Homo sapiens) CpG-island No: 7023
aatatagaagttttttgtattgataaaattcgtcgttttttcgtcggtaagtataaaggtgtgtagtaatagttatatacgaattatatatttaagtatttaattagttagtttcgcgcgtagtttggtcgtttttttaatatagtagtttaaggttattggagagtttacgatcgtatatagttttttcggtatttgttttcgtggcgtaggcgcgtagtggagggggtcgcgggttttttgggagatgtagtttaacgatgacggtcgtggcgtaaagcgtttggggttcgtggttcgcggggtttatggggaacgcggtgtcgttggttagatttcgtagagtttagagttttgtatgttttagttttcgtttcgtttttttcgcggaggattttgggaggtgacgtcgcgggtttcggtcgcggggtcgtttgtagagttcgcggcgtcgggaggtgagtggggtcgggtttcggcgggagcgggaagttaagggcgggtttcgggtggttcggtcgcgttagga

SEQ ID NO: 7024 - DNA, 529 bp, Artificial Sequence
  chemically treated genomic DNA (Homo sapiens) CpG-island No: 7024
tcctaacgcgaccgaaccacccgaaacccgcccttaacttcccgctcccgccgaaacccgaccccactcacctcccgacgccgcgaactctacaaacgaccccgcgaccgaaacccgcgacgtcacctcccaaaatcctccgcgaaaaaaacgaaacgaaaactaaaacatacaaaactctaaactctacgaaatctaaccaacgacaccgcgttccccataaaccccgcgaaccacgaaccccaaacgctttacgccacgaccgtcatcgttaaactacatctcccaaaaaacccgcgaccccctccactacgcgcctacgccacgaaaacaaataccgaaaaaactatatacgatcgtaaactctccaataaccttaaactactatattaaaaaaacgaccaaactacgcgcgaaactaactaattaaatacttaaatatataattcgtatataactattactacacacctttatacttaccgacgaaaaaacgacgaattttatcaatacaaaaaacttctatatt

SEQ ID NO: 7025 - DNA, 1193 bp, Artificial Sequence
  chemically treated genomic DNA (Homo sapiens) CpG-island No: 7025
  misc_feature (567)..(567): n is either a, c, g or t
  misc_feature (1147)..(1147): n is either a, c, g or t
  misc_feature (1189)..(1189): n is either a, c, g or t
gtgcgtagaagtcgggattaggtagatatcgcgatgtttttcgttgcggtttttatgataatgacgaatcgttagtaggttcgcgtattcgttttgtgcgttagagttcggttgtatataaacggcgtcgtaatcggttagttttattagttagttagttagttgcgtaattatttgttgataattttcggtttgtttcggcgggtagaacgggtgtagttcggtaaatttcggttaggtgattgggattatttcggcggcggcgtttagttttatggtgtaggaatttagcgggattatcgtttgatttagcgttagatttttacgttttagcgagtgtatatagcgtattatttcggtttcgttgtggtagcgattaaatatcggatgggtgaggatttcgtcgtcgcgtagtatcgtaggttggatagagcggttgtcgtgagttacgtttttgtttagcgtgtcgatgtttaagtcgggggtatcggttagtagtacgttgaaaaattgtattacgtttttacgcgtgggttgtttagcgggtgattgttgtattgagttttntttggagatttttcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcggggtaataagggcgcgtgcgttatttatttttttgttcgtntatatttaacggtttttttgaggagtttattttttatcgttnggaa

SEQ ID NO: 7026 - DNA, 1193 bp, Artificial Sequence
  chemically treated genomic DNA (Homo sapiens) CpG-island No: 7026
  misc_feature (5)..(5): n is either a, c, g or t
  misc_feature (47)..(47): n is either a, c, g or t
  misc_feature (627)..(627): n is either a, c, g or t
ttccnaacgataaaaaataaactcctcaaaaaaaccgttaaatatanacgaacaaaaaaataaataacgcacgcgcccttattaccccgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgaaaaatctccaaanaaaactcaatacaacaatcacccgctaaacaacccacgcgtaaaaacgtaatacaatttttcaacgtactactaaccgatacccccgacttaaacatcgacacgctaaacaaaaacgtaactcacgacaaccgctctatccaacctacgatactacgcgacgacgaaatcctcacccatccgatatttaatcgctaccacaacgaaaccgaaataatacgctatatacactcgctaaaacgtaaaaatctaacgctaaatcaaacgataatcccgctaaattcctacaccataaaactaaacgccgccgccgaaataatcccaatcacctaaccgaaatttaccgaactacacccgttctacccgccgaaacaaaccgaaaattatcaacaaataattacgcaactaactaactaactaataaaactaaccgattacgacgccgtttatatacaaccgaactctaacgcacaaaacgaatacgcgaacctactaacgattcgtcattatcataaaaaccgcaacgaaaaacatcgcgatatctacctaatcccgacttctacgcac

SEQ ID NO: 7027 - DNA, 1193 bp, Artificial Sequence
  chemically treated genomic DNA (Homo sapiens) CpG-island No: 7027
  misc_feature (5)..(5): n is either a, c, g or t
  misc_feature (47)..(47): n is either a, c, g or t
  misc_feature (627)..(627): n is either a, c, g or t
ttttnaacgatggaaaatgaattttttaaagaagtcgttgaatatgnacgggtaaaaaagtggatagcgtacgcgtttttattgtttcggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcgggggatttttagangggatttagtgtagtagttattcgttaaataatttacgcgtgaaaacgtaatgtagttttttaacgtgttgttggtcgatattttcggtttggatatcgatacgttggataaagacgtggtttacgatagtcgttttatttagtttgcgatgttgcgcgacgacgaaatttttatttattcggtgtttaatcgttattatagcgaaatcgaaatgatgcgttatatgtattcgttggagcgtaaagatttggcgttgaattaggcgatgatttcgttgggtttttgtattatgaaattgaacgtcgtcgtcgagatgattttaattatttggtcggaatttgtcgaattgtattcgttttgttcgtcggagtaggtcgaaggttattagtagatgattgcgtagttggttgattggttggtgaaattgatcggttacgacgtcgtttgtatgtagtcgaattttggcgtatagggcgaatacgcgggtttgttggcgattcgttattattatgaaagtcgtaacgaagggtatcgcgatatttgtttgatttcggtttttgcgtat

SEQ ID NO: 7028 - DNA, 1193 bp, Artificial Sequence
  chemically treated genomic DNA (Homo sapiens) CpG-island No: 7028
  misc_feature (567)..(567): n is either a, c, g or t
  misc_feature (1147)..(1147): n is either a, c, g or t
  misc_feature (1189)..(1189): n is either a, c, g or t
atacgcaaaaaccgaaatcaaacaaatatcgcgatacccttcgttacgactttcataataataacgaatcgccaacaaacccgcgtattcgccctatacgccaaaattcgactacatacaaacgacgtcgtaaccgatcaatttcaccaaccaatcaaccaactacgcaatcatctactaataaccttcgacctactccgacgaacaaaacgaatacaattcgacaaattccgaccaaataattaaaatcatctcgacgacgacgttcaatttcataatacaaaaacccaacgaaatcatcgcctaattcaacgccaaatctttacgctccaacgaatacatataacgcatcatttcgatttcgctataataacgattaaacaccgaataaataaaaatttcgtcgtcgcgcaacatcgcaaactaaataaaacgactatcgtaaaccacgtctttatccaacgtatcgatatccaaaccgaaaatatcgaccaacaacacgttaaaaaactacattacgttttcacgcgtaaattatttaacgaataactactacactaaatcccntctaaaaatcccccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccgaaacaataaaaacgcgtacgctatccacttttttacccgtncatattcaacgacttctttaaaaaattcattttccatcgttnaaaa

SEQ ID NO: 7029 - DNA, 582 bp, Artificial Sequence
  chemically treated genomic DNA (Homo sapiens) CpG-island No: 7029
ttagttgtattagtaattgatggtttatcgttatatttttagcgaagtttacgtcgtttagcgagttggcggtaaaaatttcggttatgatatagtcgataatgttataaacgtcgtgtatatcgaagatatcgtagggattatttattcgtagtaagcgtttgagtatggtaacgttttataagttcgttagattagttattacgtcgataattaacgcgtcgttaattttaatgtagtcgtaggttggcgttacgtcgattagatcggtaatcgcgttagaatacgtttttagtagtgaaggtttattacgtagcgtttatttatcgaagatttagttaagaattgtcgtcgtcgttgcgattatagtatttataaatgttagtgtcgcgattttattcgtcgtgttcgttgattcggcgttaaagttaaattaatcgatatagagaatggtagtttcggtgaagattatcggtaggttgtgcgggttaaacgtttaatatcgttatcggcgtttagattaacgtttgttataaatattattaaagatttttaggttggattaaatttagtttttaatta

SEQ ID NO: 7030 - DNA, 582 bp, Artificial Sequence
  chemically treated genomic DNA (Homo sapiens) CpG-island No: 7030
taattaaaaactaaatttaatccaacctaaaaatctttaataatatttataacaaacgttaatctaaacgccgataacgatattaaacgtttaacccgcacaacctaccgataatcttcaccgaaactaccattctctatatcgattaatttaactttaacgccgaatcaacgaacacgacgaataaaatcgcgacactaacatttataaatactataatcgcaacgacgacgacaattcttaactaaatcttcgataaataaacgctacgtaataaaccttcactactaaaaacgtattctaacgcgattaccgatctaatcgacgtaacgccaacctacgactacattaaaattaacgacgcgttaattatcgacgtaataactaatctaacgaacttataaaacgttaccatactcaaacgcttactacgaataaataatccctacgatatcttcgatatacacgacgtttataacattatcgactatatcataaccgaaatttttaccgccaactcgctaaacgacgtaaacttcgctaaaaatataacgataaaccatcaattactaatacaactaa

SEQ ID NO: 7031 - DNA, 582 bp, Artificial Sequence
  chemically treated genomic DNA (Homo sapiens) CpG-island No: 7031
tgattgagagttggatttgatttaatttggggatttttgatggtgtttatggtaggcgttggtttgagcgtcggtagcggtattgagcgtttaattcgtataatttgtcgatggtttttatcgggattgttattttttatatcggttggtttggttttaacgtcgggttagcgggtacggcgaatgaaatcgcggtattggtatttgtgaatattgtggtcgtaacggcggcggtaatttttggttggattttcggtgaatgggcgttgcgtggtaagtttttattgttgggggcgtgttttggcgcgattgtcggtttggtcggcgtgacgttagtttgcggttatattggggttggcggcgcgttgattatcggcgtggtagttggtttggcgggtttgtggggcgttattatgtttaaacgtttgttgcgggtggatgatttttgcgatgttttcggtgtgtacggcgtttgtggtattgtcggttgtattatgatcgggatttttgtcgttagttcgttgggcggcgtgggtttcgttgaaggtgtgacgatgggttattagttgttggtatagttgg

SEQ ID NO: 7032 - DNA, 582 bp, Artificial Sequence
  chemically treated genomic DNA (Homo sapiens) CpG-island No: 7032
ccaactataccaacaactaataacccatcgtcacaccttcaacgaaacccacgccgcccaacgaactaacgacaaaaatcccgatcataatacaaccgacaataccacaaacgccgtacacaccgaaaacatcgcaaaaatcatccacccgcaacaaacgtttaaacataataacgccccacaaacccgccaaaccaactaccacgccgataatcaacgcgccgccaaccccaatataaccgcaaactaacgtcacgccgaccaaaccgacaatcgcgccaaaacacgcccccaacaataaaaacttaccacgcaacgcccattcaccgaaaatccaaccaaaaattaccgccgccgttacgaccacaatattcacaaataccaataccgcgatttcattcgccgtacccgctaacccgacgttaaaaccaaaccaaccgatataaaaaataacaatcccgataaaaaccatcgacaaattatacgaattaaacgctcaataccgctaccgacgctcaaaccaacgcctaccataaacaccatcaaaaatccccaaattaaatcaaatccaactctcaatca

SEQ ID NO: 7033 - DNA, 554 bp, Artificial Sequence
  chemically treated genomic DNA (Homo sapiens) CpG-island No: 7033
gttaattggattgtattttataattcggcggaatagtttcgcgatgtattgttcgtttcgttagtttggtaggaaggcggtagtatggcgtatttgttgggtatcgatgacgtaggtcgtgatgtgttgtcgcgtttgatgtacggtgcgcgtttgtcgttgttggttggttgtttggtagttgtgttatcgttgattatgggcgttattttcggtttgatcgtcggttattttggcggtttggtcgataatattattatgcgcgtggtcgatattatgttggcgttgttaagtttgttgttggcgttggtgttggtggtaattttcggttcgtcgattggtaacgtcgcgttggtattgattttcgttggtttgtcgtattatgtgcgtttaattcgcgtcgtcgtgttggtggaagttaatcgcgattacgttatcgcgtttcgcgtggcgggtgtttgggcgatgcgttagatgtttattaatatttttttagaattgttttgcgtcgttgattgtttaggcgtcgttcggtttttttaacgttattttcg

SEQ ID NO: 7034 - DNA, 554 bp, Artificial Sequence
  chemically treated genomic DNA (Homo sapiens) CpG-island No: 7034
cgaaaataacgttaaaaaaaccgaacgacgcctaaacaatcaacgacgcaaaacaattctaaaaaaatattaataaacatctaacgcatcgcccaaacacccgccacgcgaaacgcgataacgtaatcgcgattaacttccaccaacacgacgacgcgaattaaacgcacataatacgacaaaccaacgaaaatcaataccaacgcgacgttaccaatcgacgaaccgaaaattaccaccaacaccaacgccaacaacaaacttaacaacgccaacataatatcgaccacgcgcataataatattatcgaccaaaccgccaaaataaccgacgatcaaaccgaaaataacgcccataatcaacgataacacaactaccaaacaaccaaccaacaacgacaaacgcgcaccgtacatcaaacgcgacaacacatcacgacctacgtcatcgatacccaacaaatacgccatactaccgccttcctaccaaactaacgaaacgaacaatacatcgcgaaactattccgccgaattataaaatacaatccaattaac

SEQ ID NO: 7035 - DNA, 554 bp, Artificial Sequence
  chemically treated genomic DNA (Homo sapiens) CpG-island No: 7035
cgagaatggcgttagagaaatcgagcgacgtttgaataattagcggcgtaaggtagttttggaaaaatgttaataaatatttgacgtatcgtttaggtattcgttacgcgagacgcggtgacgtaatcgcggttaatttttattagtacggcggcgcgggttaagcgtatatagtgcggtaagttagcgaaggttagtgttagcgcggcgttattaatcgacgggtcgaaaattgttattagtattagcgttagtagtagatttggtagcgttagtatgatatcgattacgcgtataatgatgttatcgattaggtcgttaaagtaatcggcgattaggtcgagaataacgtttataattagcgataatataattattagatagttaattagtagcgataggcgcgtatcgtatattaggcgcgatagtatattacggtttacgttatcggtgtttagtaagtgcgttatgttgtcgtttttttgttaggttggcggggcgagtagtgtatcgcggaattgtttcgtcgggttatagggtgtaatttagttggt

SEQ ID NO: 7036 - DNA, 554 bp, Artificial Sequence
  chemically treated genomic DNA (Homo sapiens) CpG-island No: 7036
accaactaaattacaccctataacccgacgaaacaattccgcgatacactactcgccccgccaacctaacaaaaaaacgacaacataacgcacttactaaacaccgataacgtaaaccgtaatatactatcgcgcctaatatacgatacgcgcctatcgctactaattaactatctaataattatattatcgctaattataaacgttattctcgacctaatcgccgattactttaacgacctaatcgataacatcattatacgcgtaatcgatatcatactaacgctaccaaatctactactaacgctaatactaataacaattttcgacccgtcgattaataacgccgcgctaacactaaccttcgctaacttaccgcactatatacgcttaacccgcgccgccgtactaataaaaattaaccgcgattacgtcaccgcgtctcgcgtaacgaatacctaaacgatacgtcaaatatttattaacatttttccaaaactaccttacgccgctaattattcaaacgtcgctcgatttctctaacgccattctcg

SEQ ID NO: 7037 - DNA, 534 bp, Artificial Sequence
  chemically treated genomic DNA (Homo sapiens) CpG-island No: 7037
  misc_feature (399)..(399): n is either a, c, g or t
gttgtaggcgttttttttttatgcggtattggaagtaggtgaagggtaggcggatatttggtaggatgcggtgtagttgatgacgttatattcggcgaaaggtttggagttttcgtaggtgtttatcgttggtatggaagagggtatgtttttaagttagatgtcgttggatgaaggcgggcgtttggaagaagaacgtcgtttggtttacgttggcgtaattcgcgcgatgtagaaattgacgttgatttacgcggaaattcgtcgtttgtatggtaaagaggtttattatcgttcgtcgcgttttatcggcgagttgtcggaagagtgtgtggaagaggtgcgtttgcgcgttacggtaagtcgttcggttagttattagcggatgggtacgtcgantgtcgagaacgatagcggttataagttcggttagcgcgtacgttacgttaagtttggtgaaggtattattgttaatatggaaggtagcggtgagtatagtcgtttgtaggtggtattttagggttaggggtatta

SEQ ID NO: 7038 - DNA, 534 bp, Artificial Sequence
  chemically treated genomic DNA (Homo sapiens) CpG-island No: 7038
  misc_feature (136)..(136): n is either a, c, g or t
taatacccctaaccctaaaataccacctacaaacgactatactcaccgctaccttccatattaacaataataccttcaccaaacttaacgtaacgtacgcgctaaccgaacttataaccgctatcgttctcgacantcgacgtacccatccgctaataactaaccgaacgacttaccgtaacgcgcaaacgcacctcttccacacactcttccgacaactcgccgataaaacgcgacgaacgataataaacctctttaccatacaaacgacgaatttccgcgtaaatcaacgtcaatttctacatcgcgcgaattacgccaacgtaaaccaaacgacgttcttcttccaaacgcccgccttcatccaacgacatctaacttaaaaacataccctcttccataccaacgataaacacctacgaaaactccaaacctttcgccgaatataacgtcatcaactacaccgcatcctaccaaatatccgcctacccttcacctacttccaataccgcataaaaaaaaaacgcctacaac

SEQ ID NO: 7039 - DNA, 534 bp, Artificial Sequence
  chemically treated genomic DNA (Homo sapiens) CpG-island No: 7039
  misc_feature (136)..(136): n is either a, c, g or t
taatatttttggttttgaaatgttatttgtaaacggttatgtttatcgttgttttttatattgataatggtgtttttattaaatttagcgtggcgtacgcgttggtcgagtttgtagtcgttgtcgttttcgatantcggcgtatttattcgttgatggttgatcgggcggtttatcgtggcgcgtaggcgtattttttttatatattttttcggtagttcgtcgataaagcgcgacgggcgatggtaaatttttttattatatagacggcgggttttcgcgtaggttagcgttagtttttgtatcgcgcgggttacgttaacgtaggttagacggcgttttttttttagacgttcgtttttatttagcgatatttggtttgggaatatgtttttttttatattaacgataaatatttgcgggaattttaggtttttcgtcgagtgtagcgttattaattgtatcgtattttgttaggtattcgtttgttttttatttgtttttagtgtcgtatgggagaggaacgtttgtagt

SEQ ID NO: 7040 - DNA, 534 bp, Artificial Sequence
  chemically treated genomic DNA (Homo sapiens) CpG-island No: 7040
  misc_feature (399)..(399): n is either a, c, g or t
actacaaacgttcctctcccatacgacactaaaaacaaataaaaaacaaacgaatacctaacaaaatacgatacaattaataacgctacactcgacgaaaaacctaaaattcccgcaaatatttatcgttaatataaaaaaaaacatattcccaaaccaaatatcgctaaataaaaacgaacgtctaaaaaaaaaacgccgtctaacctacgttaacgtaacccgcgcgatacaaaaactaacgctaacctacgcgaaaacccgccgtctatataataaaaaaatttaccatcgcccgtcgcgctttatcgacgaactaccgaaaaaatatataaaaaaaatacgcctacgcgccacgataaaccgcccgatcaaccatcaacgaataaatacgccgantatcgaaaacgacaacgactacaaactcgaccaacgcgtacgccacgctaaatttaataaaaacaccattatcaatataaaaaacaacgataaacataaccgtttacaaataacatttcaaaaccaaaaatatta

SEQ ID NO: 7041 - DNA, 795 bp, Artificial Sequence
  chemically treated genomic DNA (Homo sapiens) CpG-island No: 7041
cgacgttatcggtgttgttaaaagaaggttagtacgacgtagcgtaaaaattgttcgttatttttttcgttaattaaatgtttgaggagcgttatgttgttagcgtggcgattcgtaataaggttgaagttttgcgtttggtacgattgttgtattagtaagaatcggtaaattttattcgtttggattaattaatttggtaattgatgtagaacgagtagttacgcgaagttgtcgatttattgttgtaacgttattttttttagcgcgatgcgcgtgttagttagtattttaatggcgcgattggcgtttttgttggaaagttatttttatttggttaacgttatgttaaggtggcgattttatcgaaatttttatcgttggcggagtaacgttagtggtaaagttagttgtcgggttattgtacgattattgttcggtaatagttcgtttgttgggttgatatgtcgtttttttacgatgtcgtcgtttgtgaatcgtttggataaagtgttatcggcgatacgttattcggttgtgcgcgttgtatgtatggttttaggtcgaattaacgattatcgagcgtttggtaatatcgtgcggtagtttattaggcgtattaggttgaggattacgttatcgtatttggcggtttggtagaaaattatgtttttacgatatgagtaatgaggattttgtttgttgttgttaatatcgtttagtgcggtaggaaatggtgcggttcgcgatcgttggttacgaataggtagaaaacgtggattgggaagttaatgt

SEQ ID NO: 7042 - DNA, 795 bp, Artificial Sequence
  chemically treated genomic DNA (Homo sapiens) CpG-island No: 7042
acattaacttcccaatccacgttttctacctattcgtaaccaacgatcgcgaaccgcaccatttcctaccgcactaaacgatattaacaacaacaaacaaaatcctcattactcatatcgtaaaaacataattttctaccaaaccgccaaatacgataacgtaatcctcaacctaatacgcctaataaactaccgcacgatattaccaaacgctcgataatcgttaattcgacctaaaaccatacatacaacgcgcacaaccgaataacgtatcgccgataacactttatccaaacgattcacaaacgacgacatcgtaaaaaaacgacatatcaacccaacaaacgaactattaccgaacaataatcgtacaataacccgacaactaactttaccactaacgttactccgccaacgataaaaatttcgataaaatcgccaccttaacataacgttaaccaaataaaaataactttccaacaaaaacgccaatcgcgccattaaaatactaactaacacgcgcatcgcgctaaaaaaaataacgttacaacaataaatcgacaacttcgcgtaactactcgttctacatcaattaccaaattaattaatccaaacgaataaaatttaccgattcttactaatacaacaatcgtaccaaacgcaaaacttcaaccttattacgaatcgccacgctaacaacataacgctcctcaaacatttaattaacgaaaaaaataacgaacaatttttacgctacgtcgtactaaccttcttttaacaacaccgataacgtcg

SEQ ID NO: 7043 - DNA, 795 bp, Artificial Sequence
  chemically treated genomic DNA (Homo sapiens) CpG-island No: 7043
gtattagttttttagtttacgttttttgtttgttcgtagttagcgatcgcgagtcgtattattttttgtcgtattgggcggtattggtagtagtaagtaagatttttattgtttatgtcgtgaagatatgattttttgttaggtcgttagatgcggtggcgtagtttttaatttgatacgtttgataggttatcgtacgatgttgttaggcgttcggtggtcgttgattcggtttgaagttatgtatataacgcgtatagtcgggtagcgtgtcgtcgataatattttgtttagacggtttataggcggcggtatcgtaggaaggcgatatattagtttagtaagcgaattattgtcgggtaatgatcgtgtaatagttcggtaattgattttgttattgacgttgtttcgttagcggtaagggtttcgataaaatcgttattttagtatggcgttgattaggtaaggatgattttttagtagagacgttagtcgcgttattaaagtattggttgatacgcgtatcgcgttggaaaggatagcgttgtagtaataaatcggtagtttcgcgtgattgttcgttttgtattagttgttaggttagttgatttaggcgggtaagatttgtcggtttttgttgatatagtaatcgtgttagacgtagagttttagttttgttacgggtcgttacgttgatagtataacgttttttaagtatttaattggcggggagggtggcgagtagtttttgcgttgcgtcgtattgatttttttttaatagtatcggtagcgtcg

SEQ ID NO: 7044 - DNA, 795 bp, Artificial Sequence
  chemically treated genomic DNA (Homo sapiens) CpG-island No: 7044
cgacgctaccgatactattaaaaaaaaatcaatacgacgcaacgcaaaaactactcgccaccctccccgccaattaaatacttaaaaaacgttatactatcaacgtaacgacccgtaacaaaactaaaactctacgtctaacacgattactatatcaacaaaaaccgacaaatcttacccgcctaaatcaactaacctaacaactaatacaaaacgaacaatcacgcgaaactaccgatttattactacaacgctatcctttccaacgcgatacgcgtatcaaccaatactttaataacgcgactaacgtctctactaaaaaatcatccttacctaatcaacgccatactaaaataacgattttatcgaaacccttaccgctaacgaaacaacgtcaataacaaaatcaattaccgaactattacacgatcattacccgacaataattcgcttactaaactaatatatcgccttcctacgataccgccgcctataaaccgtctaaacaaaatattatcgacgacacgctacccgactatacgcgttatatacataacttcaaaccgaatcaacgaccaccgaacgcctaacaacatcgtacgataacctatcaaacgtatcaaattaaaaactacgccaccgcatctaacgacctaacaaaaaatcatatcttcacgacataaacaataaaaatcttacttactactaccaataccgcccaatacgacaaaaaataatacgactcgcgatcgctaactacgaacaaacaaaaaacgtaaactaaaaaactaatac

SEQ ID NO: 7045 - DNA, 571 bp, Artificial Sequence
  chemically treated genomic DNA (Homo sapiens) CpG-island No: 7045
gttattcggttatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaagttgtttaagtgttggttttgtaattgttcggtaggggtataagcggtggtgagtttataacggtcgaagttgcgtatcgtttttcggtgtaagcggtcgcgggtgtattttattagcggtgtgtcgtcgagttttatgtttgataagtaatcgttgtcgtaggttagttattttacggcgggtaggttgtacggtatatagcggttcgttagtttttgcgcgttggacgtatgtttggttttatgttggtaaaaatatgttttcgtttgtaggtgatgtatcgtttgacgtttatcggtaattcggtttttttattatatttgtgtgtgtatgtgtgtg

SEQ ID NO: 7046 - DNA, 571 bp, Artificial Sequence
  chemically treated genomic DNA (Homo sapiens) CpG-island No: 7046
cacacacatacacacacaaatataataaaaaaaccgaattaccgataaacgtcaaacgatacatcacctacaaacgaaaacatatttttaccaacataaaaccaaacatacgtccaacgcgcaaaaactaacgaaccgctatataccgtacaacctacccgccgtaaaataactaacctacgacaacgattacttatcaaacataaaactcgacgacacaccgctaataaaatacacccgcgaccgcttacaccgaaaaacgatacgcaacttcgaccgttataaactcaccaccgcttatacccctaccgaacaattacaaaaccaacacttaaacaacttactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgcctacccgacccgaaactacacccgaacaacaccctcaacatataaccgaataac

SEQ ID NO: 7047 - DNA, 571 bp, Artificial Sequence
  chemically treated genomic DNA (Homo sapiens) CpG-island No: 7047
tatatatatatatatatagatatgatgagaaagtcgggttatcggtgagcgttagacggtgtattatttgtagacgaaagtatgtttttgttagtatgagattagatatgcgtttaacgcgtaggggttggcgaatcgttgtatatcgtatagtttgttcgtcgtggaatggttgatttacggtagcggttatttgttaggtatgaaattcggcgatatatcgttggtggagtatattcgcgatcgtttgtatcgggaaacgatgcgtagtttcggtcgttatgaatttattatcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgtttgttcgattcggagttgtattcggatagtatttttagtatgtggtcggataat

SEQ ID NO: 7048 - DNA, 571 bp, Artificial Sequence
  chemically treated genomic DNA (Homo sapiens) CpG-island No: 7048
attatccgaccacatactaaaaatactatccgaatacaactccgaatcgaacaaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgataataaattcataacgaccgaaactacgcatcgtttcccgatacaaacgatcgcgaatatactccaccaacgatatatcgccgaatttcatacctaacaaataaccgctaccgtaaatcaaccattccacgacgaacaaactatacgatatacaacgattcgccaacccctacgcgttaaacgcatatctaatctcatactaacaaaaacatactttcgtctacaaataatacaccgtctaacgctcaccgataacccgactttctcatcatatctatatatatatatatata

SEQ ID NO: 7049 - DNA, 1014 bp, Artificial Sequence
  chemically treated genomic DNA (Homo sapiens) CpG-island No: 7049
tcgtttgaataacgcgttaagcgcgatgagttcggtgagtaaagcggtgtagtaaatcgtaggtcggataagacgtttcggcgtcgtattcgataatgtgtaggcgttgatgtcggatgcggtgtaagtattttattcggtttatagatcggagttaaatatgtaaatcggtacgaattttagttcggtattttatttggaagataattatttgattttcggttagcggcgtttcggggatgcggtgacgcgtttggataatcgtcgtatcgttcgtacgtttcgtggtgtttatttcggttacgcgtttgaagaagttgcgaatcgatacggcgttggtggtgttattcgcgttttggttaattatttttagtacgtcgttttcgttaattacgttggcggtaagttgaatgtcgtcggttttttagtcgtacggtatcggtatttcgcgttcgttaaacggtatttgataatcggggatcgttatcgtttttaagatggcgcggcggattatgcgtttggtttgttcgtcgaggtaggtaaagttgtagtcgtttagattagttatggttttgtttttgttgtagacgtttgagtagttttagttcggtttggaaatcgacgtagtgggggagtttgaggtgtgagataaagtttgcggtttcgacgttgtcggtatgtgttagtacgaattttttattttgcgtcgggtttgtcgcgtgttcgtcgtatttcggggtttgtagagcgcgggtcgattatcgttatatttatgggttttggttcgtttatgtcgaatattagttcgttgtggcgtaggacgtttttttttatgttattgcgtagggtaattacgtaacgtcgttcggtgttaatatcgaagggttgaagcgtcgcggatttagtcgtgaggcgattatcgttattcgtaatgcgtataagttgatatttttgttgagtattagttatatattcgttattattttttattttttaattatggggatatagtat

SEQ ID NO: 7050 - DNA, 1014 bp, Artificial Sequence
  chemically treated genomic DNA (Homo sapiens) CpG-island No: 7050
atactatatccccataattaaaaaataaaaaataataacgaatatataactaatactcaacaaaaatatcaacttatacgcattacgaataacgataatcgcctcacgactaaatccgcgacgcttcaacccttcgatattaacaccgaacgacgttacgtaattaccctacgcaataacataaaaaaaaacgtcctacgccacaacgaactaatattcgacataaacgaaccaaaacccataaatataacgataatcgacccgcgctctacaaaccccgaaatacgacgaacacgcgacaaacccgacgcaaaataaaaaattcgtactaacacataccgacaacgtcgaaaccgcaaactttatctcacacctcaaactcccccactacgtcgatttccaaaccgaactaaaactactcaaacgtctacaacaaaaacaaaaccataactaatctaaacgactacaactttacctacctcgacgaacaaaccaaacgcataatccgccgcgccatcttaaaaacgataacgatccccgattatcaaataccgtttaacgaacgcgaaataccgataccgtacgactaaaaaaccgacgacattcaacttaccgccaacgtaattaacgaaaacgacgtactaaaaataattaaccaaaacgcgaataacaccaccaacgccgtatcgattcgcaacttcttcaaacgcgtaaccgaaataaacaccacgaaacgtacgaacgatacgacgattatccaaacgcgtcaccgcatccccgaaacgccgctaaccgaaaatcaaataattatcttccaaataaaataccgaactaaaattcgtaccgatttacatatttaactccgatctataaaccgaataaaatacttacaccgcatccgacatcaacgcctacacattatcgaatacgacgccgaaacgtcttatccgacctacgatttactacaccgctttactcaccgaactcatcgcgcttaacgcgttattcaaacga

SEQ ID NO: 7051 - DNA, 1014 bp, Artificial Sequence
  chemically treated genomic DNA (Homo sapiens) CpG-island No: 7051
gtattgtgtttttatggttggggggtggggggtggtggcgagtatatgattgatatttagtagaagtattagtttatacgtattgcggatagcggtaatcgttttacggttgaattcgcggcgttttagtttttcgatattgatatcgaacggcgttgcgtggttattttgcgtaatgatataaggagggacgttttgcgttataacgggttggtgttcggtatgagcgagttaaaatttatgaatatggcgatggtcgattcgcgttttgtaagtttcgaagtacggcgagtacgcgataggttcggcgtaggatgaagagttcgtgttggtatatgtcgataacgtcgaagtcgtaggttttgttttatattttaaatttttttattacgtcgatttttaggtcgaattggagttatttaaacgtttgtaataggagtagaattatggttaatttgagcggttataattttgtttatttcgacgagtagattaaacgtatgattcgtcgcgttattttaaaagcggtggcgattttcggttattaggtgtcgtttggcgggcgcgagatgtcgatgtcgtacggttggggaatcggcggtatttagtttatcgttagcgtgattggcgaaagcgacgtgttgaaggtgattgattagggcgcggatgatattattaacgtcgtgtcgattcgtaatttttttaagcgcgtgatcggggtaaatattacggaacgtacggacgatgcgacggttatttagacgcgttatcgtattttcgaaacgtcgttgatcgaagattagataattattttttaggtggggtatcgagttagagttcgtatcggtttgtatgtttggtttcggtttgtaggtcgaataaggtgtttgtatcgtattcggtattaacgtttgtatattgtcggatgcgacgtcggggcgttttattcgatttacgatttattgtatcgttttatttatcgaatttatcgcgtttagcgcgttgtttaggcgg

SEQ ID NO: 7052 - DNA, 1014 bp, Artificial Sequence
  chemically treated genomic DNA (Homo sapiens) CpG-island No: 7052
ccgcctaaacaacgcgctaaacgcgataaattcgataaataaaacgatacaataaatcgtaaatcgaataaaacgccccgacgtcgcatccgacaatatacaaacgttaataccgaatacgatacaaacaccttattcgacctacaaaccgaaaccaaacatacaaaccgatacgaactctaactcgataccccacctaaaaaataattatctaatcttcgatcaacgacgtttcgaaaatacgataacgcgtctaaataaccgtcgcatcgtccgtacgttccgtaatatttaccccgatcacgcgcttaaaaaaattacgaatcgacacgacgttaataatatcatccgcgccctaatcaatcaccttcaacacgtcgctttcgccaatcacgctaacgataaactaaataccgccgattccccaaccgtacgacatcgacatctcgcgcccgccaaacgacacctaataaccgaaaatcgccaccgcttttaaaataacgcgacgaatcatacgtttaatctactcgtcgaaataaacaaaattataaccgctcaaattaaccataattctactcctattacaaacgtttaaataactccaattcgacctaaaaatcgacgtaataaaaaaatttaaaatataaaacaaaacctacgacttcgacgttatcgacatataccaacacgaactcttcatcctacgccgaacctatcgcgtactcgccgtacttcgaaacttacaaaacgcgaatcgaccatcgccatattcataaattttaactcgctcataccgaacaccaacccgttataacgcaaaacgtccctccttatatcattacgcaaaataaccacgcaacgccgttcgatatcaatatcgaaaaactaaaacgccgcgaattcaaccgtaaaacgattaccgctatccgcaatacgtataaactaatacttctactaaatatcaatcatatactcgccaccaccccccaccccccaaccataaaaacacaatac

SEQ ID NO: 7053 - DNA, 592 bp, Artificial Sequence
  chemically treated genomic DNA (Homo sapiens) CpG-island No: 7053
ttttttttttgtttttttgtttgttttttttttttcggattttcgtttttttttcggagtggcgcgtcgggggtttcgtcgttggttaggcgtgatgttgtacgtggagatgttgacgttggtgtttttggtgttttggatgtgtgtgtttagttaggattcgggttttaaggtcgtcgtcgatcgttacgttgtttattggaatagtagtaattttaggtaagtcgataataggcggagagttagggttattcgggtttcggggttttgcggaaggagcggcggcggggatcggcgcgtattaatcgttggcggcgcgtattttcggagtttgcgtcgttcgggcgttgatggtttgaggcgtcggcgggaagcgttcgcgtcgcgtttttttttgttaagtcgtcgcggaaaggttaggtatttttgggagttttcggggttgtttagattaattgtttttgcggggcgtcgggagattcggaaaagggcgggagtcggggagtagggatttttttgttttttagtttcggtatttggttggtattcggttttcggcgcggggagtttttagtgtgcgtagtcgggagtt

SEQ ID NO: 7054 - DNA, 592 bp, Artificial Sequence
  chemically treated genomic DNA (Homo sapiens) CpG-island No: 7054
aactcccgactacgcacactaaaaactccccgcgccgaaaaccgaataccaaccaaataccgaaactaaaaaacaaaaaaatccctactccccgactcccgcccttttccgaatctcccgacgccccgcaaaaacaattaatctaaacaaccccgaaaactcccaaaaatacctaacctttccgcgacgacttaacaaaaaaaaacgcgacgcgaacgcttcccgccgacgcctcaaaccatcaacgcccgaacgacgcaaactccgaaaatacgcgccgccaacgattaatacgcgccgatccccgccgccgctccttccgcaaaaccccgaaacccgaataaccctaactctccgcctattatcgacttacctaaaattactactattccaataaacaacgtaacgatcgacgacgaccttaaaacccgaatcctaactaaacacacacatccaaaacaccaaaaacaccaacgtcaacatctccacgtacaacatcacgcctaaccaacgacgaaacccccgacgcgccactccgaaaaaaaaacgaaaatccgaaaaaaaaaaaacaaacaaaaaaacaaaaaaaaaa

SEQ ID NO: 7055 - DNA, 592 bp, Artificial Sequence
  chemically treated genomic DNA (Homo sapiens) CpG-island No: 7055
agttttcggttgcgtatattgggggtttttcgcgtcgggaatcggatgttagttagatgtcggggttgggaagtagagaagtttttatttttcggttttcgttttttttcgagtttttcggcgtttcgtagaagtagttggtttaggtagtttcggggatttttaggggtatttggttttttcgcggcggtttaataaagaggggcgcgacgcgagcgtttttcgtcgacgttttaagttattagcgttcgggcgacgtaggtttcgagggtgcgcgtcgttagcggttggtgcgcgtcgattttcgtcgtcgtttttttcgtagggtttcgaggttcgggtagttttggtttttcgtttgttatcggtttatttggggttgttgttgttttagtagatagcgtagcggtcggcgacggttttggagttcgggttttggttgaatatatatatttagagtattagaaatattagcgttaatatttttacgtgtaatattacgtttggttagcggcggagttttcgacgcgttatttcggggagagagcggggattcggagggagggaggtaggtaaagggatagagagagag

SEQ ID NO: 7056 - DNA, 592 bp, Artificial Sequence
  chemically treated genomic DNA (Homo sapiens) CpG-island No: 7056
ctctctctctatccctttacctacctccctccctccgaatccccgctctctccccgaaataacgcgtcgaaaactccgccgctaaccaaacgtaatattacacgtaaaaatattaacgctaatatttctaatactctaaatatatatattcaaccaaaacccgaactccaaaaccgtcgccgaccgctacgctatctactaaaacaacaacaaccccaaataaaccgataacaaacgaaaaaccaaaactacccgaacctcgaaaccctacgaaaaaaacgacgacgaaaatcgacgcgcaccaaccgctaacgacgcgcaccctcgaaacctacgtcgcccgaacgctaataacttaaaacgtcgacgaaaaacgctcgcgtcgcgcccctctttattaaaccgccgcgaaaaaaccaaatacccctaaaaatccccgaaactacctaaaccaactacttctacgaaacgccgaaaaactcgaaaaaaaacgaaaaccgaaaaataaaaacttctctacttcccaaccccgacatctaactaacatccgattcccgacgcgaaaaacccccaatatacgcaaccgaaaact

SEQ ID NO: 7057 - DNA, 501 bp, Artificial Sequence
  chemically treated genomic DNA (Homo sapiens) CpG-island No: 7057
aattgatcgataaagtgggttagttaggtaaaaagttgtatatcgggcgtagtcgtaatgattaggtagcgattgatttgaaattgtggtgtaaagatatcgttagcgagttattgacggttaatcggtagttgtaatcggcgttggtggaaatcgtataaaataattaggacgcggtaatgttaggttatatttatttgtaacgcgtttagtcggtgacgttcgcgtattggtgtttggtttatgttgagatgttggcgcgtgatgaaagtcgtttgtaggatgcgtttaagcgtttggatgttagttcgttaggttgtggcgcgttggcgggaacggtttatgaaatcgatcgtgaatagttagtaggttggttgggttttgtttcggcgattcgtaatagtttcgatagcgtttttgatcgtgattatgtgttggaattgttttttgttgtcgttatcggtatggtgtatttgtcgcgttttgttgaagatttgattt

SEQ ID NO: 7058 - DNA, 501 bp, Artificial Sequence
  chemically treated genomic DNA (Homo sapiens) CpG-island No: 7058
aaatcaaatcttcaacaaaacgcgacaaatacaccataccgataacgacaacaaaaaacaattccaacacataatcacgatcaaaaacgctatcgaaactattacgaatcgccgaaacaaaacccaaccaacctactaactattcacgatcgatttcataaaccgttcccgccaacgcgccacaacctaacgaactaacatccaaacgcttaaacgcatcctacaaacgactttcatcacgcgccaacatctcaacataaaccaaacaccaatacgcgaacgtcaccgactaaacgcgttacaaataaatataacctaacattaccgcgtcctaattattttatacgatttccaccaacgccgattacaactaccgattaaccgtcaataactcgctaacgatatctttacaccacaatttcaaatcaatcgctacctaatcattacgactacgcccgatatacaactttttacctaactaacccactttatcgatcaatt

SEQ ID NO: 7059 - DNA, 501 bp, Artificial Sequence
  chemically treated genomic DNA (Homo sapiens) CpG-island No: 7059
aaattagatttttagtaaaacgcgatagatgtattatgtcgatagcggtagtagaaagtagttttaatatatggttacggttagaaacgttgtcgagattgttacgggtcgtcgaagtaaagtttagttagtttgttaattgtttacggtcgattttataggtcgttttcgttagcgcgttatagtttagcgggttgatatttagacgtttaagcgtattttgtaaacggtttttattacgcgttagtattttaatataggttaggtattagtgcgcgaacgttatcggttgggcgcgttgtaggtgagtgtaatttggtattatcgcgttttgattgttttgtgcggtttttattagcgtcgattgtagttgtcggttagtcgttagtaattcgttaacggtatttttgtattatagttttaggttagtcgttatttgattattacggttacgttcggtatgtagttttttgtttaattggtttattttgtcgattagtt

SEQ ID NO: 7060 - DNA, 501 bp, Artificial Sequence
  chemically treated genomic DNA (Homo sapiens) CpG-island No: 7060
aactaatcgacaaaataaaccaattaaacaaaaaactacataccgaacgtaaccgtaataatcaaataacgactaacctaaaactataatacaaaaataccgttaacgaattactaacgactaaccgacaactacaatcgacgctaataaaaaccgcacaaaacaatcaaaacgcgataataccaaattacactcacctacaacgcgcccaaccgataacgttcgcgcactaatacctaacctatattaaaatactaacgcgtaataaaaaccgtttacaaaatacgcttaaacgtctaaatatcaacccgctaaactataacgcgctaacgaaaacgacctataaaatcgaccgtaaacaattaacaaactaactaaactttacttcgacgacccgtaacaatctcgacaacgtttctaaccgtaaccatatattaaaactactttctactaccgctatcgacataatacatctatcgcgttttactaaaaatctaattt

SEQ ID NO: 7061 - DNA, 604 bp, Artificial Sequence
  chemically treated genomic DNA (Homo sapiens) CpG-island No: 7061
  misc_feature (488)..(488): n is either a, c, g or t
attcggagatacggaaattagagtttttcgcgttagcgaggataaatcggatttatttcgaaagagattgttagttagtttgagtttttcgcgttagcggggataaatcgttgttggagttggttgtaaggtaagtcgtttagagtttttcgcgttagcggggataaatcggggggcgtatgatcgtaaatattatttttcgggagtttttcgcgttagcggggataaatcgggagtttatatataggtggaatgatggattacgagtttttcgcgttagcggggataaatcgttcggtagttatgtttgtaacgtttgaatcgagagtttttcgcgttagtagggataaatcggtaacgacggtgagattttacgtttgacgttggtgtttttcgtattagcggggataaatcgggcgtattggatgcgatgatggatattatttggagttttttcgtttttgcggtagaatttttagttgttattnttaaatttattaagacgttttcgttaatttttttattagaggtagtattattcgtataacgttaggcgaattgagttttgtatgtttgtagttttcgatagacgattttttcgttt

SEQ ID NO: 7062 - DNA, 604 bp, Artificial Sequence
  chemically treated genomic DNA (Homo sapiens) CpG-island No: 7062
  misc_feature (117)..(117): n is either a, c, g or t
aaacgaaaaaatcgtctatcgaaaactacaaacatacaaaactcaattcgcctaacgttatacgaataatactacctctaataaaaaaattaacgaaaacgtcttaataaatttaanaataacaactaaaaattctaccgcaaaaacgaaaaaactccaaataatatccatcatcgcatccaatacgcccgatttatccccgctaatacgaaaaacaccaacgtcaaacgtaaaatctcaccgtcgttaccgatttatccctactaacgcgaaaaactctcgattcaaacgttacaaacataactaccgaacgatttatccccgctaacgcgaaaaactcgtaatccatcattccacctatatataaactcccgatttatccccgctaacgcgaaaaactcccgaaaaataatatttacgatcatacgccccccgatttatccccgctaacgcgaaaaactctaaacgacttaccttacaaccaactccaacaacgatttatccccgctaacgcgaaaaactcaaactaactaacaatctctttcgaaataaatccgatttatcctcgctaacgcgaaaaactctaatttccgtatctccgaat

SEQ ID NO: 7063 - DNA, 604 bp, Artificial Sequence
  chemically treated genomic DNA (Homo sapiens) CpG-island No: 7063
  misc_feature (117)..(117): n is either a, c, g or t
aaacgaagggatcgtttatcgaggattgtaggtatgtaagatttaattcgtttgacgttatgcggataatgttatttttggtgaaggagttggcgaaggcgttttgatgggtttganaatggtagttgggagttttatcgtagaggcgggggaattttaagtgatatttattatcgtatttagtgcgttcggtttattttcgttgatgcggggaatattagcgttaggcgtgaaattttatcgtcgttgtcggtttatttttgttggcgcggggaattttcggtttaggcgttgtaaatatggttatcgggcggtttattttcgttaacgcggggaattcgtagtttattattttatttatgtgtgaattttcggtttattttcgttggcgcggggaattttcgggggataatgtttacggttatgcgtttttcggtttattttcgttggcgcggggaattttgggcggtttgttttgtagttagttttagtagcggtttattttcgttggcgcggggaatttaagttggttggtaatttttttcggggtgagttcggtttattttcgttggcgcggggaattttagttttcgtattttcggat

SEQ ID NO: 7064 - DNA, 604 bp, Artificial Sequence
  chemically treated genomic DNA (Homo sapiens) CpG-island No: 7064
  misc_feature (488)..(488): n is either a, c, g or t
atccgaaaatacgaaaactaaaattccccgcgccaacgaaaataaaccgaactcaccccgaaaaaaattaccaaccaacttaaattccccgcgccaacgaaaataaaccgctactaaaactaactacaaaacaaaccgcccaaaattccccgcgccaacgaaaataaaccgaaaaacgcataaccgtaaacattatcccccgaaaattccccgcgccaacgaaaataaaccgaaaattcacacataaataaaataataaactacgaattccccgcgttaacgaaaataaaccgcccgataaccatatttacaacgcctaaaccgaaaattccccgcgccaacaaaaataaaccgacaacgacgataaaatttcacgcctaacgctaatattccccgcatcaacgaaaataaaccgaacgcactaaatacgataataaatatcacttaaaattcccccgcctctacgataaaactcccaactaccattntcaaacccatcaaaacgccttcgccaactccttcaccaaaaataacattatccgcataacgtcaaacgaattaaatcttacatacctacaatcctcgataaacgatcccttcgttt

SEQ ID NO: 7065 - DNA, 569 bp, Artificial Sequence
  chemically treated genomic DNA (Homo sapiens) CpG-island No: 7065
  misc_feature (69)..(69): n is either a, c, g or t
gtcgcgttgtcgtgtcgtgcgggcggcgtcgcggtttgttgcgtacggttcggcgcgtacggtcgtgtngtgcgcggtcgttttgtcgggcgtcgtcgttcgtcgcgcgttcggttgtcgtcgtcgcgcgttcgtagtgcgtcgttgcgggattgtattgattaattgtatcgtatagcgtcgatttttgattttgttagtggttcgggaagcgtaatgcgttatgtggtatatcgaagaagtattacggaagcgcgttgggtttaaggtacgagttcgcgttcgcgatataattatatagtcgtggcgttggtatgttgaagattgtttaatagatgaagtagatcggtagagtagaagggggggtaagaacggacggacggagaggaaggacgtaggtggggaattgatagtgaattagggcgcgattaaaagttttttaaataagtcggtaattgaatagggaatgcgcgtgtgtacggtaaaaaatcgggacggagggaatggtaatagtagggcgtaagatttgaaatagtataggcggtgttttgattataggagaaatgtta

SEQ ID NO: 7066 - DNA, 569 bp, Artificial Sequence
  chemically treated genomic DNA (Homo sapiens) CpG-island No: 7066
  misc_feature (501)..(501): n is either a, c, g or t
taacatttctcctataatcaaaacaccgcctatactatttcaaatcttacgccctactattaccattccctccgtcccgattttttaccgtacacacgcgcattccctattcaattaccgacttatttaaaaaacttttaatcgcgccctaattcactatcaattccccacctacgtccttcctctccgtccgtccgttcttacccccccttctactctaccgatctacttcatctattaaacaatcttcaacataccaacgccacgactatataattatatcgcgaacgcgaactcgtaccttaaacccaacgcgcttccgtaatacttcttcgatataccacataacgcattacgcttcccgaaccactaacaaaatcaaaaatcgacgctatacgatacaattaatcaatacaatcccgcaacgacgcactacgaacgcgcgacgacgacaaccgaacgcgcgacgaacgacgacgcccgacaaaacgaccgcgcacnacacgaccgtacgcgccgaaccgtacgcaacaaaccgcgacgccgcccgcacgacacgacaacgcgac

SEQ ID NO: 7067 - DNA, 569 bp, Artificial Sequence
  chemically treated genomic DNA (Homo sapiens) CpG-island No: 7067
  misc_feature (501)..(501): n is either a, c, g or t
tggtattttttttgtaattaaagtatcgtttgtattattttaagttttgcgttttattgttattatttttttcgtttcggttttttgtcgtgtatacgcgtattttttatttagttatcggtttatttagggagtttttggtcgcgttttaatttattattaattttttatttgcgtttttttttttcgttcgttcgtttttatttttttttttgttttgtcgatttattttatttgttaagtagtttttagtatgttaacgttacggttgtatagttatatcgcgggcgcgggttcgtgttttaggtttaacgcgttttcgtggtgttttttcggtgtattatatggcgtattgcgtttttcgggttattggtaaaattaaaaatcggcgttatacgatgtagttagttagtgtagtttcgtagcgacgtattgcgagcgcgcgacgacgatagtcgagcgcgcggcgagcggcggcgttcgataggacggtcgcgtatngtacgatcgtgcgcgtcggatcgtacgtagtaggtcgcgacgtcgttcgtacggtacggtagcgcggt

SEQ ID NO: 7068 - DNA, 569 bp, Artificial Sequence
  chemically treated genomic DNA (Homo sapiens) CpG-island No: 7068
  misc_feature (69)..(69): n is either a, c, g or t
accgcgctaccgtaccgtacgaacgacgtcgcgacctactacgtacgatccgacgcgcacgatcgtacnatacgcgaccgtcctatcgaacgccgccgctcgccgcgcgctcgactatcgtcgtcgcgcgctcgcaatacgtcgctacgaaactacactaactaactacatcgtataacgccgatttttaattttaccaataacccgaaaaacgcaatacgccatataatacaccgaaaaaacaccacgaaaacgcgttaaacctaaaacacgaacccgcgcccgcgatataactatacaaccgtaacgttaacatactaaaaactacttaacaaataaaataaatcgacaaaacaaaaaaaaaaataaaaacgaacgaacgaaaaaaaaaaacgcaaataaaaaattaataataaattaaaacgcgaccaaaaactccctaaataaaccgataactaaataaaaaatacgcgtatacacgacaaaaaaccgaaacgaaaaaaataataacaataaaacgcaaaacttaaaataatacaaacgatactttaattacaaaaaaaatacca

SEQ ID NO: 7069 - DNA, 728 bp, Artificial Sequence
  chemically treated genomic DNA (Homo sapiens) CpG-island No: 7069
aattttatttcgcggacgttttaggtagcggatggcggcgggggggggaggttaggggatatttaggggataaattttttagatttcgaggtagtcggcgacggcgtttaatttttaaataaatagaataaatttttatttggaaaaggtttttttcggggtttttttgcgttcgcggtttagtttttttgtagacggttatcgtgggtttttcgtagggttgcggagtttcggagttatcgaggtgggaggtgtcggttacgcgcgtttttaggaatagagtattgttttgtagtttagtacgaagggtcggttggagcgggagcgcgaggtttattgtaagaggattaggagttagtaagttcggttttttttcgtttttatttttcgtgcgttcggggttaagatcgtttgttcggaatttgattagtgttcgttttcgttgtggttttgggatttcgcggtggtttttttttggggacgaacggtagtgttcgaaggatgttttatttattttcgtttttagatttgttgggtttcgataatatttagtgggtgtcgcgagttttcgggcgtagagtttagcgttcggttttcgagtttaatttcgcgtttcgacggttttggcgtttttcgttgcgttaaattgtttatcgcgtataggttggaagcgaagtcgggttttttttttttggtttgtagggtttttttaggttttttttgttcgg

SEQ ID NO: 7070 - DNA, 728 bp, Artificial Sequence
  chemically treated genomic DNA (Homo sapiens) CpG-island No: 7070
ccgaacaaaaaaaacctaaaaaaaccctacaaaccaaaaaaaaaaaacccgacttcgcttccaacctatacgcgataaacaatttaacgcaacgaaaaacgccaaaaccgtcgaaacgcgaaattaaactcgaaaaccgaacgctaaactctacgcccgaaaactcgcgacacccactaaatattatcgaaacccaacaaatctaaaaacgaaaataaataaaacatccttcgaacactaccgttcgtccccaaaaaaaaaccaccgcgaaatcccaaaaccacaacgaaaacgaacactaatcaaattccgaacaaacgatcttaaccccgaacgcacgaaaaataaaaacgaaaaaaaaccgaacttactaactcctaatcctcttacaataaacctcgcgctcccgctccaaccgacccttcgtactaaactacaaaacaatactctattcctaaaaacgcgcgtaaccgacacctcccacctcgataactccgaaactccgcaaccctacgaaaaacccacgataaccgtctacaaaaaaactaaaccgcgaacgcaaaaaaaccccgaaaaaaaccttttccaaataaaaatttattctatttatttaaaaattaaacgccgtcgccgactacctcgaaatctaaaaaatttatcccctaaatatcccctaacctcccccccccgccgccatccgctacctaaaacgtccgcgaaataaaatt

SEQ ID NO: 7071 - DNA, 728 bp, Artificial Sequence
  chemically treated genomic DNA (Homo sapiens) CpG-island No: 7071
tcggataggaaaggtttggagggattttgtagattaggaggagggggttcgatttcgtttttagtttgtgcgcggtggatagtttagcgtagcgggaagcgttaaggtcgtcggggcgcgggattgagttcgagagtcggacgttggattttgcgttcgggaattcgcggtatttattgggtattgtcgggatttagtaagtttaggaacgggggtgggtagagtatttttcgggtattgtcgttcgtttttaaaagaagattatcgcggggttttagggttatagcgaggacgggtattggttagatttcggataggcggttttggtttcgggcgtacgaaaggtggagacgaagaaaagtcggatttattggtttttgatttttttgtagtgggtttcgcgttttcgttttagtcggtttttcgtgttaaattgtagggtagtgttttgtttttgaggacgcgcgtggtcggtattttttatttcggtgatttcgagatttcgtagttttgcggagagtttacgatggtcgtttgtagaggagttggatcgcgggcgtaggaagatttcggggaaggttttttttaagtaggagtttgttttatttatttgggaattggacgtcgtcgtcggttgtttcgaagtttgaggaatttgttttttaaatgttttttggtttttttttttcgtcgttattcgttgtttgggacgttcgcggggtggagtt

SEQ ID NO: 7072 - DNA, 728 bp, Artificial Sequence
  chemically treated genomic DNA (Homo sapiens) CpG-island No: 7072
aactccaccccgcgaacgtcccaaacaacgaataacgacgaaaaaaaaaaaccaaaaaacatttaaaaaacaaattcctcaaacttcgaaacaaccgacgacgacgtccaattcccaaataaataaaacaaactcctacttaaaaaaaaccttccccgaaatcttcctacgcccgcgatccaactcctctacaaacgaccatcgtaaactctccgcaaaactacgaaatctcgaaatcaccgaaataaaaaataccgaccacgcgcgtcctcaaaaacaaaacactaccctacaatttaacacgaaaaaccgactaaaacgaaaacgcgaaacccactacaaaaaaatcaaaaaccaataaatccgacttttcttcgtctccacctttcgtacgcccgaaaccaaaaccgcctatccgaaatctaaccaatacccgtcctcgctataaccctaaaaccccgcgataatcttcttttaaaaacgaacgacaatacccgaaaaatactctacccacccccgttcctaaacttactaaatcccgacaatacccaataaataccgcgaattcccgaacgcaaaatccaacgtccgactctcgaactcaatcccgcgccccgacgaccttaacgcttcccgctacgctaaactatccaccgcgcacaaactaaaaacgaaatcgaaccccctcctcctaatctacaaaatccctccaaacctttcctatccga

SEQ ID NO: 7073 - DNA, 1059 bp, Artificial Sequence
  chemically treated genomic DNA (Homo sapiens) CpG-island No: 7073
ggttcgcgcggttacggtttttcgtgatagtgtttgtaaagcgcggagggcgtttcggagaaggcggcgtatttgttagggtagggttttagggcggcgtttgcggagaaggggtatatagtggtttggtcgaagggcgttaagggcgcggcgtttacgggcgcggttaggttttggttttggttgaggaaggttattaggcgtcgtatttcgtttagggtttgcgtttgtatgaggatatagtttttggcgagtagtagcgtggcgattttggagagtttgcgtatcgacgggttgtgcgcgtaggggatgacggttcgtagttcgtttagcgcgtcgtttaggtcgtgtatgcgtcgtcgttcgcgcgcgttgatgttgagtcgtagagatcgttgttttcgcggtcgtcgtcgttcgttcgtcgcgttttttggttcgcgtcgtcgtcgtcgttgttcgaaggcgtcgttttcgttttcgttttgttcgtcgttgtttttcgtcgtttgagttggggcgcgaggtgtaggcgtcgcggggaggtcgtcgttcgggttcggagtgtcgtagtcgcgggtcgtttcgggttttcgcgtcgtttcgtaggcgagattcgtagtcgtcgtcgcgtagtcgtggtttagtgttaggtacgcgtttttcgatagcgatttgagttcggttatggtcgcgtcgtttgggttcgggggttcgtcgggtgggcggatgtttatgtgggtgagtagttttcgaggtcggttcgagttcgtcgttgtcgttgtcgttgcgatgaggttttcggttttgcgcgtcggtttggtttgtttgcgggttttagagtttcggcgttcgttgtttttttcgtttttttttttttttttatttttttttttttttagtcgcgacgcgtagggggcgggttttatttttttttcgttttcgtttcggttttaagtcgcggaggcgttcggtgggatttcgttgttgtttaattaggggggatcgggtgagtttttttttttggagtcgggttttattagcgtcgtaggtttatag

SEQ ID NO: 7074 - DNA, 1059 bp, Artificial Sequence
  chemically treated genomic DNA (Homo sapiens) CpG-island No: 7074
ctataaacctacgacgctaataaaacccgactccaaaaaaaaaaactcacccgatcccccctaattaaacaacaacgaaatcccaccgaacgcctccgcgacttaaaaccgaaacgaaaacgaaaaaaaaataaaacccgccccctacgcgtcgcgactaaaaaaaaaaaaaaataaaaaaaaaaaaaaaaacgaaaaaaacaacgaacgccgaaactctaaaacccgcaaacaaaccaaaccgacgcgcaaaaccgaaaacctcatcgcaacgacaacgacaacgacgaactcgaaccgacctcgaaaactactcacccacataaacatccgcccacccgacgaacccccgaacccaaacgacgcgaccataaccgaactcaaatcgctatcgaaaaacgcgtacctaacactaaaccacgactacgcgacgacgactacgaatctcgcctacgaaacgacgcgaaaacccgaaacgacccgcgactacgacactccgaacccgaacgacgacctccccgcgacgcctacacctcgcgccccaactcaaacgacgaaaaacaacgacgaacaaaacgaaaacgaaaacgacgccttcgaacaacgacgacgacgacgcgaaccaaaaaacgcgacgaacgaacgacgacgaccgcgaaaacaacgatctctacgactcaacatcaacgcgcgcgaacgacgacgcatacacgacctaaacgacgcgctaaacgaactacgaaccgtcatcccctacgcgcacaacccgtcgatacgcaaactctccaaaatcgccacgctactactcgccaaaaactatatcctcatacaaacgcaaaccctaaacgaaatacgacgcctaataaccttcctcaaccaaaaccaaaacctaaccgcgcccgtaaacgccgcgcccttaacgcccttcgaccaaaccactatataccccttctccgcaaacgccgccctaaaaccctaccctaacaaatacgccgccttctccgaaacgccctccgcgctttacaaacactatcacgaaaaaccgtaaccgcgcgaacc

SEQ ID NO: 7075 - DNA, 1059 bp, Artificial Sequence
  chemically treated genomic DNA (Homo sapiens) CpG-island No: 7075
ttgtgagtttgcggcgttggtggagttcggttttaggaagaggagtttattcggttttttttgattggatagtagcgaggttttatcgggcgttttcgcggtttaaaatcgaagcgggggcgagggggaggtagagttcgttttttgcgcgtcgcggttgggagggagaggaggtgggagagaaggaagaggcggaggaggtagcgggcgtcgaggttttgggattcgtaggtaagttagatcgacgcgtagagtcgggagttttatcgtagcggtagcggtagcggcgggttcgggtcggtttcgggggttgtttatttatatgagtattcgtttattcggcgagttttcgagtttaggcggcgcggttatggtcgagtttaagtcgttgtcgggggacgcgtatttggtattaagttacggttacgcggcggcggttgcgggtttcgtttacggggcggcgcgagaattcgaagcggttcgcggttacggtatttcgggttcgggcggcgattttttcgcggcgtttgtatttcgcgttttagtttaggcggcggagagtagcggcgaatagagcggggacgaggacgacgttttcgagtagcggcggcggcggcgcgggttagggagcgcggcggacgggcggcggcggtcgcgagagtagcggtttttgcggtttagtattaacgcgcgcgagcggcggcgtatgtacgatttaaacgacgcgttggacgggttgcgagtcgttattttttacgcgtatagttcgtcggtgcgtaagttttttaagatcgttacgttgttgttcgttaagaattatatttttatgtaggcgtaggttttggacgagatgcggcgtttggtggttttttttaattagggttagggtttggtcgcgttcgtaaacgtcgcgtttttgacgtttttcggttaggttattgtgtgtttttttttcgtaggcgtcgttttggggttttgttttgataagtgcgtcgtttttttcgggacgtttttcgcgttttgtaaatattgttacgagaagtcgtgatcgcgcgggtt

SEQ ID NO: 7076 - DNA, 1059 bp, Artificial Sequence
  chemically treated genomic DNA (Homo sapiens) CpG-island No: 7076
aacccgcgcgatcacgacttctcgtaacaatatttacaaaacgcgaaaaacgtcccgaaaaaaacgacgcacttatcaaaacaaaaccccaaaacgacgcctacgaaaaaaaaacacacaataacctaaccgaaaaacgtcaaaaacgcgacgtttacgaacgcgaccaaaccctaaccctaattaaaaaaaaccaccaaacgccgcatctcgtccaaaacctacgcctacataaaaatataattcttaacgaacaacaacgtaacgatcttaaaaaacttacgcaccgacgaactatacgcgtaaaaaataacgactcgcaacccgtccaacgcgtcgtttaaatcgtacatacgccgccgctcgcgcgcgttaatactaaaccgcaaaaaccgctactctcgcgaccgccgccgcccgtccgccgcgctccctaacccgcgccgccgccgccgctactcgaaaacgtcgtcctcgtccccgctctattcgccgctactctccgccgcctaaactaaaacgcgaaatacaaacgccgcgaaaaaatcgccgcccgaacccgaaataccgtaaccgcgaaccgcttcgaattctcgcgccgccccgtaaacgaaacccgcaaccgccgccgcgtaaccgtaacttaataccaaatacgcgtcccccgacaacgacttaaactcgaccataaccgcgccgcctaaactcgaaaactcgccgaataaacgaatactcatataaataaacaacccccgaaaccgacccgaacccgccgctaccgctaccgctacgataaaactcccgactctacgcgtcgatctaacttacctacgaatcccaaaacctcgacgcccgctacctcctccgcctcttccttctctcccacctcctctccctcccaaccgcgacgcgcaaaaaacgaactctacctccccctcgcccccgcttcgattttaaaccgcgaaaacgcccgataaaacctcgctactatccaatcaaaaaaaaccgaataaactcctcttcctaaaaccgaactccaccaacgccgcaaactcacaa

SEQ ID NO: 7077 - DNA, 842 bp, Artificial Sequence
  chemically treated genomic DNA (Homo sapiens) CpG-island No: 7077
ttgtagcgttagtcgtttttgtagtgtcggaatttttcgaaggtacgttagaagttaagtcggttatttcgatcgtatttaaggttcgggaggaagcgtcgaggttttcgagaatgtttagggaaattagttgcgtttataagttagttacgtagttttcgagtttcgggtcgtattcgtttaggttagttttgcgttttttttcgcgagcggtcgtttcgatttttattttcggaatcgttttagtcgcgattatcgagtgttcgttagttttttcgattttacgtagtttattagggtcggcgtttgaggttcgcgttttaggtcgcggcggttttgatcggtttcgttcgttcgttcgttcgttcgttcgttttttttttttcgcggtcgttattttttcggcgggagcggtttgtgcgggattcgcggttttcgttagtcgggtttcgatgtcggtttcgtttcgttttcgagggcggtttaagcggcggtcggtttttttattcggcgttcgggacgttatttatcgtaggtcgtaggtttttagggtttcgtagttattttttcgaacgtcgcggagtgggcggacggttatcgagatggcgcggggttagagcggcgttttcgcgcggcgggcggaggacgagatcggttatcgagacgttgcggggttagagcggagttcgggttgcgaagttcggtttcggattgcgcgtatgcgttcgttttttatatttgtatttcggacgcgtttttcgggtttgtattgataatgatttgtttgtattttttgtggatattttattttttcgattttaagagtgaaagttggggtagtg

SEQ ID NO: 7078 - DNA, 842 bp, Artificial Sequence
  chemically treated genomic DNA (Homo sapiens) CpG-island No: 7078
cactaccccaactttcactcttaaaatcgaaaaaataaaatatccacaaaaaatacaaacaaatcattatcaatacaaacccgaaaaacgcgtccgaaatacaaatataaaaaacgaacgcatacgcgcaatccgaaaccgaacttcgcaacccgaactccgctctaaccccgcaacgtctcgataaccgatctcgtcctccgcccgccgcgcgaaaacgccgctctaaccccgcgccatctcgataaccgtccgcccactccgcgacgttcgaaaaaataactacgaaaccctaaaaacctacgacctacgataaataacgtcccgaacgccgaataaaaaaaccgaccgccgcttaaaccgccctcgaaaacgaaacgaaaccgacatcgaaacccgactaacgaaaaccgcgaatcccgcacaaaccgctcccgccgaaaaaataacgaccgcgaaaaaaaaaaaacgaacgaacgaacgaacgaacgaacgaaaccgatcaaaaccgccgcgacctaaaacgcgaacctcaaacgccgaccctaataaactacgtaaaatcgaaaaaactaacgaacactcgataatcgcgactaaaacgattccgaaaataaaaatcgaaacgaccgctcgcgaaaaaaaacgcaaaactaacctaaacgaatacgacccgaaactcgaaaactacgtaactaacttataaacgcaactaatttccctaaacattctcgaaaacctcgacgcttcctcccgaaccttaaatacgatcgaaataaccgacttaacttctaacgtaccttcgaaaaattccgacactacaaaaacgactaacgctacaa

SEQ ID NO: 7079 - DNA, 842 bp, Artificial Sequence
  chemically treated genomic DNA (Homo sapiens) CpG-island No: 7079
tattgttttagtttttatttttggagtcggggaaataaggtgtttataaaggatgtaagtaagttattgttagtgtagattcgaagggcgcgttcggagtgtaggtatgaaagacgggcgtatgcgcgtagttcggggtcgggtttcgtagttcgggtttcgttttagtttcgtagcgtttcggtggtcggtttcgtttttcgttcgtcgcgcgggggcgtcgttttagtttcgcgttatttcggtggtcgttcgtttatttcgcggcgttcggggaaatggttgcgagattttagaggtttgcggtttgcggtaagtggcgtttcgggcgtcgggtagaagagtcggtcgtcgtttgggtcgttttcgggagcggggcggggtcggtatcggagttcggttggcgagagtcgcggatttcgtataggtcgttttcgtcgagaagatggcggtcgcggaagggaaggagcgggcgggcgggcgggcgagcgggcggggtcggttagagtcgtcgcggtttggggcgcgggttttagacgtcggttttggtgggttgcgtgaggtcgaggggattggcgagtattcggtggtcgcggttggaacggtttcgagggtgggagtcggggcggtcgttcgcggggaagagcgtagggttggtttgggcgagtgcggttcggggttcgggggttgcgtagttggtttgtaagcgtagttggtttttttaggtattttcggggatttcggcgttttttttcgggttttgggtgcggtcggggtggtcggtttagtttttggcgtgttttcgggggatttcggtattgtaggggcggttggcgttgtag

SEQ ID NO: 7080 - DNA, 842 bp, Artificial Sequence
  chemically treated genomic DNA (Homo sapiens) CpG-island No: 7080
ctacaacgccaaccgcccctacaataccgaaatcccccgaaaacacgccaaaaactaaaccgaccaccccgaccgcacccaaaacccgaaaaaaaacgccgaaatccccgaaaatacctaaaaaaaccaactacgcttacaaaccaactacgcaacccccgaaccccgaaccgcactcgcccaaaccaaccctacgctcttccccgcgaacgaccgccccgactcccaccctcgaaaccgttccaaccgcgaccaccgaatactcgccaatcccctcgacctcacgcaacccaccaaaaccgacgtctaaaacccgcgccccaaaccgcgacgactctaaccgaccccgcccgctcgcccgcccgcccgcccgctccttcccttccgcgaccgccatcttctcgacgaaaacgacctatacgaaatccgcgactctcgccaaccgaactccgataccgaccccgccccgctcccgaaaacgacccaaacgacgaccgactcttctacccgacgcccgaaacgccacttaccgcaaaccgcaaacctctaaaatctcgcaaccatttccccgaacgccgcgaaataaacgaacgaccaccgaaataacgcgaaactaaaacgacgcccccgcgcgacgaacgaaaaacgaaaccgaccaccgaaacgctacgaaactaaaacgaaacccgaactacgaaacccgaccccgaactacgcgcatacgcccgtctttcatacctacactccgaacgcgcccttcgaatctacactaacaataacttacttacatcctttataaacaccttatttccccgactccaaaaataaaaactaaaacaata

SEQ ID NO: 7081 - DNA, 829 bp, Artificial Sequence
  chemically treated genomic DNA (Homo sapiens) CpG-island No: 7081
tttcgtttgaggggcggtcgcggatattcggcgtttttttttcgttttatttcgtgcggttttacgtaaacgataggaaaaaagttgggattttcgttttcgatttagtgtagacgtcgttatttcggttttagattttcgcgttttaacgttttcgtagtagttattttgttagagggtcgacgttttttgattttggcgttaattcgtagtgcgtggtcgtcgcgaggggagttttgcgtaagtacggaagttgaggtttcgcgttttcgggaggtcgttcgtttcgttttttcgcgggggcgttttattggttatcggttcgcgttttcgcgtttttttgttgtcgcgagaggtgttgaggggcggttttcggtgcgtttgttttttcgtttttcgttttcgttttcgttttcgttttcgtcgcggtttttatttttgtttttttttattcgggcgtttcggcggtcgttatttttttttagtttaggagaggttgcggagtcgtagtcgtttagatcgcgtagcgcgggaggtaggtttcgtacggtaagatggcggcggcgggttcgggcggtcgggtcgagcgtttttcggggtcgggtcgggcgggtaggcgggatgtggtcggggtgcgcgtcgttttcgttttgggggttttggaagcgtcggcgttggtaggtgcggaattggggcgcgtagtgagtttaggttcggacggtcgtttcgcgtcggtgtttagggggtagttagggtttagtttttaggcgcgcggttttaggcgttggtgttttggggcggtttcggttagtttgaggggcggcggtag

SEQ ID NO: 7082 - DNA, 829 bp, Artificial Sequence
  chemically treated genomic DNA (Homo sapiens) CpG-island No: 7082
ctaccgccgcccctcaaactaaccgaaaccgccccaaaacaccaacgcctaaaaccgcgcgcctaaaaactaaaccctaactaccccctaaacaccgacgcgaaacgaccgtccgaacctaaactcactacgcgccccaattccgcacctaccaacgccgacgcttccaaaacccccaaaacgaaaacgacgcgcaccccgaccacatcccgcctacccgcccgacccgaccccgaaaaacgctcgacccgaccgcccgaacccgccgccgccatcttaccgtacgaaacctacctcccgcgctacgcgatctaaacgactacgactccgcaacctctcctaaactaaaaaaaaataacgaccgccgaaacgcccgaataaaaaaaaacaaaaataaaaaccgcgacgaaaacgaaaacgaaaacgaaaacgaaaaacgaaaaaacaaacgcaccgaaaaccgcccctcaacacctctcgcgacaacaaaaaaacgcgaaaacgcgaaccgataaccaataaaacgcccccgcgaaaaaacgaaacgaacgacctcccgaaaacgcgaaacctcaacttccgtacttacgcaaaactcccctcgcgacgaccacgcactacgaattaacgccaaaatcaaaaaacgtcgaccctctaacaaaataactactacgaaaacgttaaaacgcgaaaatctaaaaccgaaataacgacgtctacactaaatcgaaaacgaaaatcccaacttttttcctatcgtttacgtaaaaccgcacgaaataaaacgaaaaaaaaacgccgaatatccgcgaccgcccctcaaacgaaa

SEQ ID NO: 7083 - DNA, 829 bp, Artificial Sequence
  chemically treated genomic DNA (Homo sapiens) CpG-island No: 7083
ttatcgtcgttttttaggttggtcgggatcgttttagaatattagcgtttgaggtcgcgcgtttggaggttgagttttgattgttttttgggtatcggcgcggggcggtcgttcgggtttggatttattgcgcgttttaatttcgtatttgttagcgtcggcgtttttaaggtttttagagcgggggcggcgcgtatttcggttatatttcgtttgttcgttcggttcggtttcgggagacgttcggttcggtcgttcgggttcgtcgtcgttattttatcgtgcggaatttgtttttcgcgttgcgcggtttgggcggttgcggtttcgtagttttttttgggttggggagaggtggcggtcgtcggggcgttcgagtagaaggaggtagaggtgggggtcgcggcggaggcgggggcgggggcgggggcggggagcgggagggtaggcgtatcggaggtcgttttttagtatttttcgcgatagtaagagagcgcgagagcgcgagtcgatgattaatgaagcgttttcgcgagggggcggggcggacggtttttcggaagcgcggaattttagttttcgtatttgcgtagaatttttttcgcggcgattacgtattacgggttggcgttagagttaaaaggcgtcggttttttggtaagatggttgttgcggaggcgttggagcgcggaaatttggaatcgggatggcgacgtttatattgagtcggaggcgaaggttttagttttttttttgtcgtttgcgtgaggtcgtacggggtggggcgggggaaaggcgtcgggtgttcgcggtcgttttttagacgggg

SEQ ID NO: 7084 - DNA, 829 bp, Artificial Sequence
  chemically treated genomic DNA (Homo sapiens) CpG-island No: 7084
ccccgtctaaaaaacgaccgcgaacacccgacgcctttcccccgccccaccccgtacgacctcacgcaaacgacaaaaaaaaaactaaaaccttcgcctccgactcaatataaacgtcgccatcccgattccaaatttccgcgctccaacgcctccgcaacaaccatcttaccaaaaaaccgacgccttttaactctaacgccaacccgtaatacgtaatcgccgcgaaaaaaattctacgcaaatacgaaaactaaaattccgcgcttccgaaaaaccgtccgccccgccccctcgcgaaaacgcttcattaatcatcgactcgcgctctcgcgctctcttactatcgcgaaaaatactaaaaaacgacctccgatacgcctaccctcccgctccccgcccccgcccccgcccccgcctccgccgcgacccccacctctacctccttctactcgaacgccccgacgaccgccacctctccccaacccaaaaaaaactacgaaaccgcaaccgcccaaaccgcgcaacgcgaaaaacaaattccgcacgataaaataacgacgacgaacccgaacgaccgaaccgaacgtctcccgaaaccgaaccgaacgaacaaacgaaatataaccgaaatacgcgccgcccccgctctaaaaaccttaaaaacgccgacgctaacaaatacgaaattaaaacgcgcaataaatccaaacccgaacgaccgccccgcgccgatacccaaaaaacaatcaaaactcaacctccaaacgcgcgacctcaaacgctaatattctaaaacgatcccgaccaacctaaaaaacgacgataa

SEQ ID NO: 7085 - DNA, 658 bp, Artificial Sequence
  chemically treated genomic DNA (Homo sapiens) CpG-island No: 7085
tagttcgcgttattagtttcgtttttaataaaataggcgatggcggggcgggttcggagtgtttagataattttttaagagttttagataattttatttattagttcgttcgcgggatagtatcgtttattagtttcggggttttcgagtgcggaaattttatttttgcggtggggtttggacgttcgagagttttttttagtaaagtttttgaagaggagcgaggcggtttcgaggaatcgcggaggaagtgaagttagtttcgttattttttagatcggttttttatttcggttacgcgttattatagagttgaaggaggtttagagagtcgcgcgtgtcgcgttatcgagatcggaaggaggcggtatagatttggaggacgatcgcggagttgagcgtttagagtcgtcgaattatagagatcggaaataggagcgagcggtagcgtcggaaaggaggttaagagcgcgggcggcgaggtaagatggcggtaattaagaggaaacggcgtggaggttttgtagtttaggcgaagaagttaaaaagaaacgaaatagatgcggagtcgttagttaagcggtacgttatagtagaggaggtggaggaagaagagagggatcggattttaggtttcgtttgtaaggtaggaggggat

SEQ ID NO: 7086 - DNA, 658 bp, Artificial Sequence
  chemically treated genomic DNA (Homo sapiens) CpG-island No: 7086
atcccctcctaccttacaaacgaaacctaaaatccgatccctctcttcttcctccacctcctctactataacgtaccgcttaactaacgactccgcatctatttcgtttctttttaacttcttcgcctaaactacaaaacctccacgccgtttcctcttaattaccgccatcttacctcgccgcccgcgctcttaacctcctttccgacgctaccgctcgctcctatttccgatctctataattcgacgactctaaacgctcaactccgcgatcgtcctccaaatctataccgcctccttccgatctcgataacgcgacacgcgcgactctctaaacctccttcaactctataataacgcgtaaccgaaataaaaaaccgatctaaaaaataacgaaactaacttcacttcctccgcgattcctcgaaaccgcctcgctcctcttcaaaaactttactaaaaaaaactctcgaacgtccaaaccccaccgcaaaaataaaatttccgcactcgaaaaccccgaaactaataaacgatactatcccgcgaacgaactaataaataaaattatctaaaactcttaaaaaattatctaaacactccgaacccgccccgccatcgcctattttattaaaaacgaaactaataacgcgaacta

SEQ ID NO: 7087 - DNA, 658 bp, Artificial Sequence
  chemically treated genomic DNA (Homo sapiens) CpG-island No: 7087
atttttttttattttgtaaacggggtttgggattcggttttttttttttttttttattttttttgttgtggcgtgtcgtttagttggcggtttcgtatttatttcgtttttttttggttttttcgtttgaattgtaaagtttttacgtcgtttttttttggttgtcgttattttgtttcgtcgttcgcgtttttggtttttttttcggcgttgtcgttcgtttttattttcgatttttatggttcggcggttttaagcgtttagtttcgcggtcgttttttaggtttgtgtcgttttttttcggtttcggtggcgcggtacgcgcggttttttaggttttttttagttttgtggtgacgcgtggtcgaggtggagggtcggtttgaagagtggcgggattggttttatttttttcgcggtttttcggagtcgtttcgtttttttttagggattttgttgagaagggttttcgggcgtttagattttatcgtaaaggtagggttttcgtattcggggatttcgagattagtaagcgatgttgtttcgcgggcgggttggtgaatggggttgtttgggatttttggaggattatttggatatttcgggttcgtttcgttatcgtttgttttgttggaggcggggttggtggcgcgggttg

SEQ ID NO: 7088 - DNA, 658 bp, Artificial Sequence
  chemically treated genomic DNA (Homo sapiens) CpG-island No: 7088
caacccgcgccaccaaccccgcctccaacaaaacaaacgataacgaaacgaacccgaaatatccaaataatcctccaaaaatcccaaacaaccccattcaccaacccgcccgcgaaacaacatcgcttactaatctcgaaatccccgaatacgaaaaccctacctttacgataaaatctaaacgcccgaaaacccttctcaacaaaatccctaaaaaaaaacgaaacgactccgaaaaaccgcgaaaaaaataaaaccaatcccgccactcttcaaaccgaccctccacctcgaccacgcgtcaccacaaaactaaaaaaaacctaaaaaaccgcgcgtaccgcgccaccgaaaccgaaaaaaaacgacacaaacctaaaaaacgaccgcgaaactaaacgcttaaaaccgccgaaccataaaaatcgaaaataaaaacgaacgacaacgccgaaaaaaaaaccaaaaacgcgaacgacgaaacaaaataacgacaaccaaaaaaaaacgacgtaaaaactttacaattcaaacgaaaaaaccaaaaaaaaacgaaataaatacgaaaccgccaactaaacgacacgccacaacaaaaaaaataaaaaaaaaaaaaaaaaaccgaatcccaaaccccgtttacaaaataaaaaaaaat

SEQ ID NO: 7089 - DNA, 1099 bp, Artificial Sequence
  chemically treated genomic DNA (Homo sapiens) CpG-island No: 7089
ttcgcgcggtttcgtttttcgtttcgtcgaggtttcgttttttatattaaggtttcgttttttttttgtttttttcggttaaggtttattttttttttacgcggttcgttttttttttcgttaagttttcgttttttttttgcgcggttcgttttttttttcgttaaggtttcgtttttttttttcggggtttcgttttttatttcgtcgaggttttattttttttcgcgcggttttttcggtatagagtttatttttagtttatgcgaagcggcggtcgtcggaaatcgattatcgacgcgttttcgtttgtcgtagtttgacgtcgtttagtcgatatcgagcgtttttattgatttatattatcgtcgatacgtcgtacgtcgacgtcgggtatcgtatggttggttcggtgcgggcggcggattttcgtcggagaggattgttagttcgttttcgtcgtcgtttcggttcggttcggtttcgatttcgtttcggttttagcgtcggtcgttcgttcggtcgggcgatgaagtgttattatgaggcgttgggggtgcggcgcgacgttagcgaggaggagtttaagaaggtttatcggaagttggttttgaaatggtattcgggtaagtatttgtttcgtagttttcgcggttattcggagaagttcggtttttttcgatttttttttttttcgggcggatttcgcggagttagtagagagggatttggcggtttaggagttttttgtttcgttcggttagtgttcggagtcgttttgttcgtttcggtgggcgaagcgtttcgttttggcgtatttcggtttatattttatttttttatattcgcgatttcggtttcgtatcgttattgtagggggaaaattgtagtttaataattttatttgttttcgttatcgggtcgtagatattacgagggagtagtcgggaattcggaatttagatttgttttaggtttgtttttttttgcgttttttgtagcgtagtttttcggtgtttttttttcgttgttttttatttcgttcgggaattttagatattttaatttgatgtatggtttttttcgttttttagttaag

SEQ ID NO: 7090 - DNA, 1099 bp, Artificial Sequence
  chemically treated genomic DNA (Homo sapiens) CpG-island No: 7090
cttaactaaaaaacgaaaaaaaccatacatcaaattaaaatatctaaaattcccgaacgaaataaaaaacaacgaaaaaaaaacaccgaaaaactacgctacaaaaaacgcaaaaaaaaacaaacctaaaacaaatctaaattccgaattcccgactactccctcgtaatatctacgacccgataacgaaaacaaataaaattattaaactacaattttccccctacaataacgatacgaaaccgaaatcgcgaatataaaaaaataaaatataaaccgaaatacgccaaaacgaaacgcttcgcccaccgaaacgaacaaaacgactccgaacactaaccgaacgaaacaaaaaactcctaaaccgccaaatccctctctactaactccgcgaaatccgcccgaaaaaaaaaaaaatcgaaaaaaaccgaacttctccgaataaccgcgaaaactacgaaacaaatacttacccgaataccatttcaaaaccaacttccgataaaccttcttaaactcctcctcgctaacgtcgcgccgcacccccaacgcctcataataacacttcatcgcccgaccgaacgaacgaccgacgctaaaaccgaaacgaaatcgaaaccgaaccgaaccgaaacgacgacgaaaacgaactaacaatcctctccgacgaaaatccgccgcccgcaccgaaccaaccatacgatacccgacgtcgacgtacgacgtatcgacgataatataaatcaataaaaacgctcgatatcgactaaacgacgtcaaactacgacaaacgaaaacgcgtcgataatcgatttccgacgaccgccgcttcgcataaactaaaaataaactctataccgaaaaaaccgcgcgaaaaaaaataaaacctcgacgaaataaaaaacgaaaccccgaaaaaaaaaaacgaaaccttaacgaaaaaaaaaacgaaccgcgcaaaaaaaaaacgaaaacttaacgaaaaaaaaaacgaaccgcgtaaaaaaaaaataaaccttaaccgaaaaaaacaaaaaaaaaacgaaaccttaatataaaaaacgaaacctcgacgaaacgaaaaacgaaaccgcgcgaa

SEQ ID NO: 7091 - DNA, 1099 bp, Artificial Sequence
  chemically treated genomic DNA (Homo sapiens) CpG-island No: 7091
tttaattaagaaacgaaaagagttatatattaggttgaagtatttgggattttcggacgaggtggagggtagcggaggaaaaatatcgagaggttgcgttgtaagggacgtagggaaaagtaagtttggggtaggtttgagtttcgagttttcgattgttttttcgtggtgtttgcgattcggtagcgggagtaagtgaggttgttggattgtagttttttttttatagtggcgatgcggggtcggggtcgcgggtatgaggagatggggtgtgagtcggggtgcgttagggcggagcgtttcgtttatcgagacgggtagggcggtttcgggtattggtcgggcggggtaaggagtttttaggtcgttaggtttttttttgttggtttcgcggagttcgttcgggggaagggaaggtcggggagggtcgggttttttcgagtggtcgcgggggttgcgggataggtatttattcgggtgttattttagggttagttttcgataggtttttttgagttttttttcgttggcgtcgcgtcgtatttttagcgttttatagtgatattttatcgttcgatcgggcgggcggtcggcgttggggtcgggacggggtcggggtcgggtcgggtcgaagcggcggcggaggcgggttggtagtttttttcggcgggagttcgtcgttcgtatcgggttagttatgcgatgttcggcgtcggcgtgcggcgtgtcggcggtggtgtaggttagtgaaggcgttcggtgtcggttagacgacgttaggttgcggtaagcgggagcgcgtcggtggtcggttttcggcggtcgtcgtttcgtatgggttaggggtgggttttgtgtcggaaaggtcgcgcgggagggggtggggtttcggcggggtgagaggcgaggtttcgaggaaggaaggcggggttttggcgaggagagaggcgggtcgcgtaggagaaaggcgggagtttggcggggaaagaggcgggtcgcgtgggaggaaggtaggttttggtcgggaagaataggaggaaggcgggattttggtgtgagaggcggggtttcggcggggcgagaggcggggtcgcgcgga

SEQ ID NO: 7092 - DNA, 1099 bp, Artificial Sequence
  chemically treated genomic DNA (Homo sapiens) CpG-island No: 7092
tccgcgcgaccccgcctctcgccccgccgaaaccccgcctctcacaccaaaatcccgccttcctcctattcttcccgaccaaaacctaccttcctcccacgcgacccgcctctttccccgccaaactcccgcctttctcctacgcgacccgcctctctcctcgccaaaaccccgccttccttcctcgaaacctcgcctctcaccccgccgaaaccccaccccctcccgcgcgacctttccgacacaaaacccacccctaacccatacgaaacgacgaccgccgaaaaccgaccaccgacgcgctcccgcttaccgcaacctaacgtcgtctaaccgacaccgaacgccttcactaacctacaccaccgccgacacgccgcacgccgacgccgaacatcgcataactaacccgatacgaacgacgaactcccgccgaaaaaaactaccaacccgcctccgccgccgcttcgacccgacccgaccccgaccccgtcccgaccccaacgccgaccgcccgcccgatcgaacgataaaatatcactataaaacgctaaaaatacgacgcgacgccaacgaaaaaaaactcaaaaaaacctatcgaaaactaaccctaaaataacacccgaataaatacctatcccgcaacccccgcgaccactcgaaaaaacccgaccctccccgaccttcccttcccccgaacgaactccgcgaaaccaacaaaaaaaaacctaacgacctaaaaactccttaccccgcccgaccaatacccgaaaccgccctacccgtctcgataaacgaaacgctccgccctaacgcaccccgactcacaccccatctcctcatacccgcgaccccgaccccgcatcgccactataaaaaaaaaactacaatccaacaacctcacttactcccgctaccgaatcgcaaacaccacgaaaaaacaatcgaaaactcgaaactcaaacctaccccaaacttacttttccctacgtcccttacaacgcaacctctcgatatttttcctccgctaccctccacctcgtccgaaaatcccaaatacttcaacctaatatataactcttttcgtttcttaattaaa

SEQ ID NO: 7093 - DNA, 584 bp, Artificial Sequence
  chemically treated genomic DNA (Homo sapiens) CpG-island No: 7093
cgatattttaattttagttacgcgatttagtattcggtttttttttattttaggtcgcgtcgtttcgatttttcgcgtttttatagcgtacgaattttttggcgttaggttgggttagattcgtcggtttggtaggcgcggttttcggtttagttgcgtcggggcggtttagcgcgatttcgcgggttttttggttgttcgtttcggtttcggaatattgttagattttttttcgtagaggtagcgcgttattttagtttcgcggcggggcggggcgttttttaatttcgtttagttgcgttttcggtcggttaacgttgcgtttcgttttttatcgggatttaggcgttgattggtttttgagagattttttgcgtttaggtattggtttagtggtcgtttgtcgacgagggggcgggatttcgaggggtagcgattttcgtaacgcggtttttcgcgtttcggatttcggtggttgcgttcgcgtcgttttttttagattagatcgaagggttttttttattttttttttgtgggcggaaagagcggaatgttttatttttttgtggaataacggggttatg

SEQ ID NO: 7094 - DNA, 584 bp, Artificial Sequence
  chemically treated genomic DNA (Homo sapiens) CpG-island No: 7094
cataaccccgttattccacaaaaaaataaaacattccgctctttccgcccacaaaaaaaaaataaaaaaaacccttcgatctaatctaaaaaaaacgacgcgaacgcaaccaccgaaatccgaaacgcgaaaaaccgcgttacgaaaatcgctacccctcgaaatcccgccccctcgtcgacaaacgaccactaaaccaatacctaaacgcaaaaaatctctcaaaaaccaatcaacgcctaaatcccgataaaaaacgaaacgcaacgttaaccgaccgaaaacgcaactaaacgaaattaaaaaacgccccgccccgccgcgaaactaaaataacgcgctacctctacgaaaaaaaatctaacaatattccgaaaccgaaacgaacaaccaaaaaacccgcgaaatcgcgctaaaccgccccgacgcaactaaaccgaaaaccgcgcctaccaaaccgacgaatctaacccaacctaacgccaaaaaattcgtacgctataaaaacgcgaaaaatcgaaacgacgcgacctaaaataaaaaaaaaccgaatactaaatcgcgtaactaaaattaaaatatcg

SEQ ID NO: 7095 - DNA, 584 bp, Artificial Sequence
  chemically treated genomic DNA (Homo sapiens) CpG-island No: 7095
tatgatttcgttattttatagaaaaatggaatatttcgtttttttcgtttatagaggggaggtggggggaatttttcgatttagtttgggagaggcgacgcggacgtagttatcggaattcgggacgcgaagagtcgcgttacgggaatcgttatttttcggagtttcgttttttcgtcgataggcggttattggattaatgtttgggcgtaaagggttttttaggggttaattagcgtttaggtttcggtagggggcggggcgtagcgttggtcggtcgggggcgtagttgggcgggattggggagcgtttcgtttcgtcgcgggattggggtggcgcgttatttttgcggagaaggatttgatagtgtttcggagtcggggcgagtagttaaaaggttcgcggagtcgcgttgggtcgtttcggcgtagttgaatcgggggtcgcgtttgttaggtcgacgggtttggtttagtttggcgttaaggggttcgtgcgttgtggagacgcggagggtcgaggcggcgcggtttgaggtgaggaggggtcgggtgttgggtcgcgtagttggagttagagtgtcg

SEQ ID NO: 7096 - DNA, 584 bp, Artificial Sequence
  chemically treated genomic DNA (Homo sapiens) CpG-island No: 7096
cgacactctaactccaactacgcgacccaacacccgacccctcctcacctcaaaccgcgccgcctcgaccctccgcgtctccacaacgcacgaaccccttaacgccaaactaaaccaaacccgtcgacctaacaaacgcgacccccgattcaactacgccgaaacgacccaacgcgactccgcgaaccttttaactactcgccccgactccgaaacactatcaaatccttctccgcaaaaataacgcgccaccccaatcccgcgacgaaacgaaacgctccccaatcccgcccaactacgcccccgaccgaccaacgctacgccccgccccctaccgaaacctaaacgctaattaacccctaaaaaaccctttacgcccaaacattaatccaataaccgcctatcgacgaaaaaacgaaactccgaaaaataacgattcccgtaacgcgactcttcgcgtcccgaattccgataactacgtccgcgtcgcctctcccaaactaaatcgaaaaattccccccacctcccctctataaacgaaaaaaacgaaatattccatttttctataaaataacgaaatcata

SEQ ID NO: 7097 - DNA, 539 bp, Artificial Sequence
  chemically treated genomic DNA (Homo sapiens) CpG-island No: 7097
gattggtaattcgtttggtttgggcgagacggtaattttcgggattgtttttgcgttggggcgtagcggtttgaatgtcgaaaattacgaaaattttatttagatcgatgtagcgattaatcgtggtaatttcggtggtgcgttggttaatttgaacggcgaattgatcggtattaatatcgcgattttcgtatcggacggcggtaatatcggtatcggttttgttatttcgagtaatatggtgaaaaatttgatttcgtagatggtggaatacggttaggtgaaacgcggtgagttgggtattatggggattgagttgaatttcgaattggcgaaagcgatgaaagttgacgtttagcgcggtgttttcgtaagttatgttttgtttaattttttcgttgtaaaagcgggtattaaagcgggtgatgtgattattttattgaacggtaagtcgattagtagttttgtcgtattgcgtgtttaggtgggtattatgtcggagaaattagaatttgtattttgatagtttattttagagg

SEQ ID NO: 7098 - DNA, 539 bp, Artificial Sequence
  chemically treated genomic DNA (Homo sapiens) CpG-island No: 7098
cctctaaaataaactatcaaaatacaaattctaatttctccgacataatacccacctaaacacgcaatacgacaaaactactaatcgacttaccgttcaataaaataatcacatcacccgctttaatacccgcttttacaacgaaaaaattaaacaaaacataacttacgaaaacaccgcgctaaacgtcaactttcatcgctttcgccaattcgaaattcaactcaatccccataatacccaactcaccgcgtttcacctaaccgtattccaccatctacgaaatcaaatttttcaccatattactcgaaataacaaaaccgataccgatattaccgccgtccgatacgaaaatcgcgatattaataccgatcaattcgccgttcaaattaaccaacgcaccaccgaaattaccacgattaatcgctacatcgatctaaataaaattttcgtaattttcgacattcaaaccgctacgccccaacgcaaaaacaatcccgaaaattaccgtctcgcccaaaccaaacgaattaccaatc

SEQ ID NO: 7099 - DNA, 539 bp, Artificial Sequence
  chemically treated genomic DNA (Homo sapiens) CpG-island No: 7099
tttttagagtggattgttaggatgtagattttggttttttcggtatagtatttatttgagtacgtagtgcggtaaagttgttgatcggtttatcgtttagtgaggtgattatattattcgttttaatgttcgtttttgtagcggaggaattaggtagaatatggtttacgaaagtatcgcgttgggcgttaatttttatcgttttcgttagttcggagtttagtttagtttttataatatttagtttatcgcgttttatttggtcgtattttattatttgcgaggttaggttttttattatgttattcgggatagtaaaatcgatatcgatgttgtcgtcgttcggtgcgaggatcgcggtgttgatatcgattagttcgtcgtttaggttaattagcgtattatcggagttattacggttgatcgttgtatcggtttggatgaagttttcgtagttttcggtatttaggtcgttacgttttagcgtagagataatttcggaagttatcgtttcgtttagattaaacgggttattaatt

SEQ ID NO: 7100 - DNA, 539 bp, Artificial Sequence
  chemically treated genomic DNA (Homo sapiens) CpG-island No: 7100
aattaataacccgtttaatctaaacgaaacgataacttccgaaattatctctacgctaaaacgtaacgacctaaataccgaaaactacgaaaacttcatccaaaccgatacaacgatcaaccgtaataactccgataatacgctaattaacctaaacgacgaactaatcgatatcaacaccgcgatcctcgcaccgaacgacgacaacatcgatatcgattttactatcccgaataacataataaaaaacctaacctcgcaaataataaaatacgaccaaataaaacgcgataaactaaatattataaaaactaaactaaactccgaactaacgaaaacgataaaaattaacgcccaacgcgatactttcgtaaaccatattctacctaattcctccgctacaaaaacgaacattaaaacgaataatataatcacctcactaaacgataaaccgatcaacaactttaccgcactacgtactcaaataaatactataccgaaaaaaccaaaatctacatcctaacaatccactctaaaaa

SEQ ID NO: 7101 - DNA, 710 bp, Artificial Sequence
  chemically treated genomic DNA (Homo sapiens) CpG-island No: 7101
  misc_feature (368)..(368): n is either a, c, g or t
  misc_feature (384)..(384): n is either a, c, g or t
cgtaagggacgagatgggtgtgcgtatgggacgaggtgggtgggagtatgagacgaggtgggtggggcggtgggtgaggttttcgtttttagacgggttggcgaggaagtagggaagaagtaacgttgggttggtgaggtaataggtggggcgtattggagttgcgggataataggtggaataaattggggattatattcgtgggcgtacgtgcggaagagggattgaggaggtttttgcgtgtttttttcgagtatcgtcgatagttttattcgtattttttgtttttcgtatcgttgatttttatcgtttcgcgtattgcgcgtttttagttttagtgtagttagttttcggtcgggttcgcgcgnaggttagggttgtaanttgttcgcgggcgggttggtggttggggagggcgttgggaggaggagtttcgtcgggtggacgcgcgttttttagcggcggaggcggaggcggtagcggcgaggtttgagggtgcgtgttagggagttttggcgcgttttttttttgtcggcgtttttttgcgtttgtagttgtttttcgacgttcgggaggtttattcgttagtcgcgatgggcgcgtagagtttaaaagggcgatttttaaataaaatttacgtatataaattttttagagatttttttattttttcgttaatatatatatatttatatatatatatatataat

SEQ ID NO: 7102 - DNA, 710 bp, Artificial Sequence
  chemically treated genomic DNA (Homo sapiens) CpG-island No: 7102
  misc_feature (327)..(327): n is either a, c, g or t
  misc_feature (343)..(343): n is either a, c, g or t
attatatatatatatatataaatatatatatattaacgaaaaaataaaaaaatctctaaaaaatttatatacgtaaattttatttaaaaatcgcccttttaaactctacgcgcccatcgcgactaacgaataaacctcccgaacgtcgaaaaacaactacaaacgcaaaaaaacgccgacaaaaaaaaaacgcgccaaaactccctaacacgcaccctcaaacctcgccgctaccgcctccgcctccgccgctaaaaaacgcgcgtccacccgacgaaactcctcctcccaacgccctccccaaccaccaacccgcccgcgaacaanttacaaccctaacctncgcgcgaacccgaccgaaaactaactacactaaaactaaaaacgcgcaatacgcgaaacgataaaaatcaacgatacgaaaaacaaaaaatacgaataaaactatcgacgatactcgaaaaaaacacgcaaaaacctcctcaatccctcttccgcacgtacgcccacgaatataatccccaatttattccacctattatcccgcaactccaatacgccccacctattacctcaccaacccaacgttacttcttccctacttcctcgccaacccgtctaaaaacgaaaacctcacccaccgccccacccacctcgtctcatactcccacccacctcgtcccatacgcacacccatctcgtcccttacg

SEQ ID NO: 7103 - DNA, 710 bp, Artificial Sequence
  chemically treated genomic DNA (Homo sapiens) CpG-island No: 7103
  misc_feature (327)..(327): n is either a, c, g or t
  misc_feature (343)..(343): n is either a, c, g or t
attgtgtgtatgtgtgtgtgggtgtgtgtgtgttggcggggggatgaggaagtttttggaggatttatatgcgtgagttttgtttgggggtcgtttttttgggttttgcgcgtttatcgcggttagcgggtgggtttttcgggcgtcggggagtagttgtaagcgtagggggacgtcggtagaagaaggacgcgttaggattttttagtacgtatttttaggtttcgtcgttgtcgttttcgttttcgtcgttgaagggcgcgcgtttattcggcgggatttttttttttaacgttttttttaattattagttcgttcgcgggtagnttgtagttttggtttncgcgcggattcggtcgggagttggttgtattagggttgggggcgcgtagtgcgcggagcggtaggagttagcggtgcggaaggtaggaggtgcgggtgaagttgtcggcggtgttcgaggggagtacgtaagaatttttttagtttttttttcgtacgtgcgtttacgagtgtagtttttagtttgttttatttattatttcgtagttttagtgcgttttatttgttgttttattagtttaacgttattttttttttgttttttcgttagttcgtttgggggcggagattttatttatcgttttatttatttcgttttatgtttttatttatttcgttttatgcgtatatttatttcgttttttgcg

SEQ ID NO: 7104 - DNA, 710 bp, Artificial Sequence
  chemically treated genomic DNA (Homo sapiens) CpG-island No: 7104
  misc_feature (368)..(368): n is either a, c, g or t
  misc_feature (384)..(384): n is either a, c, g or t
cgcaaaaaacgaaataaatatacgcataaaacgaaataaataaaaacataaaacgaaataaataaaacgataaataaaatctccgcccccaaacgaactaacgaaaaaacaaaaaaaaaataacgttaaactaataaaacaacaaataaaacgcactaaaactacgaaataataaataaaacaaactaaaaactacactcgtaaacgcacgtacgaaaaaaaaactaaaaaaattcttacgtactcccctcgaacaccgccgacaacttcacccgcacctcctaccttccgcaccgctaactcctaccgctccgcgcactacgcgcccccaaccctaatacaaccaactcccgaccgaatccgcgcgnaaaccaaaactacaanctacccgcgaacgaactaataattaaaaaaaacgttaaaaaaaaaaatcccgccgaataaacgcgcgcccttcaacgacgaaaacgaaaacgacaacgacgaaacctaaaaatacgtactaaaaaatcctaacgcgtccttcttctaccgacgtccccctacgcttacaactactccccgacgcccgaaaaacccacccgctaaccgcgataaacgcgcaaaacccaaaaaaacgacccccaaacaaaactcacgcatataaatcctccaaaaacttcctcatccccccgccaacacacacacacccacacacacatacacacaat

SEQ ID NO: 7105 - DNA, 618 bp, Artificial Sequence
  chemically treated genomic DNA (Homo sapiens) CpG-island No: 7105
gtgcggatggcgaaagagggcgaaacgttggtgttgttcgacggtattgaagcgaagttgaatgttgatattttggttatcgtcgattataataaggcgttggcgatgggcggtattttcggtggcgaatattttggcgtgaatgacgaaatataaaacgtgttgttggaatgcgcgttttttagttcgttgtttattatcggtcgtgttcgtcgttatggtttgtatatcgatgcgttttatcgttatgagcgtggcgttgattcggtattgtagtataaagcgatggaacgtgcgattcgtttgttgatcgatatttgcggtggtgaggttggttcggtaattgatattattaacgaagtaacgtttgtcgaagcgtgtaattattattttacgtcgtagtaaattggatcgtttgatcggttattatattgcggatgagtaggttattgatattttgcgtcgtttcggttgcgaagtgatcgaaggtaaagacgaatggtaggtagttgcgtcgagttggcgtttcgatatggagattgaagaagatttggttgaagaagtcgcgcgtgtttacggttataataatatttcggatgagtcggtataggtaagttt

SEQ ID NO: 7106 - DNA, 618 bp, Artificial Sequence
  chemically treated genomic DNA (Homo sapiens) CpG-island No: 7106
aaacttacctataccgactcatccgaaatattattataaccgtaaacacgcgcgacttcttcaaccaaatcttcttcaatctccatatcgaaacgccaactcgacgcaactacctaccattcgtctttaccttcgatcacttcgcaaccgaaacgacgcaaaatatcaataacctactcatccgcaatataataaccgatcaaacgatccaatttactacgacgtaaaataataattacacgcttcgacaaacgttacttcgttaataatatcaattaccgaaccaacctcaccaccgcaaatatcgatcaacaaacgaatcgcacgttccatcgctttatactacaataccgaatcaacgccacgctcataacgataaaacgcatcgatatacaaaccataacgacgaacacgaccgataataaacaacgaactaaaaaacgcgcattccaacaacacgttttatatttcgtcattcacgccaaaatattcgccaccgaaaataccgcccatcgccaacgccttattataatcgacgataaccaaaatatcaacattcaacttcgcttcaataccgtcgaacaacaccaacgtttcgccctctttcgccatccgcac

SEQ ID NO: 7107 - DNA, 618 bp, Artificial Sequence
  chemically treated genomic DNA (Homo sapiens) CpG-island No: 7107
aggtttgtttgtatcggtttattcgggatgttgttgtagtcgtaaatacgcgcgatttttttaattagattttttttaatttttatatcgaaacgttagttcggcgtaattgtttgttattcgtttttgttttcggttatttcgtagtcgagacgacgtagaatgttagtaatttgtttattcgtaatatgatggtcgattaggcgatttagtttgttacgacgtagagtgatggttgtacgtttcggtaagcgttgtttcgttggtgatattaattatcgggttagttttattatcgtagatgtcgattagtagacgggtcgtacgttttatcgttttgtgttgtagtgtcggattaacgttacgtttataacggtgagacgtatcggtatgtaggttatgacgacgagtacgatcggtgatagatagcgggttaaagaacgcgtattttagtagtacgttttgtgtttcgttatttacgttagagtgttcgttatcgaagatgtcgtttatcgttagcgttttgttgtggtcggcgatgattagagtgttagtatttagtttcgttttagtatcgtcgagtagtattagcgtttcgttttttttcgttattcgtat

SEQ ID NO: 7108 - DNA, 618 bp, Artificial Sequence
  chemically treated genomic DNA (Homo sapiens) CpG-island No: 7108
atacgaataacgaaaaaaaacgaaacgctaatactactcgacgatactaaaacgaaactaaatactaacactctaatcatcgccgaccacaacaaaacgctaacgataaacgacatcttcgataacgaacactctaacgtaaataacgaaacacaaaacgtactactaaaatacgcgttctttaacccgctatctatcaccgatcgtactcgtcgtcataacctacataccgatacgtctcaccgttataaacgtaacgttaatccgacactacaacacaaaacgataaaacgtacgacccgtctactaatcgacatctacgataataaaactaacccgataattaatatcaccaacgaaacaacgcttaccgaaacgtacaaccatcactctacgtcgtaacaaactaaatcgcctaatcgaccatcatattacgaataaacaaattactaacattctacgtcgtctcgactacgaaataaccgaaaacaaaaacgaataacaaacaattacgccgaactaacgtttcgatataaaaattaaaaaaaatctaattaaaaaaatcgcgcgtatttacgactacaacaacatcccgaataaaccgatacaaacaaacct

SEQ ID NO: 7109 - DNA, 588 bp, Artificial Sequence
  chemically treated genomic DNA (Homo sapiens) CpG-island No: 7109
  misc_feature (386)..(386): n is either a, c, g or t
acgcgggattagtatgtcgatgtatttatttatacgtagtattttattgattagcgtacggttaggattattaatcgtttgtacggtattcgtcggtaagtcgtaggattttagggcgttttgaattatcgttatcgttgtagcgttagtgcgatacgtttttttgttatcgcgtaggattatcgtattatcggtttttaggtatagcgaagcgatattaatcgttacgttcgggcgcgttttataaattacgttaataatttttagcggtacgcgacgacgtttaagacgtaggtcgttgtttagtacgtcgttatcgattatttgttttatcgggatcggcgaggttgtatatttgaagtatttcgtcggtaatgttttttagncgtgcgggcgttagtgttagacggttaaagtatttttcgttagagttatgggtcgcgcggtaataatatcgagcgtagcgtgacgatgattttatgtgttttagattcgggaatatttatagttaattattcgttgagattgtatataagagcgtttgggaagttttttcgttacgatataggacgttcgaagatcggaaat

SEQ ID NO: 7110 - DNA, 588 bp, Artificial Sequence
  chemically treated genomic DNA (Homo sapiens) CpG-island No: 7110
  misc_feature (203)..(203): n is either a, c, g or t
atttccgatcttcgaacgtcctatatcgtaacgaaaaaacttcccaaacgctcttatatacaatctcaacgaataattaactataaatattcccgaatctaaaacacataaaatcatcgtcacgctacgctcgatattattaccgcgcgacccataactctaacgaaaaatactttaaccgtctaacactaacgcccgcacgnctaaaaaacattaccgacgaaatacttcaaatatacaacctcgccgatcccgataaaacaaataatcgataacgacgtactaaacaacgacctacgtcttaaacgtcgtcgcgtaccgctaaaaattattaacgtaatttataaaacgcgcccgaacgtaacgattaatatcgcttcgctatacctaaaaaccgataatacgataatcctacgcgataacaaaaaaacgtatcgcactaacgctacaacgataacgataattcaaaacgccctaaaatcctacgacttaccgacgaataccgtacaaacgattaataatcctaaccgtacgctaatcaataaaatactacgtataaataaatacatcgacatactaatcccgcgt

SEQ ID NO: 7111 - DNA, 588 bp, Artificial Sequence
  chemically treated genomic DNA (Homo sapiens) CpG-island No: 7111
  misc_feature (203)..(203): n is either a, c, g or t
gttttcggttttcggacgttttatgtcgtagcgaaaaggttttttagacgtttttatgtgtaattttagcggataattggttgtggatattttcgggtttggagtatatgggattatcgttacgttacgttcgatgttgttatcgcgcgatttatggttttagcgaaggatgttttgatcgtttggtattgacgttcgtacgnttgaaaggtattgtcgacgaggtattttaggtgtgtaatttcgtcgatttcggtggggtaggtaatcgatggcggcgtattggatagcggtttgcgttttgagcgtcgtcgcgtatcgttgggggttattggcgtgatttatgaagcgcgttcgaacgtgacggttgatgtcgtttcgttgtgtttgaaaatcggtaatgcggtgattttgcgcggtggtaaagaaacgtgtcgtattaacgttgtaacggtggcggtgatttaggacgttttgaaattttgcggtttatcggcgggtgtcgtgtaggcgattgataattttgatcgtgcgttggttagtgaaatgttgcgtatggataaatatatcgatatgttgatttcgcgt

SEQ ID NO: 7112 - DNA, 588 bp, Artificial Sequence
  chemically treated genomic DNA (Homo sapiens) CpG-island No: 7112
  misc_feature (386)..(386): n is either a, c, g or t
acgcgaaatcaacatatcgatatatttatccatacgcaacatttcactaaccaacgcacgatcaaaattatcaatcgcctacacgacacccgccgataaaccgcaaaatttcaaaacgtcctaaatcaccgccaccgttacaacgttaatacgacacgtttctttaccaccgcgcaaaatcaccgcattaccgattttcaaacacaacgaaacgacatcaaccgtcacgttcgaacgcgcttcataaatcacgccaataacccccaacgatacgcgacgacgctcaaaacgcaaaccgctatccaatacgccgccatcgattacctaccccaccgaaatcgacgaaattacacacctaaaatacctcgtcgacaatacctttcaancgtacgaacgtcaataccaaacgatcaaaacatccttcgctaaaaccataaatcgcgcgataacaacatcgaacgtaacgtaacgataatcccatatactccaaacccgaaaatatccacaaccaattatccgctaaaattacacataaaaacgtctaaaaaaccttttcgctacgacataaaacgtccgaaaaccgaaaac

SEQ ID NO: 7113 - DNA, 694 bp, Artificial Sequence
  chemically treated genomic DNA (Homo sapiens) CpG-island No: 7113
  misc_feature (627)..(627): n is either a, c, g or t
  misc_feature (637)..(638): n is either a, c, g or t
  misc_feature (640)..(640): n is either a, c, g or t
  misc_feature (642)..(643): n is either a, c, g or t
  misc_feature (645)..(646): n is either a, c, g or t
gttagcgatgttggcgacgtcggcgaagttgttttttaggttttcggcgtagtcgtcgtttagcggtatgcgttagtaggggtttagggcggtttcgttcgcggcgagtagggatgcggttagtttatcgtcgttggtatatatgtcgttgcgtacgtcgtttagggcgatgacgtaggtttcggttagcgtcgttacgtcgacgacgatagcgggtttgaagcgttcggtataggttagcgcgtcgtagaggatgaggcggttttcggcgttcgtgtttaagatttcgatggtttggttcgatatcgacgtgacgatatcgttcggtttgatcgtatggtcgttgggtatgttttcgtaggcggtaacgattatgacgaggttgagtttgggttttaattcggttatcgcgcgtagcgtgtcgatgacgttggcggcgtcgtttatgtcgaattttatttcgtttatttcggtttttagttttaacgagatgttttcggtgtcgaaggtgatgtttttgtcgacgaggacgacgggcgttatcgttttgtaagcgttttttagcgcgttacgatgaagcgttacggttcgttcgaatttttgggtacgggttcggggggattgatnttttttgganngntnnannattgattgttgtcgtgagtcgtttttagaggatttttagaataaaata

SEQ ID NO: 7114 - DNA, 694 bp, Artificial Sequence
  chemically treated genomic DNA (Homo sapiens) CpG-island No: 7114
  misc_feature (49)..(50): n is either a, c, g or t
  misc_feature (52)..(53): n is either a, c, g or t
  misc_feature (55)..(55): n is either a, c, g or t
  misc_feature (57)..(58): n is either a, c, g or t
  misc_feature (68)..(68): n is either a, c, g or t
tattttattctaaaaatcctctaaaaacgactcacgacaacaatcaatnntnnancnntccaaaaaanatcaatccccccgaacccgtacccaaaaattcgaacgaaccgtaacgcttcatcgtaacgcgctaaaaaacgcttacaaaacgataacgcccgtcgtcctcgtcgacaaaaacatcaccttcgacaccgaaaacatctcgttaaaactaaaaaccgaaataaacgaaataaaattcgacataaacgacgccgccaacgtcatcgacacgctacgcgcgataaccgaattaaaacccaaactcaacctcgtcataatcgttaccgcctacgaaaacatacccaacgaccatacgatcaaaccgaacgatatcgtcacgtcgatatcgaaccaaaccatcgaaatcttaaacacgaacgccgaaaaccgcctcatcctctacgacgcgctaacctataccgaacgcttcaaacccgctatcgtcgtcgacgtaacgacgctaaccgaaacctacgtcatcgccctaaacgacgtacgcaacgacatatataccaacgacgataaactaaccgcatccctactcgccgcgaacgaaaccgccctaaacccctactaacgcataccgctaaacgacgactacgccgaaaacctaaaaaacaacttcgccgacgtcgccaacatcgctaac

SEQ ID NO: 7115 - DNA, 694 bp, Artificial Sequence
  chemically treated genomic DNA (Homo sapiens) CpG-island No: 7115
  misc_feature (49)..(50): n is either a, c, g or t
  misc_feature (52)..(53): n is either a, c, g or t
  misc_feature (55)..(55): n is either a, c, g or t
  misc_feature (57)..(58): n is either a, c, g or t
  misc_feature (68)..(68): n is either a, c, g or t
tattttattttggggattttttagaggcgatttacgatagtaattaatnntnngntnntttaaggggnattaattttttcgagttcgtgtttaggggttcgaacgaatcgtggcgttttatcgtggcgcgttagaaggcgtttgtaagacggtggcgttcgtcgttttcgtcggtaagggtattattttcgatatcggaggtatttcgttaaagttgggagtcgagatggacgagatgaagttcgatatgggcggcgtcgttagcgttatcggtacgttgcgcgcggtggtcgaattgaagtttaagtttaatttcgttatgatcgttgtcgtttgcgagaatatgtttagcggttatgcggttaagtcgggcgatgtcgttacgtcgatgtcgggttagattatcgaaattttgaatacggacgtcgagggtcgttttattttttgcgacgcgttgatttatgtcgagcgttttaagttcgttgtcgtcgtcgacgtggcgacgttgatcggggtttgcgttatcgttttgggcggcgtgcgtagcggtatgtatgttagcgacgatgaattggtcgtatttttgttcgtcgcgggcgaggtcgttttggatttttgttggcgtatgtcgttggacgacgattacgtcgaaggtttgaagagtaatttcgtcgacgtcgttaatatcgttggt

SEQ ID NO: 7116 - DNA, 694 bp, Artificial Sequence
  chemically treated genomic DNA (Homo sapiens) CpG-island No: 7116
  misc_feature (627)..(627): n is either a, c, g or t
  misc_feature (637)..(638): n is either a, c, g or t
  misc_feature (640)..(640): n is either a, c, g or t
  misc_feature (642)..(643): n is either a, c, g or t
  misc_feature (645)..(646): n is either a, c, g or t
accaacgatattaacgacgtcgacgaaattactcttcaaaccttcgacgtaatcgtcgtccaacgacatacgccaacaaaaatccaaaacgacctcgcccgcgacgaacaaaaatacgaccaattcatcgtcgctaacatacataccgctacgcacgccgcccaaaacgataacgcaaaccccgatcaacgtcgccacgtcgacgacgacaacgaacttaaaacgctcgacataaatcaacgcgtcgcaaaaaataaaacgaccctcgacgtccgtattcaaaatttcgataatctaacccgacatcgacgtaacgacatcgcccgacttaaccgcataaccgctaaacatattctcgcaaacgacaacgatcataacgaaattaaacttaaacttcaattcgaccaccgcgcgcaacgtaccgataacgctaacgacgccgcccatatcgaacttcatctcgtccatctcgactcccaactttaacgaaatacctccgatatcgaaaataatacccttaccgacgaaaacgacgaacgccaccgtcttacaaacgccttctaacgcgccacgataaaacgccacgattcgttcgaacccctaaacacgaactcgaaaaaattaatnccccttaaannancnnannattaattactatcgtaaatcgcctctaaaaaatccccaaaataaaata

SEQ ID NO: 7117 - DNA, 534 bp, Artificial Sequence
  chemically treated genomic DNA (Homo sapiens) CpG-island No: 7117
tagagttggcgtaggttattgaagcggcgggcgcgattattattaatatcggtattggttggtatgaagtacgtatttcgattattgttacgttcgtgtcgcgcggcgtatttagttgggttacgcgtaaattgaaaggttacgtttcgttgtcgttggtaattattaatcggattaacgattcgtaggttgtcgacgatattttttcgcgcggcgatgtcgatatggtatcgatggcgcgatcgttttttgttgatgcggagttgttgttaaaagcgtaatcgggacgagtcgatgagattaatatttgtattggttgtaattaggtttgtttcgattaaattttcgttggtaaagttatttcgtgtttggtgaattttcgcgtttgttacgaaattaaaatgttaatttttttcgtcgtgtagaaaaaaaatttggcggtggtcggtgcgggatttgttgggttggcgtttgttattaacgcggcggcgcgtgggtattaggtaatattgtttgacgtttatagcgagattg

SEQ ID NO: 7118 - DNA, 534 bp, Artificial Sequence
  chemically treated genomic DNA (Homo sapiens) CpG-island No: 7118
caatctcgctataaacgtcaaacaatattacctaatacccacgcgccgccgcgttaataacaaacgccaacccaacaaatcccgcaccgaccaccgccaaattttttttctacacgacgaaaaaaattaacattttaatttcgtaacaaacgcgaaaattcaccaaacacgaaataactttaccaacgaaaatttaatcgaaacaaacctaattacaaccaatacaaatattaatctcatcgactcgtcccgattacgcttttaacaacaactccgcatcaacaaaaaacgatcgcgccatcgataccatatcgacatcgccgcgcgaaaaaatatcgtcgacaacctacgaatcgttaatccgattaataattaccaacgacaacgaaacgtaacctttcaatttacgcgtaacccaactaaatacgccgcgcgacacgaacgtaacaataatcgaaatacgtacttcataccaaccaataccgatattaataataatcgcgcccgccgcttcaataacctacgccaactcta

SEQ ID NO: 7119 - DNA, 534 bp, Artificial Sequence
  chemically treated genomic DNA (Homo sapiens) CpG-island No: 7119
taatttcgttatgagcgttaaataatgttatttgatgtttacgcgtcgtcgcgttaatggtaaacgttagtttagtaggtttcgtatcgattatcgttagattttttttttgtacggcgggaaggattggtattttggtttcgtggtaggcgcgaggatttattaggtacgaggtgattttgttaacgaagatttgatcgagataggtttgattgtagttaatataagtgttgattttatcggttcgtttcgattgcgtttttgatagtagtttcgtattagtaagaaacggtcgcgttatcgatattatatcggtatcgtcgcgcgagagaatatcgtcggtaatttgcggatcgttaattcggttggtggttattagcggtagcgagacgtggttttttagtttgcgcgtgatttagttaaatgcgtcgcgcggtacgggcgtggtaatggtcggaatacgtgttttatgttagttaatgtcggtgttgataatggtcgcgttcgtcgttttaatggtttgcgttagtttta

SEQ ID NO: 7120 - DNA, 534 bp, Artificial Sequence
  chemically treated genomic DNA (Homo sapiens) CpG-island No: 7120
taaaactaacgcaaaccattaaaacgacgaacgcgaccattatcaacaccgacattaactaacataaaacacgtattccgaccattaccacgcccgtaccgcgcgacgcatttaactaaatcacgcgcaaactaaaaaaccacgtctcgctaccgctaataaccaccaaccgaattaacgatccgcaaattaccgacgatattctctcgcgcgacgataccgatataatatcgataacgcgaccgtttcttactaatacgaaactactatcaaaaacgcaatcgaaacgaaccgataaaatcaacacttatattaactacaatcaaacctatctcgatcaaatcttcgttaacaaaatcacctcgtacctaataaatcctcgcgcctaccacgaaaccaaaataccaatccttcccgccgtacaaaaaaaaaatctaacgataatcgatacgaaacctactaaactaacgtttaccattaacgcgacgacgcgtaaacatcaaataacattatttaacgctcataacgaaatta

SEQ ID NO: 7121 - DNA, 541 bp, Artificial Sequence
  chemically treated genomic DNA (Homo sapiens) CpG-island No: 7121
gcgtatcgtttcgatgtatttagatttgttgtagagtagttcgtttaattttatggtcgtcgttttttttttttagtttcggattttgttagagttagtcggttagttttttagagatttcggttattttcggtcgtttttttattttcgttttaggtggtttattgggatttatcgatagcgcggtttttttttaggcggtttcgttttattgttcggtcgtttacggttgcgcgtgcgtaggtcgaatggtggatttaattggtcggagtttagggcgcgtttggttcgcgtgggttagttgatcgcgtattgagggtgcgatttcgggttttttatttttttttggggcgttttttcggtttagggttaattgggtttcggtgtcggtaggtttggggtcggcgacggttgtttttttcgttttgtcgtttgttcgatggacgagtttttcgggaagttttttagttgtgaggagaaggaaaaggtgtcgggggtgcgggaagggcggacgtaggattttgatttcgtttttttaggg

SEQ ID NO: 7122 - DNA, 541 bp, Artificial Sequence
  chemically treated genomic DNA (Homo sapiens) CpG-island No: 7122
ccctaaaaaaacgaaatcaaaatcctacgtccgcccttcccgcacccccgacaccttttccttctcctcacaactaaaaaacttcccgaaaaactcgtccatcgaacaaacgacaaaacgaaaaaaacaaccgtcgccgaccccaaacctaccgacaccgaaacccaattaaccctaaaccgaaaaaacgccccaaaaaaaaataaaaaacccgaaatcgcaccctcaatacgcgatcaactaacccacgcgaaccaaacgcgccctaaactccgaccaattaaatccaccattcgacctacgcacgcgcaaccgtaaacgaccgaacaataaaacgaaaccgcctaaaaaaaaaccgcgctatcgataaatcccaataaaccacctaaaacgaaaataaaaaaacgaccgaaaataaccgaaatctctaaaaaactaaccgactaactctaacaaaatccgaaactaaaaaaaaaaaacgacgaccataaaattaaacgaactactctacaacaaatctaaatacatcgaaacgatacgc

SEQ ID NO: 7123 - DNA, 541 bp, Artificial Sequence
  chemically treated genomic DNA (Homo sapiens) CpG-island No: 7123
ttttgggaaagcggggttagagttttgcgttcgtttttttcgtattttcggtattttttttttttttttatagttgaggggtttttcgggaggttcgtttatcgggtaggcgatagaacgaaaagagtagtcgtcgtcgattttaggtttgtcgatatcgggatttagttggttttgggtcggggaggcgttttaggaaggaatggggagttcgggatcgtatttttagtgcgcgattagttgatttacgcgggttaagcgcgttttaaatttcggttaattaaatttattattcggtttgcgtacgcgtagtcgtagacggtcgagtagtggagcgaggtcgtttaaaggagagtcgcgttgtcgatgagttttagtgggttatttggagcggaagtggaggagcggtcggaagtagtcggaatttttgaaagattgatcgattgattttgataggattcggggttgagggaaggaggcggcggttatggagttgggcgagttgttttataataagtttgagtatatcgagacggtgcgt

SEQ ID NO: 7124 - DNA, 541 bp, Artificial Sequence
  chemically treated genomic DNA (Homo sapiens) CpG-island No: 7124
acgcaccgtctcgatatactcaaacttattataaaacaactcgcccaactccataaccgccgcctccttccctcaaccccgaatcctatcaaaatcaatcgatcaatctttcaaaaattccgactacttccgaccgctcctccacttccgctccaaataacccactaaaactcatcgacaacgcgactctcctttaaacgacctcgctccactactcgaccgtctacgactacgcgtacgcaaaccgaataataaatttaattaaccgaaatttaaaacgcgcttaacccgcgtaaatcaactaatcgcgcactaaaaatacgatcccgaactccccattccttcctaaaacgcctccccgacccaaaaccaactaaatcccgatatcgacaaacctaaaatcgacgacgactactcttttcgttctatcgcctacccgataaacgaacctcccgaaaaacccctcaactataaaaaaaaaaaaaaaataccgaaaatacgaaaaaaacgaacgcaaaactctaaccccgctttcccaaaa

SEQ ID NO: 7125 - DNA, 642 bp, Artificial Sequence
  chemically treated genomic DNA (Homo sapiens) CpG-island No: 7125
gagaaagggagaaatttcgaaggaattttttttttttcggggttgggttttcgtatttacgtcgggtttggttttttaggttattttacgtgttcgggcgttcgtgttaattaggtttttttcggttgggttcgggtttaaaggttgttgttgcgtagggcgtttttatggtgtcgcgcggcgggcgggtttggattttaaattttcgcggttaattagtggcgcgtaggtttttgtaacgtttttagcgtcgcgtttgaattcggggaggagcggagcggtgcggaggttttgttcggatcgaggtttgtagcgtagtttcgggagtatgagtgttgtagtgattgtagggaagttggtacgggtatcggtcgattttgggaaagtcggggttttcggagttgtagttttcggagtttcggcggcggttttatcggcgaaagagatttcggaggttttagtggatttacgtagtcggcggcgttatgtgcggggtcgttttttgggtaagggcggttttgttaagtgtttcgagatttcggacgcggatattaagtgaggtgttcgcgaggtaagattgtgtttatagtttttgttgtttaagtcgtattagagggagaagatgtttatggaaatatttat

SEQ ID NO: 7126 - DNA, 642 bp, Artificial Sequence
  chemically treated genomic DNA (Homo sapiens) CpG-island No: 7126
ataaatatttccataaacatcttctccctctaatacgacttaaacaacaaaaactataaacacaatcttacctcgcgaacacctcacttaatatccgcgtccgaaatctcgaaacacttaacaaaaccgcccttacccaaaaaacgaccccgcacataacgccgccgactacgtaaatccactaaaacctccgaaatctctttcgccgataaaaccgccgccgaaactccgaaaactacaactccgaaaaccccgactttcccaaaatcgaccgatacccgtaccaacttccctacaatcactacaacactcatactcccgaaactacgctacaaacctcgatccgaacaaaacctccgcaccgctccgctcctccccgaattcaaacgcgacgctaaaaacgttacaaaaacctacgcgccactaattaaccgcgaaaatttaaaatccaaacccgcccgccgcgcgacaccataaaaacgccctacgcaacaacaacctttaaacccgaacccaaccgaaaaaaacctaattaacacgaacgcccgaacacgtaaaataacctaaaaaaccaaacccgacgtaaatacgaaaacccaaccccgaaaaaaaaaaaattccttcgaaatttctccctttctc

SEQ ID NO: 7127 - DNA, 642 bp, Artificial Sequence
  chemically treated genomic DNA (Homo sapiens) CpG-island No: 7127
atggatatttttatggatattttttttttttggtgcggtttgagtagtagagattataggtataattttgtttcgcgaatattttatttggtgttcgcgttcgagatttcgaagtatttggtaaagtcgtttttgtttaaaaagcggtttcgtatatagcgtcgtcggttgcgtgggtttattaggattttcgggatttttttcgtcggtggagtcgtcgtcggagtttcgggagttgtaatttcggggatttcggtttttttagggtcggtcggtgttcgtgttagtttttttgtagttattgtagtatttatgttttcgaagttgcgttgtagatttcgattcgagtagagttttcgtatcgtttcgttttttttcgaatttaaacgcggcgttgggaacgttataaaagtttgcgcgttattgattggtcgcggggatttaaaatttaaattcgttcgtcgcgcggtattatgggagcgttttgcgtagtagtagtttttaaattcggatttagtcggggaaaatttgattgatacggacgttcgaatacgtgggatagtttgggaaattaaattcggcgtggatgcggagatttagtttcgagagaggaggaattttttcggggtttttttttttttt

SEQ ID NO: 7128 - DNA, 642 bp, Artificial Sequence
  chemically treated genomic DNA (Homo sapiens) CpG-island No: 7128
aaaaaaaaaaaaaaccccgaaaaaattcctcctctctcgaaactaaatctccgcatccacgccgaatttaatttcccaaactatcccacgtattcgaacgtccgtatcaatcaaattttccccgactaaatccgaatttaaaaactactactacgcaaaacgctcccataataccgcgcgacgaacgaatttaaattttaaatccccgcgaccaatcaataacgcgcaaacttttataacgttcccaacgccgcgtttaaattcgaaaaaaaacgaaacgatacgaaaactctactcgaatcgaaatctacaacgcaacttcgaaaacataaatactacaataactacaaaaaaactaacacgaacaccgaccgaccctaaaaaaaccgaaatccccgaaattacaactcccgaaactccgacgacgactccaccgacgaaaaaaatcccgaaaatcctaataaacccacgcaaccgacgacgctatatacgaaaccgctttttaaacaaaaacgactttaccaaatacttcgaaatctcgaacgcgaacaccaaataaaatattcgcgaaacaaaattatacctataatctctactactcaaaccgcaccaaaaaaaaaaaatatccataaaaatatccat

SEQ ID NO: 7129 - DNA, 515 bp, Artificial Sequence
  chemically treated genomic DNA (Homo sapiens) CpG-island No: 7129
ggcgttgttatcgttgttggcgaacgggaaaattagttacgcgatgtacgatatttttcgtgaattgtattagtagattcgttgtaatgtcgatgagtaggcggtataagtcgttttggagttagtataatgatcgaatttgtttattcgtatacgtagttggttgcgggtgtggatgaagtcggacgcgggtcgttagttggcgcggtcgttatcgttgcggtgatttttgattcggcgcgttcgattgtcgggttgaatgattttaaaaagttgagcgaaaaacgtcgtttggcgttttatgaagagattaaagagaaagcgttgagttggagtttgggtcgcgcggaattttacgaaatcgacgagttgaatattttttatgcgattatgttggcgatgtagcgtgtcgtcgttgggttgtatattgcgtcggaatatgtgttgattgatggtaatcgttgttcgaaattatcgatgtttgcgatggttgtggtgaaaggcgatagtcgcgt

SEQ ID NO: 7130 - DNA, 515 bp, Artificial Sequence
  chemically treated genomic DNA (Homo sapiens) CpG-island No: 7130
acgcgactatcgcctttcaccacaaccatcgcaaacatcgataatttcgaacaacgattaccatcaatcaacacatattccgacgcaatatacaacccaacgacgacacgctacatcgccaacataatcgcataaaaaatattcaactcgtcgatttcgtaaaattccgcgcgacccaaactccaactcaacgctttctctttaatctcttcataaaacgccaaacgacgtttttcgctcaactttttaaaatcattcaacccgacaatcgaacgcgccgaatcaaaaatcaccgcaacgataacgaccgcgccaactaacgacccgcgtccgacttcatccacacccgcaaccaactacgtatacgaataaacaaattcgatcattatactaactccaaaacgacttataccgcctactcatcgacattacaacgaatctactaatacaattcacgaaaaatatcgtacatcgcgtaactaattttcccgttcgccaacaacgataacaacgcc

SEQ ID NO: 7131 - DNA, 515 bp, Artificial Sequence
  chemically treated genomic DNA (Homo sapiens) CpG-island No: 7131
acgcggttatcgttttttattatagttatcgtaggtatcggtaatttcgggtagcggttattattaattaatatatatttcggcgtaatatgtagtttagcgacggtacgttgtatcgttagtatggtcgtatgaagaatgtttagttcgtcgatttcgtggggtttcgcgcggtttagattttagtttaacgttttttttttgatttttttatagagcgttagacggcgtttttcgtttagttttttggaattatttagttcggtaatcgggcgcgtcgggttaaggattatcgtagcggtgacgatcgcgttaattaacggttcgcgttcgattttatttatattcgtaattagttgcgtgtgcggataaataaattcgattattgtgttaattttagaacggtttgtgtcgtttgtttatcggtattgtagcggatttgttgatgtagtttacggaaggtatcgtgtatcgcgtggttggttttttcgttcgttaatagcggtaatagcgtt

SEQ ID NO: 7132 - DNA, 515 bp, Artificial Sequence
  chemically treated genomic DNA (Homo sapiens) CpG-island No: 7132
aacgctattaccgctattaacgaacgaaaaaaccaaccacgcgatacacgataccttccgtaaactacatcaacaaatccgctacaataccgataaacaaacgacacaaaccgttctaaaattaacacaataatcgaatttatttatccgcacacgcaactaattacgaatataaataaaatcgaacgcgaaccgttaattaacgcgatcgtcaccgctacgataatccttaacccgacgcgcccgattaccgaactaaataattccaaaaaactaaacgaaaaacgccgtctaacgctctataaaaaaatcaaaaaaaaaacgttaaactaaaatctaaaccgcgcgaaaccccacgaaatcgacgaactaaacattcttcatacgaccatactaacgatacaacgtaccgtcgctaaactacatattacgccgaaatatatattaattaataataaccgctacccgaaattaccgatacctacgataactataataaaaaacgataaccgcgt

SEQ ID NO: 7133 - DNA, 768 bp, Artificial Sequence
  chemically treated genomic DNA (Homo sapiens) CpG-island No: 7133
atcgtggggttttgttatagaaattttagtagcgtagttatcggattgggttttggaggtcgagtcgtagttcgtgcggcggcgttgggaagagaaggcgtttcggtagtttttttgttatcggtttcgaggagcggttggtttttttagtttagcgtcgtcgtcgttcggtaattttaggcgtaattgggcgtaattggggtagttgcgatatcgaattttttatatttgtaatttgggtgttgcggttattgagaaaatggaggcgtagattaacgagcggtgtcgcgatcgagagatttcggttggcgaaatggtggtgtcgggagtttgcgagtgacgttagtcggcggggttgttaaggataatattcgttttgacgtagttaatggcgtcgttattaagaaattatcgattttgagaaaaaagagaggttcggttatcgagaaatttcgtacgataagtgttgtggtagaaaaatcgtttatttcgcgttataggtaaaatagttaatggaaattttaggtgttgcgatcgtgatatcggtattagagggtttcggatggagaaagcggcgtacggagattaggaaattatgtgtagtataattagtagaaaatcgtttggtcggttattcgggagaaagcgcggattagaaataagcgatttcgatgtagggaatcgcgtagttattgaagaaagtgatttacgtggtagtggtgttagcgaaatattgtagtttggacggtagttgtggggatgttatag

SEQ ID NO: 7134 - DNA, 768 bp, Artificial Sequence
  chemically treated genomic DNA (Homo sapiens) CpG-island No: 7134
ctataacatccccacaactaccgtccaaactacaatatttcgctaacaccactaccacgtaaatcactttcttcaataactacgcgattccctacatcgaaatcgcttatttctaatccgcgctttctcccgaataaccgaccaaacgattttctactaattatactacacataatttcctaatctccgtacgccgctttctccatccgaaaccctctaataccgatatcacgatcgcaacacctaaaatttccattaactattttacctataacgcgaaataaacgatttttctaccacaacacttatcgtacgaaatttctcgataaccgaacctctcttttttctcaaaatcgataatttcttaataacgacgccattaactacgtcaaaacgaatattatccttaacaaccccgccgactaacgtcactcgcaaactcccgacaccaccatttcgccaaccgaaatctctcgatcgcgacaccgctcgttaatctacgcctccattttctcaataaccgcaacacccaaattacaaatataaaaaattcgatatcgcaactaccccaattacgcccaattacgcctaaaattaccgaacgacgacgacgctaaactaaaaaaaccaaccgctcctcgaaaccgataacaaaaaaactaccgaaacgccttctcttcccaacgccgccgcacgaactacgactcgacctccaaaacccaatccgataactacgctactaaaatttctataacaaaaccccacgat

SEQ ID NO: 7135 - DNA, 768 bp, Artificial Sequence
  chemically treated genomic DNA (Homo sapiens) CpG-island No: 7135
ttgtggtatttttatagttgtcgtttaaattgtagtgtttcgttggtattattgttacgtgggttattttttttagtggttgcgcggttttttgtatcgaagtcgtttgtttttgattcgcgttttttttcggatggtcgattagacggttttttgttagttgtgttatatatagttttttggttttcgtgcgtcgttttttttattcgagattttttagtgtcggtgttacggtcgtagtatttggggtttttattggttgttttgtttgtggcgcggagtaggcggtttttttgttatagtatttgtcgtacggagtttttcggtggtcgaatttttttttttttttagagtcgatggttttttggtgacggcgttattggttgcgttaaaacgaatgttgtttttgataatttcgtcggttggcgttattcgtaggttttcggtattattatttcgttagtcgaggtttttcggtcgcggtatcgttcgttggtttgcgtttttatttttttagtggtcgtagtatttaggttgtagatgtgagggattcggtgtcgtagttgttttagttgcgtttagttgcgtttggagttatcgggcggcggcggcgttgggttgggggagttagtcgtttttcggggtcggtggtaggggagttgtcggggcgttttttttttttagcgtcgtcgtacggattgcggttcggtttttagaatttagttcggtggttgcgttgttggggtttttgtgataggattttacggt

SEQ ID NO: 7136 - DNA, 768 bp, Artificial Sequence
  chemically treated genomic DNA (Homo sapiens) CpG-island No: 7136
accgtaaaatcctatcacaaaaaccccaacaacgcaaccaccgaactaaattctaaaaaccgaaccgcaatccgtacgacgacgctaaaaaaaaaaaacgccccgacaactcccctaccaccgaccccgaaaaacgactaactcccccaacccaacgccgccgccgcccgataactccaaacgcaactaaacgcaactaaaacaactacgacaccgaatccctcacatctacaacctaaatactacgaccactaaaaaaataaaaacgcaaaccaacgaacgataccgcgaccgaaaaacctcgactaacgaaataataataccgaaaacctacgaataacgccaaccgacgaaattatcaaaaacaacattcgttttaacgcaaccaataacgccgtcaccaaaaaaccatcgactctaaaaaaaaaaaaaaattcgaccaccgaaaaactccgtacgacaaatactataacaaaaaaaccgcctactccgcgccacaaacaaaacaaccaataaaaaccccaaatactacgaccgtaacaccgacactaaaaaatctcgaataaaaaaaacgacgcacgaaaaccaaaaaactatatataacacaactaacaaaaaaccgtctaatcgaccatccgaaaaaaaacgcgaatcaaaaacaaacgacttcgatacaaaaaaccgcgcaaccactaaaaaaaataacccacgtaacaataataccaacgaaacactacaatttaaacgacaactataaaaataccacaa

SEQ ID NO: 7137 - DNA, 610 bp, Artificial Sequence
  chemically treated genomic DNA (Homo sapiens) CpG-island No: 7137
gttatggtacgttgttttcggttttagttagcgtattggtatattgtcgttagtaaataggttaagtaggggtttttgttgattcgttttcgttatcgaatttagtgaggtagtatcgtttattaattgataattacgcgtttgtgtttgtttacgtagcgtttttttttgttatttattagcggttgtcgttttagtaaaggtttttgcgtcgtcgttaagcgtaacgtcggtacgagcgttaagtagttgttcggtaatcgattttttttcgtttttttttagagcgttattcggatattttttattggtcgcgttcggatcgtagtatttgcgcgaggttatatgtgttattagcgtagcgggcgtggtattttgtaattttgcggtagaaacgttatcggtcgttagatttgcggtttttgttatttttagaatcgttgggtgatttttttcgtgaatatcgacgtttagcgcgtcgttataggttttgatatcggttgattaggcggttgttgatgtagtcgagtcggtgacgtagttcggtttgtcggtttttttatttagcgtatagtgagtgtattgttcggtaagcggtaaggtatttata

SEQ ID NO: 7138 - DNA, 610 bp, Artificial Sequence
  chemically treated genomic DNA (Homo sapiens) CpG-island No: 7138
tataaataccttaccgcttaccgaacaatacactcactatacgctaaataaaaaaaccgacaaaccgaactacgtcaccgactcgactacatcaacaaccgcctaatcaaccgatatcaaaacctataacgacgcgctaaacgtcgatattcacgaaaaaaatcacccaacgattctaaaaataacaaaaaccgcaaatctaacgaccgataacgtttctaccgcaaaattacaaaataccacgcccgctacgctaataacacatataacctcgcgcaaatactacgatccgaacgcgaccaataaaaaatatccgaataacgctctaaaaaaaaacgaaaaaaaatcgattaccgaacaactacttaacgctcgtaccgacgttacgcttaacgacgacgcaaaaacctttactaaaacgacaaccgctaataaataacaaaaaaaaacgctacgtaaacaaacacaaacgcgtaattatcaattaataaacgatactacctcactaaattcgataacgaaaacgaatcaacaaaaacccctacttaacctatttactaacgacaatataccaatacgctaactaaaaccgaaaacaacgtaccataac

SEQ ID NO: 7139 - DNA, 610 bp, Artificial Sequence
  chemically treated genomic DNA (Homo sapiens) CpG-island No: 7139
tatagatgttttatcgtttatcgggtaatatatttattatgcgttgaataaaaaaatcggtaaatcggattacgttatcgattcggttgtattagtaatcgtttggttaatcggtgttaaaatttataacggcgcgttgggcgtcgatatttacgaaaaagattatttaacgattttggaaatggtaaaagtcgtaggtttggcgatcggtaacgtttttatcgtagagttgtaggatgttacgttcgttgcgttggtggtatatgtgatttcgcgtaaatgttacggttcgagcgcgattagtgaaaaatgttcgggtaacgttttggaaaaaggcggaaaaggatcgattatcgaatagttgtttaacgttcgtgtcgacgttacgtttggcggcggcgtaaaaatttttgttgaaacggtaatcgttggtgaatggtagggaaaaacgttgcgtgaataggtataggcgcgtggttattagttggtgagcgatgttgttttattgaattcggtgacggaagcgaattagtaaaaatttttgtttggtttgtttgttgacggtaatatgttagtgcgttggttaggatcgaaagtaacgtattatggt

SEQ ID NO: 7140 - DNA, 610 bp, Artificial Sequence
  chemically treated genomic DNA (Homo sapiens) CpG-island No: 7140
accataatacgttactttcgatcctaaccaacgcactaacatattaccgtcaacaaacaaaccaaacaaaaatttttactaattcgcttccgtcaccgaattcaataaaacaacatcgctcaccaactaataaccacgcgcctatacctattcacgcaacgtttttccctaccattcaccaacgattaccgtttcaacaaaaatttttacgccgccgccaaacgtaacgtcgacacgaacgttaaacaactattcgataatcgatccttttccgcctttttccaaaacgttacccgaacatttttcactaatcgcgctcgaaccgtaacatttacgcgaaatcacatataccaccaacgcaacgaacgtaacatcctacaactctacgataaaaacgttaccgatcgccaaacctacgacttttaccatttccaaaatcgttaaataatctttttcgtaaatatcgacgcccaacgcgccgttataaattttaacaccgattaaccaaacgattactaatacaaccgaatcgataacgtaatccgatttaccgatttttttattcaacgcataataaatatattacccgataaacgataaaacatctata

SEQ ID NO: 7141 - DNA, 615 bp, Artificial Sequence
  chemically treated genomic DNA (Homo sapiens) CpG-island No: 7141
  misc_feature (214)..(214): n is either a, c, g or t
gcgtaacgttttcggagcgttattattttttgtgatagtttcggcggtaggagttttttaatggcgtaggtgtcgagtagatttagcgtttggtcggttaatttacgtagcgtggtttgttttacgtttttcgttgttggataaatcggcgtgagcgttttttgtaattttggcgtgttgagatcgttttgtacgcggtatttcgggtggatanttttcgtattatatttatcgcgttttgtttcgttataagttagtatacggcggttcgtcgttaggttattttttattgtcgcgttgaaattgaaaaagcgtatggtgaggatgtcggaatcgtcgttgatttggtaggttattattcgtcgatcgtcgaaggagatattgtagtttagtatttcgttttttatcgtggtataaacgttcggtagtagtttttcgatggggtagagatgggtgcgattttcgtagcgtaggggaaggtgtaagagtagattttgtacggtatgtaggttgattttcgttagtttgttattaagtgttgcgttaacgttcgttagggaattgagtgggatagtatttaataggcgattttttatggtatttattttgtagttt

SEQ ID NO: 7142 - DNA, 615 bp, Artificial Sequence
  chemically treated genomic DNA (Homo sapiens) CpG-island No: 7142
  misc_feature (402)..(402): n is either a, c, g or t
aaactacaaaataaataccataaaaaatcgcctattaaatactatcccactcaattccctaacgaacgttaacgcaacacttaataacaaactaacgaaaatcaacctacataccgtacaaaatctactcttacaccttcccctacgctacgaaaatcgcacccatctctaccccatcgaaaaactactaccgaacgtttataccacgataaaaaacgaaatactaaactacaatatctccttcgacgatcgacgaataataacctaccaaatcaacgacgattccgacatcctcaccatacgctttttcaatttcaacgcgacaataaaaaataacctaacgacgaaccgccgtatactaacttataacgaaacaaaacgcgataaatataatacgaaaantatccacccgaaataccgcgtacaaaacgatctcaacacgccaaaattacaaaaaacgctcacgccgatttatccaacaacgaaaaacgtaaaacaaaccacgctacgtaaattaaccgaccaaacgctaaatctactcgacacctacgccattaaaaaactcctaccgccgaaactatcacaaaaaataataacgctccgaaaacgttacgc

SEQ ID NO: 7143 - DNA, 615 bp, Artificial Sequence
  chemically treated genomic DNA (Homo sapiens) CpG-island No: 7143
  misc_feature (402)..(402): n is either a, c, g or t
aggttgtagggtaagtgttatgaaaggtcgtttgttagatgttgttttatttagttttttaacgggcgttggcgtagtatttagtaataaattggcgaaaattaatttgtatatcgtgtaggatttatttttatatttttttttgcgttacgaagatcgtatttatttttattttatcggagaattattgtcgggcgtttatgttacggtggaaggcgaagtgttgaattgtaatatttttttcggcggtcggcggatgatgatttgttagattagcgacggtttcggtatttttattatgcgtttttttaattttagcgcggtaatgaaaaatagtttggcggcgggtcgtcgtgtattggtttatggcgaagtaaagcgcggtaaatatggtgcggagantatttattcggaatatcgcgtgtagggcgattttagtacgttagaattataggaaacgtttacgtcggtttatttaataacggaaggcgtaaagtaggttacgttgcgtaaattaatcgattaggcgttggatttgttcgatatttgcgttattgaagaatttttgtcgtcggaattgttataaggaatgatgacgtttcggaagcgttgcgt

SEQ ID NO: 7144 - DNA, 615 bp, Artificial Sequence
  chemically treated genomic DNA (Homo sapiens) CpG-island No: 7144
  misc_feature (214)..(214): n is either a, c, g or t
acgcaacgcttccgaaacgtcatcattccttataacaattccgacgacaaaaattcttcaataacgcaaatatcgaacaaatccaacgcctaatcgattaatttacgcaacgtaacctactttacgccttccgttattaaataaaccgacgtaaacgtttcctataattctaacgtactaaaatcgccctacacgcgatattccgaataaatantctccgcaccatatttaccgcgctttacttcgccataaaccaatacacgacgacccgccgccaaactatttttcattaccgcgctaaaattaaaaaaacgcataataaaaataccgaaaccgtcgctaatctaacaaatcatcatccgccgaccgccgaaaaaaatattacaattcaacacttcgccttccaccgtaacataaacgcccgacaataattctccgataaaataaaaataaatacgatcttcgtaacgcaaaaaaaaatataaaaataaatcctacacgatatacaaattaattttcgccaatttattactaaatactacgccaacgcccgttaaaaaactaaataaaacaacatctaacaaacgacctttcataacacttaccctacaacct

SEQ ID NO: 7145 - DNA, 664 bp, Artificial Sequence
  chemically treated genomic DNA (Homo sapiens) CpG-island No: 7145
gtaggcggtaatcgtttattaggatagttatgtggagacgtagcgggttgttatttaggagcgggagaagtagtttcggttgtagtcgacgcgtgggaatttgttgttggagtaggagcggtaacgtaatttcgagaagtagcgggaggagcgcgcggttttggagaagttgtagagttagttgcggtacgagtagtagcgttgggagcgcgagcgttagtggtagtattaggagttggagcgtgcgggcgcgcggttgtaggagcgcgagggcgaggcgcggtagttacgcgagcggttggagtaggagcgggtcgagttggagcgttagcgttaggtttattagtacgatttggagcggttgcgcgaggtttagcgtgtcgtggagcgcgagcgggagcgtttggagttgttgcgtcgttttaagaagtagaatatcgcgttaggcgcgttgtcgttcgatatattggtcgaggtgagcgcgtagtagttagtgtgcgtaggttgggggtgatcggtttgtacgtgtatttgtacgagtgtatgtaggtgatagggttcgcgggtgtatgcgtgtaggagtgtaagagtaaacggtataagatatttttgtattaatagtttatgtcgtagtatagatttttttcggagttggttaaatgtt

SEQ ID NO: 7146 - DNA, 664 bp, Artificial Sequence
  chemically treated genomic DNA (Homo sapiens) CpG-island No: 7146
aacatttaaccaactccgaaaaaaatctatactacgacataaactattaatacaaaaatatcttataccgtttactcttacactcctacacgcatacacccgcgaaccctatcacctacatacactcgtacaaatacacgtacaaaccgatcacccccaacctacgcacactaactactacgcgctcacctcgaccaatatatcgaacgacaacgcgcctaacgcgatattctacttcttaaaacgacgcaacaactccaaacgctcccgctcgcgctccacgacacgctaaacctcgcgcaaccgctccaaatcgtactaataaacctaacgctaacgctccaactcgacccgctcctactccaaccgctcgcgtaactaccgcgcctcgccctcgcgctcctacaaccgcgcgcccgcacgctccaactcctaatactaccactaacgctcgcgctcccaacgctactactcgtaccgcaactaactctacaacttctccaaaaccgcgcgctcctcccgctacttctcgaaattacgttaccgctcctactccaacaacaaattcccacgcgtcgactacaaccgaaactacttctcccgctcctaaataacaacccgctacgtctccacataactatcctaataaacgattaccgcctac

SEQ ID NO: 7147 - DNA, 664 bp, Artificial Sequence
  chemically treated genomic DNA (Homo sapiens) CpG-island No: 7147
agtatttagttagtttcgagaaaggtttgtattgcggtatgagttgttaatgtaagggtattttgtgtcgtttgtttttatatttttgtacgtatgtattcgcgaattttgttatttgtatgtattcgtgtaaatgtacgtgtaaatcggttatttttaatttgcgtatattggttgttgcgcgtttatttcggttagtgtgtcgggcggtagcgcgtttggcgcggtgttttgttttttgaggcggcgtagtagttttaggcgttttcgttcgcgttttacggtacgttgggtttcgcgtagtcgttttaggtcgtgttggtaggtttggcgttggcgttttagttcggttcgtttttgttttagtcgttcgcgtagttgtcgcgtttcgttttcgcgtttttgtagtcgcgcgttcgtacgttttagtttttggtgttgttattggcgttcgcgtttttagcgttgttgttcgtgtcgtagttggttttgtagtttttttagggtcgcgcgtttttttcgttgtttttcgaagttgcgttgtcgtttttgttttagtagtaggtttttacgcgtcgattgtagtcggaattgtttttttcgtttttggatggtagttcgttgcgtttttatatagttgttttggtgggcgattatcgtttgt

SEQ ID NO: 7148 - DNA, 664 bp, Artificial Sequence
  chemically treated genomic DNA (Homo sapiens) CpG-island No: 7148
acaaacgataatcgcccaccaaaacaactatataaaaacgcaacgaactaccatccaaaaacgaaaaaaacaattccgactacaatcgacgcgtaaaaacctactactaaaacaaaaacgacaacgcaacttcgaaaaacaacgaaaaaaacgcgcgaccctaaaaaaactacaaaaccaactacgacacgaacaacaacgctaaaaacgcgaacgccaataacaacaccaaaaactaaaacgtacgaacgcgcgactacaaaaacgcgaaaacgaaacgcgacaactacgcgaacgactaaaacaaaaacgaaccgaactaaaacgccaacgccaaacctaccaacacgacctaaaacgactacgcgaaacccaacgtaccgtaaaacgcgaacgaaaacgcctaaaactactacgccgcctcaaaaaacaaaacaccgcgccaaacgcgctaccgcccgacacactaaccgaaataaacgcgcaacaaccaatatacgcaaattaaaaataaccgatttacacgtacatttacacgaatacatacaaataacaaaattcgcgaatacatacgtacaaaaatataaaaacaaacgacacaaaatacccttacattaacaactcataccgcaatacaaacctttctcgaaactaactaaatact

SEQ ID NO: 7149 - DNA, 506 bp, Artificial Sequence
  chemically treated genomic DNA (Homo sapiens) CpG-island No: 7149
tagagcgcgtcggcgttaggatttagcgattgttttcgatttagagggcgtcggtagaggtacgtatgcgcgttgtttcggtaggggttgtcgtggcgtagggggcgggattagaggcggttacgtgaggggttttgggttatcgggttacgtgatcgaggtatagattagttgatgtcggagggtttgaagtcgcgtcgcgagggagcgaggtcgtagtgatagcggcgggcgatcggatttaggttgtttcgtcgtattcgtttgcgtttcgcgttttcgttttagtatgatagtttcggcgggttcgcgcggtttaggtgagggcgcgggcggtatcgtggggtttcgaatttaggcgggcgggttgtgttttttatttggggcggcggagtttttagtttttttttttttaagttttagcgttgattttttacggtggagaaaagggtagacggtttttagaatttgggcggcgggtgggtattagtttttttaattttttt

SEQ ID NO: 7150 - DNA, 506 bp, Artificial Sequence
  chemically treated genomic DNA (Homo sapiens) CpG-island No: 7150
aaaaaaattaaaaaaactaatacccacccgccgcccaaattctaaaaaccgtctacccttttctccaccgtaaaaaatcaacgctaaaacttaaaaaaaaaaaaactaaaaactccgccgccccaaataaaaaacacaacccgcccgcctaaattcgaaaccccacgataccgcccgcgccctcacctaaaccgcgcgaacccgccgaaactatcatactaaaacgaaaacgcgaaacgcaaacgaatacgacgaaacaacctaaatccgatcgcccgccgctatcactacgacctcgctccctcgcgacgcgacttcaaaccctccgacatcaactaatctatacctcgatcacgtaacccgataacccaaaacccctcacgtaaccgcctctaatcccgccccctacgccacgacaacccctaccgaaacaacgcgcatacgtacctctaccgacgccctctaaatcgaaaacaatcgctaaatcctaacgccgacgcgctcta

SEQ ID NO: 7151 - DNA, 506 bp, Artificial Sequence
  chemically treated genomic DNA (Homo sapiens) CpG-island No: 7151
ggaagaattggagaggttggtgtttattcgtcgtttaagttttaggagtcgtttgtttttttttttatcgtgaaaagttagcgttggagtttagaaaaaaagagattaggagtttcgtcgttttaggtgggagatatagttcgttcgtttgagttcggggttttacggtgtcgttcgcgtttttatttgagtcgcgcggattcgtcggggttgttatgttggggcgggagcgcgggacgtaggcgggtacggcggggtagtttgggttcgatcgttcgtcgttgttattgcgatttcgttttttcgcggcgcggttttaaatttttcggtattagttgatttgtgtttcggttacgtgattcggtagtttagagttttttacgtgatcgtttttggtttcgttttttgcgttacgataatttttgtcggaatagcgcgtatgcgtgtttttgtcggcgttttttgggtcgaaggtagtcgttaggttttagcgtcgacgcgttttg

SEQ ID NO: 7152 - DNA, 506 bp, Artificial Sequence
  chemically treated genomic DNA (Homo sapiens) CpG-island No: 7152
caaaacgcgtcgacgctaaaacctaacgactaccttcgacccaaaaaacgccgacaaaaacacgcatacgcgctattccgacaaaaattatcgtaacgcaaaaaacgaaaccaaaaacgatcacgtaaaaaactctaaactaccgaatcacgtaaccgaaacacaaatcaactaataccgaaaaatttaaaaccgcgccgcgaaaaaacgaaatcgcaataacaacgacgaacgatcgaacccaaactaccccgccgtacccgcctacgtcccgcgctcccgccccaacataacaaccccgacgaatccgcgcgactcaaataaaaacgcgaacgacaccgtaaaaccccgaactcaaacgaacgaactatatctcccacctaaaacgacgaaactcctaatctctttttttctaaactccaacgctaacttttcacgataaaaaaaaaaacaaacgactcctaaaacttaaacgacgaataaacaccaacctctccaattcttcc

SEQ ID NO: 7153 - DNA, 519 bp, Artificial Sequence
  chemically treated genomic DNA (Homo sapiens) CpG-island No: 7153
tcgtttagttggaattaatcgatggaggtttcgttgtaaattggaatggtaaggggtggggcggagatcgggtaggtgtcggcgtggggcgttaagaggattataattttcggcgtgtttagcgcgtattacgtggtttggcgataacgcgttgcgttcgttcgggcggaattacgtttttcggtatgtattgcgggtcgtcgggttttagggaagagtcgcgttttcggggagggagtagtattggtttattttgtagatggggatatcgagttacgggttggttacgaatttttcgggggcgaaggtggcggagagggatgggttttaggacgttttggcgttcggggaaggttcggcgggacggatttgcggtgcgtagttagtgtcgttcgttttttaggtgtttggcgtgatgatcggggtcggagtggcggtggtggttacggtcgtgtttatttttttggtggtgcggaggttgcgagtgttaagtgagtattcgaggggttttttttggga

SEQ ID NO: 7154 - DNA, 519 bp, Artificial Sequence
  chemically treated genomic DNA (Homo sapiens) CpG-island No: 7154
tcccaaaaaaaacccctcgaatactcacttaacactcgcaacctccgcaccaccaaaaaaataaacacgaccgtaaccaccaccgccactccgaccccgatcatcacgccaaacacctaaaaaacgaacgacactaactacgcaccgcaaatccgtcccgccgaaccttccccgaacgccaaaacgtcctaaaacccatccctctccgccaccttcgcccccgaaaaattcgtaaccaacccgtaactcgatatccccatctacaaaataaaccaatactactccctccccgaaaacgcgactcttccctaaaacccgacgacccgcaatacataccgaaaaacgtaattccgcccgaacgaacgcaacgcgttatcgccaaaccacgtaatacgcgctaaacacgccgaaaattataatcctcttaacgccccacgccgacacctacccgatctccgccccaccccttaccattccaatttacaacgaaacctccatcgattaattccaactaaacga

SEQ ID NO: 7155 - DNA, 519 bp, Artificial Sequence
  chemically treated genomic DNA (Homo sapiens) CpG-island No: 7155
ttttaagaggggtttttcgggtgtttatttggtattcgtagttttcgtattattaggaggatgagtacggtcgtgattattatcgttatttcggtttcgattattacgttaagtatttgagggacgaacggtattggttgcgtatcgtaaattcgtttcgtcgagtttttttcgggcgttaggacgttttggaatttattttttttcgttattttcgttttcgaggagttcgtagttagttcgtgattcgatgtttttatttgtagaatgggttagtgttgtttttttttcgggggcgcgatttttttttgaggttcggcggttcgtagtgtatgtcgggaaacgtagtttcgttcgagcggacgtagcgcgttatcgttagattacgtaatgcgcgttgagtacgtcgggagttgtagtttttttggcgttttacgtcggtatttattcggttttcgttttattttttattattttagtttgtagcggagtttttatcggttgattttagttggacgg

SEQ ID NO: 7156 - DNA, 519 bp, Artificial Sequence
  chemically treated genomic DNA (Homo sapiens) CpG-island No: 7156
ccgtccaactaaaatcaaccgataaaaactccgctacaaactaaaataataaaaaataaaacgaaaaccgaataaataccgacgtaaaacgccaaaaaaactacaactcccgacgtactcaacgcgcattacgtaatctaacgataacgcgctacgtccgctcgaacgaaactacgtttcccgacatacactacgaaccgccgaacctcaaaaaaaaatcgcgcccccgaaaaaaaaacaacactaacccattctacaaataaaaacatcgaatcacgaactaactacgaactcctcgaaaacgaaaataacgaaaaaaaataaattccaaaacgtcctaacgcccgaaaaaaactcgacgaaacgaatttacgatacgcaaccaataccgttcgtccctcaaatacttaacgtaataatcgaaaccgaaataacgataataatcacgaccgtactcatcctcctaataatacgaaaactacgaataccaaataaacacccgaaaaacccctcttaaaa

SEQ ID NO: 7157 - DNA, 615 bp, Artificial Sequence
  chemically treated genomic DNA (Homo sapiens) CpG-island No: 7157
cgcgttcgtgttcgatgtttcggttggatttttttaaggtttcgtatttttcgttggggtttgatttgcggttgtacgagggtattatgcgtattacgtcgtatcgggattttgtttattcggttgttattcgggagtcgtcgagtttgtagtcgtcgttcgcgttgttttttttaatggattcgcgttgggatcgggaagagcgcgtgtcggaggcgtatcgcgcgttttcgtcgttatttacgtcgtcgtgggagttgttgtaagcgtaggcgcgggaacgtacgttcgttatgtaggtcggtaatttgtatttgtacgaggacgcgtacgtcgggatcggtttttttaacgcgtacgtcgtttacggttggttcgagttgtcggcgcgtattcgagagcggattcgcggcgcgcgttttattttcgatcgcgattttttgttttttggcgatcgcgataagttgcgtatttcgtttattacgtattaggcgttttttttattttacgacgcgcgttcgtagtttcgcgcgtttagttgttatttcggtgagcgcgcgttcgggttgagtgggcgatttgttttatattgtggtttttaaataggggtaaggg

SEQ ID NO: 7158 - DNA, 615 bp, Artificial Sequence
  chemically treated genomic DNA (Homo sapiens) CpG-island No: 7158
cccttacccctatttaaaaaccacaatataaaacaaatcgcccactcaacccgaacgcgcgctcaccgaaataacaactaaacgcgcgaaactacgaacgcgcgtcgtaaaataaaaaaaacgcctaatacgtaataaacgaaatacgcaacttatcgcgatcgccaaaaaacaaaaaatcgcgatcgaaaataaaacgcgcgccgcgaatccgctctcgaatacgcgccgacaactcgaaccaaccgtaaacgacgtacgcgttaaaaaaaccgatcccgacgtacgcgtcctcgtacaaatacaaattaccgacctacataacgaacgtacgttcccgcgcctacgcttacaacaactcccacgacgacgtaaataacgacgaaaacgcgcgatacgcctccgacacgcgctcttcccgatcccaacgcgaatccattaaaaaaaacaacgcgaacgacgactacaaactcgacgactcccgaataacaaccgaataaacaaaatcccgatacgacgtaatacgcataataccctcgtacaaccgcaaatcaaaccccaacgaaaaatacgaaaccttaaaaaaatccaaccgaaacatcgaacacgaacgcg

SEQ ID NO: 7159 - DNA, 615 bp, Artificial Sequence
  chemically treated genomic DNA (Homo sapiens) CpG-island No: 7159
tttttgtttttgtttgagaattataatgtgaagtaaatcgtttatttagttcgggcgcgcgtttatcgaggtggtaattgggcgcgcgaggttgcgggcgcgcgtcgtggggtggaaagagcgtttggtgcgtggtgggcgggatgcgtaatttgtcgcggtcgttaggaggtagggagtcgcggtcgaagatgaggcgcgcgtcgcggattcgttttcgggtgcgcgtcggtagttcgggttagtcgtaggcggcgtgcgcgttggagaggtcgatttcggcgtgcgcgttttcgtgtaggtgtaggttgtcggtttgtatggcgagcgtgcgttttcgcgtttgcgtttgtagtagtttttacggcggcgtggatggcggcgggaacgcgcggtgcgttttcgatacgcgtttttttcggttttagcgcgggtttattgggaaaagtagcgcgggcggcggttgtaggttcggcggttttcgggtggtagtcgggtaggtaaagtttcggtgcgacgtggtgcgtatggtgttttcgtgtagtcgtaggttaggttttagcgagaagtgcgaggttttgaggaagtttagtcgggatatcgggtacgggcgcg

SEQ ID NO: 7160 - DNA, 615 bp, Artificial Sequence
  chemically treated genomic DNA (Homo sapiens) CpG-island No: 7160
cgcgcccgtacccgatatcccgactaaacttcctcaaaacctcgcacttctcgctaaaacctaacctacgactacacgaaaacaccatacgcaccacgtcgcaccgaaactttacctacccgactaccacccgaaaaccgccgaacctacaaccgccgcccgcgctacttttcccaataaacccgcgctaaaaccgaaaaaaacgcgtatcgaaaacgcaccgcgcgttcccgccgccatccacgccgccgtaaaaactactacaaacgcaaacgcgaaaacgcacgctcgccatacaaaccgacaacctacacctacacgaaaacgcgcacgccgaaatcgacctctccaacgcgcacgccgcctacgactaacccgaactaccgacgcgcacccgaaaacgaatccgcgacgcgcgcctcatcttcgaccgcgactccctacctcctaacgaccgcgacaaattacgcatcccgcccaccacgcaccaaacgctctttccaccccacgacgcgcgcccgcaacctcgcgcgcccaattaccacctcgataaacgcgcgcccgaactaaataaacgatttacttcacattataattctcaaacaaaaacaaaaa

SEQ ID NO: 7161 - DNA, 684 bp, Artificial Sequence
  chemically treated genomic DNA (Homo sapiens) CpG-island No: 7161
tgttcggattgcgggcgagtttttcgtcgatagtttcgggttgagttagtatcgacgtacgtatagcggcgagaagtcgtatcgttgtttcgattgcgggaagttttttagttacggtgttattttggtttagtatcgtggtatttatattggggcgcggtcgtattagtgcgcggtttgcggtaaggttttcggttggcgttttacgttgttgaaatatcgtagtagttatagcggggagaagtcgtattattgttcggtgtgtggtaaggttttcgggtacggttcgtttttggtatagtatttgcgtacgtacggcggttcgcggttttataagtgttcggtgtgcgttaagggtttcggttagtgttttgcgttgtttaaatatttgcgtacgtatacgggcgagcggttttattcgtgttcgtagtgcggtaaggttttcgggtagagttcggcgttgttgtagtattagcgtatatatacggtcgagcgtttttatcgttgtttttattgcggtaaagttttcgggtagagttttaatttgtaatattatttgcgtatttatacgggcgagcggttttacgtttgttcgtattgttttaaggttttcggttagagtttagcgttgttttagtatttgtacgtgtattcgggcgagcgtttttatcgttgttagttttg

SEQ ID NO: 7162 - DNA, 684 bp, Artificial Sequence
  chemically treated genomic DNA (Homo sapiens) CpG-island No: 7162
caaaactaacaacgataaaaacgctcgcccgaatacacgtacaaatactaaaacaacgctaaactctaaccgaaaaccttaaaacaatacgaacaaacgtaaaaccgctcgcccgtataaatacgcaaataatattacaaattaaaactctacccgaaaactttaccgcaataaaaacaacgataaaaacgctcgaccgtatatatacgctaatactacaacaacgccgaactctacccgaaaaccttaccgcactacgaacacgaataaaaccgctcgcccgtatacgtacgcaaatatttaaacaacgcaaaacactaaccgaaacccttaacgcacaccgaacacttataaaaccgcgaaccgccgtacgtacgcaaatactataccaaaaacgaaccgtacccgaaaaccttaccacacaccgaacaataatacgacttctccccgctataactactacgatatttcaacaacgtaaaacgccaaccgaaaaccttaccgcaaaccgcgcactaatacgaccgcgccccaatataaataccacgatactaaaccaaaataacaccgtaactaaaaaacttcccgcaatcgaaacaacgatacgacttctcgccgctatacgtacgtcgatactaactcaacccgaaactatcgacgaaaaactcgcccgcaatccgaaca

SEQ ID NO: 7163 - DNA, 684 bp, Artificial Sequence
  chemically treated genomic DNA (Homo sapiens) CpG-island No: 7163
tagagttgatagcgatagggacgttcgttcgaatgtacgtgtaggtgttggagtagcgttgagttttggtcgaaggttttggagtagtgcgggtaggcgtagggtcgttcgttcgtgtggatgcgtaggtggtgttgtaagttggagttttgttcgaaggttttgtcgtagtgggggtagcggtaggggcgttcggtcgtgtgtgtgcgttggtgttgtagtagcgtcgagttttgttcgaaggttttgtcgtattgcggatacgggtagggtcgttcgttcgtgtgcgtgcgtaggtgtttgagtagcgtagagtattggtcgaagtttttggcgtatatcgggtatttgtggggtcgcgggtcgtcgtgcgtgcgtaggtgttgtgttaggagcgagtcgtgttcgaaggttttgttatatatcgggtagtggtgcggttttttttcgttgtggttgttgcgatgttttagtagcgtggagcgttagtcgaaggttttgtcgtaggtcgcgtattggtacggtcgcgttttagtgtggatgttacggtgttgagttagggtggtatcgtggttgaaggatttttcgtagtcggggtagcggtacggtttttcgtcgttgtgcgtgcgtcgatgttggtttagttcggagttgtcggcggaaggttcgttcgtaattcgggta

SEQ ID NO: 7164 - DNA, 684 bp, Artificial Sequence
  chemically treated genomic DNA (Homo sapiens) CpG-island No: 7164
tacccgaattacgaacgaaccttccgccgacaactccgaactaaaccaacatcgacgcacgcacaacgacgaaaaaccgtaccgctaccccgactacgaaaaatccttcaaccacgataccaccctaactcaacaccgtaacatccacactaaaacgcgaccgtaccaatacgcgacctacgacaaaaccttcgactaacgctccacgctactaaaacatcgcaacaaccacaacgaaaaaaaaccgcaccactacccgatatataacaaaaccttcgaacacgactcgctcctaacacaacacctacgcacgcacgacgacccgcgaccccacaaatacccgatatacgccaaaaacttcgaccaatactctacgctactcaaacacctacgcacgcacacgaacgaacgaccctacccgtatccgcaatacgacaaaaccttcgaacaaaactcgacgctactacaacaccaacgcacacacacgaccgaacgcccctaccgctacccccactacgacaaaaccttcgaacaaaactccaacttacaacaccacctacgcatccacacgaacgaacgaccctacgcctacccgcactactccaaaaccttcgaccaaaactcaacgctactccaacacctacacgtacattcgaacgaacgtccctatcgctatcaactcta

SEQ ID NO: 7165 - DNA, 504 bp, Artificial Sequence
  chemically treated genomic DNA (Homo sapiens) CpG-island No: 7165
ttagttatcgacgatgtagcgtggcgtattgattgtttcggtgaatacgtttatgtagcgcgtttgtttatatagttttttttacggttatgcgttggtgatgaaaaaaggttagcgtttgttacgagatgtattacgaatttaattggatagcgtcggttatcgttatgttgattaggtgatggagtacggcgaatacgttacgcgcggcgcgttgttggattttttttcgatggggagtgagttgttttatcgttttgatttttttgatgatgaaatcgatagtttgcgggtgtttgacgtcgatagttagcgtacgttggaggaagtagaagcgattaatttgttgttcgcgtacgaattttcgatcgataaagcggtaattgaattgtttcgtagttagtggcgcgatattttcgaagtgaagcgcgatttagaatatatttattaataaggggagtagaggtatattatttgtcgggatcgaatattggtagttattgt

SEQ ID NO: 7166 - DNA, 504 bp, Artificial Sequence
  chemically treated genomic DNA (Homo sapiens) CpG-island No: 7166
acaataactaccaatattcgatcccgacaaataatatacctctactccccttattaataaatatattctaaatcgcgcttcacttcgaaaatatcgcgccactaactacgaaacaattcaattaccgctttatcgatcgaaaattcgtacgcgaacaacaaattaatcgcttctacttcctccaacgtacgctaactatcgacgtcaaacacccgcaaactatcgatttcatcatcaaaaaaatcaaaacgataaaacaactcactccccatcgaaaaaaaatccaacaacgcgccgcgcgtaacgtattcgccgtactccatcacctaatcaacataacgataaccgacgctatccaattaaattcgtaatacatctcgtaacaaacgctaaccttttttcatcaccaacgcataaccgtaaaaaaaactatataaacaaacgcgctacataaacgtattcaccgaaacaatcaatacgccacgctacatcgtcgataactaa

SEQ ID NO: 7167 - DNA, 504 bp, Artificial Sequence
  chemically treated genomic DNA (Homo sapiens) CpG-island No: 7167
ataatggttgttagtattcgatttcggtaggtaatgtgtttttattttttttgttggtaaatatgttttggatcgcgttttatttcgaaggtatcgcgttattggttgcggaatagtttaattgtcgttttatcggtcggaaattcgtgcgcgggtagtagattgatcgtttttattttttttagcgtgcgttggttgtcgacgttaaatattcgtaggttgtcgattttattattaaagaaattaagacgataaggtagtttattttttatcgggaagagatttagtaacgcgtcgcgcgtggcgtattcgtcgtgttttattatttggttaatatggcgataatcggcgttgtttagttgggttcgtaatgtatttcgtgataggcgttgatttttttttattattagcgtatgatcgtggagaaaattgtgtgggtaaacgcgttgtataagcgtatttatcggaataattagtacgttacgttgtatcgtcggtagttgg

SEQ ID NO: 7168 - DNA, 504 bp, Artificial Sequence
  chemically treated genomic DNA (Homo sapiens) CpG-island No: 7168
ccaactaccgacgatacaacgtaacgtactaattattccgataaatacgcttatacaacgcgtttacccacacaattttctccacgatcatacgctaataataaaaaaaaatcaacgcctatcacgaaatacattacgaacccaactaaacaacgccgattatcgccatattaaccaaataataaaacacgacgaatacgccacgcgcgacgcgttactaaatctcttcccgataaaaaataaactaccttatcgtcttaatttctttaataataaaatcgacaacctacgaatatttaacgtcgacaaccaacgcacgctaaaaaaaataaaaacgatcaatctactacccgcgcacgaatttccgaccgataaaacgacaattaaactattccgcaaccaataacgcgataccttcgaaataaaacgcgatccaaaacatatttaccaacaaaaaaaataaaaacacattacctaccgaaatcgaatactaacaaccattat

SEQ ID NO: 7169 - DNA, 1026 bp, Artificial Sequence
  chemically treated genomic DNA (Homo sapiens) CpG-island No: 7169
acggcgcgttttgtacgcgaatttacggtcgtcggttgtttttttttcggttttcggttcgttgtttttagtcgtcgacgtcggttcgtatcgttttcgcgcgttgattggttcgcgtaggttttttgttcggttgttggcggttggggcgaagtcggcgggaggtcgtttcgttttcgttttcgtcgtagagtcgcggcgcgtagtttttttattcgtcgcggtcggggcggtggcgttgttgtcgtcgcggtttgtgaggtagtaattttttttcgtttttgttttattttttttttttttttttcgtttttttcgtttttttttttttcgtcgtttttcgttcgagtgaatgtggcgcggcggcgcgggacgtagtttcggtttttgtcgcggtttcgtaagttcgtgaggagacggagttgttttttgttttcgttttttgcgcgtttcggggagttatcgtcgttggcgaaggagaataagtagggtagcggagggacggtggcgggaaaacgggagagggaggagaagagggttcgagggcgagtagggaaagcggggagggacggacggaaggacggacggttcgacggacggttcggggagggggtcgttattgagtttgttcgatttttcggtttcggtttcgggtggcggcggtagcggcgtcgcggacgaagggcgcggtaagcgttatcgagataataattttgtcgttcggttttgggggtaacggagaggaagcggtggcggtttagcgcggtcgaggttcgtcgagcgttcgggtagcgttttcgttttcgtcggtcgggtgttgttgtcgttcggtgtgcggggcgcgtcggttgttcggaattcgaggttttcggcggtcgttttttttttttttttttttcggtgcgcgcggagttggtttttcgggtttttttggacggagttggattttgtttttcgttaaggtaggaagtgagtttcgtattgtaatttcgggcggtgttacgagtgaaaagttttgtttttttt

SEQ ID NO: 7170 - DNA, 1026 bp, Artificial Sequence
  chemically treated genomic DNA (Homo sapiens) CpG-island No: 7170
aaaaaaaacaaaacttttcactcgtaacaccgcccgaaattacaatacgaaactcacttcctaccttaacgaaaaacaaaatccaactccgtccaaaaaaacccgaaaaaccaactccgcgcgcaccgaaaaaaaaaaaaaaaaaaaacgaccgccgaaaacctcgaattccgaacaaccgacgcgccccgcacaccgaacgacaacaacacccgaccgacgaaaacgaaaacgctacccgaacgctcgacgaacctcgaccgcgctaaaccgccaccgcttcctctccgttacccccaaaaccgaacgacaaaattattatctcgataacgcttaccgcgcccttcgtccgcgacgccgctaccgccgccacccgaaaccgaaaccgaaaaatcgaacaaactcaataacgaccccctccccgaaccgtccgtcgaaccgtccgtccttccgtccgtccctccccgctttccctactcgccctcgaaccctcttctcctccctctcccgttttcccgccaccgtccctccgctaccctacttattctccttcgccaacgacgataactccccgaaacgcgcaaaaaacgaaaacaaaaaacaactccgtctcctcacgaacttacgaaaccgcgacaaaaaccgaaactacgtcccgcgccgccgcgccacattcactcgaacgaaaaacgacgaaaaaaaaaaaaacgaaaaaaacgaaaaaaaaaaaaaaaaaataaaacaaaaacgaaaaaaaattactacctcacaaaccgcgacgacaacaacgccaccgccccgaccgcgacgaataaaaaaactacgcgccgcgactctacgacgaaaacgaaaacgaaacgacctcccgccgacttcgccccaaccgccaacaaccgaacaaaaaacctacgcgaaccaatcaacgcgcgaaaacgatacgaaccgacgtcgacgactaaaaacaacgaaccgaaaaccgaaaaaaaaacaaccgacgaccgtaaattcgcgtacaaaacgcgccgt

SEQ ID NO: 7171 - DNA, 1026 bp, Artificial Sequence
  chemically treated genomic DNA (Homo sapiens) CpG-island No: 7171
aaaaaaaataaaattttttattcgtgatatcgttcggaattgtagtgcgaaatttattttttgttttggcgagaagtaggatttagtttcgtttaggggaattcggaaaattagtttcgcgcgtatcggagagggggaggggaggggacggtcgtcgggagtttcgggtttcgggtaatcggcgcgtttcgtatatcggacggtagtagtattcggtcggcgggggcgaggacgttgttcgggcgttcggcgagtttcggtcgcgttaggtcgttatcgtttttttttcgttgtttttagagtcgggcggtagggttattgtttcgatagcgtttgtcgcgtttttcgttcgcgacgtcgttgtcgtcgttattcggagtcggagtcgaggagtcgggtaggtttaatagcggtttttttttcgggtcgttcgtcgggtcgttcgttttttcgttcgttttttttcgttttttttattcgttttcgaattttttttttttttttttttcgttttttcgttatcgttttttcgttgttttgtttgttttttttcgttagcggcggtggtttttcgagacgcgtagggggcgggagtaggaggtagtttcgtttttttacgagtttgcggggtcgcggtaggggtcgagattgcgtttcgcgtcgtcgcgttatatttattcgagcgagagacggcgaggggagggaggacggagggagcggagagaaaggaggaggaatggggtaggggcggaggggagttattgttttataggtcgcggcggtaatagcgttatcgtttcggtcgcgacgggtgaagaggttgcgcgtcgcgattttgcggcgggggcgggggcggggcggtttttcgtcggtttcgttttaatcgttaatagtcgggtaggaggtttgcgcgggttagttagcgcgcgggggcggtgcgggtcgacgtcggcggttgggggtagcgggtcgggggtcgggggaggggtagtcggcggtcgtgggttcgcgtgtaaggcgcgtcgt

SEQ ID NO: 7172 - DNA, 1026 bp, Artificial Sequence
  chemically treated genomic DNA (Homo sapiens) CpG-island No: 7172
acgacgcgccttacacgcgaacccacgaccgccgactacccctcccccgacccccgacccgctacccccaaccgccgacgtcgacccgcaccgcccccgcgcgctaactaacccgcgcaaacctcctacccgactattaacgattaaaacgaaaccgacgaaaaaccgccccgcccccgcccccgccgcaaaatcgcgacgcgcaacctcttcacccgtcgcgaccgaaacgataacgctattaccgccgcgacctataaaacaataactcccctccgcccctaccccattcctcctcctttctctccgctccctccgtcctccctcccctcgccgtctctcgctcgaataaatataacgcgacgacgcgaaacgcaatctcgacccctaccgcgaccccgcaaactcgtaaaaaaacgaaactacctcctactcccgccccctacgcgtctcgaaaaaccaccgccgctaacgaaaaaaaacaaacaaaacaacgaaaaaacgataacgaaaaaacgaaaaaaaaaaaaaaaaaaaattcgaaaacgaataaaaaaaacgaaaaaaaacgaacgaaaaaacgaacgacccgacgaacgacccgaaaaaaaaaccgctattaaacctacccgactcctcgactccgactccgaataacgacgacaacgacgtcgcgaacgaaaaacgcgacaaacgctatcgaaacaataaccctaccgcccgactctaaaaacaacgaaaaaaaaacgataacgacctaacgcgaccgaaactcgccgaacgcccgaacaacgtcctcgcccccgccgaccgaatactactaccgtccgatatacgaaacgcgccgattacccgaaacccgaaactcccgacgaccgtcccctcccctccccctctccgatacgcgcgaaactaattttccgaattcccctaaacgaaactaaatcctacttctcgccaaaacaaaaaataaatttcgcactacaattccgaacgatatcacgaataaaaaattttatttttttt

SEQ ID NO: 7173 - DNA, 758 bp, Artificial Sequence
  chemically treated genomic DNA (Homo sapiens) CpG-island No: 7173
  misc_feature (559)..(559): n is either a, c, g or t
cgtgagcgcgtagtagtagttcggcgaagtttattaggttcgcgcggttatacgttttttgatacgtttgatatattttttgttaggtttgttttatcggattatcgtagttttgaatatgatgcggacgtaggtttttatttttttggttgttgatgtattatattgtttgtcgcggcggttattgtttttcgtcgaggtttatggttttgattagacgtttaagtaggcgtagttggtttttattgtcgaggatttggaaattttgcggtagattggcgtttatatggtgcgtacgtagtaaacgggtgcgttagttcggtggaaggtgcgatttatatatcgttttggttggtgttattagtggtcgatacgatgacgtattttcgtcgtcgttttgttggtaaacgttacgttataatcgagtatggcgagtagtttttacgtttattaattagcgatacgatgtattagtacgcgcgtgtttatatttgtcgcggtcgttagtattagaaggttgttgtttggcgcggtacggtttcgcgttgtttgttattanggttgtgatattcgtaatgaagatgaatcgaaatcggcgttgatgtcgcggtttggttttacggaaatttaggcggaagcgattttcgaattgaaattgcgttattttgttaaattggaagagatgaagattcgcggtgagtagagtgaattggaaaaagagcgcgattagttgtagggtattttggttttcgagcgta

SEQ ID NO: 7174 - DNA, 758 bp, Artificial Sequence
  chemically treated genomic DNA (Homo sapiens) CpG-island No: 7174
  misc_feature (200)..(200): n is either a, c, g or t
tacgctcgaaaaccaaaataccctacaactaatcgcgctctttttccaattcactctactcaccgcgaatcttcatctcttccaatttaacaaaataacgcaatttcaattcgaaaatcgcttccgcctaaatttccgtaaaaccaaaccgcgacatcaacgccgatttcgattcatcttcattacgaatatcacaaccntaataacaaacaacgcgaaaccgtaccgcgccaaacaacaaccttctaatactaacgaccgcgacaaatataaacacgcgcgtactaatacatcgtatcgctaattaataaacgtaaaaactactcgccatactcgattataacgtaacgtttaccaacaaaacgacgacgaaaatacgtcatcgtatcgaccactaataacaccaaccaaaacgatatataaatcgcaccttccaccgaactaacgcacccgtttactacgtacgcaccatataaacgccaatctaccgcaaaatttccaaatcctcgacaataaaaaccaactacgcctacttaaacgtctaatcaaaaccataaacctcgacgaaaaacaataaccgccgcgacaaacaatataatacatcaacaaccaaaaaaataaaaacctacgtccgcatcatattcaaaactacgataatccgataaaacaaacctaacaaaaaatatatcaaacgtatcaaaaaacgtataaccgcgcgaacctaataaacttcgccgaactactactacgcgctcacg

SEQ ID NO: 7175 - DNA, 758 bp, Artificial Sequence
  chemically treated genomic DNA (Homo sapiens) CpG-island No: 7175
  misc_feature (200)..(200): n is either a, c, g or t
tacgttcggaagttaaaatgttttgtaattggtcgcgttttttttttagtttattttgtttatcgcgaatttttattttttttagtttggtaagatgacgtagttttagttcgaggatcgttttcgtttgggttttcgtaaggttaaatcgcgatattagcgtcggtttcggtttatttttattacgaatgttatagttntaatgataaatagcgcgaagtcgtgtcgcgttaagtagtaattttttggtgttggcggtcgcggtaagtgtaaatacgcgcgtattggtgtatcgtatcgttggttgatgagcgtgaaaattgttcgttatattcgattatggcgtgacgtttattaataaagcggcggcggagatgcgttatcgtatcggttattgatggtattagttagggcggtatgtgggtcgtattttttatcgggttggcgtattcgtttgttgcgtgcgtattatatggacgttaatttgtcgtaggatttttagattttcgatagtgaagattagttacgtttgtttaagcgtttgattaaagttatgaatttcgacgagaagtagtggtcgtcgcggtaggtaatgtggtatattaatagttagaaagatgaaggtttgcgttcgtattatatttaaagttacggtaattcggtggagtagatttggtagaaggtgtattaggcgtattaggaagcgtgtgatcgcgcgggtttggtggatttcgtcgagttgttgttgcgcgtttacg

SEQ ID NO: 7176 - DNA, 758 bp, Artificial Sequence
  chemically treated genomic DNA (Homo sapiens) CpG-island No: 7176
  misc_feature (559)..(559): n is either a, c, g or t
cgtaaacgcgcaacaacaactcgacgaaatccaccaaacccgcgcgatcacacgcttcctaatacgcctaatacaccttctaccaaatctactccaccgaattaccgtaactttaaatataatacgaacgcaaaccttcatctttctaactattaatataccacattacctaccgcgacgaccactacttctcgtcgaaattcataactttaatcaaacgcttaaacaaacgtaactaatcttcactatcgaaaatctaaaaatcctacgacaaattaacgtccatataatacgcacgcaacaaacgaatacgccaacccgataaaaaatacgacccacataccgccctaactaataccatcaataaccgatacgataacgcatctccgccgccgctttattaataaacgtcacgccataatcgaatataacgaacaattttcacgctcatcaaccaacgatacgatacaccaatacgcgcgtatttacacttaccgcgaccgccaacaccaaaaaattactacttaacgcgacacgacttcgcgctatttatcattanaactataacattcgtaataaaaataaaccgaaaccgacgctaatatcgcgatttaaccttacgaaaacccaaacgaaaacgatcctcgaactaaaactacgtcatcttaccaaactaaaaaaaataaaaattcgcgataaacaaaataaactaaaaaaaaaacgcgaccaattacaaaacattttaacttccgaacgta

SEQ ID NO: 7177 - DNA, 1015 bp, Artificial Sequence
  chemically treated genomic DNA (Homo sapiens) CpG-island No: 7177
cgattacgttgtcgtcggcgcgtggttagggcgagtcgtttacggtaaattaacgttgtcgtttggggcgatcgttgattatatgttgatgggaagcgacgattagaaattgttgatgggtttcgatgcgggttacggtttttttgtatttttgacgatttggtggtttttgaggtgaatcgttatattttgcgtcgcgttatcgattaattggtggaaaaaggttgggtatagcgtcgttagggcgtcggcgtgttggtgttgatgcgttcgttcgattattcgtttaacgtttaggcgcgttttagttagaatttgttggattagggtagttattttattagcgaaaaattgttttcggtattgcgtttcgcgttcggttacgtcgttgacgtattggggattatcgagggggagaacgttatttatttgcgtattttgcgtcgtgttaacggcgtcgcgttttgtttaatcgattattatttcgcggattttattttttggtcgacgttgtaacgtttcgatagcggttcgttgtacgattttttgcgcgagtaaatcggaattgcgttgcgtcgtagttagacgcggattagcgttcgtcgcgtttaggttaaagagtgttagcgttttgaaatttcgaatatgtcgtcgttgttgtgcgtgcgtatttttaattatcgtgacggtgaaagtagttcggcggagtatttcgttagtttgacgcgcgtcgatatgattgaatttattatggagtattgaatgtacgtagatatcgcgattcgttaatattaggaggcggcgagtttttatgtttgtaggtcgcgtttatgaattttttcgagagatggtttaatgcgtagttatttgtcgtttatgtaaaagttatgatatcgtcgtaataggtcgggatcgtcgtttgataaaagttaacgtcgttgaagtaatggttgagtttgcgatggttgtcgatggtttttttttgttgtaaaaagtagacgtcgttttgtgcgat

SEQ ID NO: 7178 - DNA, 1015 bp, Artificial Sequence
  chemically treated genomic DNA (Homo sapiens) CpG-island No: 7178
atcgcacaaaacgacgtctactttttacaacaaaaaaaaaccatcgacaaccatcgcaaactcaaccattacttcaacgacgttaacttttatcaaacgacgatcccgacctattacgacgatatcataacttttacataaacgacaaataactacgcattaaaccatctctcgaaaaaattcataaacgcgacctacaaacataaaaactcgccgcctcctaatattaacgaatcgcgatatctacgtacattcaatactccataataaattcaatcatatcgacgcgcgtcaaactaacgaaatactccgccgaactactttcaccgtcacgataattaaaaatacgcacgcacaacaacgacgacatattcgaaatttcaaaacgctaacactctttaacctaaacgcgacgaacgctaatccgcgtctaactacgacgcaacgcaattccgatttactcgcgcaaaaaatcgtacaacgaaccgctatcgaaacgttacaacgtcgaccaaaaaataaaatccgcgaaataataatcgattaaacaaaacgcgacgccgttaacacgacgcaaaatacgcaaataaataacgttctccccctcgataatccccaatacgtcaacgacgtaaccgaacgcgaaacgcaataccgaaaacaatttttcgctaataaaataactaccctaatccaacaaattctaactaaaacgcgcctaaacgttaaacgaataatcgaacgaacgcatcaacaccaacacgccgacgccctaacgacgctatacccaacctttttccaccaattaatcgataacgcgacgcaaaatataacgattcacctcaaaaaccaccaaatcgtcaaaaatacaaaaaaaccgtaacccgcatcgaaacccatcaacaatttctaatcgtcgcttcccatcaacatataatcaacgatcgccccaaacgacaacgttaatttaccgtaaacgactcgccctaaccacgcgccgacgacaacgtaatcg

SEQ ID NO: 7179 - DNA, 1015 bp, Artificial Sequence
  chemically treated genomic DNA (Homo sapiens) CpG-island No: 7179
gtcgtataaaacggcgtttgttttttatagtaggaagaagttatcgatagttatcgtaaatttagttattattttagcgacgttggtttttattaggcggcgatttcgatttattacggcggtattatgatttttgtatgggcgatagataattacgtattaggttatttttcggggaaatttataggcgcgatttgtaggtatgaaagttcgtcgttttttaatgttggcgggtcgcggtatttgcgtgtatttagtgttttatagtgaatttaattatgtcggcgcgcgttaggttgacggagtatttcgtcgggttgtttttatcgttacggtggttaagggtgcgtacgtatagtagcggcgatatattcgggattttaagacgttggtattttttggtttgggcgcggcgggcgttgattcgcgtttggttgcggcgtagcgtaatttcggtttgttcgcgtagaaaatcgtgtagcgagtcgttgtcgaagcgttgtagcgtcggttagagggtgaggttcgcgaagtagtggtcgattaaatagagcgcgacgtcgttgatacgacgtagggtgcgtaggtggatgacgttttttttttcggtaatttttagtgcgttagcgacgtggtcggacgcggggcgtaatatcgaaagtagtttttcgttggtgggatggttgttttgatttagtagattttggttaaaacgcgtttgggcgttgagcgggtaatcgaacgggcgtattagtattagtacgtcgacgttttgacggcgttgtatttagtttttttttattagttggtcgatggcgcggcgtagggtgtggcgatttattttaaaggttattagatcgttaaaggtgtagagaaatcgtaattcgtatcgaagtttattagtagtttttgatcgtcgttttttattagtatatggttaacggtcgttttaggcggtaacgttaatttgtcgtgagcggttcgttttgattacgcgtcgacggtagcgtaatcg

SEQ ID NO: 7180 - DNA, 1015 bp, Artificial Sequence
  chemically treated genomic DNA (Homo sapiens) CpG-island No: 7180
cgattacgctaccgtcgacgcgtaatcaaaacgaaccgctcacgacaaattaacgttaccgcctaaaacgaccgttaaccatatactaataaaaaacgacgatcaaaaactactaataaacttcgatacgaattacgatttctctacacctttaacgatctaataacctttaaaataaatcgccacaccctacgccgcgccatcgaccaactaataaaaaaaaactaaatacaacgccgtcaaaacgtcgacgtactaatactaatacgcccgttcgattacccgctcaacgcccaaacgcgttttaaccaaaatctactaaatcaaaacaaccatcccaccaacgaaaaactactttcgatattacgccccgcgtccgaccacgtcgctaacgcactaaaaattaccgaaaaaaaaaacgtcatccacctacgcaccctacgtcgtatcaacgacgtcgcgctctatttaatcgaccactacttcgcgaacctcaccctctaaccgacgctacaacgcttcgacaacgactcgctacacgattttctacgcgaacaaaccgaaattacgctacgccgcaaccaaacgcgaatcaacgcccgccgcgcccaaaccaaaaaataccaacgtcttaaaatcccgaatatatcgccgctactatacgtacgcacccttaaccaccgtaacgataaaaacaacccgacgaaatactccgtcaacctaacgcgcgccgacataattaaattcactataaaacactaaatacacgcaaataccgcgacccgccaacattaaaaaacgacgaactttcatacctacaaatcgcgcctataaatttccccgaaaaataacctaatacgtaattatctatcgcccatacaaaaatcataataccgccgtaataaatcgaaatcgccgcctaataaaaaccaacgtcgctaaaataataactaaatttacgataactatcgataacttcttcctactataaaaaacaaacgccgttttatacgac

SEQ ID NO: 7181 - DNA, 632 bp, Artificial Sequence
  chemically treated genomic DNA (Homo sapiens) CpG-island No: 7181
tttgtgtacgtttgagttttaggataatcgtcgtttgtacgattgggtattggataatattacgatttttgtttattcgcgttagtatgagttttcgcgtttgaatttggaatatatcgtgatgtttaagcgtaagttgaatttgttggtgatcgataagtacgttgaaggttgggatgattcgcgtatgtcgattattttcggtttgcgtcgtcgtggttatattgcggtttttattcgtgagttttgtaaacgtatcggcgtgattaagtaggataatattattgagatggcgtcgttggaattttgtattcgtgaagattttaacgaaaatgcgtcgcgcgtaatggcgggtatcgattcggtgaaattggttatcgaaaattattagggcgaaggcgaaatggttattatgtcgaaatattcggaataaatcggaaatgggtattcgttaggtgtcgtttagcggtgagaattggattgatcgcgtcgattttcgcgaagaaattattggattggggttaatttttatcgtatttcgtattatttttacgttgaagagatgttcgattgggtagatgaatatggtatcgtggtgattgatgaaattgttgttgtcggttttaattttt

SEQ ID NO: 7182 - DNA, 632 bp, Artificial Sequence
  chemically treated genomic DNA (Homo sapiens) CpG-island No: 7182
aaaaattaaaaccgacaacaacaatttcatcaatcaccacgataccatattcatctacccaatcgaacatctcttcaacgtaaaaataatacgaaatacgataaaaattaaccccaatccaataatttcttcgcgaaaatcgacgcgatcaatccaattctcaccgctaaacgacacctaacgaatacccatttccgatttattccgaatatttcgacataataaccatttcgccttcgccctaataattttcgataaccaatttcaccgaatcgatacccgccattacgcgcgacgcattttcgttaaaatcttcacgaatacaaaattccaacgacgccatctcaataatattatcctacttaatcacgccgatacgtttacaaaactcacgaataaaaaccgcaatataaccacgacgacgcaaaccgaaaataatcgacatacgcgaatcatcccaaccttcaacgtacttatcgatcaccaacaaattcaacttacgcttaaacatcacgatatattccaaattcaaacgcgaaaactcatactaacgcgaataaacaaaaatcgtaatattatccaatacccaatcgtacaaacgacgattatcctaaaactcaaacgtacacaaa

SEQ ID NO: 7183 - DNA, 632 bp, Artificial Sequence
  chemically treated genomic DNA (Homo sapiens) CpG-island No: 7183
agaggttaaagtcgatagtagtagttttattaattattacgatgttatgtttatttgtttagtcgagtatttttttagcgtaagggtaatgcgaggtacggtaggagttggttttaatttagtggttttttcgcggaaatcggcgcgattaatttaatttttatcgttaaacggtatttgacgggtgtttattttcggtttgtttcggatgtttcggtatggtaattatttcgttttcgttttgatagttttcgataattagttttatcggatcgatattcgttattgcgcgcggcgtattttcgttgagatttttacggatgtaggattttagcgacgttattttaatggtgttgttttgtttggttacgtcgatgcgtttgtagaatttacgaatagaagtcgtagtgtaattacgacgacgtagatcggaaatggtcggtatacgcgggttattttagtttttaacgtgtttgtcggttattagtaggtttaatttacgtttggatattacggtgtattttagatttaggcgcgagaatttatattggcgcgggtgaataggaatcgtgatgttgtttagtatttagtcgtatagacgacggttgttttggaatttaagcgtatataga

SEQ ID NO: 7184 - DNA, 632 bp, Artificial Sequence
  chemically treated genomic DNA (Homo sapiens) CpG-island No: 7184
tctatatacgcttaaattccaaaacaaccgtcgtctatacgactaaatactaaacaacatcacgattcctattcacccgcgccaatataaattctcgcgcctaaatctaaaatacaccgtaatatccaaacgtaaattaaacctactaataaccgacaaacacgttaaaaactaaaataacccgcgtataccgaccatttccgatctacgtcgtcgtaattacactacgacttctattcgtaaattctacaaacgcatcgacgtaaccaaacaaaacaacaccattaaaataacgtcgctaaaatcctacatccgtaaaaatctcaacgaaaatacgccgcgcgcaataacgaatatcgatccgataaaactaattatcgaaaactatcaaaacgaaaacgaaataattaccataccgaaacatccgaaacaaaccgaaaataaacacccgtcaaataccgtttaacgataaaaattaaattaatcgcgccgatttccgcgaaaaaaccactaaattaaaaccaactcctaccgtacctcgcattacccttacgctaaaaaaatactcgactaaacaaataaacataacatcgtaataattaataaaactactactatcgactttaacctct

SEQ ID NO: 7185 - DNA, 874 bp, Artificial Sequence
  chemically treated genomic DNA (Homo sapiens) CpG-island No: 7185
tatgatcgaaattagcgcggtgttggcgggttttatttgtacggggggtagcgtttatttttggtcgttggcgatgatcgcgattttcggttatttggttaataagtgcggggagaatcgtgttgtttggtttttttcgggtttgagattatatgtttgtacgtttagtttagagatttttttaagttttcgcgtacgattttttttttatttatagtattcgttagcgcggcgaatttaattatcgtatatttatcgtttatttgatacgcgttaatcggtaatttagtacgtttacgtagtttacgtacgatgtcgaggtacgttttagtaggtttaattattaggtagtttgcgttttgggttttatttagtagtgatttacgaatcgttttacgacggtttattgggtttatttgatagtttttgcggtcgttttttaatgcgttttcggtagttttacggaacgggttataaaaggaggaggcgaatttggtcgaatacgatataatcgtcgtatttttaaatttcgtagcgtttagcgtttgacgaatcgtttgtatttggtcgtttatcgcggcggaaggggcgatgaagtttgtatttgtagtagttgtaattacggtttgtttgtttaaattttttagagtcgcgtcgttgtcgacgttatgttcgtatagtatatcgtagtgatcgtgagaagtgtatttatagaagtaggtgtttgatataacgattatttttggtacggtttgtttgtagatgcgcgatatacgcggttatagtttattttcgcgttaggtatcgttgtcggttgtgtgtttgtgtgtgtatttgtatgtttgagtatttgtgtttgtgtgtatatgtattg

SEQ ID NO: 7186 - DNA, 874 bp, Artificial Sequence
  chemically treated genomic DNA (Homo sapiens) CpG-island No: 7186
caatacatatacacacaaacacaaatactcaaacatacaaatacacacacaaacacacaaccgacaacgatacctaacgcgaaaataaactataaccgcgtatatcgcgcatctacaaacaaaccgtaccaaaaataatcgttatatcaaacacctacttctataaatacacttctcacgatcactacgatatactatacgaacataacgtcgacaacgacgcgactctaaaaaatttaaacaaacaaaccgtaattacaactactacaaatacaaacttcatcgccccttccgccgcgataaacgaccaaatacaaacgattcgtcaaacgctaaacgctacgaaatttaaaaatacgacgattatatcgtattcgaccaaattcgcctcctccttttataacccgttccgtaaaactaccgaaaacgcattaaaaaacgaccgcaaaaactatcaaataaacccaataaaccgtcgtaaaacgattcgtaaatcactactaaataaaacccaaaacgcaaactacctaataattaaacctactaaaacgtacctcgacatcgtacgtaaactacgtaaacgtactaaattaccgattaacgcgtatcaaataaacgataaatatacgataattaaattcgccgcgctaacgaatactataaataaaaaaaaaatcgtacgcgaaaacttaaaaaaatctctaaactaaacgtacaaacatataatctcaaacccgaaaaaaaccaaacaacacgattctccccgcacttattaaccaaataaccgaaaatcgcgatcatcgccaacgaccaaaaataaacgctaccccccgtacaaataaaacccgccaacaccgcgctaatttcgatcata

SEQ ID NO: 7187 - DNA, 874 bp, Artificial Sequence
  chemically treated genomic DNA (Homo sapiens) CpG-island No: 7187
taatatatgtatatatagatataaatgtttaaatatgtagatatatatatagatatataatcggtagcgatgtttggcgcgaagatggattgtggtcgcgtatgtcgcgtatttgtaagtagatcgtgttagaaatgatcgttatgttagatatttgtttttgtgaatatattttttacggttattgcggtgtgttgtgcgagtatggcgtcgataacgacgcgattttggaaaatttaggtaagtaagtcgtggttgtagttgttgtaggtgtagattttatcgtttttttcgtcgcgatggacggttaggtataggcgattcgttaggcgttggacgttgcgggatttaaagatacggcgattatgtcgtattcgattaagttcgttttttttttttatggttcgtttcgtgaagttgtcggaagcgtattaaaaggcgatcgtaaaagttattagatgaatttaatgaatcgtcgtgaggcgattcgtgaattattgttggatgaagtttagggcgtagattgtttgatggttaaatttgttggagcgtatttcgatatcgtgcgtgagttgcgtgaacgtattgaattgtcgattggcgcgtattaggtgagcggtgagtatgcgatgattaagttcgtcgcgttggcgggtgttatagatgaagagaaagtcgtgcgcgaaagtttaggggaatttttagattggacgtgtaggtatgtaattttagattcgaaggaagttaaatagtacggtttttttcgtatttattgattagataatcgaggatcgcggttatcgttagcggttagaaatgggcgttatttttcgtataagtaaagttcgttagtatcgcgttggtttcgattatg

SEQ ID NO: 7188 - DNA, 874 bp, Artificial Sequence
  chemically treated genomic DNA (Homo sapiens) CpG-island No: 7188
cataatcgaaaccaacgcgatactaacgaactttacttatacgaaaaataacgcccatttctaaccgctaacgataaccgcgatcctcgattatctaatcaataaatacgaaaaaaaccgtactatttaacttccttcgaatctaaaattacatacctacacgtccaatctaaaaattcccctaaactttcgcgcacgactttctcttcatctataacacccgccaacgcgacgaacttaatcatcgcatactcaccgctcacctaatacgcgccaatcgacaattcaatacgttcacgcaactcacgcacgatatcgaaatacgctccaacaaatttaaccatcaaacaatctacgccctaaacttcatccaacaataattcacgaatcgcctcacgacgattcattaaattcatctaataacttttacgatcgccttttaatacgcttccgacaacttcacgaaacgaaccataaaaaaaaaaaacgaacttaatcgaatacgacataatcgccgtatctttaaatcccgcaacgtccaacgcctaacgaatcgcctatacctaaccgtccatcgcgacgaaaaaaacgataaaatctacacctacaacaactacaaccacgacttacttacctaaattttccaaaatcgcgtcgttatcgacgccatactcgcacaacacaccgcaataaccgtaaaaaatatattcacaaaaacaaatatctaacataacgatcatttctaacacgatctacttacaaatacgcgacatacgcgaccacaatccatcttcgcgccaaacatcgctaccgattatatatctatatatatatctacatatttaaacatttatatctatatatacatatatta

SEQ ID NO: 7189 - DNA, 631 bp, Artificial Sequence
  chemically treated genomic DNA (Homo sapiens) CpG-island No: 7189
gaattttttcgtttggcgcggtttagtagcggtggcggcgcggtgttttacgatttcggtaatatttgttttatttttatggttggtaagtcggagtacgataaaattatttttacgtcgattgtgtttaatgcgttgaacgcgttcggcgttagcgtcgaagcgttcggacgtaacgatttggtggtgaaaatcgtcgaaggcgatcgtaaagttttaggttcggtttatcgcgaaattaaagatcgcggtttttattacggtattttgttatttaatgtcgattttagtcgtttggtaaattattttaattcggataaaaagaaattggcggcgaaaggtattacgtcggtacgttttcgcgtgattaattttatcgagttgttgtcggggattatttatgagtaggtttgcgaggttataatcgaggtttttttcgtttattatggcgagcgcgtggaagcgggaaattattttttcgaataaaacgttagagttgttaaattttgtcgaaatttttgttcgttaagatagttgggaatggaattttcgttaagtttcggtattttcgtattttttggatgaacggtttaattgggggcggtttggaattttatttcgacgttgaaaa

SEQ ID NO: 7190 - DNA, 631 bp, Artificial Sequence
  chemically treated genomic DNA (Homo sapiens) CpG-island No: 7190
ttttcaacgtcgaaataaaattccaaaccgcccccaattaaaccgttcatccaaaaaatacgaaaataccgaaacttaacgaaaattccattcccaactatcttaacgaacaaaaatttcgacaaaatttaacaactctaacgttttattcgaaaaaataatttcccgcttccacgcgctcgccataataaacgaaaaaaacctcgattataacctcgcaaacctactcataaataatccccgacaacaactcgataaaattaatcacgcgaaaacgtaccgacgtaatacctttcgccgccaatttctttttatccgaattaaaataatttaccaaacgactaaaatcgacattaaataacaaaataccgtaataaaaaccgcgatctttaatttcgcgataaaccgaacctaaaactttacgatcgccttcgacgattttcaccaccaaatcgttacgtccgaacgcttcgacgctaacgccgaacgcgttcaacgcattaaacacaatcgacgtaaaaataattttatcgtactccgacttaccaaccataaaaataaaacaaatattaccgaaatcgtaaaacaccgcgccgccaccgctactaaaccgcgccaaacgaaaaaattc

SEQ ID NO: 7191 - DNA, 631 bp, Artificial Sequence
  chemically treated genomic DNA (Homo sapiens) CpG-island No: 7191
tttttaacgtcgaaatgaagttttaggtcgtttttagttaaatcgtttatttagaagatgcgaaaatgtcggagtttgacggaagttttatttttagttattttggcgggtaaaggtttcggtaaagtttggtaattttggcgttttgttcggggagatgatttttcgtttttacgcgttcgttataatgggcgaaaaaggtttcggttatggtttcgtaaatttgtttatgggtgattttcggtaatagttcggtgaggttggttacgcgggaacgtatcgacgtaatgtttttcgtcgttagtttttttttattcggattgagatagtttgttaggcggttgaggtcggtattgagtagtaaggtgtcgtggtggaagtcgcgatttttggtttcgcgataggtcgagtttgagattttgcggtcgttttcgacggtttttattattagatcgttacgttcggacgtttcggcgttgacgtcgagcgcgtttagcgtattgagtataatcgacgtggagatagttttatcgtatttcggtttgttagttataaaggtaaagtaggtattgtcgagatcgtggaatatcgcgtcgttatcgttattaagtcgcgttaggcgggggaattt

SEQ ID NO: 7192 - DNA, 631 bp, Artificial Sequence
  chemically treated genomic DNA (Homo sapiens) CpG-island No: 7192
aaattcccccgcctaacgcgacttaataacgataacgacgcgatattccacgatctcgacaatacctactttacctttataactaacaaaccgaaatacgataaaactatctccacgtcgattatactcaatacgctaaacgcgctcgacgtcaacgccgaaacgtccgaacgtaacgatctaataataaaaaccgtcgaaaacgaccgcaaaatctcaaactcgacctatcgcgaaaccaaaaatcgcgacttccaccacgacaccttactactcaataccgacctcaaccgcctaacaaactatctcaatccgaataaaaaaaaactaacgacgaaaaacattacgtcgatacgttcccgcgtaaccaacctcaccgaactattaccgaaaatcacccataaacaaatttacgaaaccataaccgaaacctttttcgcccattataacgaacgcgtaaaaacgaaaaatcatctccccgaacaaaacgccaaaattaccaaactttaccgaaacctttacccgccaaaataactaaaaataaaacttccgtcaaactccgacattttcgcatcttctaaataaacgatttaactaaaaacgacctaaaacttcatttcgacgttaaaaa

SEQ ID NO: 7193 - DNA, 506 bp, Artificial Sequence
  chemically treated genomic DNA (Homo sapiens) CpG-island No: 7193
  misc_feature (24)..(24): n is either a, c, g or t
ggtatattttggtttacgttgaangacgcgagtttattgtcgattttagacgttttttttcgttttagtcgtgttaggtgttgttttagatttaggttatgtcgtttaattcgttgcgtatatcgtttgttgattacgtgtagttttttttttaggcgggatttatatagcggttagttattcgttatttatattattacgttaaagggtgatagtaggtttataagacgttttagcgtcgttatagtgcgtttatcgaatacgtgcgtaataatcgtttttcggagattgttatacgcgtaaaatagttagcgttggcgcgatttagtttcgatatagttttattgttcgtttattttcgcgtagacgatgacgttattgttcggttgtatgcgcgaggttatcgattgcggtttgagttttttaagtgacgtaaaatcgtgttgaggttaacgtttataatgcgggttgttgttcggtatttaacgttatttatggttatatta

SEQ ID NO: 7194 - DNA, 506 bp, Artificial Sequence
  chemically treated genomic DNA (Homo sapiens) CpG-island No: 7194
  misc_feature (483)..(483): n is either a, c, g or t
taatataaccataaataacgttaaataccgaacaacaacccgcattataaacgttaacctcaacacgattttacgtcacttaaaaaactcaaaccgcaatcgataacctcgcgcatacaaccgaacaataacgtcatcgtctacgcgaaaataaacgaacaataaaactatatcgaaactaaatcgcgccaacgctaactattttacgcgtataacaatctccgaaaaacgattattacgcacgtattcgataaacgcactataacgacgctaaaacgtcttataaacctactatcaccctttaacgtaataatataaataacgaataactaaccgctatataaatcccgcctaaaaaaaaaactacacgtaatcaacaaacgatatacgcaacgaattaaacgacataacctaaatctaaaacaacacctaacacgactaaaacgaaaaaaaacgtctaaaatcgacaataaactcgcgtcnttcaacgtaaaccaaaatatacc

SEQ ID NO: 7195 - DNA, 506 bp, Artificial Sequence
  chemically treated genomic DNA (Homo sapiens) CpG-island No: 7195
  misc_feature (483)..(483): n is either a, c, g or t
tgatatggttatgaatggcgttggatgtcgggtaatagttcgtattatgggcgttggttttaatacgattttacgttatttaaaaaatttaggtcgtagtcggtaatttcgcgtatatagtcgggtagtgacgttatcgtttgcgcggaaatggacgaatagtggggttatgtcggggttaaatcgcgttagcgttggttgttttacgcgtatgatagttttcggaagacggttgttgcgtacgtattcggtgaacgtattatggcgacgttggggcgttttatgagtttgttgttattttttgacgtggtgatatggatgacggatggttggtcgttgtatgaatttcgtttgaagggaaagttgtacgtaattagtaagcgatatacgtagcgaattgagcggtataatttgaatttgaggtagtatttggtacggttgggacggaaggggacgtttagagtcgataataaattcgcgttntttaacgtgggttaggatgtgtt

SEQ ID NO: 7196 - DNA, 506 bp, Artificial Sequence
  chemically treated genomic DNA (Homo sapiens) CpG-island No: 7196
  misc_feature (24)..(24): n is either a, c, g or t
aacacatcctaacccacgttaaanaacgcgaatttattatcgactctaaacgtccccttccgtcccaaccgtaccaaatactacctcaaattcaaattataccgctcaattcgctacgtatatcgcttactaattacgtacaactttcccttcaaacgaaattcatacaacgaccaaccatccgtcatccatatcaccacgtcaaaaaataacaacaaactcataaaacgccccaacgtcgccataatacgttcaccgaatacgtacgcaacaaccgtcttccgaaaactatcatacgcgtaaaacaaccaacgctaacgcgatttaaccccgacataaccccactattcgtccatttccgcgcaaacgataacgtcactacccgactatatacgcgaaattaccgactacgacctaaattttttaaataacgtaaaatcgtattaaaaccaacgcccataatacgaactattacccgacatccaacgccattcataaccatatca

SEQ ID NO: 7197 - DNA, 927 bp, Artificial Sequence
  chemically treated genomic DNA (Homo sapiens) CpG-island No: 7197
gttgtgatgttttttattgcgtggcgacgtaattatttttttaacgttacgttttcggttattgggtttaacgcggcgttggtttcgttttggtttgttggttaggcgggcgttatggacgttacgtcgttgatgcgcgttgatgggttcgttatgttttatatcgggttggtattgttggcgagtttcgttatttgtattttcgtttattcgtggtttgaaggttataacgataataaggatgagttttatttgttggtgttaattgtcgcgttgggcgggattttgttggcgaatgttaatatttggcgtttttgtttttcggtatcgaattgcgtgtagtagtagttggttagcgtgtttgagcgttacggtttgtcggatcggatgattatggataacggtttatcgtggggcgatattatcggtatttggacggcgttggagttgtggttgatgcgtttgggtattcgggtggggtattttcggttttattattcgtagacgtaggggaagttggagcgtttttatcgtagtttgaaggcggaagtgttgtagggaaaatggttcgtagatagcggtgaattgtagcgcgttttcgattattggcggacggtttataattttgaacgttcgtacgaggcgttggatatggcggtatcgggttcgcggtattagtcgttagcgcggtagtatagcggtaatataacgttttcgggaatacgatgaaggggtgatggttaggaaagtggatattagcggaaagttgagcgtgaaaggggtaagtttgagcgtaggtaaggcgtttaggggagaacgggtcgggttgaaggagatgtatgaagacggtagttacgatgtgtggtggtatagtacgaaagtgggggtgatcgatttgaagaaaaagtcgattattatgggtaaagg

SEQ ID NO: 7198 - DNA, 927 bp, Artificial Sequence
  chemically treated genomic DNA (Homo sapiens) CpG-island No: 7198
cctttacccataataatcgactttttcttcaaatcgatcacccccactttcgtactataccaccacacatcgtaactaccgtcttcatacatctccttcaacccgacccgttctcccctaaacgccttacctacgctcaaacttacccctttcacgctcaactttccgctaatatccactttcctaaccatcaccccttcatcgtattcccgaaaacgttatattaccgctatactaccgcgctaacgactaataccgcgaacccgataccgccatatccaacgcctcgtacgaacgttcaaaattataaaccgtccgccaataatcgaaaacgcgctacaattcaccgctatctacgaaccattttccctacaacacttccgccttcaaactacgataaaaacgctccaacttcccctacgtctacgaataataaaaccgaaaataccccacccgaatacccaaacgcatcaaccacaactccaacgccgtccaaataccgataatatcgccccacgataaaccgttatccataatcatccgatccgacaaaccgtaacgctcaaacacgctaaccaactactactacacgcaattcgataccgaaaaacaaaaacgccaaatattaacattcgccaacaaaatcccgcccaacgcgacaattaacaccaacaaataaaactcatccttattatcgttataaccttcaaaccacgaataaacgaaaatacaaataacgaaactcgccaacaataccaacccgatataaaacataacgaacccatcaacgcgcatcaacgacgtaacgtccataacgcccgcctaaccaacaaaccaaaacgaaaccaacgccgcgttaaacccaataaccgaaaacgtaacgttaaaaaaataattacgtcgccacgcaataaaaaacatcacaac

SEQ ID NO: 7199 - DNA, 927 bp, Artificial Sequence
  chemically treated genomic DNA (Homo sapiens) CpG-island No: 7199
tttttatttatggtgatcgattttttttttaggtcgattatttttattttcgtgttgtattattatatatcgtagttgtcgtttttatgtattttttttagttcgattcgtttttttttgaacgttttgtttgcgtttagatttattttttttacgtttagtttttcgttgatatttatttttttgattattatttttttatcgtattttcgggggcgttgtgttgtcgttgtattgtcgcgttgacggttgatatcgcgagttcggtatcgttatatttagcgtttcgtgcgggcgtttaaggttatagatcgttcgttagtggtcgaaggcgcgttgtagtttatcgttgtttgcgaattattttttttgtagtattttcgtttttaggttgcggtgaaaacgttttagttttttttgcgtttgcggatgataaggtcgggagtgttttattcggatatttaggcgtattagttatagttttagcgtcgtttaggtgtcggtggtgtcgttttacggtgagtcgttatttatggttattcggttcggtaggtcgtaacgtttaaatacgttgattagttgttgttgtacgtagttcgatatcgaggaatagagacgttagatgttggtattcgttagtaggatttcgtttagcgcggtaattaatattaataggtagaatttatttttgttgtcgttatagtttttaagttacgggtaggcgaaagtataggtggcgaggttcgttaataatattagttcggtgtaaagtatggcgaatttattaacgcgtattagcggcgtaacgtttatagcgttcgtttggttaataaattagagcgaaattagcgtcgcgttaagtttaataatcgagagcgtagcgttgaggaaatgattgcgtcgttacgtaatggagagtattataat

SEQ ID NO: 7200 - DNA, 927 bp, Artificial Sequence
  chemically treated genomic DNA (Homo sapiens) CpG-island No: 7200
attataatactctccattacgtaacgacgcaatcatttcctcaacgctacgctctcgattattaaacttaacgcgacgctaatttcgctctaatttattaaccaaacgaacgctataaacgttacgccgctaatacgcgttaataaattcgccatactttacaccgaactaatattattaacgaacctcgccacctatactttcgcctacccgtaacttaaaaactataacgacaacaaaaataaattctacctattaatattaattaccgcgctaaacgaaatcctactaacgaataccaacatctaacgtctctattcctcgatatcgaactacgtacaacaacaactaatcaacgtatttaaacgttacgacctaccgaaccgaataaccataaataacgactcaccgtaaaacgacaccaccgacacctaaacgacgctaaaactataactaatacgcctaaatatccgaataaaacactcccgaccttatcatccgcaaacgcaaaaaaaactaaaacgttttcaccgcaacctaaaaacgaaaatactacaaaaaaaataattcgcaaacaacgataaactacaacgcgccttcgaccactaacgaacgatctataaccttaaacgcccgcacgaaacgctaaatataacgataccgaactcgcgatatcaaccgtcaacgcgacaatacaacgacaacacaacgcccccgaaaatacgataaaaaaataataatcaaaaaaataaatatcaacgaaaaactaaacgtaaaaaaaataaatctaaacgcaaacaaaacgttcaaaaaaaaacgaatcgaactaaaaaaaatacataaaaacgacaactacgatatataataatacaacacgaaaataaaaataatcgacctaaaaaaaaaatcgatcaccataaataaaaa

SEQ ID NO: 7201 - DNA, 1024 bp, Artificial Sequence
  chemically treated genomic DNA (Homo sapiens) CpG-island No: 7201
gtcgtttggagtagatacgtcgtcgtcgcgttttttggaacggttagggaagtaagtagaagtcgggaagtcgcgaaagaggcgagaaagtgcgattttttttttagattttcggtttttcgtcgaaatttttgtcggtcggttaaattttagataatggaagttttacgtttttatttttatttttttttataagttcggtcgcgggtttttttcggttcgggatttcggcgttagtttcggagtcggagtttgtacgatacgttttttttcgtcgttttatttttttattcggagatcgtttatttttttcgttttatttttttatttttcgtttggtcggtttcgttcgattcggaggcggcgtttttttttttgttttaggtttaggaaggaggacggcggaggaagtagggggttttggttgcggggcgtagggatgtgggtcggcgatcggcgttcgagggcgtaaaaaggcggttcgaggattgcgcgcgggcgggtagcgcgggaagtcgggaagaaaggagggcgcgcgggggagaagtttgcgggtgcggggttttaggtcggggcgtttattttttcgcgtcgttcgcgttcgtcgtttagttttcgttgtaggttttgcgcgcggtttttcgtttcgttcgtttgttgttgtagggtttggattttgcgttttatcgtttttagggagttgaggtcggttatggcgcggaggcgtagaggcgtacgggtagcggcggacgttcggttgggttcggtttcggcgagagttgtatagtcgcgtttcggttttttaagtttttgtttgcgcgggggtcgttttcgttttttttcgtttttcgggtcggttgtcgtcggggcgatgaggttattcggtcggatcgtcgacgttagtatcgttgggggagggtttgacgtcggtatcgttggttatagttgttggaaagtgttttttttcgggatttatttggagaaagcgttgggaggcgtcgttttttttttttttttttttttt

SEQ ID NO: 7202 - DNA, 1024 bp, Artificial Sequence
  chemically treated genomic DNA (Homo sapiens) CpG-island No: 7202
aaaaaaaaaaaaaaaaaaaaaaacgacgcctcccaacgctttctccaaataaatcccgaaaaaaaacactttccaacaactataaccaacgataccgacgtcaaaccctcccccaacgatactaacgtcgacgatccgaccgaataacctcatcgccccgacgacaaccgacccgaaaaacgaaaaaaaacgaaaacgacccccgcgcaaacaaaaacttaaaaaaccgaaacgcgactatacaactctcgccgaaaccgaacccaaccgaacgtccgccgctacccgtacgcctctacgcctccgcgccataaccgacctcaactccctaaaaacgataaaacgcaaaatccaaaccctacaacaacaaacgaacgaaacgaaaaaccgcgcgcaaaacctacaacgaaaactaaacgacgaacgcgaacgacgcgaaaaaataaacgccccgacctaaaaccccgcacccgcaaacttctcccccgcgcgccctcctttcttcccgacttcccgcgctacccgcccgcgcgcaatcctcgaaccgcctttttacgccctcgaacgccgatcgccgacccacatccctacgccccgcaaccaaaaccccctacttcctccgccgtcctccttcctaaacctaaaacaaaaaaaaaaacgccgcctccgaatcgaacgaaaccgaccaaacgaaaaataaaaaaataaaacgaaaaaaataaacgatctccgaataaaaaaataaaacgacgaaaaaaaacgtatcgtacaaactccgactccgaaactaacgccgaaatcccgaaccgaaaaaaacccgcgaccgaacttataaaaaaaaataaaaataaaaacgtaaaacttccattatctaaaatttaaccgaccgacaaaaatttcgacgaaaaaccgaaaatctaaaaaaaaaatcgcactttctcgcctctttcgcgacttcccgacttctacttacttccctaaccgttccaaaaaacgcgacgacgacgtatctactccaaacgac

SEQ ID NO: 7203 - DNA, 1024 bp, Artificial Sequence
  chemically treated genomic DNA (Homo sapiens) CpG-island No: 7203
ggaggaagaggaggaggagaaggcggcgttttttagcgttttttttaaataagtttcgaaaaggggtattttttagtagttgtggttagcggtgtcgacgttaggtttttttttagcggtgttgacgtcggcggttcggtcgggtgattttatcgtttcgacggtagtcggttcggggggcggggagaggcgggggcggttttcgcgtaggtaaaggtttggggggtcggggcgcggttgtgtagttttcgtcggagtcgagtttagtcgagcgttcgtcgttgttcgtgcgtttttgcgttttcgcgttatggtcggttttaattttttggaggcggtgaaacgtaagatttaggttttgtagtagtaggcggacgaggcggaagatcgcgcgtagggtttgtaacgggagttggacggcgagcgcgagcggcgcgagaaagtgagcgtttcggtttggggtttcgtattcgtaagtttttttttcgcgcgttttttttttttttcggtttttcgcgttgttcgttcgcgcgtagttttcgggtcgtttttttacgttttcggacgtcgatcgtcgatttatatttttgcgtttcgtagttaggattttttatttttttcgtcgtttttttttttgggtttgggataggggagggggcgtcgttttcgggtcgggcggggtcggttaagcgggaaatggggggatggggcggagggggtgagcgattttcgggtggagaagtggagcggcgggagggggcgtatcgtgtaggtttcgatttcggggttggcgtcggggtttcgggtcgaggggaattcgcgatcggatttgtgggggagaatgaggatgaaaacgtggagtttttattgtttagggtttgatcggtcgatagggatttcgacgggggatcggggatttggggagggggtcgtattttttcgtttttttcgcggtttttcggtttttgtttgtttttttgatcgttttaaggggcgcggcggcgacgtgtttgttttaggcggt

SEQ ID NO: 7204 - DNA, 1024 bp, Artificial Sequence
  chemically treated genomic DNA (Homo sapiens) CpG-island No: 7204
accgcctaaaacaaacacgtcgccgccgcgccccttaaaacgatcaaaaaaacaaacaaaaaccgaaaaaccgcgaaaaaaacgaaaaaatacgaccccctccccaaatccccgatcccccgtcgaaatccctatcgaccgatcaaaccctaaacaataaaaactccacgttttcatcctcattctcccccacaaatccgatcgcgaattcccctcgacccgaaaccccgacgccaaccccgaaatcgaaacctacacgatacgccccctcccgccgctccacttctccacccgaaaatcgctcaccccctccgccccatccccccatttcccgcttaaccgaccccgcccgacccgaaaacgacgccccctcccctatcccaaacccaaaaaaaaaaacgacgaaaaaaataaaaaatcctaactacgaaacgcaaaaatataaatcgacgatcgacgtccgaaaacgtaaaaaaacgacccgaaaactacgcgcgaacgaacaacgcgaaaaaccgaaaaaaaaaaaaaacgcgcgaaaaaaaaacttacgaatacgaaaccccaaaccgaaacgctcactttctcgcgccgctcgcgctcgccgtccaactcccgttacaaaccctacgcgcgatcttccgcctcgtccgcctactactacaaaacctaaatcttacgtttcaccgcctccaaaaaattaaaaccgaccataacgcgaaaacgcaaaaacgcacgaacaacgacgaacgctcgactaaactcgactccgacgaaaactacacaaccgcgccccgaccccccaaacctttacctacgcgaaaaccgcccccgcctctccccgccccccgaaccgactaccgtcgaaacgataaaatcacccgaccgaaccgccgacgtcaacaccgctaaaaaaaaacctaacgtcgacaccgctaaccacaactactaaaaaataccccttttcgaaacttatttaaaaaaaacgctaaaaaacgccgccttctcctcctcctcttcctcc

SEQ ID NO: 7205 - DNA, 589 bp, Artificial Sequence
  chemically treated genomic DNA (Homo sapiens) CpG-island No: 7205
cgacgcgcggcgcgtttttggtttaattgttaatttagcgtaaggaaagtgaagatgttaataatgtttaatattatttacggaagtttttgttggtgcgtcgattttgttaagttaaatagttcgtcggtatcgatataattaaataacgtcggtaatcgttagatttaaatcgtttaattttattgagcggatgacgatttttgatgtacgatttttagttggtatttcgggttgatggttaattttataaattacgcgtcggatcgagtatcgggcgaatgatgttcgtacgtatcgtaaagtcgtcgaagtttttattcgtttcgcgttttttcgtttagcgttttattagtttattaagcgacgttaggattttcggttcggtgatgttttttttatatattcgtgggatacgtgttttaatgcggttgtcgttaagatgtaggttgtagcgattcggcgttttatttattaggtttattttcgttagtatcgcgcgattataatcgttcgggtagtttgttatacgtattacgatatgtttatcgttgatattatgtttcgttattaaattatcgatgttgtt

SEQ ID NO: 7206 - DNA, 589 bp, Artificial Sequence
  chemically treated genomic DNA (Homo sapiens) CpG-island No: 7206
aacaacatcgataatttaataacgaaacataatatcaacgataaacatatcgtaatacgtataacaaactacccgaacgattataatcgcgcgatactaacgaaaataaacctaataaataaaacgccgaatcgctacaacctacatcttaacgacaaccgcattaaaacacgtatcccacgaatatataaaaaaaacatcaccgaaccgaaaatcctaacgtcgcttaataaactaataaaacgctaaacgaaaaaacgcgaaacgaataaaaacttcgacgactttacgatacgtacgaacatcattcgcccgatactcgatccgacgcgtaatttataaaattaaccatcaacccgaaataccaactaaaaatcgtacatcaaaaatcgtcatccgctcaataaaattaaacgatttaaatctaacgattaccgacgttatttaattatatcgataccgacgaactatttaacttaacaaaatcgacgcaccaacaaaaacttccgtaaataatattaaacattattaacatcttcactttccttacgctaaattaacaattaaaccaaaaacgcgccgcgcgtcg

SEQ ID NO: 7207 - DNA, 589 bp, Artificial Sequence
  chemically treated genomic DNA (Homo sapiens) CpG-island No: 7207
gataatatcgataatttaatggcgaaatatggtgttagcgatgagtatatcgtgatgcgtgtaataggttgttcgaacggttgtggtcgcgcgatgttggcggaagtgggtttggtgggtaaagcgtcgggtcgttataatttgtattttggcggtaatcgtattgggatacgtattttacggatgtataaagaaaatattatcgagtcggaaattttggcgtcgtttgatgaattgatagggcgttgggcgaaagagcgcgaagcgggtgaaggtttcggcgattttacggtgcgtgcgggtattattcgttcggtgttcgattcggcgcgtgatttgtgggattaattattagttcggggtattagttagagatcgtatattaggggtcgttattcgtttaatggggttaagcggtttgggtttggcgattgtcggcgttatttggttatatcggtgtcggcgggttgtttgatttggtaaaatcggcgtattagtaagagttttcgtggatgatgttgggtattattggtatttttattttttttgcgttgggttggtagttaagttagaaacgcgtcgcgcgtcg

SEQ ID NO: 7208 - DNA, 589 bp, Artificial Sequence
  chemically treated genomic DNA (Homo sapiens) CpG-island No: 7208
cgacgcgcgacgcgtttctaacttaactaccaacccaacgcaaaaaaaataaaaataccaataatacccaacatcatccacgaaaactcttactaatacgccgattttaccaaatcaaacaacccgccgacaccgatataaccaaataacgccgacaatcgccaaacccaaaccgcttaaccccattaaacgaataacgacccctaatatacgatctctaactaataccccgaactaataattaatcccacaaatcacgcgccgaatcgaacaccgaacgaataatacccgcacgcaccgtaaaatcgccgaaaccttcacccgcttcgcgctctttcgcccaacgccctatcaattcatcaaacgacgccaaaatttccgactcgataatattttctttatacatccgtaaaatacgtatcccaatacgattaccgccaaaatacaaattataacgacccgacgctttacccaccaaacccacttccgccaacatcgcgcgaccacaaccgttcgaacaacctattacacgcatcacgatatactcatcgctaacaccatatttcgccattaaattatcgatattatc

SEQ ID NO: 7209 - DNA, 560 bp, Artificial Sequence
  chemically treated genomic DNA (Homo sapiens) CpG-island No: 7209
gttttagcgttttcgttatatttttagagcgtttttttttttcggacgttttttttttatttttaatgttttttcgttatttataagattgtgttttacgagttttttttcgttttaaagtttttaattatttataacgttttttatttgtatagttttttttttttggaatattatttttaatgttcgtcgtcgcgagatttttggtaattttcgcgcgtagaattatcgttttgtgttttttttttcggttttggatcggttttaatttttagagttcgcgtttgatttagattattcgcggtagagaagggatttgttagcgttcgatttagtttcggttatttacgcgtgggtttttttttcgttagttttcggcgtagcgttttttcgttattatggcgattttcgtttagattttagcggtttcggtttcgcggcgattgggtagtttcggtttaaggtgtagttgtagggtttagagttagagcggattttcggtagaaaaattcgtttgttttttcgcgtatagatttttgggagttgtagttttattaaag

SEQ ID NO: 7210 - DNA, 560 bp, Artificial Sequence
  chemically treated genomic DNA (Homo sapiens) CpG-island No: 7210
ctttaataaaactacaactcccaaaaatctatacgcgaaaaaacaaacgaatttttctaccgaaaatccgctctaactctaaaccctacaactacaccttaaaccgaaactacccaatcgccgcgaaaccgaaaccgctaaaatctaaacgaaaatcgccataataacgaaaaaacgctacgccgaaaactaacgaaaaaaaaacccacgcgtaaataaccgaaactaaatcgaacgctaacaaatcccttctctaccgcgaataatctaaatcaaacgcgaactctaaaaattaaaaccgatccaaaaccgaaaaaaaaaacacaaaacgataattctacgcgcgaaaattaccaaaaatctcgcgacgacgaacattaaaaataatattccaaaaaaaaaaaactatacaaataaaaaacgttataaataattaaaaactttaaaacgaaaaaaaactcgtaaaacacaatcttataaataacgaaaaaacattaaaaataaaaaaaaaacgtccgaaaaaaaaaaacgctctaaaaatataacgaaaacgctaaaac

SEQ ID NO: 7211 - DNA, 560 bp, Artificial Sequence
  chemically treated genomic DNA (Homo sapiens) CpG-island No: 7211
ttttggtgaaattataatttttaggggtttgtgcgcgagaaggtagacgggtttttttatcggaagttcgttttagttttgggttttataattgtattttgagtcggagttgtttagtcgtcgcgggatcggggtcgttggggtttggacgggggtcgttatggtaacgggggagcgttacgtcggggattggcggagggggggtttacgcgtaaatagtcgaggttggatcgggcgttgataagttttttttttgtcgcggatggtttgggttaggcgcgggttttggggattgggatcgatttagggtcgggaaggagggtatagggcggtgattttgcgcgcgggggttattaggggtttcgcggcgacgggtattgggggtggtgttttaaggggaaagggttgtgtaggtgggaaacgttgtagatggttggaagttttgaaacgagaggaaattcgtgagatatagttttgtgggtagcgagaaggtattggaggtggggagagggcgttcgaaagaggaaggcgttttggaagtgtggcgggagcgttgggat

SEQ ID NO: 7212 - DNA, 560 bp, Artificial Sequence
  chemically treated genomic DNA (Homo sapiens) CpG-island No: 7212
atcccaacgctcccgccacacttccaaaacgccttcctctttcgaacgccctctccccacctccaataccttctcgctacccacaaaactatatctcacgaatttcctctcgtttcaaaacttccaaccatctacaacgtttcccacctacacaaccctttccccttaaaacaccacccccaatacccgtcgccgcgaaacccctaataacccccgcgcgcaaaatcaccgccctataccctccttcccgaccctaaatcgatcccaatccccaaaacccgcgcctaacccaaaccatccgcgacaaaaaaaaaacttatcaacgcccgatccaacctcgactatttacgcgtaaaccccccctccgccaatccccgacgtaacgctcccccgttaccataacgacccccgtccaaaccccaacgaccccgatcccgcgacgactaaacaactccgactcaaaatacaattataaaacccaaaactaaaacgaacttccgataaaaaaacccgtctaccttctcgcgcacaaacccctaaaaattataatttcaccaaaa

SEQ ID NO: 7213 - DNA, 890 bp, Artificial Sequence
  chemically treated genomic DNA (Homo sapiens) CpG-island No: 7213
  misc_feature (747)..(747): n is either a, c, g or t
  misc_feature (833)..(833): n is either a, c, g or t
  misc_feature (835)..(835): n is either a, c, g or t
  misc_feature (837)..(837): n is either a, c, g or t
  misc_feature (839)..(839): n is either a, c, g or t
  misc_feature (841)..(841): n is either a, c, g or t
  misc_feature (847)..(847): n is either a, c, g or t
  misc_feature (855)..(856): n is either a, c, g or t
  misc_feature (858)..(860): n is either a, c, g or t
  misc_feature (863)..(865): n is either a, c, g or t
  misc_feature (867)..(867): n is either a, c, g or t
  misc_feature (869)..(869): n is either a, c, g or t
  misc_feature (873)..(873): n is either a, c, g or t
  misc_feature (875)..(875): n is either a, c, g or t
  misc_feature (877)..(877): n is either a, c, g or t
  misc_feature (884)..(884): n is either a, c, g or t
  misc_feature (889)..(889): n is either a, c, g or t
gcgcgcgttggttgtagattttttttatagttaggagaaagagtacgcgttttttagtttcgtgtttttttttttgggacgacgaattgcggggttcggattgggttgaggcgggttacgtttttttatattttttaattaattttttttttggtgcgtttttttttttttagtttcgttttatcgttttacgttacgtcgttttttttggtttttttcgttatttcggcggttgcggttcgcgcggtaaatttattttttattgttttttattggttggttaggtttcgcgcgagcgggatcgcgtttttcgttttttatttttaaaatcgggttatgtttttttttttcggttttttttaagagttagcgcgaggtagtagatcggttgtttgagacgcgcgcgtagtttttgcggattatttttttcgttttgcgttagtagttgcgtcggttggtagtttttcgcgtacgcgcgttcgtttatttcgttttttttgttcgtttgtaagtcgtttcgcgtttagtcgcgacggcggtcgtcgtaatagcggtattttcgggggcgtacgcgtattgtatcgttcgcggtcgtttttaattttaggtagcggttgtggtagtaagtttttcgggtgcgtacgcgttttgatttttttttattgtttcgttggttgttttttcgcggcgcgcgtttaggggtcgttatatttttgtaacggtttacgcgtcgcgtacgcgtagtancgagggggcgcgcgcgcgggagcggtcgtcgtaagaaggaggtgtcgtcgttgtcgttattgcgagggagggagggagggagggantnantnangtttgntcgttttnntnnntgnnntngntttntntnttttttnttttnt

SEQ ID NO: 7214 - DNA, 890 bp, Artificial Sequence
  chemically treated genomic DNA (Homo sapiens) CpG-island No: 7214
  misc_feature (2)..(2): n is either a, c, g or t
  misc_feature (7)..(7): n is either a, c, g or t
  misc_feature (14)..(14): n is either a, c, g or t
  misc_feature (16)..(16): n is either a, c, g or t
  misc_feature (18)..(18): n is either a, c, g or t
  misc_feature (22)..(22): n is either a, c, g or t
  misc_feature (24)..(24): n is either a, c, g or t
  misc_feature (26)..(28): n is either a, c, g or t
  misc_feature (31)..(33): n is either a, c, g or t
  misc_feature (35)..(36): n is either a, c, g or t
  misc_feature (44)..(44): n is either a, c, g or t
  misc_feature (50)..(50): n is either a, c, g or t
  misc_feature (52)..(52): n is either a, c, g or t
  misc_feature (54)..(54): n is either a, c, g or t
  misc_feature (56)..(56): n is either a, c, g or t
  misc_feature (58)..(58): n is either a, c, g or t
  misc_feature (144)..(144): n is either a, c, g or t
anaaaanaaaaaanananaaancnannncannnannaaaacgancaaacntnantnantccctccctccctccctccctcgcaataacgacaacgacgacacctccttcttacgacgaccgctcccgcgcgcgcgccccctcgntactacgcgtacgcgacgcgtaaaccgttacaaaaatataacgacccctaaacgcgcgccgcgaaaaaacaaccaacgaaacaataaaaaaaaatcaaaacgcgtacgcacccgaaaaacttactaccacaaccgctacctaaaattaaaaacgaccgcgaacgatacaatacgcgtacgcccccgaaaataccgctattacgacgaccgccgtcgcgactaaacgcgaaacgacttacaaacgaacaaaaaaaacgaaataaacgaacgcgcgtacgcgaaaaactaccaaccgacgcaactactaacgcaaaacgaaaaaaataatccgcaaaaactacgcgcgcgtctcaaacaaccgatctactacctcgcgctaactcttaaaaaaaaccgaaaaaaaaaaacataacccgattttaaaaataaaaaacgaaaaacgcgatcccgctcgcgcgaaacctaaccaaccaataaaaaacaataaaaaataaatttaccgcgcgaaccgcaaccgccgaaataacgaaaaaaaccaaaaaaaacgacgtaacgtaaaacgataaaacgaaactaaaaaaaaaaaaacgcaccaaaaaaaaaattaattaaaaaatataaaaaaacgtaacccgcctcaacccaatccgaaccccgcaattcgtcgtcccaaaaaaaaaaacacgaaactaaaaaacgcgtactctttctcctaactataaaaaaaatctacaaccaacgcgcgc

SEQ ID NO: 7215 - DNA, 890 bp, Artificial Sequence
  chemically treated genomic DNA (Homo sapiens) CpG-island No: 7215
  misc_feature (2)..(2): n is either a, c, g or t
  misc_feature (7)..(7): n is either a, c, g or t
  misc_feature (14)..(14): n is either a, c, g or t
  misc_feature (16)..(16): n is either a, c, g or t
  misc_feature (18)..(18): n is either a, c, g or t
  misc_feature (22)..(22): n is either a, c, g or t
  misc_feature (24)..(24): n is either a, c, g or t
  misc_feature (26)..(28): n is either a, c, g or t
  misc_feature (31)..(33): n is either a, c, g or t
  misc_feature (35)..(36): n is either a, c, g or t
  misc_feature (44)..(44): n is either a, c, g or t
  misc_feature (50)..(50): n is either a, c, g or t
  misc_feature (52)..(52): n is either a, c, g or t
  misc_feature (54)..(54): n is either a, c, g or t
  misc_feature (56)..(56): n is either a, c, g or t
  misc_feature (58)..(58): n is either a, c, g or t
  misc_feature (144)..(144): n is either a, c, g or t
gngaggngaagggngnangggntngnnntannngnnagggcggntaagtntngntnantttttttttttttttttttttcgtaatggcggtagcggcggtattttttttttgcgacggtcgttttcgcgcgcgcgttttttcgntattgcgcgtgcgcggcgcgtggatcgttgtaggggtataacggtttttgggcgcgcgtcgcgaagggataattagcgaggtagtgggaagaggttagagcgcgtgcgtattcgaggggtttattgttatagtcgttgtttgaggttaggaacggtcgcggacggtgtagtgcgcgtgcgttttcgaaaatgtcgttattgcggcggtcgtcgtcgcgattgagcgcgaggcgatttgtaaacgagtagagggagcgggatgggcgagcgcgcgtgcgcggggggttgttagtcggcgtagttgttggcgtagggcggagggagtggttcgtaggagttgcgcgcgcgttttaagtagtcgatttattgtttcgcgttggtttttggagaaagtcgaaggagagaggtatggttcggttttgggggtggggggcgaagggcgcgatttcgttcgcgcgggatttgattagttaatgggaagtaatgggaggtgggtttgtcgcgcgagtcgtagtcgtcgggataacggaggaggttagaaggagcgacgtaacgtggggcggtggggcggggttgagaaggagggagcgtattagagagggagttgattggaggatatgaggaggcgtggttcgttttagtttaattcgagtttcgtaattcgtcgttttaggaagaagagtacggggttggagagcgcgtgtttttttttttggttgtgaagaaaatttgtagttaacgcgcgt

SEQ ID NO: 7216 - DNA, 890 bp, Artificial Sequence
  chemically treated genomic DNA (Homo sapiens) CpG-island No: 7216
  misc_feature (747)..(747): n is either a, c, g or t
  misc_feature (833)..(833): n is either a, c, g or t
  misc_feature (835)..(835): n is either a, c, g or t
  misc_feature (837)..(837): n is either a, c, g or t
  misc_feature (839)..(839): n is either a, c, g or t
  misc_feature (841)..(841): n is either a, c, g or t
  misc_feature (847)..(847): n is either a, c, g or t
  misc_feature (855)..(856): n is either a, c, g or t
  misc_feature (858)..(860): n is either a, c, g or t
  misc_feature (863)..(865): n is either a, c, g or t
  misc_feature (867)..(867): n is either a, c, g or t
  misc_feature (869)..(869): n is either a, c, g or t
  misc_feature (873)..(873): n is either a, c, g or t
  misc_feature (875)..(875): n is either a, c, g or t
  misc_feature (877)..(877): n is either a, c, g or t
  misc_feature (884)..(884): n is either a, c, g or t
  misc_feature (889)..(889): n is either a, c, g or t
acgcgcgttaactacaaattttcttcacaaccaaaaaaaaaaacacgcgctctccaaccccgtactcttcttcctaaaacgacgaattacgaaactcgaattaaactaaaacgaaccacgcctcctcatatcctccaatcaactccctctctaatacgctccctccttctcaaccccgccccaccgccccacgttacgtcgctccttctaacctcctccgttatcccgacgactacgactcgcgcgacaaacccacctcccattacttcccattaactaatcaaatcccgcgcgaacgaaatcgcgcccttcgccccccacccccaaaaccgaaccatacctctctccttcgactttctccaaaaaccaacgcgaaacaataaatcgactacttaaaacgcgcgcgcaactcctacgaaccactccctccgccctacgccaacaactacgccgactaacaaccccccgcgcacgcgcgctcgcccatcccgctccctctactcgtttacaaatcgcctcgcgctcaatcgcgacgacgaccgccgcaataacgacattttcgaaaacgcacgcgcactacaccgtccgcgaccgttcctaacctcaaacaacgactataacaataaacccctcgaatacgcacgcgctctaacctcttcccactacctcgctaattatcccttcgcgacgcgcgcccaaaaaccgttatacccctacaacgatccacgcgccgcgcacgcgcaatancgaaaaaacgcgcgcgcgaaaacgaccgtcgcaaaaaaaaaataccgccgctaccgccattacgaaaaaaaaaaaaaaaaaaaaantnancnanacttanccgccctnncnnntannncnancccntncncccttcncctcnc

SEQ ID NO: 7217 - DNA, 796 bp, Artificial Sequence
  chemically treated genomic DNA (Homo sapiens) CpG-island No: 7217
ttattacggataaatttcgtagtgatatttttcggtagatgtgcgttaaagtttattttcggatgttggtggcgtaaaatttcgttacggatgcgttcgcggtttatattttcgcggatggcgatgaattttattttcggcgtgatgatgttttggcgggcgtagtgtagttgggtgataacggcgttttgtttttggtagcgtaaagggttgttagtacgtcgttaaaacgtagttcgtcgaggttattatttgttagtcgcgttttagtgtaatcggaattgcgtacggtaagtttttcggtatcgtcgcgcgtatcgatttacggttggcgtagttttgttagtttttgttgtacgttaatggtaatttgcggattattatacgggtcggaggtgtcgtagatcggaatcgtttcgtttttttcgtattgcggttgttttttgttatcgttaattagcgtcgggttaagttggattttacgtatcggtacgcgtacgtcggggtgtgtgttagtgatataaatgcgttttgagttgggaaaggcggtgttttttaggggtgtcgataaaatgttgggttcgggcgcgttgttcgcggcgggttagttttgttgtagatatagtttattttaaaaagttaaggacgtggtttgttagacgacggatgaagtaagagacgatcgtcgtaggggcgatgcgatagtagattaatttttgtttttttcgtaggtattagtttgattaggtttcgcggatttcgaataaacggttttagttagttaaggtatttcgat

SEQ ID NO: 7218 - DNA, 796 bp, Artificial Sequence
  chemically treated genomic DNA (Homo sapiens) CpG-island No: 7218
atcgaaataccttaactaactaaaaccgtttattcgaaatccgcgaaacctaatcaaactaatacctacgaaaaaaacaaaaattaatctactatcgcatcgcccctacgacgatcgtctcttacttcatccgtcgtctaacaaaccacgtccttaactttttaaaataaactatatctacaacaaaactaacccgccgcgaacaacgcgcccgaacccaacattttatcgacacccctaaaaaacaccgcctttcccaactcaaaacgcatttatatcactaacacacaccccgacgtacgcgtaccgatacgtaaaatccaacttaacccgacgctaattaacgataacaaaaaacaaccgcaatacgaaaaaaacgaaacgattccgatctacgacacctccgacccgtataataatccgcaaattaccattaacgtacaacaaaaactaacaaaactacgccaaccgtaaatcgatacgcgcgacgataccgaaaaacttaccgtacgcaattccgattacactaaaacgcgactaacaaataataacctcgacgaactacgttttaacgacgtactaacaaccctttacgctaccaaaaacaaaacgccgttatcacccaactacactacgcccgccaaaacatcatcacgccgaaaataaaattcatcgccatccgcgaaaatataaaccgcgaacgcatccgtaacgaaattttacgccaccaacatccgaaaataaactttaacgcacatctaccgaaaaatatcactacgaaatttatccgtaataa

SEQ ID NO: 7219 - DNA, 796 bp, Artificial Sequence
  chemically treated genomic DNA (Homo sapiens) CpG-island No: 7219
gtcggagtgttttaattggttgagatcgtttattcgggattcgcggaatttgattaggttaatatttgcgaagggaataagagttaatttgttatcgtatcgtttttgcggcgatcgttttttgttttattcgtcgtttgataagttacgtttttaattttttggaatgagttatgtttgtaataaaattgattcgtcgcgaataacgcgttcgggtttaatattttatcgatatttttggaaggtatcgttttttttaatttaaaacgtatttatattattggtatatatttcggcgtgcgcgtgtcgatgcgtgagatttagtttagttcgacgttaattggcggtagtaaagaatagtcgtagtacgaagaaaacgaagcgatttcggtttacgatattttcggttcgtatggtgattcgtagattgttattaacgtgtagtaagggttggtaaaattacgttagtcgtggatcgatgcgcgcggcgatatcgaagaatttatcgtgcgtagtttcgattatattaaagcgcggttggtagatgatggtttcgacgaattgcgttttaacggcgtattgataattttttacgttgttaaaagtaggacgtcgttgttatttaattgtattacgttcgttagggtattattacgtcggaaatggaatttatcgttattcgcgagaatatgggtcgcgagcgtattcgtagcgaggttttacgttattagtattcgggaatgagttttggcgtatatttgtcggaaaatattattgcggaatttgttcgtgatga

SEQ ID NO: 7220 - DNA, 796 bp, Artificial Sequence
  chemically treated genomic DNA (Homo sapiens) CpG-island No: 7220
tcatcacgaacaaattccgcaataatattttccgacaaatatacgccaaaactcattcccgaatactaataacgtaaaacctcgctacgaatacgctcgcgacccatattctcgcgaataacgataaattccatttccgacgtaataataccctaacgaacgtaatacaattaaataacaacgacgtcctacttttaacaacgtaaaaaattatcaatacgccgttaaaacgcaattcgtcgaaaccatcatctaccaaccgcgctttaatataatcgaaactacgcacgataaattcttcgatatcgccgcgcgcatcgatccacgactaacgtaattttaccaacccttactacacgttaataacaatctacgaatcaccatacgaaccgaaaatatcgtaaaccgaaatcgcttcgttttcttcgtactacgactattctttactaccgccaattaacgtcgaactaaactaaatctcacgcatcgacacgcgcacgccgaaatatataccaataatataaatacgttttaaattaaaaaaaacgataccttccaaaaatatcgataaaatattaaacccgaacgcgttattcgcgacgaatcaattttattacaaacataactcattccaaaaaattaaaaacgtaacttatcaaacgacgaataaaacaaaaaacgatcgccgcaaaaacgatacgataacaaattaactcttattcccttcgcaaatattaacctaatcaaattccgcgaatcccgaataaacgatctcaaccaattaaaacactccgac

SEQ ID NO: 7221 - DNA, 550 bp, Artificial Sequence
  chemically treated genomic DNA (Homo sapiens) CpG-island No: 7221
  misc_feature (163)..(163): n is either a, c, g or t
  misc_feature (202)..(202): n is either a, c, g or t
tttgttttttcgcggtacggatagttatcgatagtagtgtttttatcgtatcgttgcgtttatcgaataatttagatattacgtcggagttacggtttagatcgagcgttagttgcgttatatcgtttgagttaattgagaagtcgtcgaaatattcgagggnaataattttggtcgtttggcgggggttcggtttaacggntaaggcgttggacgggattttatatattatgatttttagttcgttttcgttacgttttagtttttgacgcgttagttttttaattatcgttttcgtttgatttacggtacgtacgaacgggattatgattttaacgttggttagttttatgtcgttgcgtatacgttttattgttttatattttagcgcgaaatagtcgcggtaagttgtcggaaatatagcggtttttgttgtttacggaatgtcgtagtatcggcgttttttttatttggttcgtaacgtttattatcgattagtgttggtatattcgttcgatttaaaattagagagacggataatgacgcgttt

SEQ ID NO: 7222 - DNA, 550 bp, Artificial Sequence
  chemically treated genomic DNA (Homo sapiens) CpG-island No: 7222
  misc_feature (349)..(349): n is either a, c, g or t
  misc_feature (388)..(388): n is either a, c, g or t
aaacgcgtcattatccgtctctctaattttaaatcgaacgaatataccaacactaatcgataataaacgttacgaaccaaataaaaaaaacgccgatactacgacattccgtaaacaacaaaaaccgctatatttccgacaacttaccgcgactatttcgcgctaaaatataaaacaataaaacgtatacgcaacgacataaaactaaccaacgttaaaatcataatcccgttcgtacgtaccgtaaatcaaacgaaaacgataattaaaaaactaacgcgtcaaaaactaaaacgtaacgaaaacgaactaaaaatcataatatataaaatcccgtccaacgccttanccgttaaaccgaacccccgccaaacgaccaaaattattnccctcgaatatttcgacgacttctcaattaactcaaacgatataacgcaactaacgctcgatctaaaccgtaactccgacgtaatatctaaattattcgataaacgcaacgatacgataaaaacactactatcgataactatccgtaccgcgaaaaaacaaa

SEQ ID NO: 7223 - DNA, 550 bp, Artificial Sequence
  chemically treated genomic DNA (Homo sapiens) CpG-island No: 7223
  misc_feature (349)..(349): n is either a, c, g or t
  misc_feature (388)..(388): n is either a, c, g or t
aagcgcgttattgttcgtttttttgattttaaatcgaacgaatatgttaatattggtcggtggtgagcgttacgagttagatgaagagaacgtcgatgttacggtatttcgtggatagtagggatcgttatgttttcgatagtttatcgcgattgtttcgcgttggagtgtgaagtagtgaaacgtgtgcgtaacgatatgggattgattaacgttgagattatgatttcgttcgtgcgtatcgtagattaggcgaaagcggtggttgaagaattggcgcgttaggggttgaaacgtggcgagaacgggttgaaaattatgatgtgtgaaatttcgtttaacgttttgntcgttgggtcgggttttcgttagacgattagggttgttnttttcgaatatttcgacggttttttaattggtttaaacgatatgacgtagttggcgttcggtttggatcgtgatttcggcgtggtgtttgaattgttcgatgagcgtaacgatgcggtgaaagtattgttgtcgatggttattcgtgtcgcgaagaaatagg

SEQ ID NO: 7224 - DNA, 550 bp, Artificial Sequence
  chemically treated genomic DNA (Homo sapiens) CpG-island No: 7224
  misc_feature (163)..(163): n is either a, c, g or t
  misc_feature (202)..(202): n is either a, c, g or t
cctatttcttcgcgacacgaataaccatcgacaacaatactttcaccgcatcgttacgctcatcgaacaattcaaacaccacgccgaaatcacgatccaaaccgaacgccaactacgtcatatcgtttaaaccaattaaaaaaccgtcgaaatattcgaaaanaacaaccctaatcgtctaacgaaaacccgacccaacgancaaaacgttaaacgaaatttcacacatcataattttcaacccgttctcgccacgtttcaacccctaacgcgccaattcttcaaccaccgctttcgcctaatctacgatacgcacgaacgaaatcataatctcaacgttaatcaatcccatatcgttacgcacacgtttcactacttcacactccaacgcgaaacaatcgcgataaactatcgaaaacataacgatccctactatccacgaaataccgtaacatcgacgttctcttcatctaactcgtaacgctcaccaccgaccaatattaacatattcgttcgatttaaaatcaaaaaaacgaacaataacgcgctt

SEQ ID NO: 7225 - DNA, 704 bp, Artificial Sequence
  chemically treated genomic DNA (Homo sapiens) CpG-island No: 7225
gttaatgcgtattttttatttttattaatttttattaatttattttttttacgttttttatttattataagcgatcgtttttttttttttttttttttcgttttttttgtattttgcgtttttttattcgtttgttttttattcgttgttttcgatttgtattgcgttttttgttattttttttttgttattttgtttttttttttttttttttacgttttatttttttatcgcgtttttttattataatgcgtaattgtatattttttttttttttcgtttatatacggtttgtttttatatatatttttacgtatttttatcgcgtattacgttcgttatttttttttttttttgttttattatttttaatttttttattttttttttagttattatttttcggttcgtatttttttcgtcgtatttttatttttttttttttttttttttcgtcgttttttttgttgagtatttagatattttttcggtttcgcggttttatttattagtttggtacgttggtacgttgggttttattattttttcgggtttttatttggcgtattttttttcggtttttttcgcgttttttttcgtcgattttttttcgttggttttttcgttttttttggttcgtttcgtttcggttttttatttcgggcgtcgttgtttatttattgtttcggtttttttttcgtcgt

SEQ ID NO: 7226 - DNA, 704 bp, Artificial Sequence
  chemically treated genomic DNA (Homo sapiens) CpG-island No: 7226
acgacgaaaaaaaaaccgaaacaataaataaacaacgacgcccgaaataaaaaaccgaaacgaaacgaaccaaaaaaaacgaaaaaaccaacgaaaaaaaatcgacgaaaaaaaacgcgaaaaaaaccgaaaaaaaatacgccaaataaaaacccgaaaaaataataaaacccaacgtaccaacgtaccaaactaataaataaaaccgcgaaaccgaaaaaatatctaaatactcaacaaaaaaaacgacgaaaaaaaaaaaaaaaaaaaaataaaaatacgacgaaaaaaatacgaaccgaaaaataataactaaaaaaaaaataaaaaaattaaaaataataaaacaaaaaaaaaaaaaaataacgaacgtaatacgcgataaaaatacgtaaaaatatatataaaaacaaaccgtatataaacgaaaaaaaaaaaaaatatacaattacgcattataataaaaaaacgcgataaaaaaataaaacgtaaaaaaaaaaaaaaaaaaacaaaataacaaaaaaaaaataacaaaaaacgcaatacaaatcgaaaacaacgaataaaaaacaaacgaataaaaaaacgcaaaatacaaaaaaaacgaaaaaaaaaaaaaaaaaaaaacgatcgcttataataaataaaaaacgtaaaaaaaataaattaataaaaattaataaaaataaaaaatacgcattaac

SEQ ID NO: 7227 - DNA, 704 bp, Artificial Sequence
  chemically treated genomic DNA (Homo sapiens) CpG-island No: 7227
acgacgagggagaggtcgggatagtgggtggatagcggcgttcggagtagagagtcgaggcgaggcgggttaggaggggcgggagggttagcggaggagagtcggcggggggaggcgcgggggaggtcgaggaggggtgcgttaggtggaggttcgggagagtggtggggtttagcgtgttagcgtgttaggttagtgggtgggatcgcgaggtcgaggaagtgtttaagtgtttaatagagagagcggcgagggaggggggggggagggggtgggggtgcgacgaggggggtgcgggtcggaaagtggtggttgagaggggagtggaggagttaggagtagtagagtagaaagggaggggagtggcgagcgtggtgcgcggtgaaggtgcgtgagagtgtgtgtgggagtaggtcgtgtgtgagcggagaggaaagggagtgtgtagttgcgtattgtagtagaagagcgcggtgagggggtggggcgtgggagagaggggagaggggtagggtggtaagaggggggtggtagagggcgtagtgtaggtcgggggtagcgggtagggagtaggcgggtgagagagcgtagggtgtagaggaagcgggggagaggaggggggaggggcggtcgtttgtggtgggtgggaggcgtagaggaggtgagttagtgggggttggtgggagtggggagtgcgtattggt

SEQ ID NO: 7228 - DNA, 704 bp, Artificial Sequence
  chemically treated genomic DNA (Homo sapiens) CpG-island No: 7228
accaatacgcactccccactcccaccaacccccactaactcacctcctctacgcctcccacccaccacaaacgaccgcccctcccccctcctctcccccgcttcctctacaccctacgctctctcacccgcctactccctacccgctacccccgacctacactacgccctctaccacccccctcttaccaccctacccctctcccctctctcccacgccccaccccctcaccgcgctcttctactacaatacgcaactacacactccctttcctctccgctcacacacgacctactcccacacacactctcacgcaccttcaccgcgcaccacgctcgccactcccctccctttctactctactactcctaactcctccactcccctctcaaccaccactttccgacccgcacccccctcgtcgcacccccaccccctcccccccccctccctcgccgctctctctattaaacacttaaacacttcctcgacctcgcgatcccacccactaacctaacacgctaacacgctaaaccccaccactctcccgaacctccacctaacgcacccctcctcgacctcccccgcgcctccccccgccgactctcctccgctaaccctcccgcccctcctaacccgcctcgcctcgactctctactccgaacgccgctatccacccactatcccgacctctccctcgtcgt

SEQ ID NO: 7229 - DNA, 629 bp, Artificial Sequence
  chemically treated genomic DNA (Homo sapiens) CpG-island No: 7229
cgtgatttgaaatcggtggtggaaatggggtcggatgcgttgatatatgttcgatttagggttgattatgttggtgcgtgagtatttttttgaaatgtcgatttatttttcggtgtaggttaacgtcgtgaattgggcgacggtgaaattttggtagtaaatgggtttgattcgcgtgattttttttcgcgagttgtcgttggaagagattgaagagattcgtaattaggtgtcggatatggagatcgagattttcgtttacggcgcgttgtgtatggtttatttcggtcgttgtttgttttttggttatattaataagcgcgattcgaattagggtatttgtattaacgtttgtcgttgggagtataacgtttaggaagggaaagaagatgatgttggtaatatcgtatataagtacgagtcgatttcggtgtaaaatgttgagtcgacgttgggtatcggcgtattaatcgataaagtgtttatgatcgaagaggtttagcgttcgggcgagtatatgatcgcgtttgaagatgagtacggtatttatattatgaattcgaaagatttgcgcgttatcgtttatgtagaacgtttgattaaaatgggcgtgtattcgttgaaaatcg

SEQ ID NO: 7230 - DNA, 629 bp, Artificial Sequence
  chemically treated genomic DNA (Homo sapiens) CpG-island No: 7230
cgattttcaacgaatacacgcccattttaatcaaacgttctacataaacgataacgcgcaaatctttcgaattcataatataaataccgtactcatcttcaaacgcgatcatatactcgcccgaacgctaaacctcttcgatcataaacactttatcgattaatacgccgatacccaacgtcgactcaacattttacaccgaaatcgactcgtacttatatacgatattaccaacatcatcttctttcccttcctaaacgttatactcccaacgacaaacgttaatacaaataccctaattcgaatcgcgcttattaatataaccaaaaaacaaacaacgaccgaaataaaccatacacaacgcgccgtaaacgaaaatctcgatctccatatccgacacctaattacgaatctcttcaatctcttccaacgacaactcgcgaaaaaaaatcacgcgaatcaaacccatttactaccaaaatttcaccgtcgcccaattcacgacgttaacctacaccgaaaaataaatcgacatttcaaaaaaatactcacgcaccaacataatcaaccctaaatcgaacatatatcaacgcatccgaccccatttccaccaccgatttcaaatcacg

SEQ ID NO: 7231 - DNA, 629 bp, Artificial Sequence
  chemically treated genomic DNA (Homo sapiens) CpG-island No: 7231
cgatttttagcgaatgtacgtttattttggttaggcgttttatatgggcgatggcgcgtagatttttcgagtttatgatgtaagtgtcgtgtttatttttaaacgcggttatatattcgttcggacgttgggttttttcgattataaatattttgtcggttggtgcgtcgatatttagcgtcggtttaatattttgtatcggaatcggttcgtatttgtgtacgatgttgttaatattattttttttttttttttggacgttgtatttttagcggtaggcgttggtgtaggtgttttggttcgggtcgcgtttgttgatatagttagagagtaggtagcgatcggagtaggttatgtatagcgcgtcgtgaacgaagatttcgatttttatattcggtatttgattgcggatttttttaattttttttagcgatagttcgcgagagaggattacgcgggttaggtttatttgttgttagaattttatcgtcgtttagtttacggcgttagtttgtatcgaaaggtggatcggtattttagggaagtgtttacgtattagtataattagttttggatcggatatatattagcgtattcggttttatttttattatcggttttaggttacg

SEQ ID NO: 7232 - DNA, 629 bp, Artificial Sequence
  chemically treated genomic DNA (Homo sapiens) CpG-island No: 7232
cgtaacctaaaaccgataataaaaataaaaccgaatacgctaatatatatccgatccaaaactaattatactaatacgtaaacacttccctaaaataccgatccacctttcgatacaaactaacgccgtaaactaaacgacgataaaattctaacaacaaataaacctaacccgcgtaatcctctctcgcgaactatcgctaaaaaaaattaaaaaaatccgcaatcaaataccgaatataaaaatcgaaatcttcgttcacgacgcgctatacataacctactccgatcgctacctactctctaactatatcaacaaacgcgacccgaaccaaaacacctacaccaacgcctaccgctaaaaatacaacgtccaaaaaaaaaaaaaaaataatattaacaacatcgtacacaaatacgaaccgattccgatacaaaatattaaaccgacgctaaatatcgacgcaccaaccgacaaaatatttataatcgaaaaaacccaacgtccgaacgaatatataaccgcgtttaaaaataaacacgacacttacatcataaactcgaaaaatctacgcgccatcgcccatataaaacgcctaaccaaaataaacgtacattcgctaaaaatcg

SEQ ID NO: 7233 - DNA, 509 bp, Artificial Sequence
  chemically treated genomic DNA (Homo sapiens) CpG-island No: 7233
agcgcgttcgattcgcgggtaggggattgcgggtcgggaggagagcgcggtattcgttttttttttgcgttcgttaagtggggggttgagggtttggggtacgggaggagggagacggggtacgggaagaaggagacggggcgcgggaagaatgcgacggggcgcgggaggaatgcgacggggcgcgagatatggcgcgggaagggcggggggagtcgttggttaggttcgagttcgcggggtgttcggcgggttggcggcgggtttatttttgtcggtttttgtttttgttttttcgggcgcgtggtcggtgcgtttgttttacgggttttttcgttgttcggtcggcgggagttttttttagcgtttcgtttggcgtttggatgtttgttagttttgtaggttatcgacgttcgcgcgatgttaaaaggcggggtggggcgggtattttgttcgggttgaggagggtatttgtttatatttgttagagaaatttagaggttttgggt

SEQ ID NO: 7234 - DNA, 509 bp, Artificial Sequence
  chemically treated genomic DNA (Homo sapiens) CpG-island No: 7234
acccaaaacctctaaatttctctaacaaatataaacaaataccctcctcaacccgaacaaaatacccgccccaccccgccttttaacatcgcgcgaacgtcgataacctacaaaactaacaaacatccaaacgccaaacgaaacgctaaaaaaaactcccgccgaccgaacaacgaaaaaacccgtaaaacaaacgcaccgaccacgcgcccgaaaaaacaaaaacaaaaaccgacaaaaataaacccgccgccaacccgccgaacaccccgcgaactcgaacctaaccaacgactccccccgcccttcccgcgccatatctcgcgccccgtcgcattcctcccgcgccccgtcgcattcttcccgcgccccgtctccttcttcccgtaccccgtctccctcctcccgtaccccaaaccctcaaccccccacttaacgaacgcaaaaaaaaaacgaataccgcgctctcctcccgacccgcaatcccctacccgcgaatcgaacgcgct

SEQ ID NO: 7235 - DNA, 509 bp, Artificial Sequence
  chemically treated genomic DNA (Homo sapiens) CpG-island No: 7235
atttaaagtttttgggtttttttagtagatatgggtaggtgttttttttagttcgagtaagatgttcgttttatttcgttttttggtatcgcgcgggcgtcggtggtttgtaggattggtaggtatttaggcgttaggcgaagcgttgagggaggttttcgtcggtcgaatagcggggagattcgtgaagtaggcgtatcggttacgcgttcggagggatagggatagggatcggtaggggtgggttcgtcgttaattcgtcgggtatttcgcggattcgggtttagttagcgatttttttcgtttttttcgcgttatgtttcgcgtttcgtcgtatttttttcgcgtttcgtcgtatttttttcgcgtttcgttttttttttttcgtgtttcgttttttttttttcgtgttttaggtttttagttttttatttgacgggcgtagggaaggggcgggtgtcgcgtttttttttcggttcgtagttttttattcgcgggtcgagcgcgtt

SEQ ID NO: 7236 - DNA, 509 bp, Artificial Sequence
  chemically treated genomic DNA (Homo sapiens) CpG-island No: 7236
aacgcgctcgacccgcgaataaaaaactacgaaccgaaaaaaaaacgcgacacccgccccttccctacgcccgtcaaataaaaaactaaaaacctaaaacacgaaaaaaaaaaaacgaaacacgaaaaaaaaaaaacgaaacgcgaaaaaaatacgacgaaacgcgaaaaaaatacgacgaaacgcgaaacataacgcgaaaaaaacgaaaaaaatcgctaactaaacccgaatccgcgaaatacccgacgaattaacgacgaacccacccctaccgatccctatccctatccctccgaacgcgtaaccgatacgcctacttcacgaatctccccgctattcgaccgacgaaaacctccctcaacgcttcgcctaacgcctaaatacctaccaatcctacaaaccaccgacgcccgcgcgataccaaaaaacgaaataaaacgaacatcttactcgaactaaaaaaaacacctacccatatctactaaaaaaacccaaaaactttaaat

SEQ ID NO: 7237 - DNA, 565 bp, Artificial Sequence
  chemically treated genomic DNA (Homo sapiens) CpG-island No: 7237
atggagcggtaatttgtaattagtcggcggtgcgtagtttatatagtacgtggttcgtattataggttgcgttattgagtgagttagtttttagatgttaggcgtatgacgagtttacggagcgggatttttttttttacgtatttcgggttttttgggcggggtcgtcgggtaggggggcggggagtattttgcgtcgttttttcgggatcgtttcgtttcgtcgtaattagagagttgggttggagttttaagcggaaatcgcgggagtcgagtttagttaggaatgtagattttttgaaaattaagtcgaagaatgcgtggttcggtgtttacgtataatgagtattgtttttcgtcgttttgtttatggtcgcgcgtgttttcgggtttaggggttgttttttacggttatttgttttgtttgtcgcggtttggtttttttatcggatttattaggcgttgggcgtgggtttttttattttggcgatcgtggtatatcggcgttttgagtttaattgtgtttttggggttatttttttttgtcgggagtacggtacgataa

SEQ ID NO: 7238 - DNA, 565 bp, Artificial Sequence
  chemically treated genomic DNA (Homo sapiens) CpG-island No: 7238
ttatcgtaccgtactcccgacaaaaaaaaataaccccaaaaacacaattaaactcaaaacgccgatataccacgatcgccaaaataaaaaaacccacgcccaacgcctaataaatccgataaaaaaaccaaaccgcgacaaacaaaacaaataaccgtaaaaaacaacccctaaacccgaaaacacgcgcgaccataaacaaaacgacgaaaaacaatactcattatacgtaaacaccgaaccacgcattcttcgacttaattttcaaaaaatctacattcctaactaaactcgactcccgcgatttccgcttaaaactccaacccaactctctaattacgacgaaacgaaacgatcccgaaaaaacgacgcaaaatactccccgcccccctacccgacgaccccgcccaaaaaacccgaaatacgtaaaaaaaaaaatcccgctccgtaaactcgtcatacgcctaacatctaaaaactaactcactcaataacgcaacctataatacgaaccacgtactatataaactacgcaccgccgactaattacaaattaccgctccat

SEQ ID NO: 7239 - DNA, 565 bp, Artificial Sequence
  chemically treated genomic DNA (Homo sapiens) CpG-island No: 7239
ttatcgtatcgtgttttcgataaggaggggtagttttaaaaatatagttaaatttagaacgtcggtatgttacggtcgttaaaatagaaaagtttacgtttagcgtttggtgagttcggtgaaggaattaggtcgcgataagtagggtaagtagtcgtgaggaataatttttagattcgagagtacgcgcggttatgagtaaagcggcggaagatagtatttattatgcgtggatatcggattacgtatttttcggtttggtttttaggaggtttgtatttttagttgggttcggttttcgcggttttcgtttggagttttagtttagttttttgattgcgacggggcggggcggtttcgggaaggcgacgtaggatgtttttcgtttttttgttcggcggtttcgtttagggagttcgggatgcgtggggagggaggtttcgtttcgtggattcgttatgcgtttggtatttggagattggtttatttaataacgtagtttgtgatgcggattacgtgttgtgtgggttgcgtatcgtcggttgattataggttatcgttttat

SEQ ID NO: 7240 - DNA, 565 bp, Artificial Sequence
  chemically treated genomic DNA (Homo sapiens) CpG-island No: 7240
ataaaacgataacctataatcaaccgacgatacgcaacccacacaacacgtaatccgcatcacaaactacgttattaaataaaccaatctccaaataccaaacgcataacgaatccacgaaacgaaacctccctccccacgcatcccgaactccctaaacgaaaccgccgaacaaaaaaacgaaaaacatcctacgtcgccttcccgaaaccgccccgccccgtcgcaatcaaaaaactaaactaaaactccaaacgaaaaccgcgaaaaccgaacccaactaaaaatacaaacctcctaaaaaccaaaccgaaaaatacgtaatccgatatccacgcataataaatactatcttccgccgctttactcataaccgcgcgtactctcgaatctaaaaattattcctcacgactacttaccctacttatcgcgacctaattccttcaccgaactcaccaaacgctaaacgtaaacttttctattttaacgaccgtaacataccgacgttctaaatttaactatatttttaaaactacccctccttatcgaaaacacgatacgataa

SEQ ID NO: 7241 - DNA, 806 bp, Artificial Sequence
  chemically treated genomic DNA (Homo sapiens) CpG-island No: 7241
cggtgatggcgcgttgggagggcggcggtttttgtagcgagggtggtggcgatgcgtatatcgagaggataaggaagcggttttcgacgagttttttcggggtttatggggtttttggcggttcggtttcggaggttagcggggttgttcgatttggtattggaaataatggtggttcggggttggaggtaatggcgcgagtgttggggggtaggggcgattaggggagtttcggtttttcgggtttagcgtcgcggagttttgttgcgggttttagtggtagtattttcgggaatcgtaggtgttgatttaaggttcggaataggcgggttttttgtttatattttgcggcgttcgcgattcgggtcgggcgattcggcgtcgggttttgttattcgttcgtatttagaggtcgtaaggtagtcgttagtttcgggattggattttagggcgttttcggttttgcgaggttttcgttttttttttcgttttttttttatcgtttttttgaggtattttgatgcgggcgggtatttttgtcgaaaatatttatagcgttcgttttttcggtttttcgagtagtgattttttcgcggttaatttttttagggaaattagcgattcgcggtttagatagcgattttcgttcgtaggtttttgttttgtttttagatttcggttttagtggtatttgtttagcgaggtttcgtttaattaagttattcgaattaattatttatttattcgttattatattatttcgatttaattcgtagcggggtattgattttatattcgtgtgtttt

SEQ ID NO: 7242 - DNA, 806 bp, Artificial Sequence
  chemically treated genomic DNA (Homo sapiens) CpG-island No: 7242
aaaacacacgaatataaaatcaataccccgctacgaattaaatcgaaataatataataacgaataaataaataattaattcgaataacttaattaaacgaaacctcgctaaacaaataccactaaaaccgaaatctaaaaacaaaacaaaaacctacgaacgaaaatcgctatctaaaccgcgaatcgctaatttccctaaaaaaattaaccgcgaaaaaatcactactcgaaaaaccgaaaaaacgaacgctataaatattttcgacaaaaatacccgcccgcatcaaaatacctcaaaaaaacgataaaaaaaaaacgaaaaaaaaaacgaaaacctcgcaaaaccgaaaacgccctaaaatccaatcccgaaactaacgactaccttacgacctctaaatacgaacgaataacaaaacccgacgccgaatcgcccgacccgaatcgcgaacgccgcaaaatataaacaaaaaacccgcctattccgaaccttaaatcaacacctacgattcccgaaaatactaccactaaaacccgcaacaaaactccgcgacgctaaacccgaaaaaccgaaactcccctaatcgcccctaccccccaacactcgcgccattacctccaaccccgaaccaccattatttccaataccaaatcgaacaaccccgctaacctccgaaaccgaaccgccaaaaaccccataaaccccgaaaaaactcgtcgaaaaccgcttccttatcctctcgatatacgcatcgccaccaccctcgctacaaaaaccgccgccctcccaacgcgccatcaccg

SEQ ID NO: 7243 - DNA, 806 bp, Artificial Sequence
  chemically treated genomic DNA (Homo sapiens) CpG-island No: 7243
aagatatacgagtgtaaagttagtgtttcgttgcgaattaaatcggggtgatgtgatggcgagtgagtgggtagttaattcggatggtttggttagacgaggtttcgttgagtaggtgttattgaagtcgaagtttgaaggtagagtaggaatttgcgggcgaaggtcgttatttgaatcgcgaatcgttggtttttttggggaggttggtcgcggagggattattgttcgaaggatcgagggagcgggcgttgtaggtgttttcggtagagatgttcgttcgtattagagtgttttaggagggcggtgaggaggagacggaagagagggcggggatttcgtagggtcgagggcgttttggggtttagtttcggggttggcggttgttttgcggtttttaggtgcgggcggataataaaattcggcgtcggatcgttcggttcgggtcgcgggcgtcgtaggatgtgggtagaaggttcgtttgtttcgagttttaaattaatatttgcggttttcgggggtgttattattggggttcgtagtaaggtttcgcggcgttaggttcgagaaatcgaaatttttttagtcgtttttgttttttagtattcgcgttattgtttttagtttcgagttattattgtttttagtgttaaatcgggtagtttcgttagttttcgaggtcgaatcgttaggggttttataagtttcgaggaggttcgtcgggaatcgtttttttattttttcggtatgcgtatcgttattattttcgttgtagaggtcgtcgtttttttagcgcgttattatcg

SEQ ID NO: 7244 - DNA, 806 bp, Artificial Sequence
  chemically treated genomic DNA (Homo sapiens) CpG-island No: 7244
cgataataacgcgctaaaaaaacgacgacctctacaacgaaaataataacgatacgcataccgaaaaaataaaaaaacgattcccgacgaacctcctcgaaacttataaaacccctaacgattcgacctcgaaaactaacgaaactacccgatttaacactaaaaacaataataactcgaaactaaaaacaataacgcgaatactaaaaaacaaaaacgactaaaaaaatttcgatttctcgaacctaacgccgcgaaaccttactacgaaccccaataataacacccccgaaaaccgcaaatattaatttaaaactcgaaacaaacgaaccttctacccacatcctacgacgcccgcgacccgaaccgaacgatccgacgccgaattttattatccgcccgcacctaaaaaccgcaaaacaaccgccaaccccgaaactaaaccccaaaacgccctcgaccctacgaaatccccgccctctcttccgtctcctcctcaccgccctcctaaaacactctaatacgaacgaacatctctaccgaaaacacctacaacgcccgctccctcgatccttcgaacaataatccctccgcgaccaacctccccaaaaaaaccaacgattcgcgattcaaataacgaccttcgcccgcaaattcctactctaccttcaaacttcgacttcaataacacctactcaacgaaacctcgtctaaccaaaccatccgaattaactacccactcactcgccatcacatcaccccgatttaattcgcaacgaaacactaactttacactcgtatatctt

SEQ ID NO: 7245 - DNA, 700 bp, Artificial Sequence
  chemically treated genomic DNA (Homo sapiens) CpG-island No: 7245
gtttcggcgttcgggatcgggcgggtcgtagtagggttttatatttgttgagtgattgaatatcgttttcggtcggggagagcgtcgtagtcgggtttattttaggtaggggttgggttttttcggtttcgtttaggtttcgtttttagcgcgaattcgtttttatttcgtttgtttacggagtagtagggggtttgattgtgttttttttttttgtttttttcgttttttttgtagttgttacgaaaattcggaacggcggagcggcgtcgtttttcgcggtatttttttggtagtttttggaggtcgcgttgggtatgtttagttagttgggtcgttttatttttcggagtaggaaagttcgggcgtttcggttgtaaagagtcgcggcggggggaaaatggagttttttattaattgtgagtgggttgtcgaggcgtcgggattcgggtttttcggagttttgatgggtgagggtagtattgacgtatttggtgcggttggcgaatcgcgtagtgacgaatcgatttcgtaatcggggaatttttagatttcgtagtcgagtgggtagtgggaaagttggtattttatgtttgttttcggaggaggcggtgtcggttcgatttttttgtaggagcgttaagttgtggtagttgtcgagtttaatttttgtggggcgttaggagttgttttttttttt

SEQ ID NO: 7246 - DNA, 700 bp, Artificial Sequence
  chemically treated genomic DNA (Homo sapiens) CpG-island No: 7246
aaaaaaaaaaacaactcctaacgccccacaaaaattaaactcgacaactaccacaacttaacgctcctacaaaaaaatcgaaccgacaccgcctcctccgaaaacaaacataaaataccaactttcccactacccactcgactacgaaatctaaaaattccccgattacgaaatcgattcgtcactacgcgattcgccaaccgcaccaaatacgtcaatactaccctcacccatcaaaactccgaaaaacccgaatcccgacgcctcgacaacccactcacaattaataaaaaactccattttccccccgccgcgactctttacaaccgaaacgcccgaactttcctactccgaaaaataaaacgacccaactaactaaacatacccaacgcgacctccaaaaactaccaaaaaaataccgcgaaaaacgacgccgctccgccgttccgaattttcgtaacaactacaaaaaaaacgaaaaaaacaaaaaaaaaaaacacaatcaaaccccctactactccgtaaacaaacgaaataaaaacgaattcgcgctaaaaacgaaacctaaacgaaaccgaaaaaacccaacccctacctaaaataaacccgactacgacgctctccccgaccgaaaacgatattcaatcactcaacaaatataaaaccctactacgacccgcccgatcccgaacgccgaaac

SEQ ID NO: 7247 - DNA, 700 bp, Artificial Sequence
  chemically treated genomic DNA (Homo sapiens) CpG-island No: 7247
gggaagggggatagtttttggcgttttataaaagttgggttcggtagttgttataatttaacgtttttataggagagtcgggtcgatatcgtttttttcgggggtaaatatgagatgttaatttttttattgtttattcggttgcggagtttagaggtttttcgattgcgagatcggttcgttattgcgcgattcgttagtcgtattaagtgcgttaatattgtttttatttattagggtttcggagagttcgggtttcggcgtttcggtagtttatttataattggtgaagggttttatttttttttcgtcgcggttttttatagtcggagcgttcgagtttttttatttcgagagatgaggcggtttagttgattgagtatgtttagcgcggtttttaagggttgttagggaggtgtcgcgaggggcggcgtcgtttcgtcgtttcgggttttcgtggtagttgtagaaagagcgagggaagtaagagggaaaagtatagttaaattttttgttgtttcgtggataggcgaggtgggagcgggttcgcgttgggggcggggtttaggcggggtcgggaaagtttagtttttatttgaagtggattcggttgcggcgtttttttcggtcgggaacggtgtttagttatttaataaatgtggagttttattgcgattcgttcgatttcggacgtcgagat

SEQ ID NO: 7248 - DNA, 700 bp, Artificial Sequence
  chemically treated genomic DNA (Homo sapiens) CpG-island No: 7248
atctcgacgtccgaaatcgaacgaatcgcaataaaactccacatttattaaataactaaacaccgttcccgaccgaaaaaaacgccgcaaccgaatccacttcaaataaaaactaaactttcccgaccccgcctaaaccccgcccccaacgcgaacccgctcccacctcgcctatccacgaaacaacaaaaaatttaactatacttttccctcttacttccctcgctctttctacaactaccacgaaaacccgaaacgacgaaacgacgccgcccctcgcgacacctccctaacaacccttaaaaaccgcgctaaacatactcaatcaactaaaccgcctcatctctcgaaataaaaaaactcgaacgctccgactataaaaaaccgcgacgaaaaaaaaataaaacccttcaccaattataaataaactaccgaaacgccgaaacccgaactctccgaaaccctaataaataaaaacaatattaacgcacttaatacgactaacgaatcgcgcaataacgaaccgatctcgcaatcgaaaaacctctaaactccgcaaccgaataaacaataaaaaaattaacatctcatatttacccccgaaaaaaacgatatcgacccgactctcctataaaaacgttaaattataacaactaccgaacccaacttttataaaacgccaaaaactatcccccttccc

SEQ ID NO: 7249 - DNA, 580 bp, Artificial Sequence
  chemically treated genomic DNA (Homo sapiens) CpG-island No: 7249
agagagggcgggatttcgttaggtcgagggcgttttggtgtttagtttcggggttggcggttgttttgcggtttttaagtgcgggcggataataaaatttcgtgcgtcggatttgttcggttcgggtcgcgggcgtcgtaggatgtgggtagtaaggttcgtttgtttcgagttattaaattaatatttgtcggttttcgggggtgttattattggggttcgtagtaaggtttcgcggcgttaggttcgagaaatcgaaatttttttagtcgtttttgttttttagtattcgcgttattgtttttagtttcgagttattattgtttttagtgttaaatcgggtagtttcgttagttttcgaggtcgaatcgttaggggttttataagtttcgaggaggttcgtcgggaatcgtttttttattttttcggtatgcgtatcgttattattttcgttgtagaggtcgtcgtttttttagcgcgttattatcgttttttttgttttttttttttttttagtttcggtttttgtattgatttggttcgggttgcgttttattgcgtttgttaattgttatacgtt

SEQ ID NO: 7250 - DNA, 580 bp, Artificial Sequence
  chemically treated genomic DNA (Homo sapiens) CpG-island No: 7250
aacgtataacaattaacaaacgcaataaaacgcaacccgaaccaaatcaatacaaaaaccgaaactaaaaaaaaaaaaaaaacaaaaaaaacgataataacgcgctaaaaaaacgacgacctctacaacgaaaataataacgatacgcataccgaaaaaataaaaaaacgattcccgacgaacctcctcgaaacttataaaacccctaacgattcgacctcgaaaactaacgaaactacccgatttaacactaaaaacaataataactcgaaactaaaaacaataacgcgaatactaaaaaacaaaaacgactaaaaaaatttcgatttctcgaacctaacgccgcgaaaccttactacgaaccccaataataacacccccgaaaaccgacaaatattaatttaataactcgaaacaaacgaaccttactacccacatcctacgacgcccgcgacccgaaccgaacaaatccgacgcacgaaattttattatccgcccgcacttaaaaaccgcaaaacaaccgccaaccccgaaactaaacaccaaaacgccctcgacctaacgaaatcccgccctctct

SEQ ID NO: 7251 - DNA, 580 bp, Artificial Sequence
  chemically treated genomic DNA (Homo sapiens) CpG-island No: 7251
agcgtgtgatagttggtaggcgtagtgaggcgtagttcgagttaagttaatgtaggggtcggggttgagggaggggaagaggtagaggaggcggtgatggcgcgttgggagggcggcggtttttgtagcgagggtggtggcgatgcgtatatcgagaggataaggaagcggttttcgacgagttttttcggggtttatggggtttttggcggttcggtttcggaggttagcggggttgttcgatttggtattggaaataatggtggttcggggttggaggtaatggcgcgagtgttggggggtaggggcgattaggggagtttcggtttttcgggtttagcgtcgcggagttttgttgcgggttttagtggtagtattttcgggaatcgataggtgttgatttaatggttcggaataggcgggttttgttgtttatattttgcggcgttcgcgattcgggtcgggtagattcggcgtacgaggttttgttattcgttcgtatttagaggtcgtaaggtagtcgttagtttcgggattggatattagggcgttttcggtttgacgaggtttcgtttttttt

SEQ ID NO: 7252 - DNA, 580 bp, Artificial Sequence
  chemically treated genomic DNA (Homo sapiens) CpG-island No: 7252
aaaaaaaacgaaacctcgtcaaaccgaaaacgccctaatatccaatcccgaaactaacgactaccttacgacctctaaatacgaacgaataacaaaacctcgtacgccgaatctacccgacccgaatcgcgaacgccgcaaaatataaacaacaaaacccgcctattccgaaccattaaatcaacacctatcgattcccgaaaatactaccactaaaacccgcaacaaaactccgcgacgctaaacccgaaaaaccgaaactcccctaatcgcccctaccccccaacactcgcgccattacctccaaccccgaaccaccattatttccaataccaaatcgaacaaccccgctaacctccgaaaccgaaccgccaaaaaccccataaaccccgaaaaaactcgtcgaaaaccgcttccttatcctctcgatatacgcatcgccaccaccctcgctacaaaaaccgccgccctcccaacgcgccatcaccgcctcctctacctcttcccctccctcaaccccgacccctacattaacttaactcgaactacgcctcactacgcctaccaactatcacacgct

SEQ ID NO: 7253 - DNA, 579 bp, Artificial Sequence
  chemically treated genomic DNA (Homo sapiens) CpG-island No: 7253
tgttcgaattgggttagtcgatgtacgttttcgataaagatcgtattgaaggcggtattgtggtgcggatggcgaaagagggcgaaacgttggtgttgttcgacggtattgaagcgaagttgaatgttgatattttggttatcgtcgattataataaggcgttggcgatgggcggtattttcggtggcgaatattttggcgtgaatgacgaaatataaaacgtgttgttggaatgcgcgttttttagttcgttgtttattatcggtcgtgttcgtcgttatggtttgtatatcgatgcgttttatcgttatgagcgtggcgttgattcggtattgtagtataaagcgatggaacgtgcgattcgtttgttgatcgatatttgcggtggtgaggttggttcggtaattgatattattaacgaagtaacgttgtcgaagcgtgtaattattattttacgtcgtagtaaattggatcgtttgatcggttattatattgcggatgagtaggtaattgatattttgcgtcgtttcggttgcgaagtgatcgaaggtaaagacgaatggtaggtagttgcgtcga

SEQ ID NO: 7254 - DNA, 579 bp, Artificial Sequence
  chemically treated genomic DNA (Homo sapiens) CpG-island No: 7254
tcgacgcaactacctaccattcgtctttaccttcgatcacttcgcaaccgaaacgacgcaaaatatcaattacctactcatccgcaatataataaccgatcaaacgatccaatttactacgacgtaaaataataattacacgcttcgacaacgttacttcgttaataatatcaattaccgaaccaacctcaccaccgcaaatatcgatcaacaaacgaatcgcacgttccatcgctttatactacaataccgaatcaacgccacgctcataacgataaaacgcatcgatatacaaaccataacgacgaacacgaccgataataaacaacgaactaaaaaacgcgcattccaacaacacgttttatatttcgtcattcacgccaaaatattcgccaccgaaaataccgcccatcgccaacgccttattataatcgacgataaccaaaatatcaacattcaacttcgcttcaataccgtcgaacaacaccaacgtttcgccctctttcgccatccgcaccacaataccgccttcaatacgatctttatcgaaaacgtacatcgactaacccaattcgaaca

SEQ ID NO: 7255 - DNA, 579 bp, Artificial Sequence
  chemically treated genomic DNA (Homo sapiens) CpG-island No: 7255
tcggcgtaattgtttgttattcgtttttgttttcggttatttcgtagtcgagacgacgtagaatgttagttatttgtttattcgtaatatgatggtcgattaggcgatttagtttgttacgacgtagagtgatggttgtacgtttcggtagcgttgtttcgttggtgatattaattatcgggttagttttattatcgtagatgtcgattagtagacgggtcgtacgttttatcgttttgtgttgtagtgtcggattaacgttacgtttataacggtgagacgtatcggtatgtaggttatgacgacgagtacgatcggtgatagatagcgggttaaagaacgcgtattttagtagtacgttttgtgtttcgttatttacgttagagtgttcgttatcgaagatgtcgtttatcgttagcgttttgttgtggtcggcgatgattagagtgttagtatttagtttcgttttagtatcgtcgagtagtattagcgtttcgttttttttcgttattcgtattataatgtcgtttttaatgcgatttttatcgaaagcgtgtatcggttggtttagttcgagta

SEQ ID NO: 7256 - DNA, 579 bp, Artificial Sequence
  chemically treated genomic DNA (Homo sapiens) CpG-island No: 7256
tactcgaactaaaccaaccgatacacgctttcgataaaaatcgcattaaaaacgacattataatacgaataacgaaaaaaaacgaaacgctaatactactcgacgatactaaaacgaaactaaatactaacactctaatcatcgccgaccacaacaaaacgctaacgataaacgacatcttcgataacgaacactctaacgtaaataacgaaacacaaaacgtactactaaaatacgcgttctttaacccgctatctatcaccgatcgtactcgtcgtcataacctacataccgatacgtctcaccgttataaacgtaacgttaatccgacactacaacacaaaacgataaaacgtacgacccgtctactaatcgacatctacgataataaaactaacccgataattaatatcaccaacgaaacaacgctaccgaaacgtacaaccatcactctacgtcgtaacaaactaaatcgcctaatcgaccatcatattacgaataaacaaataactaacattctacgtcgtctcgactacgaaataaccgaaaacaaaaacgaataacaaacaattacgccga

SEQ ID NO: 7257 - DNA, 603 bp, Artificial Sequence
  chemically treated genomic DNA (Homo sapiens) CpG-island No: 7257
  misc_feature (582)..(583): n is either a, c, g or t
  misc_feature (585)..(589): n is either a, c, g or t
  misc_feature (591)..(591): n is either a, c, g or t
  misc_feature (595)..(595): n is either a, c, g or t
  misc_feature (598)..(598): n is either a, c, g or t
  misc_feature (602)..(602): n is either a, c, g or t
tacgtcgcggcgatagagattacgtttaatgcgcgttaaattaggttttggtttacgcggttcgtttaggtttgttaggataatttttagtatacgttttgcgatatcgcggtgacgttgagttattgttagtatcggatattgtaagaagtcgagtagttcgttatcgttaaaggtggtaattgttaggttagaaggtagtttgtcgtcgcgacgtagcgtgatatttattattttttgtaataacgtaaacgacgttgtgaatagcgtttgcggtatcggatgcgtttttagttatttttcgaataattgggtagtcgtttttcgtttatagttgttggtatataggaaatgtatttcgcgcggattatttttttaggtagtacggaaattttgtttacgtaggaagttgatagaaagtttcggtagcgtattaagataaagtatcgtttcggcgggaaatttacgtaattttttcgttagtatttcggtattattttgatcggtattaattacgttggtgaagtgtttacgatcgagggcgcggtttagcggggtatcgagttagaagtcgtatttagnngnnnnntntttnaantgtnt

SEQ ID NO: 7258 - DNA, 603 bp, Artificial Sequence
  chemically treated genomic DNA (Homo sapiens) CpG-island No: 7258
  misc_feature (2)..(2): n is either a, c, g or t
  misc_feature (6)..(6): n is either a, c, g or t
  misc_feature (9)..(9): n is either a, c, g or t
  misc_feature (13)..(13): n is either a, c, g or t
  misc_feature (15)..(19): n is either a, c, g or t
  misc_feature (21)..(22): n is either a, c, g or t
anacanttnaaanannnnncnnctaaatacgacttctaactcgataccccgctaaaccgcgccctcgatcgtaaacacttcaccaacgtaattaataccgatcaaaataataccgaaatactaacgaaaaaattacgtaaatttcccgccgaaacgatactttatcttaatacgctaccgaaactttctatcaacttcctacgtaaacaaaatttccgtactacctaaaaaaataatccgcgcgaaatacatttcctatataccaacaactataaacgaaaaacgactacccaattattcgaaaaataactaaaaacgcatccgataccgcaaacgctattcacaacgtcgtttacgttattacaaaaaataataaatatcacgctacgtcgcgacgacaaactaccttctaacctaacaattaccacctttaacgataacgaactactcgacttcttacaatatccgatactaacaataactcaacgtcaccgcgatatcgcaaaacgtatactaaaaattatcctaacaaacctaaacgaaccgcgtaaaccaaaacctaatttaacgcgcattaaacgtaatctctatcgccgcgacgta

SEQ ID NO: 7259 - DNA, 603 bp, Artificial Sequence
  chemically treated genomic DNA (Homo sapiens) CpG-island No: 7259
  misc_feature (2)..(2): n is either a, c, g or t
  misc_feature (6)..(6): n is either a, c, g or t
  misc_feature (9)..(9): n is either a, c, g or t
  misc_feature (13)..(13): n is either a, c, g or t
  misc_feature (15)..(19): n is either a, c, g or t
  misc_feature (21)..(22): n is either a, c, g or t
anatanttngganannnnntnnttggatacgatttttagttcggtatttcgttggatcgcgttttcgatcgtgaatattttattagcgtggttggtgtcgattaggatgatgtcgaaatgttggcggaagagttacgtaagtttttcgtcgagacggtgttttattttggtgcgttatcggagttttttgttagttttttgcgtgaataaggttttcgtattgtttggaaagatgattcgcgcgaagtgtattttttgtatgttaatagttatgagcgggaggcggttgtttagttattcgaaaaatggttggaaacgtattcgatgtcgtaggcgttgtttataacgtcgtttgcgttgttgtaaggagtgatggatgttacgttgcgtcgcgacggtaaattgttttttgatttggtaattgttatttttggcgataacgaattgttcgattttttatagtgttcggtgttggtagtggtttaacgttatcgcgatgtcgtagagcgtgtgttggagattgttttggtaagtttggacgaatcgcgtaagttaaaatttggtttaacgcgtattaaacgtaatttttatcgtcgcggcgtg

SEQ ID NO: 7260 - DNA, 603 bp, Artificial Sequence
  chemically treated genomic DNA (Homo sapiens) CpG-island No: 7260
  misc_feature (582)..(583): n is either a, c, g or t
  misc_feature (585)..(589): n is either a, c, g or t
  misc_feature (591)..(591): n is either a, c, g or t
  misc_feature (595)..(595): n is either a, c, g or t
  misc_feature (598)..(598): n is either a, c, g or t
  misc_feature (602)..(602): n is either a, c, g or t
cacgccgcgacgataaaaattacgtttaatacgcgttaaaccaaattttaacttacgcgattcgtccaaacttaccaaaacaatctccaacacacgctctacgacatcgcgataacgttaaaccactaccaacaccgaacactataaaaaatcgaacaattcgttatcgccaaaaataacaattaccaaatcaaaaaacaatttaccgtcgcgacgcaacgtaacatccatcactccttacaacaacgcaaacgacgttataaacaacgcctacgacatcgaatacgtttccaaccatttttcgaataactaaacaaccgcctcccgctcataactattaacatacaaaaaatacacttcgcgcgaatcatctttccaaacaatacgaaaaccttattcacgcaaaaaactaacaaaaaactccgataacgcaccaaaataaaacaccgtctcgacgaaaaacttacgtaactcttccgccaacatttcgacatcatcctaatcgacaccaaccacgctaataaaatattcacgatcgaaaacgcgatccaacgaaataccgaactaaaaatcgtatccaannannnnntntccnaantatnt

SEQ ID NO: 7261 - DNA, 773 bp, Artificial Sequence
  chemically treated genomic DNA (Homo sapiens) CpG-island No: 7261
cggcggtggttcgcgacgagaagtttggtttgttttttcgttggatgaggtcgtacgtttggtttgtttgttttacgcgttacggcgcgacgtaacgtaatagcgtttgttagtagcggattatttgcggtttgtatatcggcggtacgttggttgtcgaagcggcgggttatttgtcggatattttggcgtggaagtcgacgatatttattaatatgtatgatgttggacgtcgatagttattagattattgatttcggcgatgattttatatcgtcgggcgtttttattcgatgatcgatttaattttacgtaatagttaattgtcgatttcggcgttaaatcgtaagtgcgcgtgttgttgttgatgtcgtgattggtttcggtgcgatcgtcgattttgtcgtttcgttgtgagcgtttggtaaaaagtttgtgtcgcgcgtttagataattaattatttatgttattgttacggtgataggtattgaacgtgattcgtaatgtcgttgtagtaaatcgttacgttggaagatgcggggattgcggtcgtgagttcgtatcggaagttattttgttggcggtagcgttaatttattcgttttcgtcgtcgtatagtaatatatatcgttattattggaaaacgtcgtcgtgattatatcggattacgtagttttgcgttggagttataaagcgttagtaaatcgttgtgtattattaatggtcgttagtcgtcggtggtaataaaaaattggtcgtttattagaacgtt

SEQ ID NO: 7262 - DNA, 773 bp, Artificial Sequence
  chemically treated genomic DNA (Homo sapiens) CpG-island No: 7262
aacgttctaataaacgaccaattttttattaccaccgacgactaacgaccattaataatacacaacgatttactaacgctttataactccaacgcaaaactacgtaatccgatataatcacgacgacgttttccaataataacgatatatattactatacgacgacgaaaacgaataaattaacgctaccgccaacaaaataacttccgatacgaactcacgaccgcaatccccgcatcttccaacgtaacgatttactacaacgacattacgaatcacgttcaatacctatcaccgtaacaataacataaataattaattatctaaacgcgcgacacaaactttttaccaaacgctcacaacgaaacgacaaaatcgacgatcgcaccgaaaccaatcacgacatcaacaacaacacgcgcacttacgatttaacgccgaaatcgacaattaactattacgtaaaattaaatcgatcatcgaataaaaacgcccgacgatataaaatcatcgccgaaatcaataatctaataactatcgacgtccaacatcatacatattaataaatatcgtcgacttccacgccaaaatatccgacaaataacccgccgcttcgacaaccaacgtaccgccgatatacaaaccgcaaataatccgctactaacaaacgctattacgttacgtcgcgccgtaacgcgtaaaacaaacaaaccaaacgtacgacctcatccaacgaaaaaacaaaccaaacttctcgtcgcgaaccaccgccg

SEQ ID NO: 7263 - DNA, 773 bp, Artificial Sequence
  chemically treated genomic DNA (Homo sapiens) CpG-island No: 7263
aacgttttaataaacggttagttttttattgttatcggcgattggcgattattggtaatgtataacggtttgttggcgttttgtagttttagcgtaaagttgcgtaattcgatgtaattacggcgacgttttttagtaatgacggtgtgtgttgttgtgcggcggcgagagcggatgaattaacgttgtcgttagtaaggtggttttcggtacgaatttacgatcgtaattttcgtattttttagcgtggcgatttgttgtagcggtattgcgggttacgtttagtgtttgttatcgtggtaatggtataagtggttgattatttaaacgcgcggtataggttttttgttaggcgtttatagcgaggcggtaggatcggcggtcgtatcgaagttaattacgatattagtagtaatacgcgtatttgcggtttagcgtcgagatcggtaattaattgttgcgtaaggttgggtcgattatcggatggggacgttcgacggtgtagaattatcgtcgaggttaataatttggtggttatcggcgtttagtattatgtatgttgatgggtatcgtcggtttttacgttaaggtgttcggtaagtaattcgtcgtttcggtagttagcgtatcgtcggtatataaatcgtaaataattcgttgttgataggcgttattgcgttacgtcgcgtcgtgacgcgtgaagtaggtaagttaggcgtgcggttttatttagcgaggaggtaaattagatttttcgtcgcgggttatcgtcg

SEQ ID NO: 7264 - DNA, 773 bp, Artificial Sequence
  chemically treated genomic DNA (Homo sapiens) CpG-island No: 7264
cgacgataacccgcgacgaaaaatctaatttacctcctcgctaaataaaaccgcacgcctaacttacctacttcacgcgtcacgacgcgacgtaacgcaataacgcctatcaacaacgaattatttacgatttatataccgacgatacgctaactaccgaaacgacgaattacttaccgaacaccttaacgtaaaaaccgacgatacccatcaacatacataatactaaacgccgataaccaccaaattattaacctcgacgataattctacaccgtcgaacgtccccatccgataatcgacccaaccttacgcaacaattaattaccgatctcgacgctaaaccgcaaatacgcgtattactactaatatcgtaattaacttcgatacgaccgccgatcctaccgcctcgctataaacgcctaacaaaaaacctataccgcgcgtttaaataatcaaccacttataccattaccacgataacaaacactaaacgtaacccgcaataccgctacaacaaatcgccacgctaaaaaatacgaaaattacgatcgtaaattcgtaccgaaaaccaccttactaacgacaacgttaattcatccgctctcgccgccgcacaacaacacacaccgtcattactaaaaaacgtcgccgtaattacatcgaattacgcaactttacgctaaaactacaaaacgccaacaaaccgttatacattaccaataatcgccaatcgccgataacaataaaaaactaaccgtttattaaaacgtt

SEQ ID NO: 7265 - DNA, 562 bp, Artificial Sequence
  chemically treated genomic DNA (Homo sapiens) CpG-island No: 7265
gttttattgttcggggatggggagtaagtttagttagtcgttgttttcgggtgtgcgtgcgtagttgtacgttatttttagacgaatcgatgattggatggatgtcgtcgtagtcgttatattgatgatacggatgtgttttttcgtatatatatgttatcggagagttgttaacgtatggttatcgtcgggtatgggcgcgtttcgtagataggtagaatttgatggtatgtttgcgattaatgttaaagtgtttatcggattatgcgttagaatgcgttgttgtttgagcgaaaatcgttgtatcgttatcgaaacgggtatatataggtagagtggtcgtgaaagaagtaattagcgatggtgttttgacgggttcgagttttgttgtgataacgagagagattgcgtgttacgttcgcgttggattgttgtgatcgtgaggtttgtattgggcggttattatcggcggttttaatagtgaaatagtataggcgttatgttgggagtgatacgaattagttcggtattttatgtatattattttattttttttttttaa

SEQ ID NO: 7266 - DNA, 562 bp, Artificial Sequence
  chemically treated genomic DNA (Homo sapiens) CpG-island No: 7266
ttaaaaaaaaaaaataaaataatatacataaaataccgaactaattcgtatcactcccaacataacgcctatactatttcactattaaaaccgccgataataaccgcccaatacaaacctcacgatcacaacaatccaacgcgaacgtaacacgcaatctctctcgttatcacaacaaaactcgaacccgtcaaaacaccatcgctaattacttctttcacgaccactctacctatatatacccgtttcgataacgatacaacgattttcgctcaaacaacaacgcattctaacgcataatccgataaacactttaacattaatcgcaaacataccatcaaattctacctatctacgaaacgcgcccatacccgacgataaccatacgttaacaactctccgataacatatatatacgaaaaaacacatccgtatcatcaatataacgactacgacgacatccatccaatcatcgattcgtctaaaaataacgtacaactacgcacgcacacccgaaaacaacgactaactaaacttactccccatccccgaacaataaaac

SEQ ID NO: 7267 - DNA, 562 bp, Artificial Sequence
  chemically treated genomic DNA (Homo sapiens) CpG-island No: 7267
ttagaaggaaggaatggagtgatgtgtatagggtatcgagttgattcgtattatttttagtatgacgtttgtattgttttattgttgaagtcgtcggtagtgatcgtttagtgtaggttttacgattatagtagtttagcgcgaacgtgatacgtagtttttttcgttattatagtagaattcgaattcgttagagtattatcgttgattgttttttttacggttattttgtttgtatgtgttcgtttcgatggcggtatagcggttttcgtttaagtaatagcgtattttggcgtatgattcggtaaatattttggtattgatcgtaggtatattattaagttttgtttgtttgcgaagcgcgtttatattcgacgataattatacgttggtagtttttcgataatatgtgtatacggagaagtatattcgtattattagtgtgacgattgcggcggtatttatttagttatcggttcgtttgagaatgacgtgtaattgcgtacgtatattcggagataacggttgattaagtttattttttattttcgggtaatagggt

SEQ ID NO: 7268 - DNA, 562 bp, Artificial Sequence
  chemically treated genomic DNA (Homo sapiens) CpG-island No: 7268
accctattacccgaaaataaaaaataaacttaatcaaccgttatctccgaatatacgtacgcaattacacgtcattctcaaacgaaccgataactaaataaataccgccgcaatcgtcacactaataatacgaatatacttctccgtatacacatattatcgaaaaactaccaacgtataattatcgtcgaatataaacgcgcttcgcaaacaaacaaaacttaataatatacctacgatcaataccaaaatatttaccgaatcatacgccaaaatacgctattacttaaacgaaaaccgctataccgccatcgaaacgaacacatacaaacaaaataaccgtaaaaaaaacaatcaacgataatactctaacgaattcgaattctactataataacgaaaaaaactacgtatcacgttcgcgctaaactactataatcgtaaaacctacactaaacgatcactaccgacgacttcaacaataaaacaatacaaacgtcatactaaaaataatacgaatcaactcgataccctatacacatcactccattccttccttctaa

SEQ ID NO: 7269 - DNA, 1026 bp, Artificial Sequence
  chemically treated genomic DNA (Homo sapiens) CpG-island No: 7269
aacgcgggtagttggtgttcgcgagtcgtttttggttttttgtttatacgttgttcgttatttttttttttcgtcgagggtagcgtggttattttattttttttatcggggtttttttttttttttgggatttaataagttaggaaattttcgggggtcgtcggaaagtttcgatagcggtagcgtagtcgatttagggttgcggttgtttcggtttcgtcgttaggggtcgttcgattgttcgtttttttaacgtttaggttagttcgggatcgcggcgttagttattttgttcggttttgttttgtttggtcgttgcgggcgttgacggtagtagttgttagttacggtttcgtcggtttcgtattcgggcgcggttaggtcgtgaggggtgcgttttgtttttttgagtttagtttgtcggtcggttcgtttattttgtggttttggtaagtttcgagcgttcggatcgtcgtttcggtgagttttatatgtagtacggtgatgttgttttgttttagtcgttcgtacgatagtttatagcgttgtttttttcgtaggttttttgtttttttcgtcgttattttaaatttttcggggtgtcgtcgtcgtcgtcgtttcggttttagtttttattgcggtcgcggttgtttgggtttttgtagtcgtcgttattgttagggttatttcgttgttgacgtattgttatatattgcgcggagttagatttcggattgttatcgtcgttattcgttttatttttcggtttcgcgtttcgtttcgggttcgttttattggttttgttttttttagaatcgtttttatcggtcgttttttatttttacgggggcgggtttaaagttattagagttttgtttttgggacgggacgttcgagaggtaagaggttgacgtttaggtgacgcgttaatttaattatgtttgacgttacgtttggtcgttttggttagtcggtcgagattggttaggttggtttggggatttttttgttaattggaagtttagg

SEQ ID NO: 7270 - DNA, 1026 bp, Artificial Sequence
  chemically treated genomic DNA (Homo sapiens) CpG-island No: 7270
cctaaacttccaattaacaaaaaaatccccaaaccaacctaaccaatctcgaccgactaaccaaaacgaccaaacgtaacgtcaaacataattaaattaacgcgtcacctaaacgtcaacctcttacctctcgaacgtcccgtcccaaaaacaaaactctaataactttaaacccgcccccgtaaaaataaaaaacgaccgataaaaacgattctaaaaaaaacaaaaccaataaaacgaacccgaaacgaaacgcgaaaccgaaaaataaaacgaataacgacgataacaatccgaaatctaactccgcgcaatatataacaatacgtcaacaacgaaataaccctaacaataacgacgactacaaaaacccaaacaaccgcgaccgcaataaaaactaaaaccgaaacgacgacgacgacgacaccccgaaaaatttaaaataacgacgaaaaaaacaaaaaacctacgaaaaaaacaacgctataaactatcgtacgaacgactaaaacaaaacaacatcaccgtactacatataaaactcaccgaaacgacgatccgaacgctcgaaacttaccaaaaccacaaaataaacgaaccgaccgacaaactaaactcaaaaaaacaaaacgcacccctcacgacctaaccgcgcccgaatacgaaaccgacgaaaccgtaactaacaactactaccgtcaacgcccgcaacgaccaaacaaaacaaaaccgaacaaaataactaacgccgcgatcccgaactaacctaaacgttaaaaaaacgaacaatcgaacgacccctaacgacgaaaccgaaacaaccgcaaccctaaatcgactacgctaccgctatcgaaactttccgacgacccccgaaaatttcctaacttattaaatcccaaaaaaaaaaaaaaaccccgataaaaaaaataaaataaccacgctaccctcgacgaaaaaaaaaaataacgaacaacgtataaacaaaaaaccaaaaacgactcgcgaacaccaactacccgcgtt

SEQ ID NO: 7271 - DNA, 1026 bp, Artificial Sequence
  chemically treated genomic DNA (Homo sapiens) CpG-island No: 7271
tttggatttttaattagtaggggagtttttaagttagtttggttaatttcggtcggttagttaagacgattagacgtgacgttagatatgattaagttggcgcgttatttagacgttagttttttatttttcggacgtttcgttttaggagtaaaattttagtgattttgggttcgttttcgtgagagtggagggcggtcgatgagggcggttttgaagggaataagattaatgagacgagttcggggcggggcgcggggtcggagggtggggcgggtggcggcggtggtagttcgaggtttggtttcgcgtagtatatgatagtacgttagtagcgggatggttttagtagtggcggcggttgtagaagtttaagtagtcgcggtcgtagtggaggttagagtcggagcggcggcggcggcggtatttcggggagtttaagatggcggcgggggggatagggggtttgcgggaggagtagcgttatgggttgtcgtgcggacggttggggtaggataatattatcgtattgtatgtgaagtttatcgagacggcgattcgggcgttcgagatttattagagttataaggtgagcgggtcggtcggtaggttgggtttagagaggtagagcgtattttttacggtttggtcgcgttcgggtgcggggtcggcggagtcgtggttggtagttgttatcgttagcgttcgtagcggttaggtagggtagggtcgggtagggtggttgacgtcgcggtttcgggttagtttgggcgttggggaagcgggtagtcgggcggtttttggcggcggggtcgaggtagtcgtagttttgggtcggttgcgttgtcgttgtcgggatttttcgacggttttcgaggattttttggtttgttgggttttaaggagggagagaggtttcgataagagaagtgagatgattacgttattttcggcggggaaggagggtagcgagtagcgtatgggtaaggaattagggacgattcgcgggtattagttgttcgcgtt

SEQ ID NO: 7272 - DNA, 1026 bp, Artificial Sequence
  chemically treated genomic DNA (Homo sapiens) CpG-island No: 7272
aacgcgaacaactaatacccgcgaatcgtccctaattccttacccatacgctactcgctaccctccttccccgccgaaaataacgtaatcatctcacttctcttatcgaaacctctctccctccttaaaacccaacaaaccaaaaaatcctcgaaaaccgtcgaaaaatcccgacaacgacaacgcaaccgacccaaaactacgactacctcgaccccgccgccaaaaaccgcccgactacccgcttccccaacgcccaaactaacccgaaaccgcgacgtcaaccaccctacccgaccctaccctacctaaccgctacgaacgctaacgataacaactaccaaccacgactccgccgaccccgcacccgaacgcgaccaaaccgtaaaaaatacgctctacctctctaaacccaacctaccgaccgacccgctcaccttataactctaataaatctcgaacgcccgaatcgccgtctcgataaacttcacatacaatacgataatattatcctaccccaaccgtccgcacgacaacccataacgctactcctcccgcaaaccccctatcccccccgccgccatcttaaactccccgaaataccgccgccgccgccgctccgactctaacctccactacgaccgcgactacttaaacttctacaaccgccgccactactaaaaccatcccgctactaacgtactatcatatactacgcgaaaccaaacctcgaactaccaccgccgccacccgccccaccctccgaccccgcgccccgccccgaactcgtctcattaatcttattcccttcaaaaccgccctcatcgaccgccctccactctcacgaaaacgaacccaaaatcactaaaattttactcctaaaacgaaacgtccgaaaaataaaaaactaacgtctaaataacgcgccaacttaatcatatctaacgtcacgtctaatcgtcttaactaaccgaccgaaattaaccaaactaacttaaaaactcccctactaattaaaaatccaaa

SEQ ID NO: 7273 - DNA, 1189 bp, Artificial Sequence
  chemically treated genomic DNA (Homo sapiens) CpG-island No: 7273
tttttcgtcggatttgacgaaggtggagaagcgattgaggttgcggtttacggtggtcgagtttttgggtttcgacgggtggtgttgcggggggatcgagtcgtcgcgggagtttagggataggtcggagcgcgtggataggcggtagcggtcggttgcgtttatattcgtcgaagacgagtcgtcgaggttcgggtatgtttcgttgtttagagcgttcggttcgttcgttatcgtggagttgtcgttttattcgtcgttttagttattatcgttgttttggttggtttggtagtcgtcgtagagttgttgaggcgacggttgtagggcgttttcgtcgtacgggaagttcgcgtcgggcggttggaaggtgttcggaggcggcgtttgttgtggttgtagtagcgtttggaaggcgttaggcggcggtttgaaggaggcggggggcgcgacgggtaggggttcgaagttttcggggggtatattggcgtagcgggtcggggcgttcgggtcgtcgtttttcgtcgggttaggttcgggggcgcggattatttgtatataggaggtcgggaagaggtcgcggtcgtcgcggttgttgattttttcgagttagttttcgatgttttgttcgttgtataggtttagtatttcgtgttttcgtagcgagattttttttgggtttttcgatttgaagtcgtatagcgttcgggcgcgtagcgttatggtttcggcgtttcgattggcggtttcgattttcggcgtttcgagtcgaggtttatttgaggggttcgcggtattgttcgagttttggcgcgcggattggagtttcgaaggcggtaaatttacgttgttcggattagtcggtcgcgtttttcgcgcggtttcgttcgtagcgtttttatttcgtagcgtcgattgtcgcgttgggtcgtcgtagtcgtcgtcggtcgggggcggggttcgcggttttttacgtttttagttgcgttaatttacggtcgagagttttttgttaggcgagagtaagcgatggtcgagtcgtcgagtttatcgtttgcgtcggttttgcggcggttattgttttttagtggtcggtgtcgcgaagtcgggcgtcgtagtgagcgcggttgaaggaggtttttatttcgaagtgaattatttgagatttttttaggtttttaagttaaat

SEQ ID NO: 7274 - DNA, 1189 bp, Artificial Sequence
  chemically treated genomic DNA (Homo sapiens) CpG-island No: 7274
atttaacttaaaaacctaaaaaaatctcaaataattcacttcgaaataaaaacctccttcaaccgcgctcactacgacgcccgacttcgcgacaccgaccactaaaaaacaataaccgccgcaaaaccgacgcaaacgataaactcgacgactcgaccatcgcttactctcgcctaacaaaaaactctcgaccgtaaattaacgcaactaaaaacgtaaaaaaccgcgaaccccgcccccgaccgacgacgactacgacgacccaacgcgacaatcgacgctacgaaataaaaacgctacgaacgaaaccgcgcgaaaaacgcgaccgactaatccgaacaacgtaaatttaccgccttcgaaactccaatccgcgcgccaaaactcgaacaataccgcgaacccctcaaataaacctcgactcgaaacgccgaaaatcgaaaccgccaatcgaaacgccgaaaccataacgctacgcgcccgaacgctatacgacttcaaatcgaaaaacccaaaaaaaatctcgctacgaaaacacgaaatactaaacctatacaacgaacaaaacatcgaaaactaactcgaaaaaatcaacaaccgcgacgaccgcgacctcttcccgacctcctatatacaaataatccgcgcccccgaacctaacccgacgaaaaacgacgacccgaacgccccgacccgctacgccaatataccccccgaaaacttcgaacccctacccgtcgcgccccccgcctccttcaaaccgccgcctaacgccttccaaacgctactacaaccacaacaaacgccgcctccgaacaccttccaaccgcccgacgcgaacttcccgtacgacgaaaacgccctacaaccgtcgcctcaacaactctacgacgactaccaaaccaaccaaaacaacgataataactaaaacgacgaataaaacgacaactccacgataacgaacgaaccgaacgctctaaacaacgaaacatacccgaacctcgacgactcgtcttcgacgaatataaacgcaaccgaccgctaccgcctatccacgcgctccgacctatccctaaactcccgcgacgactcgatccccccgcaacaccacccgtcgaaacccaaaaactcgaccaccgtaaaccgcaacctcaatcgcttctccaccttcgtcaaatccgacgaaaaa

SEQ ID NO: 7275 - DNA, 1189 bp, Artificial Sequence
  chemically treated genomic DNA (Homo sapiens) CpG-island No: 7275
gtttaatttaaaagtttaaagaaattttagataatttatttcggagtagaaattttttttagtcgcgtttattacggcgttcggtttcgcggtatcggttattagagggtagtggtcgtcgtaaagtcgacgtaggcggtgggttcggcggttcggttatcgtttgttttcgtttggtaaggggttttcggtcgtggattagcgtagttggagacgtgggaggtcgcgggtttcgttttcgatcggcggcggttgcggcggtttagcgcggtagtcggcgttgcgaagtggaggcgttgcgagcggagtcgcgcggagggcgcgatcggttggttcgggtagcgtgggtttgtcgttttcggggttttagttcgcgcgttagggttcgagtagtatcgcgggttttttaggtgggtttcggttcgggacgtcgggagtcgggatcgttagtcggggcgtcgggattatggcgttgcgcgttcgggcgttgtacgattttaggtcggagaatttaggagagatttcgttgcgagagtacgaggtgttgagtttgtgtagcgagtaggatatcgagggttggttcgagggggttaatagtcgcggcgatcgcggttttttttcggttttttatgtgtaggtgattcgcgttttcgagtttggttcggcgggagacggcggttcgggcgtttcggttcgttacgttaatgtgtttttcgggggtttcgagtttttgttcgtcgcgtttttcgttttttttaagtcgtcgtttgacgttttttaggcgttgttgtagttatagtaggcgtcgttttcgagtattttttagtcgttcggcgcgggtttttcgtacggcgggggcgttttgtagtcgtcgttttagtagttttacggcggttattaggttagttaaggtagcgatgatgattgggacgacgagtgggacgatagttttacggtggcggacgagtcgggcgttttgggtagcggagtatattcggatttcgacggttcgttttcggcgggtgtgggcgtagtcggtcgttatcgtttgtttacgcgtttcgatttgtttttgggttttcgcggcggttcggttttttcgtagtattattcgtcggggtttaagagttcggttatcgtgagtcgtaattttaatcgtttttttattttcgttaagttcggcggggag

SEQ ID NO: 7276 - DNA, 1189 bp, Artificial Sequence
  chemically treated genomic DNA (Homo sapiens) CpG-island No: 7276
ctccccgccgaacttaacgaaaataaaaaaacgattaaaattacgactcacgataaccgaactcttaaaccccgacgaataatactacgaaaaaaccgaaccgccgcgaaaacccaaaaacaaatcgaaacgcgtaaacaaacgataacgaccgactacgcccacacccgccgaaaacgaaccgtcgaaatccgaatatactccgctacccaaaacgcccgactcgtccgccaccgtaaaactatcgtcccactcgtcgtcccaatcatcatcgctaccttaactaacctaataaccgccgtaaaactactaaaacgacgactacaaaacgcccccgccgtacgaaaaacccgcgccgaacgactaaaaaatactcgaaaacgacgcctactataactacaacaacgcctaaaaaacgtcaaacgacgacttaaaaaaaacgaaaaacgcgacgaacaaaaactcgaaacccccgaaaaacacattaacgtaacgaaccgaaacgcccgaaccgccgtctcccgccgaaccaaactcgaaaacgcgaatcacctacacataaaaaaccgaaaaaaaaccgcgatcgccgcgactattaaccccctcgaaccaaccctcgatatcctactcgctacacaaactcaacacctcgtactctcgcaacgaaatctctcctaaattctccgacctaaaatcgtacaacgcccgaacgcgcaacgccataatcccgacgccccgactaacgatcccgactcccgacgtcccgaaccgaaacccacctaaaaaacccgcgatactactcgaaccctaacgcgcgaactaaaaccccgaaaacgacaaacccacgctacccgaaccaaccgatcgcgccctccgcgcgactccgctcgcaacgcctccacttcgcaacgccgactaccgcgctaaaccgccgcaaccgccgccgatcgaaaacgaaacccgcgacctcccacgtctccaactacgctaatccacgaccgaaaaccccttaccaaacgaaaacaaacgataaccgaaccgccgaacccaccgcctacgtcgactttacgacgaccactaccctctaataaccgataccgcgaaaccgaacgccgtaataaacgcgactaaaaaaaatttctactccgaaataaattatctaaaatttctttaaacttttaaattaaac

SEQ ID NO: 7277 - DNA, 511 bp, Artificial Sequence
  chemically treated genomic DNA (Homo sapiens) CpG-island No: 7277
cgatagtgcgtgcgtcgagcgatggttatgtgatttaggtattgattcgttcgggtatttatgtcgcgtcgttgtcgttacgttcggtgatggtgtttatattcgattagaaacgataaatcgtggcgtagtttcgttagaattttttgttgcgattggtttttggcgacgatgcggaagtggtgtttaatgttttgttaggtaaggtatttagcggtaagttggtagttattagtttagtcgttttcggcggattttattagtcgagtcggtattttatagacgtttaaatatagcgtcgggtttagatggcgtttttgcgattattgaattggatggagtatattgatttgggcggtttattcgacggtatttatcgttaggtggcgggttatttcgtttcgtttagtaatgtttcggggatggttaaagtgttatttttatgatacgttggggtattatttttattcggatttataatttttcgtttcgtttttgtgttttttattgt

SEQ ID NO: 7278 - DNA, 511 bp, Artificial Sequence
  chemically treated genomic DNA (Homo sapiens) CpG-island No: 7278
acaataaaaaacacaaaaacgaaacgaaaaattataaatccgaataaaaataataccccaacgtatcataaaaataacactttaaccatccccgaaacattactaaacgaaacgaaataacccgccacctaacgataaataccgtcgaataaaccgcccaaatcaatatactccatccaattcaataatcgcaaaaacgccatctaaacccgacgctatatttaaacgtctataaaataccgactcgactaataaaatccgccgaaaacgactaaactaataactaccaacttaccgctaaataccttacctaacaaaacattaaacaccacttccgcatcgtcgccaaaaaccaatcgcaacaaaaaattctaacgaaactacgccacgatttatcgtttctaatcgaatataaacaccatcaccgaacgtaacgacaacgacgcgacataaatacccgaacgaatcaatacctaaatcacataaccatcgctcgacgcacgcactatcg

SEQ ID NO: 7279 - DNA, 511 bp, Artificial Sequence
  chemically treated genomic DNA (Homo sapiens) CpG-island No: 7279
atagtgaaaaatataggggcggaacggaaagttatgagttcggataaaggtaatgttttagcgtgttatgggaatagtattttggttattttcgagatattgttgaacggaacggagtaattcgttatttggcggtaaatatcgtcgggtagatcgtttaaattagtgtgttttatttagtttaatggtcgtaaaaacgttatttgaattcggcgttgtgtttaaacgtttgtaaggtgtcggttcgattgataagattcgtcgggaacggttggattaatggttgttagtttatcgttgaatattttatttggtagagtattaaatattattttcgtatcgtcgttaggagttagtcgtagtaaggagttttgacggaattgcgttacgatttgtcgtttttgatcgggtataaatattattatcggacgtagcggtagcgacgcggtataggtattcggacgaattagtatttgggttatataattatcgttcggcgtacgtattatcg

SEQ ID NO: 7280 - DNA, 511 bp, Artificial Sequence
  chemically treated genomic DNA (Homo sapiens) CpG-island No: 7280
cgataatacgtacgccgaacgataattatataacccaaatactaattcgtccgaatacctataccgcgtcgctaccgctacgtccgataataatatttatacccgatcaaaaacgacaaatcgtaacgcaattccgtcaaaactccttactacgactaactcctaacgacgatacgaaaataatatttaatactctaccaaataaaatattcaacgataaactaacaaccattaatccaaccgttcccgacgaatcttatcaatcgaaccgacaccttacaaacgtttaaacacaacgccgaattcaaataacgtttttacgaccattaaactaaataaaacacactaatttaaacgatctacccgacgatatttaccgccaaataacgaattactccgttccgttcaacaatatctcgaaaataaccaaaatactattcccataacacgctaaaacattacctttatccgaactcataactttccgttccgcccctatatttttcactat

SEQ ID NO: 7281 - DNA, 601 bp, Artificial Sequence
  chemically treated genomic DNA (Homo sapiens) CpG-island No: 7281
  misc_feature (582)..(582): n is either a, c, g or t
  misc_feature (593)..(593): n is either a, c, g or t
tattcgcgataggtggggcgagggtggtaatgttcgatatttgtcgtttaagtttttggttcggatcgggttttaatttatacgcgtatatacggttatagtcggttagtttatttttattgtatcggtagatattcggagggcgcgggcggtttcggtacgcgggttgtaattaggacgaggagggtcggcgagattagatcgtcggggcgtcgttttgaggtgttatttgattcgggtagtcgtattttgagcgcggtcgggtacgtagttaaaggtgtcgtcggtcggggaaagttattttttaaaggggtttttaggttcgttgtttcgcggtgcgggaatagcggttaagggagggagcgagcgagcgtgcgcgttaacgcgtttcgattttcgtatcgcggtatcgcgggagaggcgtttcgggtcgtcgagttttcgtatttttttagcgagcgtacgacgcgcgtatacgggggcgtacgttttcgtatatttatacgcgttgtatatttacggcgtttgcggttttatttttgtgttagggaatcgtaagttttttttattacgggggttttntagagtgaatntgtaggta

SEQ ID NO: 7282 - DNA, 601 bp, Artificial Sequence
  chemically treated genomic DNA (Homo sapiens) CpG-island No: 7282
  misc_feature (9)..(9): n is either a, c, g or t
  misc_feature (20)..(20): n is either a, c, g or t
tacctacanattcactctanaaaacccccgtaataaaaaaaacttacgattccctaacacaaaaataaaaccgcaaacgccgtaaatatacaacgcgtataaatatacgaaaacgtacgcccccgtatacgcgcgtcgtacgctcgctaaaaaaatacgaaaactcgacgacccgaaacgcctctcccgcgataccgcgatacgaaaatcgaaacgcgttaacgcgcacgctcgctcgctccctcccttaaccgctattcccgcaccgcgaaacaacgaacctaaaaacccctttaaaaaataactttccccgaccgacgacacctttaactacgtacccgaccgcgctcaaaatacgactacccgaatcaaataacacctcaaaacgacgccccgacgatctaatctcgccgaccctcctcgtcctaattacaacccgcgtaccgaaaccgcccgcgccctccgaatatctaccgatacaataaaaataaactaaccgactataaccgtatatacgcgtataaattaaaacccgatccgaaccaaaaacttaaacgacaaatatcgaacattaccaccctcgccccacctatcgcgaata

SEQ ID NO: 7283 - DNA, 601 bp, Artificial Sequence
  chemically treated genomic DNA (Homo sapiens) CpG-island No: 7283
  misc_feature (9)..(9): n is either a, c, g or t
  misc_feature (20)..(20): n is either a, c, g or t
tgtttgtangtttattttangagattttcgtggtgaggggagtttgcggttttttggtataggagtggggtcgtagacgtcgtgagtgtgtagcgcgtgtgagtgtgcgggggcgtgcgttttcgtgtgcgcgcgtcgtgcgttcgttggggaggtgcggggattcggcgattcggagcgtttttttcgcggtgtcgcggtgcggaagtcggggcgcgttggcgcgtacgttcgttcgtttttttttttggtcgttgttttcgtatcgcggggtagcgggtttggaggtttttttgagaagtagtttttttcggtcggcggtatttttggttgcgtgttcggtcgcgtttagggtgcgattgttcgggttagatagtattttagggcgacgtttcggcggtttgatttcgtcgatttttttcgttttggttgtaattcgcgtgtcgaggtcgttcgcgtttttcgagtgtttgtcggtgtagtgggggtggattggtcggttgtggtcgtgtgtgcgcgtgtggattggggttcggttcgagttagaagtttaagcggtagatgtcgggtattgttattttcgttttatttgtcgcgggtg

SEQ ID NO: 7284 - DNA, 601 bp, Artificial Sequence
  chemically treated genomic DNA (Homo sapiens) CpG-island No: 7284
  misc_feature (582)..(582): n is either a, c, g or t
  misc_feature (593)..(593): n is either a, c, g or t
cacccgcgacaaataaaacgaaaataacaatacccgacatctaccgcttaaacttctaactcgaaccgaaccccaatccacacgcgcacacacgaccacaaccgaccaatccacccccactacaccgacaaacactcgaaaaacgcgaacgacctcgacacgcgaattacaaccaaaacgaaaaaaatcgacgaaatcaaaccgccgaaacgtcgccctaaaatactatctaacccgaacaatcgcaccctaaacgcgaccgaacacgcaaccaaaaataccgccgaccgaaaaaaactacttctcaaaaaaacctccaaacccgctaccccgcgatacgaaaacaacgaccaaaaaaaaaaacgaacgaacgtacgcgccaacgcgccccgacttccgcaccgcgacaccgcgaaaaaaacgctccgaatcgccgaatccccgcacctccccaacgaacgcacgacgcgcgcacacgaaaacgcacgcccccgcacactcacacgcgctacacactcacgacgtctacgaccccactcctataccaaaaaaccgcaaactcccctcaccacgaaaatctcntaaaataaacntacaaaca

SEQ ID NO: 7285 - DNA, 579 bp, Artificial Sequence
  chemically treated genomic DNA (Homo sapiens) CpG-island No: 7285
acgtgatcgatttcgaaacgtttaatgttttgttatttaacgggtttgttagtttgttatattatcgtgaagtcgttttgtaaggaattgttatgaacgaagtcgttagtttaggtgcgtttagtattttgtttatcgatgttcgtatttataacggttggcgggagatattcgttagcgatgagacgttacgggagatttatgttttgatgaaatgggggtcgatattagttaattgtttttcggtacggatcgtgtttattcgtacggtagaaggaaaagaacgtttgcgttcggtattttttagcggtaatttgtaaaaaattttgatcgcgttcgttatcgttatcgtcgtttgggatagtgaattttatgaacggttattattattgtttttttacggtgatgttcgtagttggtttatttttagtttataatttgtcgaagaaatagcgtttcgtaatagttttatgtaggcgggttatttgatcgtcgtttgtcgggcgttgggatattatacgaattttagttcggtattcggaaaagaagtaggtaagtttaggagagagaagataaatt

SEQ ID NO: 7286 - DNA, 579 bp, Artificial Sequence
  chemically treated genomic DNA (Homo sapiens) CpG-island No: 7286
aatttatcttctctctcctaaacttacctacttcttttccgaataccgaactaaaattcgtataatatcccaacgcccgacaaacgacgatcaaataacccgcctacataaaactattacgaaacgctatttcttcgacaaattataaactaaaaataaaccaactacgaacatcaccgtaaaaaaacaataataataaccgttcataaaattcactatcccaaacgacgataacgataacgaacgcgatcaaaattttttacaaattaccgctaaaaaataccgaacgcaaacgttcttttccttctaccgtacgaataaacacgatccgtaccgaaaaacaattaactaatatcgacccccatttcatcaaaacataaatctcccgtaacgtctcatcgctaacgaatatctcccgccaaccgttataaatacgaacatcgataaacaaaatactaaacgcacctaaactaacgacttcgttcataacaattccttacaaaacgacttcacgataatataacaaactaacaaacccgttaaataacaaaacattaaacgtttcgaaatcgatcacgt

SEQ ID NO: 7287 - DNA, 579 bp, Artificial Sequence
  chemically treated genomic DNA (Homo sapiens) CpG-island No: 7287
agtttatttttttttttttaaatttgtttgtttttttttcgggtatcgagttagagttcgtataatgttttagcgttcggtaggcgacgattagatagttcgtttgtatggaattgttgcgaaacgttgttttttcggtaagttgtgggttggaggtaaattaattgcgggtattatcgtggggaaatagtagtggtaatcgtttataaaatttattgttttaggcgacgatagcggtgacgggcgcggttagggttttttgtagattgtcgttggaaagtgtcgggcgtagacgtttttttttttttgtcgtgcgggtaaatacgattcgtgtcggagaatagttagttgatgtcggtttttattttattagggtataaatttttcgtaacgttttatcgttgacgggtgtttttcgttagtcgttgtgagtgcgggtatcggtgaatagggtgttaagcgtatttgggttaacggtttcgtttatagtaattttttatagggcggttttacggtgatgtaataggttggtaagttcgttgagtaatagagtattaaacgtttcgggatcggttacgt

SEQ ID NO: 7288 - DNA, 579 bp, Artificial Sequence
  chemically treated genomic DNA (Homo sapiens) CpG-island No: 7288
acgtaaccgatcccgaaacgtttaatactctattactcaacgaacttaccaacctattacatcaccgtaaaaccgccctataaaaaattactataaacgaaaccgttaacccaaatacgcttaacaccctattcaccgatacccgcactcacaacgactaacgaaaaacacccgtcaacgataaaacgttacgaaaaatttataccctaataaaataaaaaccgacatcaactaactattctccgacacgaatcgtatttacccgcacgacaaaaaaaaaaaaacgtctacgcccgacactttccaacgacaatctacaaaaaaccctaaccgcgcccgtcaccgctatcgtcgcctaaaacaataaattttataaacgattaccactactatttccccacgataatacccgcaattaatttacctccaacccacaacttaccgaaaaaacaacgtttcgcaacaattccatacaaacgaactatctaatcgtcgcctaccgaacgctaaaacattatacgaactctaactcgatacccgaaaaaaaaacaaacaaatttaaaaaaaaaaaaataaact

SEQ ID NO: 7289 - DNA, 889 bp, Artificial Sequence
  chemically treated genomic DNA (Homo sapiens) CpG-island No: 7289
aggatttttagaagaagacgtcgtcgttgaagatttgttggtagaagtgagttagtcgaagcgcgattttagcgaagaagagattatcgttcgtatgatgatttcgatggttaacgaagtggtgcgttgtttggaggaaggtattatcgttatttcggcggaagcggatatggcgttggtttacggtttgggttttttttcgttttacggcggcgcgtttcgttggttggatattttcggtagcgtaaaatatttcgatatggtatagtaatattagtatttcggttcgttgtatgaagtgtcggaaggtttgcgtaataaagcgcgttataacgaatcgtattatttttcggttgagttagttcgttcggttggcgatttgaaaacggtttaaggagttataatggaataggttgttattgtcgatgtaattcgtatttcgatgggtcgttcgaagggcggtgtttttcgtaacgtgcgtgtagaagattttttcgtttatttaatgcgtagtttgttggcgcgtaattcggcgttggaagcggcggttttcgacgatatttattggggttgtgtgtagtaaacgttggagtagggttttaatattcgtcgtaacgcggtcgcggggggattagattaatcgtgttggattttagattaattttagttcggtatttcgtgtcggtgggtttgcgttgttgttcgaaaattttaaaggttatttaatgtcggtgttgtgtaatttgttcggtacgttaaagcgcgtggcgatgggtatggggtaggaagatgtttcggcgttgcgtgaagttggtaaattattggcgtttttgaaagagtcggagtcgttaaaaggttttcgcgatttgtttgataaattgtcgtagtt

SEQ ID NO: 7290 - DNA, 889 bp, Artificial Sequence
  chemically treated genomic DNA (Homo sapiens) CpG-island No: 7290
aactacgacaatttatcaaacaaatcgcgaaaaccttttaacgactccgactctttcaaaaacgccaataatttaccaacttcacgcaacgccgaaacatcttcctaccccatacccatcgccacgcgctttaacgtaccgaacaaattacacaacaccgacattaaataacctttaaaattttcgaacaacaacgcaaacccaccgacacgaaataccgaactaaaattaatctaaaatccaacacgattaatctaatccccccgcgaccgcgttacgacgaatattaaaaccctactccaacgtttactacacacaaccccaataaatatcgtcgaaaaccgccgcttccaacgccgaattacgcgccaacaaactacgcattaaataaacgaaaaaatcttctacacgcacgttacgaaaaacaccgcccttcgaacgacccatcgaaatacgaattacatcgacaataacaacctattccattataactccttaaaccgttttcaaatcgccaaccgaacgaactaactcaaccgaaaaataatacgattcgttataacgcgctttattacgcaaaccttccgacacttcatacaacgaaccgaaatactaatattactataccatatcgaaatattttacgctaccgaaaatatccaaccaacgaaacgcgccgccgtaaaacgaaaaaaaacccaaaccgtaaaccaacgccatatccgcttccgccgaaataacgataataccttcctccaaacaacgcaccacttcgttaaccatcgaaatcatcatacgaacgataatctcttcttcgctaaaatcgcgcttcgactaactcacttctaccaacaaatcttcaacgacgacgtcttcttctaaaaatcct

SEQ ID NO: 7291 - DNA, 889 bp, Artificial Sequence
  chemically treated genomic DNA (Homo sapiens) CpG-island No: 7291
aattgcggtagtttattaaataggtcgcggaaattttttggcggtttcggtttttttagaaacgttaataatttattaattttacgtagcgtcgaaatatttttttgttttatgtttatcgttacgcgttttggcgtatcgaataggttgtatagtatcggtattgagtagtttttagggttttcgaataatagcgtaggtttatcggtacggggtatcgagttagggttagtttagggtttagtacggttagtttaattttttcgcggtcgcgttacggcgaatattaaaattttgttttagcgtttgttgtatataattttagtaaatatcgtcgagggtcgtcgtttttagcgtcgggttacgcgttagtaggttacgtattaaatgagcggagagattttttgtacgtacgttacgaaaagtatcgtttttcgaacggtttatcggggtgcgaattgtatcgataatgataatttgttttattgtgattttttaagtcgtttttaggtcgttaatcggacgggttggtttaatcggaggatagtacggttcgttatgacgcgttttattacgtagatttttcggtattttatatagcgggtcgaggtgttgatattgttgtgttatatcgaggtattttgcgttatcgagggtgtttagttagcggaacgcgtcgtcgtggaacggagggaagtttaggtcgtagattagcgttatattcgttttcgtcggagtggcgataatgtttttttttagatagcgtattatttcgttgattatcgggattattatgcgggcgataatttttttttcgttgaaatcgcgtttcggttggtttatttttgttagtaggtttttaacggcggcgtttttttttggggatttt

SEQ ID NO: 7292 - DNA, 889 bp, Artificial Sequence
  chemically treated genomic DNA (Homo sapiens) CpG-island No: 7292
aaaatccccaaaaaaaaacgccgccgttaaaaacctactaacaaaaataaaccaaccgaaacgcgatttcaacgaaaaaaaaattatcgcccgcataataatcccgataatcaacgaaataatacgctatctaaaaaaaaacattatcgccactccgacgaaaacgaatataacgctaatctacgacctaaacttccctccgttccacgacgacgcgttccgctaactaaacaccctcgataacgcaaaatacctcgatataacacaacaatatcaacacctcgacccgctatataaaataccgaaaaatctacgtaataaaacgcgtcataacgaaccgtactatcctccgattaaaccaacccgtccgattaacgacctaaaaacgacttaaaaaatcacaataaaacaaattatcattatcgatacaattcgcaccccgataaaccgttcgaaaaacgatacttttcgtaacgtacgtacaaaaaatctctccgctcatttaatacgtaacctactaacgcgtaacccgacgctaaaaacgacgaccctcgacgatatttactaaaattatatacaacaaacgctaaaacaaaattttaatattcgccgtaacgcgaccgcgaaaaaattaaactaaccgtactaaaccctaaactaaccctaactcgataccccgtaccgataaacctacgctattattcgaaaaccctaaaaactactcaataccgatactatacaacctattcgatacgccaaaacgcgtaacgataaacataaaacaaaaaaatatttcgacgctacgtaaaattaataaattattaacgtttctaaaaaaaccgaaaccgccaaaaaatttccgcgacctatttaataaactaccgcaatt

SEQ ID NO: 7293 - DNA, 563 bp, Artificial Sequence
  chemically treated genomic DNA (Homo sapiens) CpG-island No: 7293
ggttgttgtagggtggttttttgcgtattatagtgtcggtttttcggtattattaagtgggtaatggtatttggattacgttcgttagcgagtatatttagcgtcggttttttagcgcgatatttgtagtggtataggggtagcgcgggttaagtaggtagtcgttcgggcggtttatttgtcgggaacgatatttggtaacgacgttagacgttttttgttttagtaaattttggtagcgtacgtagtaatgtttgagtatacgggtgacgcgcgtatggaagatggcgtgcgtattatcggtttttattatttggtttgttatattacgatgattttatgtgtcgttttcgttattagcgttaggttatggtaattaatattagcgttatgttttttttttgttgtagttttagtagtgttcgatgatttgcgtttgaatggttacgtttagcgcggtggtcggttttcggtaattagtagttttggtcgataggtaatcgttatggcgattattagcgttggttgggattttttagagttattatagtatgatagttgat

SEQ ID NO: 7294 - DNA, 563 bp, Artificial Sequence
  chemically treated genomic DNA (Homo sapiens) CpG-island No: 7294
atcaactatcatactataataactctaaaaaatcccaaccaacgctaataatcgccataacgattacctatcgaccaaaactactaattaccgaaaaccgaccaccgcgctaaacgtaaccattcaaacgcaaatcatcgaacactactaaaactacaacaaaaaaaaaacataacgctaatattaattaccataacctaacgctaataacgaaaacgacacataaaatcatcgtaatataacaaaccaaataataaaaaccgataatacgcacgccatcttccatacgcgcgtcacccgtatactcaaacattactacgtacgctaccaaaatttactaaaacaaaaaacgtctaacgtcgttaccaaatatcgttcccgacaaataaaccgcccgaacgactacctacttaacccgcgctacccctataccactacaaatatcgcgctaaaaaaccgacgctaaatatactcgctaacgaacgtaatccaaataccattacccacttaataataccgaaaaaccgacactataatacgcaaaaaaccaccctacaacaacc

SEQ ID NO: 7295 - DNA, 563 bp, Artificial Sequence
  chemically treated genomic DNA (Homo sapiens) CpG-island No: 7295
gttagttgttatgttgtggtgattttagaggattttagttagcgttgatgatcgttatggcgattgtttgtcggttaaaattgttgattgtcgagaatcgattatcgcgttggacgtgattatttaggcgtaaattatcgaatattgttggagttatagtagaaagagaatatggcgttggtgttaattattatgatttggcgttggtggcggaagcggtatataaaattatcgtgatgtagtaggttaggtggtggaaatcggtgatgcgtacgttattttttatgcgcgcgttattcgtatatttaggtattgttgcgtgcgttgttagaatttgttaggataaagaacgtttggcgtcgttgttaggtgtcgttttcggtaagtagatcgttcgaacggttgtttgtttaattcgcgttgtttttatgttattgtagatgtcgcgttgaagaatcggcgttgaatatgttcgttgacgggcgtagtttaaatgttattatttatttgatgatgtcgggaggtcgatattatggtacgtaagaggttattttgtaataatt

SEQ ID NO: 7296 - DNA, 563 bp, Artificial Sequence
  chemically treated genomic DNA (Homo sapiens) CpG-island No: 7296
aattattacaaaataacctcttacgtaccataatatcgacctcccgacatcatcaaataaataataacatttaaactacgcccgtcaacgaacatattcaacgccgattcttcaacgcgacatctacaataacataaaaacaacgcgaattaaacaaacaaccgttcgaacgatctacttaccgaaaacgacacctaacaacgacgccaaacgttctttatcctaacaaattctaacaacgcacgcaacaatacctaaatatacgaataacgcgcgcataaaaaataacgtacgcatcaccgatttccaccacctaacctactacatcacgataattttatataccgcttccgccaccaacgccaaatcataataattaacaccaacgccatattctctttctactataactccaacaatattcgataatttacgcctaaataatcacgtccaacgcgataatcgattctcgacaatcaacaattttaaccgacaaacaatcgccataacgatcatcaacgctaactaaaatcctctaaaatcaccacaacataacaactaac

SEQ ID NO: 7297 - DNA, 706 bp, Artificial Sequence
  chemically treated genomic DNA (Homo sapiens) CpG-island No: 7297
  misc_feature (178)..(178): n is either a, c, g or t
  misc_feature (212)..(212): n is either a, c, g or t
  misc_feature (238)..(238): n is either a, c, g or t
  misc_feature (277)..(277): n is either a, c, g or t
  misc_feature (327)..(327): n is either a, c, g or t
  misc_feature (362)..(363): n is either a, c, g or t
  misc_feature (415)..(416): n is either a, c, g or t
  misc_feature (433)..(433): n is either a, c, g or t
gtaatcgggtaaagcgtcgttgtatatgttatttaagcgtaggaagtgtatgacgttatcggtgcgggcgatacggtgatggcgttttggcggtaacgttggtagcgggtaattcgttggaagaagttttttttttgttaatgcggcggttgtgcgtggtggtcggtaaattgggaanttttacggtttcgtcgatcgagttggaaaatgtntgtacgtggacgtgcgatataggttnttggcgtgatgatcgaagaggaattgaaagttggtcgtngcggtagttgcgtaatacgtggtgaaaaagtggtgatgattaacggtgtntttggatatttttgtacgtcgggtacgttttttanntttggtaaatgtttcgtaagttgggtgatcgtttgattgttgttcgtttaanntagcgattttttattanaacggttgaaaggggattttcgttcggtaaatttattcgatagcgtatgattgtgttgggcgtattggaagcggtcgattgggtagtgcgtttgaagaggatacgtcgtagcgtttgatcgtcgggattttgttagattgttggtgaaaggcggcgattataaattagaagagattgtcgggagtaagaagtttgggttaacggtggcgaagtgttggtgtttaattttgaagacgttgttcgacgattaatattattaagaagatttaatag

SEQ ID NO: 7298 - DNA, 706 bp, Artificial Sequence
  chemically treated genomic DNA (Homo sapiens) CpG-island No: 7298
  misc_feature (274)..(274): n is either a, c, g or t
  misc_feature (291)..(292): n is either a, c, g or t
  misc_feature (344)..(345): n is either a, c, g or t
  misc_feature (380)..(380): n is either a, c, g or t
  misc_feature (430)..(430): n is either a, c, g or t
  misc_feature (469)..(469): n is either a, c, g or t
  misc_feature (495)..(495): n is either a, c, g or t
  misc_feature (529)..(529): n is either a, c, g or t
ctattaaatcttcttaataatattaatcgtcgaacaacgtcttcaaaattaaacaccaacacttcgccaccgttaacccaaacttcttactcccgacaatctcttctaatttataatcgccgcctttcaccaacaatctaacaaaatcccgacgatcaaacgctacgacgtatcctcttcaaacgcactacccaatcgaccgcttccaatacgcccaacacaatcatacgctatcgaataaatttaccgaacgaaaatcccctttcaaccgttntaataaaaaatcgctannttaaacgaacaacaatcaaacgatcacccaacttacgaaacatttaccaaanntaaaaaacgtacccgacgtacaaaaatatccaaanacaccgttaatcatcaccactttttcaccacgtattacgcaactaccgcnacgaccaactttcaattcctcttcgatcatcacgccaanaacctatatcgcacgtccacgtacanacattttccaactcgatcgacgaaaccgtaaaanttcccaatttaccgaccaccacgcacaaccgccgcattaacaaaaaaaaaacttcttccaacgaattacccgctaccaacgttaccgccaaaacgccatcaccgtatcgcccgcaccgataacgtcatacacttcctacgcttaaataacatatacaacgacgctttacccgattac

SEQ ID NO: 7299 - DNA, 706 bp, Artificial Sequence
  chemically treated genomic DNA (Homo sapiens) CpG-island No: 7299
  misc_feature (274)..(274): n is either a, c, g or t
  misc_feature (291)..(292): n is either a, c, g or t
  misc_feature (344)..(345): n is either a, c, g or t
  misc_feature (380)..(380): n is either a, c, g or t
  misc_feature (430)..(430): n is either a, c, g or t
  misc_feature (469)..(469): n is either a, c, g or t
  misc_feature (495)..(495): n is either a, c, g or t
  misc_feature (529)..(529): n is either a, c, g or t
ttgttggatttttttgatgatgttggtcgtcgagtaacgtttttaaagttgagtattaatatttcgttatcgttggtttagattttttattttcggtaattttttttggtttatagtcgtcgttttttattagtagtttggtaagatttcggcgattaagcgttgcggcgtgttttttttaaacgtattatttagtcgatcgtttttagtgcgtttagtataattatacgttgtcgagtgggtttatcgggcgggaatttttttttagtcgttntggtggaggatcgttgnnttgaacgggtaataattaagcggttatttagtttgcggggtatttgttaganntaagagacgtgttcggcgtgtaggaatgtttaaangtatcgttggttattattatttttttattacgtattacgtagttgtcgtnacggttagtttttagttttttttcggttattacgttaanagtttgtatcgtacgtttacgtatangtattttttagttcgatcggcgaaatcgtggagntttttagtttgtcgattattacgtatagtcgtcgtattggtaaagaagaggttttttttagcgaattattcgttgttagcgttgtcgttaggacgttattatcgtgtcgttcgtatcggtaacgttatatattttttgcgtttgggtggtatatgtagcggcgttttattcggttgt

SEQ ID NO: 7300 - DNA, 706 bp, Artificial Sequence
  chemically treated genomic DNA (Homo sapiens) CpG-island No: 7300
  misc_feature (178)..(178): n is either a, c, g or t
  misc_feature (212)..(212): n is either a, c, g or t
  misc_feature (238)..(238): n is either a, c, g or t
  misc_feature (277)..(277): n is either a, c, g or t
  misc_feature (327)..(327): n is either a, c, g or t
  misc_feature (362)..(363): n is either a, c, g or t
  misc_feature (415)..(416): n is either a, c, g or t
  misc_feature (433)..(433): n is either a, c, g or t
acaaccgaataaaacgccgctacatataccacccaaacgcaaaaaatatataacgttaccgatacgaacgacacgataataacgtcctaacgacaacgctaacaacgaataattcgctaaaaaaaacctcttctttaccaatacgacgactatacgtaataatcgacaaactaaaaanctccacgatttcgccgatcgaactaaaaaatacntatacgtaaacgtacgatacaaactnttaacgtaataaccgaaaaaaaactaaaaactaaccgtnacgacaactacgtaatacgtaataaaaaaataataataaccaacgatacntttaaacattcctacacgccgaacacgtctcttanntctaacaaataccccgcaaactaaataaccgcttaattattacccgttcaanncaacgatcctccaccanaacgactaaaaaaaaattcccgcccgataaacccactcgacaacgtataattatactaaacgcactaaaaacgatcgactaaataatacgtttaaaaaaaacacgccgcaacgcttaatcgccgaaatcttaccaaactactaataaaaaacgacgactataaaccaaaaaaaattaccgaaaataaaaaatctaaaccaacgataacgaaatattaatactcaactttaaaaacgttactcgacgaccaacatcatcaaaaaaatccaacaa

SEQ ID NO: 7301 - DNA, 832 bp, Artificial Sequence
  chemically treated genomic DNA (Homo sapiens) CpG-island No: 7301
tcggttggcgcgtattcgtcgggcgatatgggcgaagattttaaggtatttcgaataatttgatgttatatatcgtttaggttgttgtagtcgtcgcgattcgttggcgatttttggtaacgattattcgatcgaagatgtattggcgtacgcgattatatttacgtaatggatttggcggacggttagtcgtggcgatggaaaaattggcgaataagttaggcgtatatatttatatttcggcgttggcgtaggtaatagcgtgttggacgtggttaatgttttcgtaaagtttgcggtaaatcggttaattattattttgtatcgcgtcgcgaggcgatttttcggtttattgggcggacgttagtaaagtcgatcgtgaacgaattggcgcgtaacgcgtatattcgatgaaatggcgtaggatatttggattggtagttacgttatttatagggatatttcgattaaggaacgattatacgtaatttaatttcgttgattatttatatcggcgttataattcgtttaggggtatggattttggtttatcggtacgcgttaagcgttcggttagggggtaggaaacgtagtaaatagtgtttttgggtcgattatatggttttttggtcggtaagggggggaaagggaaaaaatcgtataatcggatatatattatagatggagacgcgacggtaggttagttgtatgttgttaggtgattttagaggattttcgttaaagttaacgatacgggttattttattagtgtagacgcggtttattcgatttttgtagtgattttttcgatacgacgaatagtatgtttcgt

SEQ ID NO: 7302 - DNA, 832 bp, Artificial Sequence
  chemically treated genomic DNA (Homo sapiens) CpG-island No: 7302
acgaaacatactattcgtcgtatcgaaaaaatcactacaaaaatcgaataaaccgcgtctacactaataaaataacccgtatcgttaactttaacgaaaatcctctaaaatcacctaacaacatacaactaacctaccgtcgcgtctccatctataatatatatccgattatacgattttttccctttcccccccttaccgaccaaaaaaccatataatcgacccaaaaacactatttactacgtttcctaccccctaaccgaacgcttaacgcgtaccgataaaccaaaatccatacccctaaacgaattataacgccgatataaataatcaacgaaattaaattacgtataatcgttccttaatcgaaatatccctataaataacgtaactaccaatccaaatatcctacgccatttcatcgaatatacgcgttacgcgccaattcgttcacgatcgactttactaacgtccgcccaataaaccgaaaaatcgcctcgcgacgcgatacaaaataataattaaccgatttaccgcaaactttacgaaaacattaaccacgtccaacacgctattacctacgccaacgccgaaatataaatatatacgcctaacttattcgccaatttttccatcgccacgactaaccgtccgccaaatccattacgtaaatataatcgcgtacgccaatacatcttcgatcgaataatcgttaccaaaaatcgccaacgaatcgcgacgactacaacaacctaaacgatatataacatcaaattattcgaaataccttaaaatcttcgcccatatcgcccgacgaatacgcgccaaccga

SEQ ID NO: 7303 - DNA, 832 bp, Artificial Sequence
  chemically treated genomic DNA (Homo sapiens) CpG-island No: 7303
gcgaaatatgttattcgtcgtatcgaagagattattgtagaaatcgagtgggtcgcgtttatattggtaaagtgattcgtatcgttgattttggcggggattttttagagttatttagtagtatgtagttgatttgtcgtcgcgtttttatttgtggtatgtgttcggttatgcggtttttttttttttttttttttatcggttaggggattatgtgatcggtttagaaatattgtttgttgcgttttttgttttttgatcgggcgtttagcgcgtgtcggtaaattagaatttatgtttttgagcgggttgtagcgtcgatgtggatgattaacgggattaaattgcgtatggtcgttttttaatcgggatatttttgtggatggcgtgattgttagtttaggtgttttgcgttattttatcgagtgtgcgcgttacgcgttagttcgtttacggtcggttttgttggcgttcgtttagtaggtcggaaggtcgtttcgcgacgcggtgtaaaatgataattaatcggtttgtcgtaggttttgcgaaggtattaattacgtttagtacgttgttgtttacgttagcgtcgaggtgtagatgtgtacgtttggtttgttcgttagtttttttatcgttacgattgatcgttcgttagatttattacgtggatgtaatcgcgtacgttagtatattttcggtcggataatcgttattaaaaatcgttagcgagtcgcgacggttatagtaatttgggcgatgtatggtattaggttattcggaatgttttgggattttcgtttatatcgttcgacggatgcgcgttaatcgg

SEQ ID NO: 7304 - DNA, 832 bp, Artificial Sequence
  chemically treated genomic DNA (Homo sapiens) CpG-island No: 7304
ccgattaacgcgcatccgtcgaacgatataaacgaaaatcccaaaacattccgaataacctaataccatacatcgcccaaattactataaccgtcgcgactcgctaacgatttttaataacgattatccgaccgaaaatatactaacgtacgcgattacatccacgtaataaatctaacgaacgatcaatcgtaacgataaaaaaactaacgaacaaaccaaacgtacacatctacacctcgacgctaacgtaaacaacaacgtactaaacgtaattaataccttcgcaaaacctacgacaaaccgattaattatcattttacaccgcgtcgcgaaacgaccttccgacctactaaacgaacgccaacaaaaccgaccgtaaacgaactaacgcgtaacgcgcacactcgataaaataacgcaaaacacctaaactaacaatcacgccatccacaaaaatatcccgattaaaaaacgaccatacgcaatttaatcccgttaatcatccacatcgacgctacaacccgctcaaaaacataaattctaatttaccgacacgcgctaaacgcccgatcaaaaaacaaaaaacgcaacaaacaatatttctaaaccgatcacataatcccctaaccgataaaaaaaaaaaaaaaaaaaaaccgcataaccgaacacataccacaaataaaaacgcgacgacaaatcaactacatactactaaataactctaaaaaatccccgccaaaatcaacgatacgaatcactttaccaatataaacgcgacccactcgatttctacaataatctcttcgatacgacgaataacatatttcgc

SEQ ID NO: 7305 - DNA, 712 bp, Artificial Sequence
  chemically treated genomic DNA (Homo sapiens) CpG-island No: 7305
cgtcggttttgaggagtttcggttttcgcgtttttcgtttttatcgtcgtgagaatagcgcgtggtacgagtttagtagttagtttcgttttcgttcgggttttcgcggtcggaatcgaggaaggtcgaatcggaacgaagtcgtttttttagtaagttcgacggacgtagagtagatttattcggggtttatttcggttagtttttgcggttttcggtttttttcgattagttatcgtaatattcgggtagcggcggcgttttgttcggtttagttttagttagtttaaatttcgttttaggttcggttttttttttttttttcggttgtagcgtaattgagacgttaatatttttcgttttagattagtttacgggtcgaaggaatgtagattatagttgagggagaatttttgtttttaaagcgttttcgtatttagttacggaggtttagtttgggtagtcgtttggggtgcggcggtcgacggcgggggcggttgcggcgattgcggggcgcgcgttgtttcgagtgagtacgcgcgggagcgtcgtcgggtagcgtacggagtttaggtagttcgagcggtttttggtggacgcgcgcggagtagtaattcgatttcggcgagtaagcgcgtattaagaataatgtttttttttgtgatatggttttagtattttttattttttagggtattaggaaatttttttt

SEQ ID NO: 7306 - DNA, 712 bp, Artificial Sequence
  chemically treated genomic DNA (Homo sapiens) CpG-island No: 7306
aaaaaaaatttcctaataccctaaaaaataaaaaatactaaaaccatatcacaaaaaaaaacattattcttaatacgcgcttactcgccgaaatcgaattactactccgcgcgcgtccaccaaaaaccgctcgaactacctaaactccgtacgctacccgacgacgctcccgcgcgtactcactcgaaacaacgcgcgccccgcaatcgccgcaaccgcccccgccgtcgaccgccgcaccccaaacgactacccaaactaaacctccgtaactaaatacgaaaacgctttaaaaacaaaaattctccctcaactataatctacattccttcgacccgtaaactaatctaaaacgaaaaatattaacgtctcaattacgctacaaccgaaaaaaaaaaaaaaaaccgaacctaaaacgaaatttaaactaactaaaactaaaccgaacaaaacgccgccgctacccgaatattacgataactaatcgaaaaaaaccgaaaaccgcaaaaactaaccgaaataaaccccgaataaatctactctacgtccgtcgaacttactaaaaaaacgacttcgttccgattcgaccttcctcgattccgaccgcgaaaacccgaacgaaaacgaaactaactactaaactcgtaccacgcgctattctcacgacgataaaaacgaaaaacgcgaaaaccgaaactcctcaaaaccgacg

SEQ ID NO: 7307 - DNA, 712 bp, Artificial Sequence
  chemically treated genomic DNA (Homo sapiens) CpG-island No: 7307
aggggagattttttggtattttaggaagtggaggatattaaagttatgttatagggaggggtattatttttggtgcgcgtttgttcgtcggggtcgggttgttgtttcgcgcgcgtttattaggggtcgttcgagttatttaagtttcgtgcgttattcggcggcgttttcgcgcgtgtttattcggagtagcgcgcgtttcgtaatcgtcgtagtcgttttcgtcgtcggtcgtcgtattttaagcgattgtttaaattaagttttcgtggttgggtacgggagcgttttggggataaaaatttttttttaattgtggtttgtattttttcggttcgtgggttgatttggggcgggaagtattagcgttttagttgcgttgtagtcggggaggaaggaggaggtcgagtttggggcggagtttgggttgattggggttggatcgggtaagacgtcgtcgttgttcggatgttgcgatggttgatcgggggaggtcgagaatcgtagggattggtcgaggtaaatttcgggtgggtttgttttgcgttcgtcgagtttgttggaggggcggtttcgtttcggttcggtttttttcggtttcgatcgcggggattcgggcggaggcggggttggttgttgagttcgtgttacgcgttgtttttacgacggtgggggcggagggcgcgggagtcggagttttttagagtcggcg

SEQ ID NO: 7308 - DNA, 712 bp, Artificial Sequence
  chemically treated genomic DNA (Homo sapiens) CpG-island No: 7308
cgccgactctaaaaaactccgactcccgcgccctccgcccccaccgtcgtaaaaacaacgcgtaacacgaactcaacaaccaaccccgcctccgcccgaatccccgcgatcgaaaccgaaaaaaaccgaaccgaaacgaaaccgcccctccaacaaactcgacgaacgcaaaacaaacccacccgaaatttacctcgaccaatccctacgattctcgacctcccccgatcaaccatcgcaacatccgaacaacgacgacgtcttacccgatccaaccccaatcaacccaaactccgccccaaactcgacctcctccttcctccccgactacaacgcaactaaaacgctaatacttcccgccccaaatcaacccacgaaccgaaaaaatacaaaccacaattaaaaaaaaatttttatccccaaaacgctcccgtacccaaccacgaaaacttaatttaaacaatcgcttaaaatacgacgaccgacgacgaaaacgactacgacgattacgaaacgcgcgctactccgaataaacacgcgcgaaaacgccgccgaataacgcacgaaacttaaataactcgaacgacccctaataaacgcgcgcgaaacaacaacccgaccccgacgaacaaacgcgcaccaaaaataatacccctccctataacataactttaatatcctccacttcctaaaataccaaaaaatctcccct

SEQ ID NO: 7309 - DNA, 637 bp, Artificial Sequence
  chemically treated genomic DNA (Homo sapiens) CpG-island No: 7309
gaataggcgatatattcggttggcgagttcggtttcgcgggttcggtagcgtagcggatattgggaaagaggttataggtttcgtttatttgaagttatcgtttattttaggtttttagcgggtttcggattttattaatttcggtttcgttcgtttttggttcgcgttttttaaattttttcgaggttttagttttcgtttattcggttcgtttattttagtttttgtttattcgggttcgtttattttaggtcggtagttagttttaggtttttcgttttgcgtttcgtcgtcgtggtggcgtttgggaatcgaaggtaggtgtttttcgttttgtcgtttcgtttttttatttcgggttgtggtttaggtttagtgcgatttagggaacgaagcggtatttgtaacggcgttatcgttgttataggtttcgtagtagacggttaggtatggttgtttcgcggggtcgtgattaggacggcgcggggaaggcggatcgaggtttcgggttcgtttcggttcgggaggagagggggtcgcgttcggtcgtttttttttggtttcgtttttagtgtttttggtatcgtttgatttttgttgttttggggtttcgtttttttttttttttgattttat

SEQ ID NO: 7310 - DNA, 637 bp, Artificial Sequence
  chemically treated genomic DNA (Homo sapiens) CpG-island No: 7310
ataaaatcaaaaaaaaaaaaaaacgaaaccccaaaacaacaaaaatcaaacgataccaaaaacactaaaaacgaaaccaaaaaaaaacgaccgaacgcgaccccctctcctcccgaaccgaaacgaacccgaaacctcgatccgccttccccgcgccgtcctaatcacgaccccgcgaaacaaccatacctaaccgtctactacgaaacctataacaacgataacgccgttacaaataccgcttcgttccctaaatcgcactaaacctaaaccacaacccgaaataaaaaaacgaaacgacaaaacgaaaaacacctaccttcgattcccaaacgccaccacgacgacgaaacgcaaaacgaaaaacctaaaactaactaccgacctaaaataaacgaacccgaataaacaaaaactaaaataaacgaaccgaataaacgaaaactaaaacctcgaaaaaatttaaaaaacgcgaaccaaaaacgaacgaaaccgaaattaataaaatccgaaacccgctaaaaacctaaaataaacgataacttcaaataaacgaaacctataacctctttcccaatatccgctacgctaccgaacccgcgaaaccgaactcgccaaccgaatatatcgcctattc

SEQ ID NO: 7311 - DNA, 637 bp, Artificial Sequence
  chemically treated genomic DNA (Homo sapiens) CpG-island No: 7311
gtgaggttaggaaaggggaaggacgaagttttagagtaatagaagttaggcggtgttaggaatattgagagcggagttaggggaaggcggtcgagcgcggtttttttttttttcgggtcggggcgggttcgaggtttcgattcgtttttttcgcgtcgttttggttacggtttcgcggggtagttatgtttggtcgtttgttgcggggtttgtggtagcgatggcgtcgttataagtatcgtttcgttttttggatcgtattgaatttaagttataattcgaggtgagagggcgggacggtagaacgaggggtatttgttttcggtttttagacgttattacggcggcgggacgtaaagcggagagtttgaggttgattgtcggtttgagatgggcgggttcgggtgggtagggattgaggtgggcgggtcgggtgggcggggattgaggtttcggaggggtttaaggaacgcgggttagaggcgggcggggtcgaggttggtggagttcgaggttcgttggaagtttgaagtgggcggtggttttaggtgggcggggtttatggttttttttttagtgttcgttgcgttgtcgggttcgcgaggtcgagttcgttagtcggatgtgtcgtttgttt

SEQ ID NO: 7312 - DNA, 637 bp, Artificial Sequence
  chemically treated genomic DNA (Homo sapiens) CpG-island No: 7312
aaacaaacgacacatccgactaacgaactcgacctcgcgaacccgacaacgcaacgaacactaaaaaaaaaaccataaaccccgcccacctaaaaccaccgcccacttcaaacttccaacgaacctcgaactccaccaacctcgaccccgcccgcctctaacccgcgttccttaaacccctccgaaacctcaatccccgcccacccgacccgcccacctcaatccctacccacccgaacccgcccatctcaaaccgacaatcaacctcaaactctccgctttacgtcccgccgccgtaataacgtctaaaaaccgaaaacaaatacccctcgttctaccgtcccgccctctcacctcgaattataacttaaattcaatacgatccaaaaaacgaaacgatacttataacgacgccatcgctaccacaaaccccgcaacaaacgaccaaacataactaccccgcgaaaccgtaaccaaaacgacgcgaaaaaaacgaatcgaaacctcgaacccgccccgacccgaaaaaaaaaaaaaccgcgctcgaccgccttcccctaactccgctctcaatattcctaacaccgcctaacttctattactctaaaacttcgtccttcccctttcctaacctcac

SEQ ID NO: 7313 - DNA, 1693 bp, Artificial Sequence
  chemically treated genomic DNA (Homo sapiens) CpG-island No: 7313
ttttcgcgagtttcgcggtgtcgggtcgagattgtcgagaggaagcggcgtagcgttgtcgttaaggttttttttgtcgtcggtgcggtcgggattatttggcggcgcggcgcgtgtagcgcgtagagtttcgggagtttacgttttcgttttcgttttcgtttttttcgttttttagtttatttcgttcgttcgttttttcgttcggcggagagtatagtttatttttttttatttgcggtcgtcgggtcgttttttatttatatttttgtcgtaggtcggatttagtgcgttcgttcgtcggttagtttaggttaggcgttcggcgggtcgcgtttacgtagttggcgtaggaggttttacgttggcggcgtagtgttcgttttttgcgtttttttcgttttttttttttttcgtaggggtcgagcgaatgtagttcgcgagagaaaatggcggcggcggcggggaatcgcgtttcgtcgtcgggattttcgggcgttagggttacgagttttgagtagcgcggcggagagtttttaaggcgagtagcgcgttcgcggttgtcgcgggattgttgcgggaggcgggtagcggggtgtttgcgagcgggcggattggcggcggcggtagttgcgtaaagtgcggagtgtggagttggattagttgtttgagtagtcgtttttttttgtcgttttatcgtcggttttttcgattttttcgtcgtcggagttcgcggacgtagcggggagtgggatcggtttttagtttgtggcggtgtcgtcgttttacggagtcgcgagtcgcggcggcgtttattttatcgagtcggtggcggcgtcggatagcggcgtttcgagtttcgtagcggtcgagttcggggagaagcgggcgttcgtcgtcgagtcgttttttgtagcggttttcgtcgggtgagtagtacggtcggggtcgcggcggggatttggagagcgggtagagggtaatgaatgaatttcgggtattatgtacggcgtttcggggtttagcgtagcgaggttacgcgtcgttcgtcgggatttacgtttttgagtatttttcgattttttcggagtcgggcggcgtttcggatttagtttgggggatcggacggggacgtgcggaagagtttgttattgtttgtagatatgtgataggcgtgcgagtttttttgcggggaatcgttgcgaaaaggtgtagggggttacggttggttttgtgggatttttggaatcggggtttttcgaggagttcgggggcggggtacggttttgcggcggcgttttcggacgggtgttttcggggtaaaggtattggggggcgaggttcgagtttgaggcgggcggtggtcggaagaggggcggggtgggtgagaagttcgaggtcgggtgggagattgagaggatcgaagagaaagtagtaggttttagcggtcgtgataggtagagtttttcggttcgttcgggattcgagtttttaggtagatatcgcgggttgggttcggacgtaggcggcgcgtttttagcgtcggtcgtagggttttaggaggacggttcggtaacgtttgttaaagtcgtgcggcgggaggttgtatattcgcggaggtttgtagttttttaggaagtgcggtttgtttaattgtagtttttaaggggttttgagtgtttttgggaatgcg

SEQ ID NO: 7314 - DNA, 1693 bp, Artificial Sequence
  chemically treated genomic DNA (Homo sapiens) CpG-island No: 7314
cgcattcccaaaaacactcaaaaccccttaaaaactacaattaaacaaaccgcacttcctaaaaaactacaaacctccgcgaatatacaacctcccgccgcacgactttaacaaacgttaccgaaccgtcctcctaaaaccctacgaccgacgctaaaaacgcgccgcctacgtccgaacccaacccgcgatatctacctaaaaactcgaatcccgaacgaaccgaaaaactctacctatcacgaccgctaaaacctactactttctcttcgatcctctcaatctcccacccgacctcgaacttctcacccaccccgcccctcttccgaccaccgcccgcctcaaactcgaacctcgccccccaatacctttaccccgaaaacacccgtccgaaaacgccgccgcaaaaccgtaccccgcccccgaactcctcgaaaaaccccgattccaaaaatcccacaaaaccaaccgtaaccccctacaccttttcgcaacgattccccgcaaaaaaactcgcacgcctatcacatatctacaaacaataacaaactcttccgcacgtccccgtccgatcccccaaactaaatccgaaacgccgcccgactccgaaaaaatcgaaaaatactcaaaaacgtaaatcccgacgaacgacgcgtaacctcgctacgctaaaccccgaaacgccgtacataatacccgaaattcattcattaccctctacccgctctccaaatccccgccgcgaccccgaccgtactactcacccgacgaaaaccgctacaaaaaacgactcgacgacgaacgcccgcttctccccgaactcgaccgctacgaaactcgaaacgccgctatccgacgccgccaccgactcgataaaataaacgccgccgcgactcgcgactccgtaaaacgacgacaccgccacaaactaaaaaccgatcccactccccgctacgtccgcgaactccgacgacgaaaaaatcgaaaaaaccgacgataaaacgacaaaaaaaaacgactactcaaacaactaatccaactccacactccgcactttacgcaactaccgccgccgccaatccgcccgctcgcaaacaccccgctacccgcctcccgcaacaatcccgcgacaaccgcgaacgcgctactcgccttaaaaactctccgccgcgctactcaaaactcgtaaccctaacgcccgaaaatcccgacgacgaaacgcgattccccgccgccgccgccattttctctcgcgaactacattcgctcgacccctacgaaaaaaaaaaaaaacgaaaaaaacgcaaaaaacgaacactacgccgccaacgtaaaacctcctacgccaactacgtaaacgcgacccgccgaacgcctaacctaaactaaccgacgaacgaacgcactaaatccgacctacgacaaaaatataaataaaaaacgacccgacgaccgcaaataaaaaaaaataaactatactctccgccgaacgaaaaaacgaacgaacgaaataaactaaaaaacgaaaaaaacgaaaacgaaaacgaaaacgtaaactcccgaaactctacgcgctacacgcgccgcgccgccaaataatcccgaccgcaccgacgacaaaaaaaaccttaacgacaacgctacgccgcttcctctcgacaatctcgacccgacaccgcgaaactcgcgaaaa

SEQ ID NO: 7315 - DNA, 1693 bp, Artificial Sequence
  chemically treated genomic DNA (Homo sapiens) CpG-island No: 7315
cgtatttttaggaatatttaaagttttttgggggttgtaattagataaatcgtattttttaaaagattgtaagttttcgcgagtgtgtagtttttcgtcgtacggttttgataggcgttatcgagtcgtttttttggagttttgcggtcggcgttgggggcgcgtcgtttgcgttcgggtttagttcgcggtatttgtttagggattcgagtttcgggcgggtcgaggggttttgtttgttacggtcgttgggatttgttatttttttttcggtttttttagttttttattcgatttcgggttttttatttatttcgtttttttttcgattatcgttcgttttaggttcgggtttcgttttttagtgtttttgtttcggggatattcgttcgggggcgtcgtcgtagggtcgtgtttcgttttcgggtttttcggagagtttcgattttaggagttttataaagttagtcgtggttttttatattttttcgtaacggtttttcgtagagaggttcgtacgtttgttatatgtttgtaaataataataaattttttcgtacgttttcgttcggttttttaggttgggttcggggcgtcgttcgatttcgaaggggtcggggggtgtttaggggcgtaggtttcggcgagcggcgcgtagtttcgttgcgttgaatttcgggacgtcgtgtatggtgttcggggtttatttattgttttttgttcgttttttaagttttcgtcgcgatttcggtcgtgttgtttattcggcgggggtcgttgtaggagacggttcggcggcgggcgttcgttttttttcgggttcggtcgttgcgggattcgaggcgtcgttgttcggcgtcgttatcgattcggtaaggtgggcgtcgtcgcggttcgcggtttcgtggggcggcggtatcgttataggttggaagtcggttttatttttcgttgcgttcgcgggtttcggcgacggggaagtcgaggaggtcggcggtgaggcggtaaggaagagcggttgtttaggtagttggtttagttttatatttcgtattttgcgtagttgtcgtcgtcgttagttcgttcgttcgtaggtatttcgttgttcgtttttcgtagtagtttcgcggtagtcgcgggcgcgttgttcgttttgagggtttttcgtcgcgttgtttagggttcgtagttttggcgttcgggaatttcgacgacgaggcgcgatttttcgtcgtcgtcgttattttttttcgcgggttatattcgttcggtttttgcgagggagggagggggcggggagagcgtagggggcgggtattgcgtcgttagcgtaaggttttttgcgttaattgcgtgagcgcggttcgtcgggcgtttggtttggattgatcgacgggcgggcgtattgggttcggtttgcggtagaggtgtgggtggagggcggttcggcggtcgtaggtgggagggagtgggttgtgtttttcgtcgggcgagagggcgggcgggcgaggtggattgggaggcggagggggcgggggcggaggcggaggcgtgggttttcgggattttgcgcgttgtacgcgtcgcgtcgttaggtagtttcggtcgtatcggcgataggaggagttttggcggtagcgttgcgtcgttttttttcggtaatttcggttcggtatcgcggagttcgcgggag

SEQ ID NO: 7316 - DNA, 1693 bp, Artificial Sequence
  chemically treated genomic DNA (Homo sapiens) CpG-island No: 7316
ctcccgcgaactccgcgataccgaaccgaaattaccgaaaaaaaacgacgcaacgctaccgccaaaactcctcctatcgccgatacgaccgaaactacctaacgacgcgacgcgtacaacgcgcaaaatcccgaaaacccacgcctccgcctccgcccccgccccctccgcctcccaatccacctcgcccgcccgccctctcgcccgacgaaaaacacaacccactccctcccacctacgaccgccgaaccgccctccacccacacctctaccgcaaaccgaacccaatacgcccgcccgtcgatcaatccaaaccaaacgcccgacgaaccgcgctcacgcaattaacgcaaaaaaccttacgctaacgacgcaatacccgccccctacgctctccccgccccctccctccctcgcaaaaaccgaacgaatataacccgcgaaaaaaaataacgacgacgacgaaaaatcgcgcctcgtcgtcgaaattcccgaacgccaaaactacgaaccctaaacaacgcgacgaaaaaccctcaaaacgaacaacgcgcccgcgactaccgcgaaactactacgaaaaacgaacaacgaaatacctacgaacgaacgaactaacgacgacgacaactacgcaaaatacgaaatataaaactaaaccaactacctaaacaaccgctcttccttaccgcctcaccgccgacctcctcgacttccccgtcgccgaaacccgcgaacgcaacgaaaaataaaaccgacttccaacctataacgataccgccgccccacgaaaccgcgaaccgcgacgacgcccaccttaccgaatcgataacgacgccgaacaacgacgcctcgaatcccgcaacgaccgaacccgaaaaaaaacgaacgcccgccgccgaaccgtctcctacaacgacccccgccgaataaacaacacgaccgaaatcgcgacgaaaacttaaaaaacgaacaaaaaacaataaataaaccccgaacaccatacacgacgtcccgaaattcaacgcaacgaaactacgcgccgctcgccgaaacctacgcccctaaacaccccccgaccccttcgaaatcgaacgacgccccgaacccaacctaaaaaaccgaacgaaaacgtacgaaaaaatttattattatttacaaacatataacaaacgtacgaacctctctacgaaaaaccgttacgaaaaaatataaaaaaccacgactaactttataaaactcctaaaatcgaaactctccgaaaaacccgaaaacgaaacacgaccctacgacgacgcccccgaacgaatatccccgaaacaaaaacactaaaaaacgaaacccgaacctaaaacgaacgataatcgaaaaaaaaacgaaataaataaaaaacccgaaatcgaataaaaaactaaaaaaaccgaaaaaaaaataacaaatcccaacgaccgtaacaaacaaaacccctcgacccgcccgaaactcgaatccctaaacaaataccgcgaactaaacccgaacgcaaacgacgcgcccccaacgccgaccgcaaaactccaaaaaaacgactcgataacgcctatcaaaaccgtacgacgaaaaactacacactcgcgaaaacttacaatcttttaaaaaatacgatttatctaattacaacccccaaaaaactttaaatattcctaaaaatacg

SEQ ID NO: 7317 - DNA, 556 bp, Artificial Sequence
  chemically treated genomic DNA (Homo sapiens) CpG-island No: 7317
  misc_feature (250)..(250): n is either a, c, g or t
tggaggacggtacgtagttggttgtgttttcgtttttcgtcgggagatttatcgtgagttggggatttttttttatttaacgaggttgtcgaagaggtaggtttgcgttgggcgtaatattatgatttttaagttattagatggcgtagtaattgggcggttcgacggaagtgtcgttgaggttaataaaagttcgtttgtcgtttggttgaaaatttggttgcgtttaatatttgggtacgcgtagcgntgatcgaaatttattagggcgaattttttcgttgtttcgttatacgttggggattatgttattggagataacggggcgtgggtagttattcgtatttcgaatcgtcggtggtttttttttattcgcggtttgttcgttggtgaagagtatattcgcggcggggcgtagtagtgttttagggcgtttttattcggtttttattattggcgcggtttttttcgtgatattttttatttaggggatattttttttttcggtatttttttaagaatataaattcgttatttttattaataaaagtatata

SEQ ID NO: 7318 - DNA, 556 bp, Artificial Sequence
  chemically treated genomic DNA (Homo sapiens) CpG-island No: 7318
  misc_feature (307)..(307): n is either a, c, g or t
tatatacttttattaataaaaataacgaatttatattcttaaaaaaataccgaaaaaaaaaatatcccctaaataaaaaatatcacgaaaaaaaccgcgccaataataaaaaccgaataaaaacgccctaaaacactactacgccccgccgcgaatatactcttcaccaacgaacaaaccgcgaataaaaaaaaaccaccgacgattcgaaatacgaataactacccacgccccgttatctccaataacataatccccaacgtataacgaaacaacgaaaaaattcgccctaataaatttcgatcancgctacgcgtacccaaatattaaacgcaaccaaattttcaaccaaacgacaaacgaacttttattaacctcaacgacacttccgtcgaaccgcccaattactacgccatctaataacttaaaaatcataatattacgcccaacgcaaacctacctcttcgacaacctcgttaaataaaaaaaaatccccaactcacgataaatctcccgacgaaaaacgaaaacacaaccaactacgtaccgtcctcca

SEQ ID NO: 7319 - DNA, 556 bp, Artificial Sequence
  chemically treated genomic DNA (Homo sapiens) CpG-island No: 7319
  misc_feature (307)..(307): n is either a, c, g or t
tgtgtatttttgttggtaaagataacgggtttatatttttggaaagatgtcggggggaaggatgttttttaaatggggggtgttacggggagaatcgcgttagtggtgaaggtcgggtaggaacgttttggagtattattacgtttcgtcgcggatatgttttttattaacgaataggtcgcgggtggagagggattatcggcggttcggaatacgaataattatttacgtttcgttatttttaatagtataatttttagcgtatagcggaatagcggagagattcgttttgatgaatttcggttancgttacgcgtatttagatattgggcgtagttaggtttttagttagacgataggcgaatttttgttgattttaacggtattttcgtcgggtcgtttagttgttgcgttatttgatggtttaagaattatagtgttgcgtttaacgtagatttgttttttcggtagtttcgttgggtagagagagatttttagtttacggtagatttttcgacggaaagcgggagtataattaattgcgtgtcgtttttta

SEQ ID NO: 7320 - DNA, 556 bp, Artificial Sequence
  chemically treated genomic DNA (Homo sapiens) CpG-island No: 7320
  misc_feature (250)..(250): n is either a, c, g or t
taaaaaacgacacgcaattaattatactcccgctttccgtcgaaaaatctaccgtaaactaaaaatctctctctacccaacgaaactaccgaaaaaacaaatctacgttaaacgcaacactataattcttaaaccatcaaataacgcaacaactaaacgacccgacgaaaataccgttaaaatcaacaaaaattcgcctatcgtctaactaaaaacctaactacgcccaatatctaaatacgcgtaacgntaaccgaaattcatcaaaacgaatctctccgctattccgctatacgctaaaaattatactattaaaaataacgaaacgtaaataattattcgtattccgaaccgccgataatccctctccacccgcgacctattcgttaataaaaaacatatccgcgacgaaacgtaataatactccaaaacgttcctacccgaccttcaccactaacgcgattctccccgtaacaccccccatttaaaaaacatccttccccccgacatctttccaaaaatataaacccgttatctttaccaacaaaaatacaca

SEQ ID NO: 7321 - DNA, 736 bp, Artificial Sequence
  chemically treated genomic DNA (Homo sapiens) CpG-island No: 7321
acgtcgaagagttggtattgttggaaattttcgatacggtaaatcgattcgttatagtttgcgtgatgtatattttcggcgcggtcgcgttattcgttggtacgtcgaagcgatcgataaagtgtatggcgaagggcgattattagtagttatgagttggcgatgatcgtgcgtgaatcggtcgcgtgattgtcgttatcgtgtcgtggaatttttcgttgttgttgatttgtggaaattcggttcggcgttggcggcgggaaatagcgtgattttaaaacgtttgaaaaattatcgtttagtgcgattcgtttcgcggggttggcgaaaaagtaggtttgtcggatggtgtgttgaacgtggtgacgggtttaggttagaagtcgggtaggcgttgtcgcgttataacgatatcgacgttattgttttatcggtttaattcgtatcgggaaatagttgttgaaagatgcgggcgacgtaatatgaaacgcgtttggttggaagcgggcggtaaaagcgttaataacgtattcgttgattgatcggatttgtaataggcggtaagcgttatcgaataggtattttttataattagggataggtgtgtatcgtcggaacgcgtttttgttggacgagagtatcgtcgatgaatttttatttttgtaaattaaagggtaaatttgtagcgtgtattattgattcggtatatatgggttttattagggtaagcgatcgg

SEQ ID NO: 7322 - DNA, 736 bp, Artificial Sequence
  chemically treated genomic DNA (Homo sapiens) CpG-island No: 7322
ccgatcgcttaccctaataaaacccatatataccgaatcaataatacacgctacaaatttaccctttaatttacaaaaataaaaattcatcgacgatactctcgtccaacaaaaacgcgttccgacgatacacacctatccctaattataaaaaatacctattcgataacgcttaccgcctattacaaatccgatcaatcaacgaatacgttattaacgcttttaccgcccgcttccaaccaaacgcgtttcatattacgtcgcccgcatctttcaacaactatttcccgatacgaattaaaccgataaaacaataacgtcgatatcgttataacgcgacaacgcctacccgacttctaacctaaacccgtcaccacgttcaacacaccatccgacaaacctactttttcgccaaccccgcgaaacgaatcgcactaaacgataatttttcaaacgttttaaaatcacgctatttcccgccgccaacgccgaaccgaatttccacaaatcaacaacaacgaaaaattccacgacacgataacgacaatcacgcgaccgattcacgcacgatcatcgccaactcataactactaataatcgcccttcgccatacactttatcgatcgcttcgacgtaccaacgaataacgcgaccgcgccgaaaatatacatcacgcaaactataacgaatcgatttaccgtatcgaaaatttccaacaataccaactcttcgacgt

SEQ ID NO: 7323 - DNA, 736 bp, Artificial Sequence
  chemically treated genomic DNA (Homo sapiens) CpG-island No: 7323
tcgatcgtttgttttgataaggtttatgtgtgtcggattaatgatgtacgttgtaagtttgttttttgatttataagggtaagaatttatcggcgatgttttcgtttagtaaaggcgcgtttcggcgatgtatatttgtttttggttgtagaaaatgtttgttcggtggcgtttgtcgtttgttgtaaattcggttagttagcgaatacgttgttggcgtttttgtcgttcgtttttagttagacgcgttttatgttgcgtcgttcgtattttttagtagttgtttttcggtacgggttgaatcggtaaggtaatggcgtcgatatcgttatgacgcgatagcgtttgttcggtttttgatttaaattcgttattacgtttaatatattattcggtaagtttgttttttcgttagtttcgcgagacgaatcgtattgagcggtgattttttagacgttttagaattacgttgtttttcgtcgttagcgtcgggtcgagtttttataagttagtaatagcgggaagttttacggtacgatggcggtaattacgcgatcggtttacgtacgattatcgttagtttatggttattggtggtcgtttttcgttatatattttgtcgatcgtttcggcgtattagcgaatggcgcggtcgcgtcgggaatatgtattacgtagattgtgacgaatcggtttgtcgtgtcgagagtttttagtagtgttagtttttcggcgt

SEQ ID NO: 7324 - DNA, 736 bp, Artificial Sequence
  chemically treated genomic DNA (Homo sapiens) CpG-island No: 7324
acgccgaaaaactaacactactaaaaactctcgacacgacaaaccgattcgtcacaatctacgtaatacatattcccgacgcgaccgcgccattcgctaatacgccgaaacgatcgacaaaatatataacgaaaaacgaccaccaataaccataaactaacgataatcgtacgtaaaccgatcgcgtaattaccgccatcgtaccgtaaaacttcccgctattactaacttataaaaactcgacccgacgctaacgacgaaaaacaacgtaattctaaaacgtctaaaaaatcaccgctcaatacgattcgtctcgcgaaactaacgaaaaaacaaacttaccgaataatatattaaacgtaataacgaatttaaatcaaaaaccgaacaaacgctatcgcgtcataacgatatcgacgccattaccttaccgattcaacccgtaccgaaaaacaactactaaaaaatacgaacgacgcaacataaaacgcgtctaactaaaaacgaacgacaaaaacgccaacaacgtattcgctaactaaccgaatttacaacaaacgacaaacgccaccgaacaaacattttctacaaccaaaaacaaatatacatcgccgaaacgcgcctttactaaacgaaaacatcgccgataaattcttacccttataaatcaaaaaacaaacttacaacgtacatcattaatccgacacacataaaccttatcaaaacaaacgatcga

SEQ ID NO: 7325 - DNA, 532 bp, Artificial Sequence
  chemically treated genomic DNA (Homo sapiens) CpG-island No: 7325
cgtcgacgtagtttagttcgttggtttatgttttattagttttatcggtaggttaataatgcgttttgatagtcgttcgtatttatgattttattcgttagtataaagaacggaatcgtagtagggagaagttatcggtttcgtttattagcgtttgtgttatgatttgatatttaatatgttagttagaatagttacgtcgtttcgtataataatatgttatggttatagggaatcgattggatattattaaagaaaggtcgaaattttgtcggtttatttagtttttggcgggcgcgtttttaatttttcgttaggtggttaaaggcgcgcgtcgaagtgtttacgttggtggtatacgggttcgcgcggtatcggtttttgtttttttttttttttttttgtgtttcgaggcgttaatgttggggtgtcgtcgttttcggggggttttaggtgcggtttaaagacgaaggaatcgggatttgggagagttttttagagatttataatggttattaggatttataagtga

SEQ ID NO: 7326 - DNA, 532 bp, Artificial Sequence
  chemically treated genomic DNA (Homo sapiens) CpG-island No: 7326
tcacttataaatcctaataaccattataaatctctaaaaaactctcccaaatcccgattccttcgtctttaaaccgcacctaaaaccccccgaaaacgacgacaccccaacattaacgcctcgaaacacaaaaaaaaaaaaaaaaaaacaaaaaccgataccgcgcgaacccgtataccaccaacgtaaacacttcgacgcgcgcctttaaccacctaacgaaaaattaaaaacgcgcccgccaaaaactaaataaaccgacaaaatttcgacctttctttaataatatccaatcgattccctataaccataacatattattatacgaaacgacgtaactattctaactaacatattaaatatcaaatcataacacaaacgctaataaacgaaaccgataacttctccctactacgattccgttctttatactaacgaataaaatcataaatacgaacgactatcaaaacgcattattaacctaccgataaaactaataaaacataaaccaacgaactaaactacgtcgacg

SEQ ID NO: 7327 - DNA, 532 bp, Artificial Sequence
  chemically treated genomic DNA (Homo sapiens) CpG-island No: 7327
ttatttgtggattttgatagttattgtgggtttttagaagatttttttaaatttcggttttttcgtttttgaatcgtatttgggatttttcggagacggcggtattttaatattggcgtttcgggatataaaaaagaggggagaaaaataaaagtcggtatcgcgcgaattcgtgtgttattagcgtggatatttcgacgcgcgtttttagttatttggcggaaaattagaaacgcgttcgttaggggttaaataggtcggtagaatttcggtttttttttggtggtatttaatcggttttttatggttatggtatgttgttgtgcggggcggcgtaattgttttggttgatatgttgaatgttagattatggtataaacgttggtgaacggagtcgatagtttttttttgttgcgatttcgttttttgtgttggcgggtgaaattatgaatgcgggcggttgttaaaacgtattgttgatttgtcgatgaaattggtggggtataaattagcgggttgggttacgtcggcg

SEQ ID NO: 7328 - DNA, 532 bp, Artificial Sequence
  chemically treated genomic DNA (Homo sapiens) CpG-island No: 7328
cgccgacgtaacccaacccgctaatttataccccaccaatttcatcgacaaatcaacaatacgttttaacaaccgcccgcattcataatttcacccgccaacacaaaaaacgaaatcgcaacaaaaaaaaactatcgactccgttcaccaacgtttataccataatctaacattcaacatatcaaccaaaacaattacgccgccccgcacaacaacataccataaccataaaaaaccgattaaataccaccaaaaaaaaaccgaaattctaccgacctatttaacccctaacgaacgcgtttctaattttccgccaaataactaaaaacgcgcgtcgaaatatccacgctaataacacacgaattcgcgcgataccgacttttatttttctcccctcttttttatatcccgaaacgccaatattaaaataccgccgtctccgaaaaatcccaaatacgattcaaaaacgaaaaaaccgaaatttaaaaaaatcttctaaaaacccacaataactatcaaaatccacaaataa

SEQ ID NO: 7329 - DNA, 591 bp, Artificial Sequence
  chemically treated genomic DNA (Homo sapiens) CpG-island No: 7329
atggagcggattatgaataggtgttgaagaatatcgatacgcgtatttataacgatatgcgcggaattcggcgtttttgtttgtcgttatgttttggtatttattgttggagcggtatagaagatcgtttaggaaagcggtttgatttattacgacgttttgcgttggcgatgaacgacgtgttggacgaagtttgtcgtttattggtaattcgaaacgtttgacgatattaattcgcgatatttggtagttgtagttggtatgtttcgtcgttagggtaaacgcgtatggaaattgttggagtatttaagtttcgtgcggtttatgatttgttggttttgcgagttgaagttgagttaacgttgaattgtagcgtttggtgaaatggtggggtgagttttaggtttcgcgttattagattaaaaagggatgtttaacgagttggatgaagaattttatcgcgtcgtcgtattcgtcgtttacgtaaacgcgtattacgtcgtggggtatcgtatgatagtggcgtatattgttataggtagtaatttggtttttcgttggagtaggtttatgttggtttgaaagtattag

SEQ ID NO: 7330 - DNA, 591 bp, Artificial Sequence
  chemically treated genomic DNA (Homo sapiens) CpG-island No: 7330
ctaatactttcaaaccaacataaacctactccaacgaaaaaccaaattactacctataacaatatacgccactatcatacgataccccacgacgtaatacgcgtttacgtaaacgacgaatacgacgacgcgataaaattcttcatccaactcgttaaacatccctttttaatctaataacgcgaaacctaaaactcaccccaccatttcaccaaacgctacaattcaacgttaactcaacttcaactcgcaaaaccaacaaatcataaaccgcacgaaacttaaatactccaacaatttccatacgcgtttaccctaacgacgaaacataccaactacaactaccaaatatcgcgaattaatatcgtcaaacgtttcgaattaccaataaacgacaaacttcgtccaacacgtcgttcatcgccaacgcaaaacgtcgtaataaatcaaaccgctttcctaaacgatcttctataccgctccaacaataaataccaaaacataacgacaaacaaaaacgccgaattccgcgcatatcgttataaatacgcgtatcgatattcttcaacacctattcataatccgctccat

SEQ ID NO: 7331 - DNA, 591 bp, Artificial Sequence
  chemically treated genomic DNA (Homo sapiens) CpG-island No: 7331
ttaatgtttttaggttagtatggatttgttttagcggaaggttagattgttgtttatggtaatatacgttattgttatgcggtattttacgacgtggtgcgcgtttgcgtggacgacgagtacgacgacgcggtgaggttttttatttagttcgttgagtatttttttttggtttggtggcgcggaatttggaatttattttattattttattagacgttgtagtttagcgttagtttaattttagttcgtaaggttaataggttataagtcgtacggaatttggatgttttagtagtttttatgcgcgtttattttgacgacgggatatattaattgtaattgttagatatcgcgggttaatgtcgttagacgtttcgggttgttagtgaacggtaggtttcgtttagtacgtcgtttatcgttagcgtaaagcgtcgtgataggttaggtcgtttttttgggcgattttttgtgtcgttttagtagtgggtattagaatatggcggtaaataggaacgtcgggtttcgcgtatatcgttatggatacgcgtatcggtattttttagtatttgtttatgattcgttttat

SEQ ID NO: 7332 - DNA, 591 bp, Artificial Sequence
  chemically treated genomic DNA (Homo sapiens) CpG-island No: 7332
ataaaacgaatcataaacaaatactaaaaaataccgatacgcgtatccataacgatatacgcgaaacccgacgttcctatttaccgccatattctaatacccactactaaaacgacacaaaaaatcgcccaaaaaaacgacctaacctatcacgacgctttacgctaacgataaacgacgtactaaacgaaacctaccgttcactaacaacccgaaacgtctaacgacattaacccgcgatatctaacaattacaattaatatatcccgtcgtcaaaataaacgcgcataaaaactactaaaacatccaaattccgtacgacttataacctattaaccttacgaactaaaattaaactaacgctaaactacaacgtctaataaaataataaaataaattccaaattccgcgccaccaaaccaaaaaaaaatactcaacgaactaaataaaaaacctcaccgcgtcgtcgtactcgtcgtccacgcaaacgcgcaccacgtcgtaaaataccgcataacaataacgtatattaccataaacaacaatctaaccttccgctaaaacaaatccatactaacctaaaaacattaa

SEQ ID NO: 7333 - DNA, 681 bp, Artificial Sequence
  chemically treated genomic DNA (Homo sapiens) CpG-island No: 7333
ttagaatttggcgggtggtgcggaaatacgttggtttttgtgttcgattgtatcgttacgtcgatgggtagtcgttgttgaaacgttggttgtatatgttagtgcgcgatattcgcgtgttgttgagcgttagtaaattattggcgtattgtaggattttatcgtcgggttacgtcggtattgcgttaggtcggcgatttggaacgtattttggtacgtttgttttacgaattgttcgtttacgcgatttggttcgtatgcgttacgtttttagtaattgtcggagttgcgtgcgtagttagaaattgtcgatagtgtacggtataggcgttacgtgagaagatgggcgagtttgtcgagttgcgcgattgttggagcgagtaattatcgatatatcgtcggtgttggtacgcgacggggtgttatcgtatcgggttataacgaagagttggatgagtggcgcgcgcggttgacggcgcgatcgattatttggagcgtttggaagttcgcgagcgtaacgtatcggtttggatacgttgaaagttggttttaatgcggtgtacggtattatatttaaattagtcgtgggtaaagttatttggtatttattaatttatgcgtcgttagacgttgaaaaacgtcgagcgttatattattttagagttaagagtttaaaataag

SEQ ID NO: 7334 - DNA, 681 bp, Artificial Sequence
  chemically treated genomic DNA (Homo sapiens) CpG-island No: 7334
cttattttaaactcttaactctaaaataatataacgctcgacgtttttcaacgtctaacgacgcataaattaataaataccaaataactttacccacgactaatttaaatataataccgtacaccgcattaaaaccaactttcaacgtatccaaaccgatacgttacgctcgcgaacttccaaacgctccaaataatcgatcgcgccgtcaaccgcgcgcgccactcatccaactcttcgttataacccgatacgataacaccccgtcgcgtaccaacaccgacgatatatcgataattactcgctccaacaatcgcgcaactcgacaaactcgcccatcttctcacgtaacgcctataccgtacactatcgacaatttctaactacgcacgcaactccgacaattactaaaaacgtaacgcatacgaaccaaatcgcgtaaacgaacaattcgtaaaacaaacgtaccaaaatacgttccaaatcgccgacctaacgcaataccgacgtaacccgacgataaaatcctacaatacgccaataatttactaacgctcaacaacacgcgaatatcgcgcactaacatatacaaccaacgtttcaacaacgactacccatcgacgtaacgatacaatcgaacacaaaaaccaacgtatttccgcaccacccgccaaattctaa

SEQ ID NO: 7335 - DNA, 681 bp, Artificial Sequence
  chemically treated genomic DNA (Homo sapiens) CpG-island No: 7335
tttattttggatttttaattttggaatgatgtagcgttcggcgttttttagcgtttggcgacgtatgagttgatgggtgttagatggttttgtttacggttgatttgaatgtagtatcgtgtatcgtattaaagttaatttttagcgtgtttaggtcggtacgttacgttcgcggatttttagacgttttagataatcggtcgcgtcgttagtcgcgcgcgttatttatttagtttttcgttatagttcgatgcgataatatttcgtcgcgtattagtatcggcggtgtgtcgatgattgttcgttttagtaatcgcgtagttcggtaaattcgtttatttttttacgtagcgtttgtatcgtgtattatcgatagtttttaattgcgtacgtagtttcggtagttgttgaaagcgtggcgtatacgggttagatcgcgtgggcgagtagttcgtaaagtagacgtgttagaatacgttttaggtcgtcgatttgacgtagtatcggcgtagttcggcggtgaaattttgtaatgcgttaatagtttgttggcgtttagtaatacgcgggtatcgcgtattggtatatgtagttagcgttttagtaacggttgtttatcggcgtgacggtgtagtcgagtatagaagttagcgtattttcgtattattcgttaggttttgg

SEQ ID NO: 7336 - DNA, 681 bp, Artificial Sequence
  chemically treated genomic DNA (Homo sapiens) CpG-island No: 7336
ccaaaacctaacgaataatacgaaaatacgctaacttctatactcgactacaccgtcacgccgataaacaaccgttactaaaacgctaactacatataccaatacgcgatacccgcgtattactaaacgccaacaaactattaacgcattacaaaatttcaccgccgaactacgccgatactacgtcaaatcgacgacctaaaacgtattctaacacgtctactttacgaactactcgcccacgcgatctaacccgtatacgccacgctttcaacaactaccgaaactacgtacgcaattaaaaactatcgataatacacgatacaaacgctacgtaaaaaaataaacgaatttaccgaactacgcgattactaaaacgaacaatcatcgacacaccgccgatactaatacgcgacgaaatattatcgcatcgaactataacgaaaaactaaataaataacgcgcgcgactaacgacgcgaccgattatctaaaacgtctaaaaatccgcgaacgtaacgtaccgacctaaacacgctaaaaattaactttaatacgatacacgatactacattcaaatcaaccgtaaacaaaaccatctaacacccatcaactcatacgtcgccaaacgctaaaaaacgccgaacgctacatcattccaaaattaaaaatccaaaataaa

SEQ ID NO: 7337 - DNA, 648 bp, Artificial Sequence
  chemically treated genomic DNA (Homo sapiens) CpG-island No: 7337
ttcggtttcggattttagatttaaaagcgttttacgcgtttcgttttaggtttatcgttcgatttcgttagatagcgtttggacgggatcgggaaacggcggtcgttatagttgtttaggttttgggatttacgtttagagacgatagcgttggcgattattagaaggtttgcgggttttcgagaaaggaaaattcgtttatagtttagcggttgatattttttagttagtcgtagcgtcgttcgttttcgttttttcgtttatttcgtgggtcgattagtttcgttttcgcggggggttgtgggtatttcgaaggcgggtaaagttgtaagggaaggaagtaagggcgagttcgtcggattacgaagcgggacggaaattataatttttagtaggttttgggttttagtgcggtcgcgaagtagagcgggttgtagagttttgcgcgcgtagtggggatggaacgttgttaggtttagcgggtttggttgttgggggttcgagtagtacgttcggagtcgtcgcgcgttaaagcgggaatttgggaggcgagtagttttgtagttaatgtacgtattttaaattttcgggtttgcggacgttatgtataggtaaacggattgtaaaaaggggaagagtatgaaatgg

SEQ ID NO: 7338 - DNA, 648 bp, Artificial Sequence
  chemically treated genomic DNA (Homo sapiens) CpG-island No: 7338
ccatttcatactcttcccctttttacaatccgtttacctatacataacgtccgcaaacccgaaaatttaaaatacgtacattaactacaaaactactcgcctcccaaattcccgctttaacgcgcgacgactccgaacgtactactcgaacccccaacaaccaaacccgctaaacctaacaacgttccatccccactacgcgcgcaaaactctacaacccgctctacttcgcgaccgcactaaaacccaaaacctactaaaaattataatttccgtcccgcttcgtaatccgacgaactcgcccttacttccttcccttacaactttacccgccttcgaaatacccacaaccccccgcgaaaacgaaactaatcgacccacgaaataaacgaaaaaacgaaaacgaacgacgctacgactaactaaaaaatatcaaccgctaaactataaacgaattttcctttctcgaaaacccgcaaaccttctaataatcgccaacgctatcgtctctaaacgtaaatcccaaaacctaaacaactataacgaccgccgtttcccgatcccgtccaaacgctatctaacgaaatcgaacgataaacctaaaacgaaacgcgtaaaacgcttttaaatctaaaatccgaaaccgaa

SEQ ID NO: 7339 - DNA, 648 bp, Artificial Sequence
  chemically treated genomic DNA (Homo sapiens) CpG-island No: 7339
ttattttatgttttttttttttttgtaattcgtttatttgtgtatagcgttcgtaggttcgggagtttaaaatacgtgtattaattgtagagttgttcgttttttagattttcgttttggcgcgcggcggtttcgagcgtgttgttcgggtttttagtagttagattcgttaagtttagtaacgttttatttttattgcgcgcgtaaggttttatagttcgttttgtttcgcggtcgtattgaggtttaaggtttgttgggaattgtagttttcgtttcgtttcgtagttcgacgggttcgtttttattttttttttttgtagttttattcgttttcgagatatttataatttttcgcgggagcgggattggtcggtttacggggtaggcggggaggcggaagcgggcggcgttacggttgattgggaaatgttagtcgttggattgtagacggatttttttttttcgggagttcgtaggttttttggtgatcgttagcgttgtcgtttttgagcgtggattttagaatttggatagttgtggcggtcgtcgtttttcggtttcgtttagacgttgtttggcgagatcggacggtgagtttaaggcggaacgcgtgaggcgtttttgagtttggggttcggggtcgag

SEQ ID NO: 7340 - DNA, 648 bp, Artificial Sequence
  chemically treated genomic DNA (Homo sapiens) CpG-island No: 7340
ctcgaccccgaaccccaaactcaaaaacgcctcacgcgttccgccttaaactcaccgtccgatctcgccaaacaacgtctaaacgaaaccgaaaaacgacgaccgccacaactatccaaattctaaaatccacgctcaaaaacgacaacgctaacgatcaccaaaaaacctacgaactcccgaaaaaaaaaaatccgtctacaatccaacgactaacatttcccaatcaaccgtaacgccgcccgcttccgcctccccgcctaccccgtaaaccgaccaatcccgctcccgcgaaaaattataaatatctcgaaaacgaataaaactacaaaaaaaaaaaataaaaacgaacccgtcgaactacgaaacgaaacgaaaactacaattcccaacaaaccttaaacctcaatacgaccgcgaaacaaaacgaactataaaaccttacgcgcgcaataaaaataaaacgttactaaacttaacgaatctaactactaaaaacccgaacaacacgctcgaaaccgccgcgcgccaaaacgaaaatctaaaaaacgaacaactctacaattaatacacgtattttaaactcccgaacctacgaacgctatacacaaataaacgaattacaaaaaaaaaaaaaacataaaataa

SEQ ID NO: 7341 - DNA, 651 bp, Artificial Sequence
  chemically treated genomic DNA (Homo sapiens) CpG-island No: 7341
  misc_feature (636)..(636): n is either a, c, g or t
tttgattaatatttcggtggggattatcggtgcgatcgttatattgttgttaatgtcgaattatattatgtagacgcggcgttttgattttttcggatttttattgttggcggttggtatggcggtattaattttggcgttggacggtagtaaaggtataggtttatcgtcgttgacgattgtaggtttggtcgtagttggcgtggtggtattggtgttttatttgttgtacgttagaaataataatcgtgttttgtttagtttgaaattgtttcgtattcgtattttttcgttgggtttggcggggagttttgtcggacgtattggtagtggtatgttgttttttatgatatcggtttttttgtaaattggtttcggtttttcgtcgttttatgtcggattgatgatgatttcgatggtgtttggtagtatgggaatgaagcgaattgtggtataggtggtgaatcgttttggttatcgtcgggtattggtagcgattacgttgggtttgtcgttggttattttgttgtttatgattatcgttttgttgggttggtattacgttttgtcgttcgttttgtttttataagggatggttaattcgacgcgttttttttttatgaatattttgacgtntaaagatttttcgga

SEQ ID NO: 7342 - DNA, 651 bp, Artificial Sequence
  chemically treated genomic DNA (Homo sapiens) CpG-island No: 7342
  misc_feature (16)..(16): n is either a, c, g or t
tccgaaaaatctttanacgtcaaaatattcataaaaaaaaaacgcgtcgaattaaccatcccttataaaaacaaaacgaacgacaaaacgtaataccaacccaacaaaacgataatcataaacaacaaaataaccaacgacaaacccaacgtaatcgctaccaatacccgacgataaccaaaacgattcaccacctataccacaattcgcttcattcccatactaccaaacaccatcgaaatcatcatcaatccgacataaaacgacgaaaaaccgaaaccaatttacaaaaaaaccgatatcataaaaaacaacataccactaccaatacgtccgacaaaactccccgccaaacccaacgaaaaaatacgaatacgaaacaatttcaaactaaacaaaacacgattattatttctaacgtacaacaaataaaacaccaataccaccacgccaactacgaccaaacctacaatcgtcaacgacgataaacctatacctttactaccgtccaacgccaaaattaataccgccataccaaccgccaacaataaaaatccgaaaaaatcaaaacgccgcgtctacataatataattcgacattaacaacaatataacgatcgcaccgataatccccaccgaaatattaatcaaa

SEQ ID NO: 7343 - DNA, 651 bp, Artificial Sequence
  chemically treated genomic DNA (Homo sapiens) CpG-island No: 7343
  misc_feature (16)..(16): n is either a, c, g or t
ttcgggagatttttangcgttagggtgtttatggaggagaaacgcgtcgagttgattattttttgtaaaaataggacgaacggtaaaacgtagtattagtttagtagggcggtagttataaataatagggtgattagcgatagatttagcgtggtcgttattagtattcgacgataattaaagcgatttattatttgtattataattcgttttatttttatgttgttaagtattatcgggattattattagttcggtatgaaacggcgagaaatcgaggttaatttgtaggaaaatcggtgttataaagggtaatatgttattgttaatacgttcggtaaagtttttcgttaggtttagcgaaaaggtacgagtacggaatagttttagattgaatagggtacggttgttatttttggcgtgtagtagataaagtattagtgttattacgttaattgcgattaggtttgtaatcgttagcggcgataaatttgtatttttattgtcgtttagcgttagggttaatatcgttatgttaatcgttagtaataaaaattcggagagattaaagcgtcgcgtttgtatggtgtagttcggtattaatagtaatgtggcgatcgtatcgataatttttatcggaatgttgattaaa

SEQ ID NO: 7344 - DNA, 651 bp, Artificial Sequence
  chemically treated genomic DNA (Homo sapiens) CpG-island No: 7344
  misc_feature (636)..(636): n is either a, c, g or t
tttaatcaacattccgataaaaattatcgatacgatcgccacattactattaataccgaactacaccatacaaacgcgacgctttaatctctccgaatttttattactaacgattaacataacgatattaaccctaacgctaaacgacaataaaaatacaaatttatcgccgctaacgattacaaacctaatcgcaattaacgtaataacactaatactttatctactacacgccaaaaataacaaccgtaccctattcaatctaaaactattccgtactcgtaccttttcgctaaacctaacgaaaaactttaccgaacgtattaacaataacatattaccctttataacaccgattttcctacaaattaacctcgatttctcgccgtttcataccgaactaataataatcccgataatacttaacaacataaaaataaaacgaattataatacaaataataaatcgctttaattatcgtcgaatactaataacgaccacgctaaatctatcgctaatcaccctattatttataactaccgccctactaaactaatactacgttttaccgttcgtcctatttttacaaaaaataatcaactcgacgcgtttctcctccataaacaccctaacgcntaaaaatctcccgaa

SEQ ID NO: 7345 - DNA, 622 bp, Artificial Sequence
  chemically treated genomic DNA (Homo sapiens) CpG-island No: 7345
ttacgaatagtcgggacgcgcgggtcggggggatgcgtcgggggttggagggcggagagtatttttcgtaggtttcggttagagttcggggtcgggttatttgattcgcggaatttggggtcgcgcggggtggaatgggaggggaatggttagcgttttttttttcgtttttattggatttaggtcggcgggggtcggcgttcggcggttacgtggtggtgttgtcgttgttttcgtttcgtcggtttagttcgggagttcggcgtttattgattttcgtagcgggggaggaggagggattgcggcgtaggaagtcgagtaggaagcgagttcggcggtcgcgtttttttggggaagcggcgggcggggtggagtagttagttgggttcggggagcgtcgtcgtcgtttcgatggggtgagtgcgcggtacggagtttgggaggttttcggcgcggggtttcgggttcgtgttttcgtttttgtgtttggacgttcgggcgcgggaggcgttggggacggcgttcgggcggagcggttgagcgggttgtagtcggggtttcgttatttttttttggtttatcgtcggtagtttattgttttgcggagagtagatttggggat

SEQ ID NO: 7346 - DNA, 622 bp, Artificial Sequence
  chemically treated genomic DNA (Homo sapiens) CpG-island No: 7346
atccccaaatctactctccgcaaaacaataaactaccgacgataaaccaaaaaaaaataacgaaaccccgactacaacccgctcaaccgctccgcccgaacgccgtccccaacgcctcccgcgcccgaacgtccaaacacaaaaacgaaaacacgaacccgaaaccccgcgccgaaaacctcccaaactccgtaccgcgcactcaccccatcgaaacgacgacgacgctccccgaacccaactaactactccaccccgcccgccgcttccccaaaaaaacgcgaccgccgaactcgcttcctactcgacttcctacgccgcaatccctcctcctcccccgctacgaaaatcaataaacgccgaactcccgaactaaaccgacgaaacgaaaacaacgacaacaccaccacgtaaccgccgaacgccgacccccgccgacctaaatccaataaaaacgaaaaaaaaaacgctaaccattcccctcccattccaccccgcgcgaccccaaattccgcgaatcaaataacccgaccccgaactctaaccgaaacctacgaaaaatactctccgccctccaacccccgacgcatccccccgacccgcgcgtcccgactattcgtaa

SEQ ID NO: 7347 - DNA, 622 bp, Artificial Sequence
  chemically treated genomic DNA (Homo sapiens) CpG-island No: 7347
gtttttagatttgtttttcgtagagtagtgggttgtcggcggtggattagggagaggtggcgggatttcggttgtagttcgtttagtcgtttcgttcgggcgtcgtttttagcgtttttcgcgttcgagcgtttagatataaaggcggggatacgagttcgggatttcgcgtcgggagttttttaagtttcgtgtcgcgtatttattttatcgaggcggcggcggcgtttttcggatttagttggttgttttatttcgttcgtcgtttttttaggaaaacgcggtcgtcgggttcgttttttgttcggttttttgcgtcgtagtttttttttttttttcgttgcgggggttagtgggcgtcgagttttcgggttaggtcggcggggcgggggtagcggtagtattattacgtggtcgtcgggcgtcggttttcgtcgatttggatttagtgggagcgggaagggaggcgttaattattttttttttattttatttcgcgcggttttaaatttcgcgagttaggtgattcggtttcgggttttggtcgggatttgcggggggtgtttttcgttttttagttttcggcgtattttttcggttcgcgcgtttcggttgttcgtgg

SEQ ID NO: 7348 - DNA, 622 bp, Artificial Sequence
  chemically treated genomic DNA (Homo sapiens) CpG-island No: 7348
ccacgaacaaccgaaacgcgcgaaccgaaaaaatacgccgaaaactaaaaaacgaaaaacaccccccgcaaatcccgaccaaaacccgaaaccgaatcacctaactcgcgaaatttaaaaccgcgcgaaataaaataaaaaaaaaataattaacgcctcccttcccgctcccactaaatccaaatcgacgaaaaccgacgcccgacgaccacgtaataatactaccgctacccccgccccgccgacctaacccgaaaactcgacgcccactaacccccgcaacgaaaaaaaaaaaaaaactacgacgcaaaaaaccgaacaaaaaacgaacccgacgaccgcgttttcctaaaaaaacgacgaacgaaataaaacaaccaactaaatccgaaaaacgccgccgccgcctcgataaaataaatacgcgacacgaaacttaaaaaactcccgacgcgaaatcccgaactcgtatccccgcctttatatctaaacgctcgaacgcgaaaaacgctaaaaacgacgcccgaacgaaacgactaaacgaactacaaccgaaatcccgccacctctccctaatccaccgccgacaacccactactctacgaaaaacaaatctaaaaac

SEQ ID NO: 7349 - DNA, 993 bp, Artificial Sequence
  chemically treated genomic DNA (Homo sapiens) CpG-island No: 7349
gttgcgtgcgagatttagaggtttcggttagcgcgtcggtcgtagggagtgcgagtatttgtgagtttcgcgtcgggtcggtgaagtttggtgttgtcgagttcgtttagaaagtacggtcgcgcgttgtcggacgtaggtttataggtttagtcgatttaggtagtaatttttttagtttcgtcgtcgttgttaaggcgatcgtcgtcgaacgttttcgcggcgggtttcgtttttcggttaatcggatcggcgttcggtgaagtttagattttttttgtttcgtagttattttaggtttcggataggaggtagtgtcgtttcggtcgaaggttcgagcgttcgaggcgtttgggatggtgtgggatcgggtaggtggcgtgagggtgcgcggtttcgaattgtaggggcgggaacggaggttgggagcgtcgagttgtttgacgcgtttacgggagagacgtcgggttcgttcgttttttcggcgtttgttcggtcgtttgaagtcgagaggtagcggcggcgcggttttaattttaatagttgttcgtttaggcgttttgcgggattcgggtagggagtaggcgacggcggttttttaagcgttcgaggatttcgttaggggcggtaggagttcgttataaggggcgggaagggaagggttttatatttaggggagcgtttgtttcgtttgttaagttgtggcgtttgagggtttttgagtgttgtagtcggttgtttcgggacggttgttttttattggttttgggcgttggtcggcgttgttcgagatgggttagtttttgtttcgtttttgggtttttttgttcgggttttttgcgttcgtatatagtgtttatcgtttttatatgtagtttgtcgttttttttttttcggcggttttttttttttggggttttttggttttacgatatgtttatataatgtttgtgattgtacgagttttgcgtgggtttgtgggttttgtttttt

SEQ ID NO: 7350 - DNA, 993 bp, Artificial Sequence
  chemically treated genomic DNA (Homo sapiens) CpG-island No: 7350
aaaaaacaaaacccacaaacccacgcaaaactcgtacaatcacaaacattatataaacatatcgtaaaaccaaaaaaccccaaaaaaaaaaaaccgccgaaaaaaaaaaaacgacaaactacatataaaaacgataaacactatatacgaacgcaaaaaacccgaacaaaaaaacccaaaaacgaaacaaaaactaacccatctcgaacaacgccgaccaacgcccaaaaccaataaaaaacaaccgtcccgaaacaaccgactacaacactcaaaaaccctcaaacgccacaacttaacaaacgaaacaaacgctcccctaaatataaaacccttcccttcccgccccttataacgaactcctaccgcccctaacgaaatcctcgaacgcttaaaaaaccgccgtcgcctactccctacccgaatcccgcaaaacgcctaaacgaacaactattaaaattaaaaccgcgccgccgctacctctcgacttcaaacgaccgaacaaacgccgaaaaaacgaacgaacccgacgtctctcccgtaaacgcgtcaaacaactcgacgctcccaacctccgttcccgcccctacaattcgaaaccgcgcaccctcacgccacctacccgatcccacaccatcccaaacgcctcgaacgctcgaaccttcgaccgaaacgacactacctcctatccgaaacctaaaataactacgaaacaaaaaaaatctaaacttcaccgaacgccgatccgattaaccgaaaaacgaaacccgccgcgaaaacgttcgacgacgatcgccttaacaacgacgacgaaactaaaaaaattactacctaaatcgactaaacctataaacctacgtccgacaacgcgcgaccgtactttctaaacgaactcgacaacaccaaacttcaccgacccgacgcgaaactcacaaatactcgcactccctacgaccgacgcgctaaccgaaacctctaaatctcgcacgcaac

SEQ ID NO: 7351 - DNA, 993 bp, Artificial Sequence
  chemically treated genomic DNA (Homo sapiens) CpG-island No: 7351
gaagggtaaaatttataagtttacgtaaaattcgtatagttataaatattatgtaaatatgtcgtgaggttaagaggttttaaggagaaagaatcgtcgggaggaagagaacggtaagttgtatgtaaggacgatgggtattgtgtgcggacgtaggagattcgggtagaggggtttaggggcgggataaagattggtttatttcgggtagcgtcggttagcgtttagaattagtgaaaggtagtcgtttcggggtagtcgattgtagtatttaagggtttttaaacgttatagtttaataggcgaggtaaacgtttttttgaatgtaagattttttttttttcgttttttgtaacgggtttttgtcgtttttaacgggattttcggacgtttgaggagtcgtcgtcgtttgttttttattcgggtttcgtagggcgtttgggcgggtagttgttggggttagaatcgcgtcgtcgttgtttttcggttttaaacggtcgggtaggcgtcgagagagcgggcgagttcggcgtttttttcgtaggcgcgttaggtagttcggcgtttttagttttcgttttcgtttttgtagttcggggtcgcgtatttttacgttatttattcggttttatattattttagacgtttcgggcgttcgggttttcggtcgaagcggtattgttttttgttcggggtttgaaatggttgcggaataaagagaatttgggttttatcgagcgtcggttcgattggtcggggggcggagttcgtcgcgggaacgttcggcggcggtcgttttggtaacggcggcggggttaggaaaattgttgtttgggtcggttgggtttgtgggtttgcgttcgatagcgcgcggtcgtgttttttaagcgggttcggtagtattagattttatcggttcggcgcggggtttataagtgttcgtattttttgcggtcggcgcgttgatcggagtttttgggtttcgtacgtagt

SEQ ID NO: 7352 - DNA, 993 bp, Artificial Sequence
  chemically treated genomic DNA (Homo sapiens) CpG-island No: 7352
actacgtacgaaacccaaaaactccgatcaacgcgccgaccgcaaaaaatacgaacacttataaaccccgcgccgaaccgataaaatctaatactaccgaacccgcttaaaaaacacgaccgcgcgctatcgaacgcaaacccacaaacccaaccgacccaaacaacaattttcctaaccccgccgccgttaccaaaacgaccgccgccgaacgttcccgcgacgaactccgccccccgaccaatcgaaccgacgctcgataaaacccaaattctctttattccgcaaccatttcaaaccccgaacaaaaaacaataccgcttcgaccgaaaacccgaacgcccgaaacgtctaaaataatataaaaccgaataaataacgtaaaaatacgcgaccccgaactacaaaaacgaaaacgaaaactaaaaacgccgaactacctaacgcgcctacgaaaaaaacgccgaactcgcccgctctctcgacgcctacccgaccgtttaaaaccgaaaaacaacgacgacgcgattctaaccccaacaactacccgcccaaacgccctacgaaacccgaataaaaaacaaacgacgacgactcctcaaacgtccgaaaatcccgttaaaaacgacaaaaacccgttacaaaaaacgaaaaaaaaaaaatcttacattcaaaaaaacgtttacctcgcctattaaactataacgtttaaaaacccttaaatactacaatcgactaccccgaaacgactacctttcactaattctaaacgctaaccgacgctacccgaaataaaccaatctttatcccgcccctaaacccctctacccgaatctcctacgtccgcacacaatacccatcgtccttacatacaacttaccgttctcttcctcccgacgattctttctccttaaaacctcttaacctcacgacatatttacataatatttataactatacgaattttacgtaaacttataaattttacccttc

SEQ ID NO: 7353 - DNA, 513 bp, Artificial Sequence
  chemically treated genomic DNA (Homo sapiens) CpG-island No: 7353
gtttcgcgttgcggtttagttttcggcggtcgggggttttcgtcgttttcgtttttgttttttttttatttttcgagatcggttttttttttgggttcgggcgcgggggaagtcgtcgttgtttttgtcgggcgattcgcgtacgcggttttggtgtttgggtcgggggcgtcgtcgcgtggggtttacgtcgttaaggttatcggttttcggcgcgtaggaggcgggggttttcggtcgtcgttcgggatcgcgatatgtgcgcgggtcgggtcgttacgttttcgttcgtcgttgatttgtcgcgggggtagggagcgggcgggcgggagcggttcgggtttatataatgcgtttcgttgggtgggggtggtaggtcgagcgggaggtcgggtggagggcgttttgtgcgcggcggagttcgtcgtttgattggttagaaatgggtggagttggcgcggggtttgaattgtagttgtgtgggttttgggggtttttttacgtttttgtttt

SEQ ID NO: 7354 - DNA, 513 bp, Artificial Sequence
  chemically treated genomic DNA (Homo sapiens) CpG-island No: 7354
aaaacaaaaacgtaaaaaaacccccaaaacccacacaactacaattcaaaccccgcgccaactccacccatttctaaccaatcaaacgacgaactccgccgcgcacaaaacgccctccacccgacctcccgctcgacctaccacccccacccaacgaaacgcattatataaacccgaaccgctcccgcccgcccgctccctacccccgcgacaaatcaacgacgaacgaaaacgtaacgacccgacccgcgcacatatcgcgatcccgaacgacgaccgaaaacccccgcctcctacgcgccgaaaaccgataaccttaacgacgtaaaccccacgcgacgacgcccccgacccaaacaccaaaaccgcgtacgcgaatcgcccgacaaaaacaacgacgacttcccccgcgcccgaacccaaaaaaaaaaccgatctcgaaaaataaaaaaaaaacaaaaacgaaaacgacgaaaacccccgaccgccgaaaactaaaccgcaacgcgaaac

SEQ ID NO: 7355 - DNA, 513 bp, Artificial Sequence
  chemically treated genomic DNA (Homo sapiens) CpG-island No: 7355
agggtaaggacgtggaaaaatttttaagatttatatagttgtagtttaaatttcgcgttagttttatttatttttggttagttaggcggcgagtttcgtcgcgtatagagcgttttttattcggtttttcgttcggtttgttatttttatttagcggggcgtattgtgtgggttcgggtcgttttcgttcgttcgttttttattttcgcggtaggttagcggcgggcggggacgtggcggttcggttcgcgtatatgtcgcgatttcgggcggcggtcgggggttttcgttttttgcgcgtcggaagtcggtggttttggcggcgtgagttttacgcggcggcgttttcggtttaggtattagggtcgcgtgcgcgagtcgttcggtaggggtagcggcggtttttttcgcgttcggatttagggaggaggtcggtttcggaggatgggggaggggtagaggcggaggcgacgggagttttcggtcgtcgggggttgggtcgtagcgcggggt

SEQ ID NO: 7356 - DNA, 513 bp, Artificial Sequence
  chemically treated genomic DNA (Homo sapiens) CpG-island No: 7356
accccgcgctacgacccaacccccgacgaccgaaaactcccgtcgcctccgcctctacccctcccccatcctccgaaaccgacctcctccctaaatccgaacgcgaaaaaaaccgccgctacccctaccgaacgactcgcgcacgcgaccctaatacctaaaccgaaaacgccgccgcgtaaaactcacgccgccaaaaccaccgacttccgacgcgcaaaaaacgaaaacccccgaccgccgcccgaaatcgcgacatatacgcgaaccgaaccgccacgtccccgcccgccgctaacctaccgcgaaaataaaaaacgaacgaacgaaaacgacccgaacccacacaatacgccccgctaaataaaaataacaaaccgaacgaaaaaccgaataaaaaacgctctatacgcgacgaaactcgccgcctaactaaccaaaaataaataaaactaacgcgaaatttaaactacaactatataaatcttaaaaatttttccacgtccttaccct

SEQ ID NO: 7357 - DNA, 517 bp, Artificial Sequence
  chemically treated genomic DNA (Homo sapiens) CpG-island No: 7357
agtacgttttttttatatcgcgttgggatatgtgttttcgacgtaaattaaatagatgttttttgtatcgtaggggttggaatagttggtacggtatgttgagcgattggcggattattttatcgtggcgattggcggtattagtttggtacgcgcgtttgcggtgatagtaacgggtgtcggtagtatcgtcgtcgttagcgttattatttaagtcgtagattggcgtttggtaacggtatagttgttggaaattgtaggagttggcgatgaatgatcgtgattttatgcgttatagtcgttaaattttgttcgacgatatcgttttggacgggtagtaaaaattgttcgatagttaggtgttgattatcggtttgggcgggttgggtatatttgttgcgttgtatttggcgggcgttggcgtcgggacgttggtattggtagatgacgacgatgtgtatttaagtaatttgtaacgataaattttttttattattgaagatatcgatcgttcgaa

SEQ ID NO: 7358 - DNA, 517 bp, Artificial Sequence
  chemically treated genomic DNA (Homo sapiens) CpG-island No: 7358
ttcgaacgatcgatatcttcaataataaaaaaaatttatcgttacaaattacttaaatacacatcgtcgtcatctaccaataccaacgtcccgacgccaacgcccgccaaatacaacgcaacaaatatacccaacccgcccaaaccgataatcaacacctaactatcgaacaatttttactacccgtccaaaacgatatcgtcgaacaaaatttaacgactataacgcataaaatcacgatcattcatcgccaactcctacaatttccaacaactataccgttaccaaacgccaatctacgacttaaataataacgctaacgacgacgatactaccgacacccgttactatcaccgcaaacgcgcgtaccaaactaataccgccaatcgccacgataaaataatccgccaatcgctcaacataccgtaccaactattccaacccctacgatacaaaaaacatctatttaatttacgtcgaaaacacatatcccaacgcgatataaaaaaaacgtact

SEQ ID NO: 7359 - DNA, 517 bp, Artificial Sequence
  chemically treated genomic DNA (Homo sapiens) CpG-island No: 7359
ttcgggcgatcgatatttttagtggtaaagaggatttgtcgttgtagattgtttaaatgtatatcgtcgttatttgttagtattagcgtttcgacgttagcgttcgttaggtatagcgtagtaggtgtatttagttcgtttagatcgataattagtatttggttgtcgagtagtttttgttgttcgtttagagcgatatcgtcgagtaggatttggcggttataacgtataaagttacggttatttatcgttaatttttgtaatttttagtaattgtgtcgttgttaaacgttagtttgcggtttgagtaatggcgttgacgacggcgatattgtcgatattcgttgttattatcgtaggcgcgcgtgttagattgatatcgttaatcgttacggtgggataattcgttagtcgtttaatatgtcgtgttagttgttttagtttttgcggtgtagaaggtatttgtttggtttgcgtcgggaatatatgttttagcgcgatataagaggggcgtgtt

SEQ ID NO: 7360 - DNA, 517 bp, Artificial Sequence
  chemically treated genomic DNA (Homo sapiens) CpG-island No: 7360
aacacgcccctcttatatcgcgctaaaacatatattcccgacgcaaaccaaacaaataccttctacaccgcaaaaactaaaacaactaacacgacatattaaacgactaacgaattatcccaccgtaacgattaacgatatcaatctaacacgcgcgcctacgataataacaacgaatatcgacaatatcgccgtcgtcaacgccattactcaaaccgcaaactaacgtttaacaacgacacaattactaaaaattacaaaaattaacgataaataaccgtaactttatacgttataaccgccaaatcctactcgacgatatcgctctaaacgaacaacaaaaactactcgacaaccaaatactaattatcgatctaaacgaactaaatacacctactacgctatacctaacgaacgctaacgtcgaaacgctaatactaacaaataacgacgatatacatttaaacaatctacaacgacaaatcctctttaccactaaaaatatcgatcgcccgaa

SEQ ID NO: 7361 - DNA, 879 bp, Artificial Sequence
  chemically treated genomic DNA (Homo sapiens) CpG-island No: 7361
ggaagagttgtattcgcgtatttttgaattgatggaagaagtggtaaaacgcgttgaagtcgatggtatttaggcgtggtgggatttcgatgcgaaagagattttcggcgacgaagttgattagtacgtgaaagtgtcggatatattggatgtatggtttgatttcggatttatttatttttttgttgttgacgtgcgttcggaatttgtcggttacgtagcggatatgtatttggaaggttttgattaatatcgcggttggtttatgttttttttaatgatttttatcgcgatgaagggtaaagcgtcgtatcgttaggtattgatttacggttttatcgtggatggttaggtcgtaagatgtttaaatttatcggtaatatcgtttcgtcgtaggatgtgatgaataaattgggcgcggatattttgcgtttgtgggtggtattaatcgattatatcggtgaaatggtcgtttttgacgagattttgaaacgtgttgtcgatagttatcgtcgtattcgtaatatcgcgcgttttttgttggtaaatttgaacggttttgatttagtaaaagatatggtgaaatcggaagagatggtggtattggatcgttgggtcgtaggttgtgcgaaagcggtataggaagatatttttaaggcgtacgaagtatacgatttttacgaagtggtatagcgtttgatgcgtttttgtttcgttgagatgggttttttttatttcgatattattaaagatcgttagtatatcgttaaagcggatagtgtggcgcgtcgtagttgttagattgcgttatattatatcgtagaagcgttggtgcgttggatggtattaatttttttttttatcgttgatgaagtgtgg

SEQ ID NO: 7362 - DNA, 879 bp, Artificial Sequence
  chemically treated genomic DNA (Homo sapiens) CpG-island No: 7362
ccacacttcatcaacgataaaaaaaaaaattaataccatccaacgcaccaacgcttctacgatataatataacgcaatctaacaactacgacgcgccacactatccgctttaacgatatactaacgatctttaataatatcgaaataaaaaaaacccatctcaacgaaacaaaaacgcatcaaacgctataccacttcgtaaaaatcgtatacttcgtacgccttaaaaatatcttcctataccgctttcgcacaacctacgacccaacgatccaataccaccatctcttccgatttcaccatatcttttactaaatcaaaaccgttcaaatttaccaacaaaaaacgcgcgatattacgaatacgacgataactatcgacaacacgtttcaaaatctcgtcaaaaacgaccatttcaccgatataatcgattaataccacccacaaacgcaaaatatccgcgcccaatttattcatcacatcctacgacgaaacgatattaccgataaatttaaacatcttacgacctaaccatccacgataaaaccgtaaatcaatacctaacgatacgacgctttacccttcatcgcgataaaaatcattaaaaaaaacataaaccaaccgcgatattaatcaaaaccttccaaatacatatccgctacgtaaccgacaaattccgaacgcacgtcaacaacaaaaaaataaataaatccgaaatcaaaccatacatccaatatatccgacactttcacgtactaatcaacttcgtcgccgaaaatctctttcgcatcgaaatcccaccacgcctaaataccatcgacttcaacgcgttttaccacttcttccatcaattcaaaaatacgcgaatacaactcttcc

SEQ ID NO: 7363 - DNA, 879 bp, Artificial Sequence
  chemically treated genomic DNA (Homo sapiens) CpG-island No: 7363
ttatattttattagcggtgaaggagaggattggtgttatttagcgtattagcgtttttgcgatgtgatatagcgtagtttggtagttacgacgcgttatattgttcgttttggcggtgtattgacggtttttgatgatgtcgaggtagaaggaatttattttaacggagtagaagcgtattagacgttgtattatttcgtggaaatcgtatgtttcgtacgttttgaggatgtttttttgtgtcgttttcgtataatttacggtttagcgatttagtattattatttttttcggttttattatattttttgttggattaaaatcgtttaggtttgttagtaggaagcgcgcggtgttacggatacgacgatagttatcggtagtacgttttaggatttcgttagaaacggttattttatcggtgtagtcggttgatgttatttatagacgtagaatattcgcgtttagtttgtttattatattttgcggcgaaacggtattgtcgatggatttagatattttgcggtttgattatttacggtaaagtcgtgggttagtatttgacgatacggcgttttattttttatcgcggtggagattattagggaagatatgaattagtcgcggtgttggttagaattttttagatatatgttcgttgcgtgatcggtaaatttcggacgtacgttaataatagaagagtgggtagattcggagttaaattatatatttaatgtgttcggtatttttacgtattgattagtttcgtcgtcgaggatttttttcgtatcgagattttattacgtttggatgttatcgattttaacgcgttttgttattttttttattagtttaagggtacgcggatgtagttttttt

SEQ ID NO: 7364 - DNA, 879 bp, Artificial Sequence
  chemically treated genomic DNA (Homo sapiens) CpG-island No: 7364
aaaaaaactacatccgcgtacccttaaactaataaaaaaaataacaaaacgcgttaaaatcgataacatccaaacgtaataaaatctcgatacgaaaaaaatcctcgacgacgaaactaatcaatacgtaaaaataccgaacacattaaatatataatttaactccgaatctacccactcttctattattaacgtacgtccgaaatttaccgatcacgcaacgaacatatatctaaaaaattctaaccaacaccgcgactaattcatatcttccctaataatctccaccgcgataaaaaataaaacgccgtatcgtcaaatactaacccacgactttaccgtaaataatcaaaccgcaaaatatctaaatccatcgacaataccgtttcgccgcaaaatataataaacaaactaaacgcgaatattctacgtctataaataacatcaaccgactacaccgataaaataaccgtttctaacgaaatcctaaaacgtactaccgataactatcgtcgtatccgtaacaccgcgcgcttcctactaacaaacctaaacgattttaatccaacaaaaaatataataaaaccgaaaaaaataataatactaaatcgctaaaccgtaaattatacgaaaacgacacaaaaaaacatcctcaaaacgtacgaaacatacgatttccacgaaataatacaacgtctaatacgcttctactccgttaaaataaattccttctacctcgacatcatcaaaaaccgtcaatacaccgccaaaacgaacaatataacgcgtcgtaactaccaaactacgctatatcacatcgcaaaaacgctaatacgctaaataacaccaatcctctccttcaccgctaataaaatataa

SEQ ID NO: 7365 - DNA, 1090 bp, Artificial Sequence
  chemically treated genomic DNA (Homo sapiens) CpG-island No: 7365
cgttaggttcggtggttgacgttaattggttgtggtggttatagtaaaacgtcgatttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtatttattatcgtaagtaaagttgcgtatttgtttgttattacggttatatattatcgttagttcgtcgcggggcgttagttatagcgtattagcggcgcggtaggtaaatttttcgggtatttcgggtcgtgcgttagttatacggtagatagacggatgtcgttgtttcggttatattcggtgtattcggtagggtattatgaaaagcggacggtttcgtttcgtcggaaatggtttgttgtcgggttttttttgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttggt

SEQ ID NO: 7366 - DNA, 1090 bp, Artificial Sequence
  chemically treated genomic DNA (Homo sapiens) CpG-island No: 7366
accaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacaaaaaaaacccgacaacaaaccatttccgacgaaacgaaaccgtccgcttttcataataccctaccgaatacaccgaatataaccgaaacaacgacatccgtctatctaccgtataactaacgcacgacccgaaatacccgaaaaatttacctaccgcgccgctaatacgctataactaacgccccgcgacgaactaacgataatatataaccgtaataacaaacaaatacgcaactttacttacgataataaataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaaatcgacgttttactataaccaccacaaccaattaacgtcaaccaccgaacctaacg

SEQ ID NO: 7367 - DNA, 1090 bp, Artificial Sequence
  chemically treated genomic DNA (Homo sapiens) CpG-island No: 7367
gttagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtagaagaagttcggtagtaggttattttcggcgggacggaatcgttcgttttttatgatattttgtcgggtatatcgaatatggtcgggataacggtattcgtttgtttgtcgtgtggttgacgtacgattcggaatattcggagaatttatttgtcgcgtcgttggtgcgttatggttgacgtttcgcggcgaattggcggtggtgtatgatcgtagtggtaaataggtgcgtagttttatttacgatgataaatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggatcggcgttttattataattattataattagttaacgttagttatcgggtttgacg

SEQ ID NO: 7368 - DNA, 1090 bp, Artificial Sequence
  chemically treated genomic DNA (Homo sapiens) CpG-island No: 7368
cgtcaaacccgataactaacgttaactaattataataattataataaaacgccgatccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatatttatcatcgtaaataaaactacgcacctatttaccactacgatcatacaccaccgccaattcgccgcgaaacgtcaaccataacgcaccaacgacgcgacaaataaattctccgaatattccgaatcgtacgtcaaccacacgacaaacaaacgaataccgttatcccgaccatattcgatatacccgacaaaatatcataaaaaacgaacgattccgtcccgccgaaaataacctactaccgaacttcttctacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaac

SEQ ID NO: 7369 - DNA, 574 bp, Artificial Sequence
  chemically treated genomic DNA (Homo sapiens) CpG-island No: 7369
cgttgacgtagttttatgaggcgtcggtaacgttaatttggcgcgatagtgacgagcgtatggtataatttatcgttcgtttgaacgaattgggtttatagtttatgtagggtgcgcgtttttggtacgtattggatgtttttgtcggaaaagattaggttgttaattggattatcgcgatttattaataattgttaggtaaacgtttaattatatttggtttgggcgatgggttaaacgatgcgtttttattggaggtaatggattacgcggtgattgtgaaagggttaaatcgtgaaggggtgtatttgtatgatgaggattcggttcgcgttatggcgaacgtagcgtgaaggatcggaaggatggcgtgaagggttggattatttttttttcgttcgttaagcgttatcgtttagcgaatattcgattacgtttagtttgtttagcgagataaagtcgacggtcggttagtgattggagttgtttaaaattataattatcggttttttcgttgttgtttatttttagcgaggtattgatgcgtatcgtcgtatttttggcgattaatatt

SEQ ID NO: 7370 - DNA, 574 bp, Artificial Sequence
  chemically treated genomic DNA (Homo sapiens) CpG-island No: 7370
aatattaatcgccaaaaatacgacgatacgcatcaatacctcgctaaaaataaacaacaacgaaaaaaccgataattataattttaaacaactccaatcactaaccgaccgtcgactttatctcgctaaacaaactaaacgtaatcgaatattcgctaaacgataacgcttaacgaacgaaaaaaaaataatccaacccttcacgccatccttccgatccttcacgctacgttcgccataacgcgaaccgaatcctcatcatacaaatacaccccttcacgatttaaccctttcacaatcaccgcgtaatccattacctccaataaaaacgcatcgtttaacccatcgcccaaaccaaatataattaaacgtttacctaacaattattaataaatcgcgataatccaattaacaacctaatcttttccgacaaaaacatccaatacgtaccaaaaacgcgcaccctacataaactataaacccaattcgttcaaacgaacgataaattataccatacgctcgtcactatcgcgccaaattaacgttaccgacgcctcataaaactacgtcaacg

SEQ ID NO: 7371 - DNA, 574 bp, Artificial Sequence
  chemically treated genomic DNA (Homo sapiens) CpG-island No: 7371
gatgttgatcgttaagagtacgacgatacgtattagtgtttcgttgggggtaagtagtagcgaggaaatcggtgattatgattttgaataattttagttattggtcgatcgtcggttttatttcgttaaataggttgggcgtaatcgggtattcgttgagcgataacgtttaacgggcggagaaaaaatggtttagttttttacgttattttttcggttttttacgttgcgttcgttatgacgcgggtcggatttttattatgtagatgtatttttttacgatttagtttttttataattatcgcgtaatttattatttttagtaagggcgtatcgtttggtttatcgtttaggttaagtgtggttgggcgtttgtttgataattgttgataggtcgcgataatttagttggtagtttgatttttttcggtagaagtatttagtacgtgttagaagcgcgtattttgtataaattgtaagtttagttcgtttagacgagcggtaaattgtgttatacgttcgttattgtcgcgttagattagcgttatcgacgttttatgaagttgcgttagcg

SEQ ID NO: 7372 - DNA, 574 bp, Artificial Sequence
  chemically treated genomic DNA (Homo sapiens) CpG-island No: 7372
cgctaacgcaacttcataaaacgtcgataacgctaatctaacgcgacaataacgaacgtataacacaatttaccgctcgtctaaacgaactaaacttacaatttatacaaaatacgcgcttctaacacgtactaaatacttctaccgaaaaaaatcaaactaccaactaaattatcgcgacctatcaacaattatcaaacaaacgcccaaccacacttaacctaaacgataaaccaaacgatacgcccttactaaaaataataaattacgcgataattataaaaaaactaaatcgtaaaaaaatacatctacataataaaaatccgacccgcgtcataacgaacgcaacgtaaaaaaccgaaaaaataacgtaaaaaactaaaccattttttctccgcccgttaaacgttatcgctcaacgaatacccgattacgcccaacctatttaacgaaataaaaccgacgatcgaccaataactaaaattattcaaaatcataatcaccgatttcctcgctactacttacccccaacgaaacactaatacgtatcgtcgtactcttaacgatcaacatc

SEQ ID NO: 7373 - DNA, 629 bp, Artificial Sequence
  chemically treated genomic DNA (Homo sapiens) CpG-island No: 7373
ggaagtacgcgtgtatgttcgtggtcgcgataagggtagattagagggcgtgacgacggcgatttggggttggaattggtgggttgggggtacgtgggaatcgataggaagggtagggcgttaatattgtatcgggcgggtagaaggtgcgtagggtgcgtggttagtggggattcgcgggaaaaattgggtagattgttaggtgggtataggtgattgttgatagcgtcggtaatggtgggaaagtggcgtgggcgtgggtggttttgaaggggttttttgggcggtgacggtgcgtgtaaaacggggcggcgtgagtggttgttggtggatgagacggggaggttatgtgatgttggatgaagcgcgggattggatggggttgtggatacgagttgataagtgttatatgcggatttagaagacggggtttggggggagttgcgtgtacgttattaatatcgcgggggttttgtaagagtgtgtaattattcgtatagggatgtaatggttgaaatatataaattgatatcggtttgtatatttcgaattatgggcggtagggggtgcgtagttgaaacggttggtggatttgaagtatttagagagtttttgtcggaaaggattaa

SEQ ID NO: 7374 - DNA, 629 bp, Artificial Sequence
  chemically treated genomic DNA (Homo sapiens) CpG-island No: 7374
ttaatcctttccgacaaaaactctctaaatacttcaaatccaccaaccgtttcaactacgcaccccctaccgcccataattcgaaatatacaaaccgatatcaatttatatatttcaaccattacatccctatacgaataattacacactcttacaaaacccccgcgatattaataacgtacacgcaactccccccaaaccccgtcttctaaatccgcatataacacttatcaactcgtatccacaaccccatccaatcccgcgcttcatccaacatcacataacctccccgtctcatccaccaacaaccactcacgccgccccgttttacacgcaccgtcaccgcccaaaaaaccccttcaaaaccacccacgcccacgccactttcccaccattaccgacgctatcaacaatcacctatacccacctaacaatctacccaatttttcccgcgaatccccactaaccacgcaccctacgcaccttctacccgcccgatacaatattaacgccctacccttcctatcgattcccacgtacccccaacccaccaattccaaccccaaatcgccgtcgtcacgccctctaatctacccttatcgcgaccacgaacatacacgcgtacttcc

SEQ ID NO: 7375 - DNA, 629 bp, Artificial Sequence
  chemically treated genomic DNA (Homo sapiens) CpG-island No: 7375
ttaatttttttcggtaaaaattttttgggtattttaaatttattaatcgttttaattgcgtattttttatcgtttataattcgaggtgtgtaggtcggtgttaatttatgtgttttaattattgtatttttgtgcgggtggttgtatatttttataaggttttcgcggtgttggtaacgtatacgtagttttttttaggtttcgttttttaggttcgtatgtaatatttattaattcgtgtttataattttatttagtttcgcgttttatttaatattatatagttttttcgttttatttattagtagttatttacgtcgtttcgttttatacgtatcgttatcgtttaggggatttttttaaaattatttacgtttacgttatttttttattattatcggcgttattagtagttatttatgtttatttaatagtttatttagtttttttcgcgggtttttattaattacgtattttgcgtattttttattcgttcgatatagtattagcgttttattttttttatcggtttttacgtatttttagtttattagttttagttttaagtcgtcgtcgttacgttttttagtttatttttatcgcggttacgggtatatacgcgtattttt

SEQ ID NO: 7376 - DNA, 629 bp, Artificial Sequence
  chemically treated genomic DNA (Homo sapiens) CpG-island No: 7376
aaaaatacgcgtatatacccgtaaccgcgataaaaataaactaaaaaacgtaacgacgacgacttaaaactaaaactaataaactaaaaatacgtaaaaaccgataaaaaaaataaaacgctaatactatatcgaacgaataaaaaatacgcaaaatacgtaattaataaaaacccgcgaaaaaaactaaataaactattaaataaacataaataactactaataacgccgataataataaaaaaataacgtaaacgtaaataattttaaaaaaatcccctaaacgataacgatacgtataaaacgaaacgacgtaaataactactaataaataaaacgaaaaaactatataatattaaataaaacgcgaaactaaataaaattataaacacgaattaataaatattacatacgaacctaaaaaacgaaacctaaaaaaaactacgtatacgttaccaacaccgcgaaaaccttataaaaatatacaaccacccgcacaaaaatacaataattaaaacacataaattaacaccgacctacacacctcgaattataaacgataaaaaatacgcaattaaaacgattaataaatttaaaatacccaaaaaatttttaccgaaaaaaattaa

SEQ ID NO: 7377 - DNA, 548 bp, Artificial Sequence
  chemically treated genomic DNA (Homo sapiens) CpG-island No: 7377
ggagcggataggcggaggaagtaaacgtgcgtgagatggtaggggagtatttgtagttcgattgcgcgggcgcgttagataacgggatgggaacgcgtcgttaaagatacgggttgtgaaaagatacgggtagggagagtaggagtcgggatacgtaacgatttatggtaattagttatttggtacgacgatttgaaggatggcgatgtcggagtgcgttatatgattttacgatgttttattacgagggagttcgagggagataagacgttgataagcgaacgcgaaaaaaaattgtcgacgaaagtaggggattgtaggggtgttggggaggtttgatagcgttatgtcgggcgaagacggttatcgagtgtataaaggggaaagttgggtagagtgagaaagttacggttggacgaagattaggggaattatgtaggaggcgcggttttggttcgtaaaattcgggatcgaatcggcgtgggtttatacgtaataaatataaatagaaattgttgttagtttgtatttatttgtgaggcgtaaaa

SEQ ID NO: 7378 - DNA, 548 bp, Artificial Sequence
  chemically treated genomic DNA (Homo sapiens) CpG-island No: 7378
ttttacgcctcacaaataaatacaaactaacaacaatttctatttatatttattacgtataaacccacgccgattcgatcccgaattttacgaaccaaaaccgcgcctcctacataattcccctaatcttcgtccaaccgtaactttctcactctacccaactttcccctttatacactcgataaccgtcttcgcccgacataacgctatcaaacctccccaacacccctacaatcccctactttcgtcgacaattttttttcgcgttcgcttatcaacgtcttatctccctcgaactccctcgtaataaaacatcgtaaaatcatataacgcactccgacatcgccatccttcaaatcgtcgtaccaaataactaattaccataaatcgttacgtatcccgactcctactctccctacccgtatcttttcacaacccgtatctttaacgacgcgttcccatcccgttatctaacgcgcccgcgcaatcgaactacaaatactcccctaccatctcacgcacgtttacttcctccgcctatccgctcc

SEQ ID NO: 7379 - DNA, 548 bp, Artificial Sequence
  chemically treated genomic DNA (Homo sapiens) CpG-island No: 7379
ttttgcgttttataggtaagtgtaaattaatagtaatttttgtttatgtttgttacgtgtaggtttacgtcggttcggtttcgggttttacgggttaaggtcgcgttttttgtatagtttttttggttttcgtttagtcgtagtttttttattttgtttagtttttttttttgtatattcggtagtcgttttcgttcggtatagcgttattaagtttttttaatatttttgtaattttttgttttcgtcggtagttttttttcgcgttcgtttgttaacgttttgtttttttcgggttttttcgtggtggggtatcgtggggttatgtggcgtatttcggtatcgttattttttaagtcgtcgtgttaggtggttagttattataaatcgttgcgtatttcggtttttgttttttttattcgtgtttttttatagttcgtgtttttaacggcgcgtttttatttcgttatttggcgcgttcgcgtagtcgggttgtaggtgtttttttattattttacgtacgtttgtttttttcgtttgttcgtttt

SEQ ID NO: 7380 - DNA, 548 bp, Artificial Sequence
  chemically treated genomic DNA (Homo sapiens) CpG-island No: 7380
aaaacgaacaaacgaaaaaaacaaacgtacgtaaaataataaaaaaacacctacaacccgactacgcgaacgcgccaaataacgaaataaaaacgcgccgttaaaaacacgaactataaaaaaacacgaataaaaaaaacaaaaaccgaaatacgcaacgatttataataactaaccacctaacacgacgacttaaaaaataacgataccgaaatacgccacataaccccacgataccccaccacgaaaaaacccgaaaaaaacaaaacgttaacaaacgaacgcgaaaaaaaactaccgacgaaaacaaaaaattacaaaaatattaaaaaaacttaataacgctataccgaacgaaaacgactaccgaatatacaaaaaaaaaaactaaacaaaataaaaaaactacgactaaacgaaaaccaaaaaaactatacaaaaaacgcgaccttaacccgtaaaacccgaaaccgaaccgacgtaaacctacacgtaacaaacataaacaaaaattactattaatttacacttacctataaaacgcaaaa

SEQ ID NO: 7381 - DNA, 890 bp, Artificial Sequence
  chemically treated genomic DNA (Homo sapiens) CpG-island No: 7381
gagtaaattgcgagtgttaatcggtggatttaaatggcgtcgggggagtgagtagtttttgcgcggacggggcggcggacgtcggtattaagaatttatgattagaggcgagcgtaagatagatttttgttcgatatttcgtgggtttatataatatgacgatatagtggatatatcgtcggcggtgtgacggttggtttgagagagggagagtgcggggaagcgcgacgcgattttgaaagattcggttttgcgtatgtatcgttggtttgggtgtttcgcgtgttttgacgtatttttgattatgtaatgtttggtataatttttttaaacgggcggtattaaagaataggttgtggattcggtttgtatcgtggtaaaggtggtttagcggagaggacgggaggggagtgaagggcgggggacggaagatatcgaataatatcgcggattgaagggcggtcgggggaatcgatatagcgacgcgtaagattataaaatcgtggtcgatcgtttgtacggcgatttggtttgatttaagaatgggttgagaaatgtttagcgaaaggagtagtaacgacgtaacgaacggaagtgaacgaaacgagttgtcgtaagcggacgtcgtagtggtttagcggaatagttaatatcggtagcgacgggatatttgtagaaaatacgttcggattaatcgtcgtttacgataaatacggttattcgggaacgaatacgagtagaaattaaaatcgagagtgggtaaattcgatatatagggtgattgcgagtgatgcgagcggaatggagggcgttgcgtttggaggtgatatttagttcgagtgttggaagagaattaacgataatggattttttgtaacgtgtcgatagaa

SEQ ID NO: 7382 - DNA, 890 bp, Artificial Sequence
  chemically treated genomic DNA (Homo sapiens) CpG-island No: 7382
ttctatcgacacgttacaaaaaatccattatcgttaattctcttccaacactcgaactaaatatcacctccaaacgcaacgccctccattccgctcgcatcactcgcaatcaccctatatatcgaatttacccactctcgattttaatttctactcgtattcgttcccgaataaccgtatttatcgtaaacgacgattaatccgaacgtattttctacaaatatcccgtcgctaccgatattaactattccgctaaaccactacgacgtccgcttacgacaactcgtttcgttcacttccgttcgttacgtcgttactactcctttcgctaaacatttctcaacccattcttaaatcaaaccaaatcgccgtacaaacgatcgaccacgattttataatcttacgcgtcgctatatcgattcccccgaccgcccttcaatccgcgatattattcgatatcttccgtcccccgcccttcactcccctcccgtcctctccgctaaaccacctttaccacgatacaaaccgaatccacaacctattctttaataccgcccgtttaaaaaaattataccaaacattacataatcaaaaatacgtcaaaacacgcgaaacacccaaaccaacgatacatacgcaaaaccgaatctttcaaaatcgcgtcgcgcttccccgcactctccctctctcaaaccaaccgtcacaccgccgacgatatatccactatatcgtcatattatataaacccacgaaatatcgaacaaaaatctatcttacgctcgcctctaatcataaattcttaataccgacgtccgccgccccgtccgcgcaaaaactactcactcccccgacgccatttaaatccaccgattaacactcgcaatttactc

SEQ ID NO: 7383 - DNA, 890 bp, Artificial Sequence
  chemically treated genomic DNA (Homo sapiens) CpG-island No: 7383
ttttatcgatacgttataaggggtttattgtcgttagtttttttttaatattcgggttaaatgttatttttaagcgtaacgttttttatttcgttcgtattattcgtaattattttgtatgtcgggtttgtttattttcggttttaatttttattcgtgttcgttttcgggtggtcgtgtttgtcgtgagcggcggttaattcgagcgtattttttataggtgtttcgtcgttgtcggtattagttatttcgttagattattgcggcgttcgtttgcggtaattcgtttcgtttattttcgttcgttacgtcgttattgtttttttcgttgggtattttttagtttatttttaggttaggttaggtcgtcgtgtaggcggtcgattacggttttgtggttttgcgcgtcgttatgtcggttttttcggtcgttttttagttcgcggtgttattcggtatttttcgtttttcgttttttatttttttttcgtttttttcgttgggttatttttattacggtataagtcgggtttatagtttattttttggtatcgttcgtttaagggggttatgttaggtattgtatggttaagggtgcgttagggtacgcggggtatttaggttagcggtatatgcgtaaggtcgggttttttaaggtcgcgtcgcgttttttcgtatttttttttttttaaattagtcgttatatcgtcggcggtgtatttattatatcgttatattgtataggtttacggggtatcgggtaaaagtttgttttacgttcgtttttagttatgggtttttagtgtcggcgttcgtcgtttcgttcgcgtaggggttgtttattttttcggcgttatttaagtttatcggttggtattcgtagtttgttt

SEQ ID NO: 7384 - DNA, 890 bp, Artificial Sequence
  chemically treated genomic DNA (Homo sapiens) CpG-island No: 7384
aaacaaactacgaataccaaccgataaacttaaataacgccgaaaaaataaacaacccctacgcgaacgaaacgacgaacgccgacactaaaaacccataactaaaaacgaacgtaaaacaaacttttacccgataccccgtaaacctatacaatataacgatataataaatacaccgccgacgatataacgactaatttaaaaaaaaaaaaatacgaaaaaacgcgacgcgaccttaaaaaacccgaccttacgcatataccgctaacctaaataccccgcgtaccctaacgcacccttaaccatacaatacctaacataacccccttaaacgaacgataccaaaaaataaactataaacccgacttataccgtaataaaaataacccaacgaaaaaaacgaaaaaaaaataaaaaacgaaaaacgaaaaataccgaataacaccgcgaactaaaaaacgaccgaaaaaaccgacataacgacgcgcaaaaccacaaaaccgtaatcgaccgcctacacgacgacctaacctaacctaaaaataaactaaaaaatacccaacgaaaaaaacaataacgacgtaacgaacgaaaataaacgaaacgaattaccgcaaacgaacgccgcaataatctaacgaaataactaataccgacaacgacgaaacacctataaaaaatacgctcgaattaaccgccgctcacgacaaacacgaccacccgaaaacgaacacgaataaaaattaaaaccgaaaataaacaaacccgacatacaaaataattacgaataatacgaacgaaataaaaaacgttacgcttaaaaataacatttaacccgaatattaaaaaaaaactaacgacaataaaccccttataacgtatcgataaaa

SEQ ID NO: 7385 - DNA, 788 bp, Artificial Sequence
  chemically treated genomic DNA (Homo sapiens) CpG-island No: 7385
tttaggcgttaggcggagcgttgagggaggttttcgtcggtcgaatagcggggagattcgtgaagtaggcgtatcggttacgcgttcggagggatagggatagggatcggtaggggtgggttcgtcgttaattcgtcgggtatttcgcggattcgggtttagttagcgatttttttcgtttttttcgcgttttgtttcgcgtttcgtcgtttttttttcgcgtttcgtcgtttttttttcgcgtttcgttttttttttttcgtgtttcgttttttttttttcgtgttttaggtttttagttttttatttgacgggcgtagggaaggggcgggtgtcgcgtttttttttcggttcgtagttttttattcgcggttcgagcgcgttgtatttggggttttggggtcgtttttatttttgcgtcgtcgttattattattgtcgtcggtttagtttttttaggatcgaaagtgaaagtggagttcggggagcggtaggttggcgttgagcggcgtttcggttcgagttttagcggtaggcggggaagtttttggttaaggcgggagttggggaaagggtaaacgggagtggggtcgagcgagggaagtcgtaatttttaggaagggaattggtaaatgagcgttgtacgtcggggaagttgcgaggttgcgatgtgggggattaggcgtaggaagtgtacgtttttttgaacgcggattcgtgtgtgtgtgtgtgtgtgtgtgtgtgtgtgtgtgtgtgtgtgtgtgtgtgtgtgtgtgtgttgagatgttt

SEQ ID NO: 7386 - DNA, 788 bp, Artificial Sequence
  chemically treated genomic DNA (Homo sapiens) CpG-island No: 7386
aaacatctcaacacacacacacacacacacacacacacacacacacacacacacacacacacacacacacacgaatccgcgttcaaaaaaacgtacacttcctacgcctaatcccccacatcgcaacctcgcaacttccccgacgtacaacgctcatttaccaattcccttcctaaaaattacgacttccctcgctcgaccccactcccgtttaccctttccccaactcccgccttaaccaaaaacttccccgcctaccgctaaaactcgaaccgaaacgccgctcaacgccaacctaccgctccccgaactccactttcactttcgatcctaaaaaaactaaaccgacgacaataataataacgacgacgcaaaaataaaaacgaccccaaaaccccaaatacaacgcgctcgaaccgcgaataaaaaactacgaaccgaaaaaaaaacgcgacacccgccccttccctacgcccgtcaaataaaaaactaaaaacctaaaacacgaaaaaaaaaaaacgaaacacgaaaaaaaaaaaacgaaacgcgaaaaaaaaacgacgaaacgcgaaaaaaaaacgacgaaacgcgaaacaaaacgcgaaaaaaacgaaaaaaatcgctaactaaacccgaatccgcgaaatacccgacgaattaacgacgaacccacccctaccgatccctatccctatccctccgaacgcgtaaccgatacgcctacttcacgaatctccccgctattcgaccgacgaaaacctccctcaacgctccgcctaacgcctaaa

SEQ ID NO: 7387 - DNA, 788 bp, Artificial Sequence
  chemically treated genomic DNA (Homo sapiens) CpG-island No: 7387
aagtattttaatatatatatatatatatatatatatatatatatatatatatatatatatatatatatatacggattcgcgtttagaaaggcgtgtattttttacgtttgattttttatatcgtaatttcgtagttttttcggcgtgtagcgtttatttattaattttttttttgggagttgcggtttttttcgttcggttttattttcgtttattttttttttagttttcgttttagttaggggttttttcgtttgtcgttagggttcgggtcgaagcgtcgtttagcgttagtttgtcgtttttcgggttttatttttattttcggttttgggggagttaggtcggcggtagtggtggtggcggcggcgtaagggtgagggcggttttagaattttaggtatagcgcgttcgagtcgcgggtaggggattgcgggtcgggaggagagcgcggtattcgttttttttttgcgttcgttaagtggggggttgagggtttggggtacgggaggagggagacggggtacgggaggagggagacggggcgcgggaggaaggcgacggggcgcgggaggaaggcgacggggcgcgagatagggcgcgggaagggcggggggagtcgttggttaggttcgagttcgcggggtgttcggcgggttggcggcgggtttatttttgtcggtttttgtttttgttttttcgggcgcgtggtcggtgcgtttgttttacgggttttttcgttgttcggtcggcgggagttttttttagcgtttcgtttggcgtttgga

SEQ ID NO: 7388 - DNA, 788 bp, Artificial Sequence
  chemically treated genomic DNA (Homo sapiens) CpG-island No: 7388
tccaaacgccaaacgaaacgctaaaaaaaactcccgccgaccgaacaacgaaaaaacccgtaaaacaaacgcaccgaccacgcgcccgaaaaaacaaaaacaaaaaccgacaaaaataaacccgccgccaacccgccgaacaccccgcgaactcgaacctaaccaacgactccccccgcccttcccgcgccctatctcgcgccccgtcgccttcctcccgcgccccgtcgccttcctcccgcgccccgtctccctcctcccgtaccccgtctccctcctcccgtaccccaaaccctcaaccccccacttaacgaacgcaaaaaaaaaacgaataccgcgctctcctcccgacccgcaatcccctacccgcgactcgaacgcgctatacctaaaattctaaaaccgccctcacccttacgccgccgccaccaccactaccgccgacctaactcccccaaaaccgaaaataaaaataaaacccgaaaaacgacaaactaacgctaaacgacgcttcgacccgaaccctaacgacaaacgaaaaaacccctaactaaaacgaaaactaaaaaaaaaataaacgaaaataaaaccgaacgaaaaaaaccgcaactcccaaaaaaaaaattaataaataaacgctacacgccgaaaaaactacgaaattacgatataaaaaatcaaacgtaaaaaatacacgcctttctaaacgcgaatccgtatatatatatatatatatatatatatatatatatatatatatatatatatatatatatattaaaatactt

SEQ ID NO: 7389 - DNA, 701 bp, Artificial Sequence
  chemically treated genomic DNA (Homo sapiens) CpG-island No: 7389
cgagggagcggtaatttgtaattagtcggcggtgcgtagtttatatagtacgtggttcgtattataggttgcgttattgagtgagttagtttttagatgttaggcgtatgacgagtttacggagcgggatttttttttttacgtatttcgggttttcggggcggggtcgtcgggtaggggggcggggagtattttgcgtcgttttttcgggatcgtttcgtttcgtcgtatttagagagttgggttggagttttaagcggaaatcgcgggagtcgagtttagttaggaatgtagattttttgaaaattaagtcgaggattgcggggttcggtgtttacgtagagtgagtattgtttttcgtcgttttgttttaggtcgcgcgtgttttcgggtttagggtttgtgttttcggttatttgttttgcgtgttcggggtttggtttttgtagcggattttttaggttcgggacgtgcgttttttttattatcgcgattttggcgatatcgtgcgttttgagtttaattgtgttttttggcgattttttttttttgtcggtaatattgttattgtttttttcgtcgggaaatgtatttggtgatcggacgcgtagggttataaaataagggatttgtgtggttcggtataagtggttcgagataagtggttcgagataagtggtttaaaagaaggaaagtagtag

SEQ ID NO: 7390 - DNA, 701 bp, Artificial Sequence
  chemically treated genomic DNA (Homo sapiens) CpG-island No: 7390
ctactactttccttcttttaaaccacttatctcgaaccacttatctcgaaccacttataccgaaccacacaaatcccttattttataaccctacgcgtccgatcaccaaatacatttcccgacgaaaaaaacaataacaatattaccgacaaaaaaaaaaaatcgccaaaaaacacaattaaactcaaaacgcacgatatcgccaaaatcgcgataataaaaaaaacgcacgtcccgaacctaaaaaatccgctacaaaaaccaaaccccgaacacgcaaaacaaataaccgaaaacacaaaccctaaacccgaaaacacgcgcgacctaaaacaaaacgacgaaaaacaatactcactctacgtaaacaccgaaccccgcaatcctcgacttaattttcaaaaaatctacattcctaactaaactcgactcccgcgatttccgcttaaaactccaacccaactctctaaatacgacgaaacgaaacgatcccgaaaaaacgacgcaaaatactccccgcccccctacccgacgaccccgccccgaaaacccgaaatacgtaaaaaaaaaaatcccgctccgtaaactcgtcatacgcctaacatctaaaaactaactcactcaataacgcaacctataatacgaaccacgtactatataaactacgcaccgccgactaattacaaattaccgctccctcg

SEQ ID NO: 7391 - DNA, 701 bp, Artificial Sequence
  chemically treated genomic DNA (Homo sapiens) CpG-island No: 7391
ttgttgtttttttttttttgggttatttgtttcgggttatttgtttcgggttatttgtatcgggttatataaattttttgttttgtaattttacgcgttcggttattagatatatttttcggcggaaggggtagtaatagtgttatcgataaggaggaggagtcgttaagaaatatagttaaatttagaacgtacggtatcgttagggtcgcgatagtaggaaaagcgtacgtttcgagtttggggagttcgttgtagggattaggtttcggatacgtagggtaggtagtcgggggtataggttttagattcgggagtacgcgcggtttggagtaaagcggcggaagatagtatttattttgcgtggatatcggatttcgtagttttcggtttggtttttaggaggtttgtatttttagttgggttcggttttcgcggttttcgtttggagttttagtttagttttttgagtgcgacggggcggggcggtttcgggaaggcgacgtaggatgtttttcgtttttttgttcggcggtttcgtttcgggagttcgggatgcgtggggagggaggtttcgtttcgtggattcgttatgcgtttggtatttggagattggtttatttaataacgtagtttgtgatgcggattacgtgttgtgtgggttgcgtatcgtcggttgattataggttatcgttttttcg

SEQ ID NO: 7392 - DNA, 701 bp, Artificial Sequence
  chemically treated genomic DNA (Homo sapiens) CpG-island No: 7392
cgaaaaaacgataacctataatcaaccgacgatacgcaacccacacaacacgtaatccgcatcacaaactacgttattaaataaaccaatctccaaataccaaacgcataacgaatccacgaaacgaaacctccctccccacgcatcccgaactcccgaaacgaaaccgccgaacaaaaaaacgaaaaacatcctacgtcgccttcccgaaaccgccccgccccgtcgcactcaaaaaactaaactaaaactccaaacgaaaaccgcgaaaaccgaacccaactaaaaatacaaacctcctaaaaaccaaaccgaaaactacgaaatccgatatccacgcaaaataaatactatcttccgccgctttactccaaaccgcgcgtactcccgaatctaaaacctatacccccgactacctaccctacgtatccgaaacctaatccctacaacgaactccccaaactcgaaacgtacgcttttcctactatcgcgaccctaacgataccgtacgttctaaatttaactatatttcttaacgactcctcctccttatcgataacactattactaccccttccgccgaaaaatatatctaataaccgaacgcgtaaaattacaaaacaaaaaatttatataacccgatacaaataacccgaaacaaataacccgaaacaaataacccaaaaaaaaaaaaacaacaa

SEQ ID NO: 7393 - DNA, 551 bp, Artificial Sequence
  chemically treated genomic DNA (Homo sapiens) CpG-island No: 7393
aagtaggagattggtaggtcggcgagagtaggtggttcgtcggtcgtatttcggttttttttttttcgttcgtttgtatttggacgacggttttcgcggcggtcggaggggagtattttttatattgttaattcgtattaatgggatttttttcgtgggaattgtttttttcggcggacgtgtttttcgggttcggcgtgggcgggcgggtgtcgcgaattttttgtagattttgggtcggtttagtgtttttttagcgttggggtcgagtttgtattattcgtcgtcgtcgtcgtcgagggggcgggggaggtgtcgcggggggcgggcgcggcgcgcggggaggggaaggggttttcgcgcgattgggcgaggttttcggtgttgtgattgaaattcgttaatatggcggcgatcggtcgcggtcgttttttgaagaattttcgagtacgaggtaagttcgttgtaatttttattttttatcgttcggcgttcgttatttttggtatttgtttttttttggttttgggttggggagcgagtcggggcgt

SEQ ID NO: 7394 - DNA, 551 bp, Artificial Sequence
  chemically treated genomic DNA (Homo sapiens) CpG-island No: 7394
acgccccgactcgctccccaacccaaaaccaaaaaaaaacaaataccaaaaataacgaacgccgaacgataaaaaataaaaattacaacgaacttacctcgtactcgaaaattcttcaaaaaacgaccgcgaccgatcgccgccatattaacgaatttcaatcacaacaccgaaaacctcgcccaatcgcgcgaaaaccccttcccctccccgcgcgccgcgcccgccccccgcgacacctcccccgccccctcgacgacgacgacgacgaataatacaaactcgaccccaacgctaaaaaaacactaaaccgacccaaaatctacaaaaaattcgcgacacccgcccgcccacgccgaacccgaaaaacacgtccgccgaaaaaaacaattcccacgaaaaaaatcccattaatacgaattaacaatataaaaaatactcccctccgaccgccgcgaaaaccgtcgtccaaatacaaacgaacgaaaaaaaaaaaaccgaaatacgaccgacgaaccacctactctcgccgacctaccaatctcctactt

SEQ ID NO: 7395 - DNA, 551 bp, Artificial Sequence
  chemically treated genomic DNA (Homo sapiens) CpG-island No: 7395
gcgtttcggttcgttttttaatttagggttaggggaaggtaagtgttaggggtggcgggcgtcgggcggtggggagtgagggttgtagcgggtttatttcgtattcggaggttttttagagagcggtcgcggtcgatcgtcgttatattgacgggttttagttataatatcggaaatttcgtttaatcgcgcgagaattttttttttttttcgcgcgtcgcgttcgtttttcgcggtatttttttcgttttttcggcggcgacggcggcgggtggtgtaggttcggttttagcgttgagggagtattgagtcgatttaaggtttgtaaggagttcgcggtattcgttcgtttacgtcggattcggagggtacgttcgtcgggaggggtagtttttacgaggaaagttttattgatgcgagttggtagtgtagaggatgttttttttcggtcgtcgcggaagtcgtcgtttaaatgtaggcgagcggggaggaggaggtcgggatgcggtcggcgggttatttgttttcgtcggtttgttagttttttgttt

SEQ ID NO: 7396 - DNA, 551 bp, Artificial Sequence
  chemically treated genomic DNA (Homo sapiens) CpG-island No: 7396
aaacaaaaaactaacaaaccgacgaaaacaaataacccgccgaccgcatcccgacctcctcctccccgctcgcctacatttaaacgacgacttccgcgacgaccgaaaaaaaacatcctctacactaccaactcgcatcaataaaactttcctcgtaaaaactacccctcccgacgaacgtaccctccgaatccgacgtaaacgaacgaataccgcgaactccttacaaaccttaaatcgactcaatactccctcaacgctaaaaccgaacctacaccacccgccgccgtcgccgccgaaaaaacgaaaaaaataccgcgaaaaacgaacgcgacgcgcgaaaaaaaaaaaaaattctcgcgcgattaaacgaaatttccgatattataactaaaacccgtcaatataacgacgatcgaccgcgaccgctctctaaaaaacctccgaatacgaaataaacccgctacaaccctcactccccaccgcccgacgcccgccacccctaacacttaccttcccctaaccctaaattaaaaaacgaaccgaaacgc

SEQ ID NO: 7397 - DNA, 667 bp, Artificial Sequence
  chemically treated genomic DNA (Homo sapiens) CpG-island No: 7397
ttcgtatcgttatcgtttttatttttcgtagtagcgtttttgacgttgcgcgatcgttgttaaggcgattggaatcgcggttcgaggtaattggagggtacggcggggcggggcgtttattttaggcggtttttgattggtttcggtcgtttttgcgttatagtttcgtttttgttcgggagtttcgtagcggtgatttgtttcgacgttcggcgtgatttagcggattaatggcggtcgttcgcggcgcgagggtgcggggatggggttcgttcgcggcgttgggcgcgttcgttagttaggggtcgttatgatcgagtggtttaggttcgagcgaagttcgcgcgcgtgagttcgtcgcggtttattcgttttttcgttcgttagagcgtttatcggacgtttattcgggagggtttcggcgtcgcgtcggcgggagttggttcggatcgcggtttaggggcgcgcgtcgggggaggcgggttcgggttcgggaggggcgggtcgggtcggggtttagagtttttcgcgagtttgatgtcgcgacggacggacggtagttgacgttcgcgggcgcgttgggggttgtgcgtttttttgatttattcgttggttttcgtcgttaggcgattttagtatttgtttaataggggggttaatttttcgg

SEQ ID NO: 7398 - DNA, 667 bp, Artificial Sequence
  chemically treated genomic DNA (Homo sapiens) CpG-island No: 7398
ccgaaaaattaacccccctattaaacaaatactaaaatcgcctaacgacgaaaaccaacgaataaatcaaaaaaacgcacaacccccaacgcgcccgcgaacgtcaactaccgtccgtccgtcgcgacatcaaactcgcgaaaaactctaaaccccgacccgacccgcccctcccgaacccgaacccgcctcccccgacgcgcgcccctaaaccgcgatccgaaccaactcccgccgacgcgacgccgaaaccctcccgaataaacgtccgataaacgctctaacgaacgaaaaaacgaataaaccgcgacgaactcacgcgcgcgaacttcgctcgaacctaaaccactcgatcataacgacccctaactaacgaacgcgcccaacgccgcgaacgaaccccatccccgcaccctcgcgccgcgaacgaccgccattaatccgctaaatcacgccgaacgtcgaaacaaatcaccgctacgaaactcccgaacaaaaacgaaactataacgcaaaaacgaccgaaaccaatcaaaaaccgcctaaaataaacgccccgccccgccgtaccctccaattacctcgaaccgcgattccaatcgccttaacaacgatcgcgcaacgtcaaaaacgctactacgaaaaataaaaacgataacgatacgaa

SEQ ID NO: 7399 - DNA, 667 bp, Artificial Sequence
  chemically treated genomic DNA (Homo sapiens) CpG-island No: 7399
tcggggaattagtttttttgttggataggtattagggtcgtttaacgacgggaattaacgggtgggttagagaggcgtatagtttttagcgcgttcgcgggcgttagttgtcgttcgttcgtcgcgatattagattcgcgaggggttttgaatttcggttcggttcgtttttttcgggttcgggttcgtttttttcgacgcgcgtttttggatcgcgattcgggttagttttcgtcgacgcggcgtcgagattttttcgggtgggcgttcgatggacgttttggcgggcggagggacggatgggtcgcggcggatttacgcgcgcgggtttcgttcgggtttgggttattcggttatggcgatttttggttggcgagcgcgtttaacgtcgcgggcggattttattttcgtattttcgcgtcgcgggcggtcgttattggttcgttggattacgtcgggcgtcgggataagttatcgttgcgggattttcgggtaggggcggggttgtgacgtagaggcggtcgaggttaattagaagtcgtttgggatgagcgtttcgtttcgtcgtgttttttagttatttcgggtcgcggttttagtcgttttggtaacggtcgcgtagcgttagggacgttgttgcggaaagtggagacggtggcggtgcggg

SEQ ID NO: 7400 - DNA, 667 bp, Artificial Sequence
  chemically treated genomic DNA (Homo sapiens) CpG-island No: 7400
cccgcaccgccaccgtctccactttccgcaacaacgtccctaacgctacgcgaccgttaccaaaacgactaaaaccgcgacccgaaataactaaaaaacacgacgaaacgaaacgctcatcccaaacgacttctaattaacctcgaccgcctctacgtcacaaccccgcccctacccgaaaatcccgcaacgataacttatcccgacgcccgacgtaatccaacgaaccaataacgaccgcccgcgacgcgaaaatacgaaaataaaatccgcccgcgacgttaaacgcgctcgccaaccaaaaatcgccataaccgaataacccaaacccgaacgaaacccgcgcgcgtaaatccgccgcgacccatccgtccctccgcccgccaaaacgtccatcgaacgcccacccgaaaaaatctcgacgccgcgtcgacgaaaactaacccgaatcgcgatccaaaaacgcgcgtcgaaaaaaacgaacccgaacccgaaaaaaacgaaccgaaccgaaattcaaaacccctcgcgaatctaatatcgcgacgaacgaacgacaactaacgcccgcgaacgcgctaaaaactatacgcctctctaacccacccgttaattcccgtcgttaaacgaccctaatacctatccaacaaaaaaactaattccccga

SEQ ID NO: 7401 - DNA, 804 bp, Artificial Sequence
  chemically treated genomic DNA (Homo sapiens) CpG-island No: 7401
gatcgtcgtcgttattgtatgtttaagggaattcggagttgttttaatttaggtttgacgttttttatagtgttttgtgtgaattggtaggggagaaacgacggttggggaacgaacggggttattcgttttattaatggtttagaagtatttttattatttgtttttagagttttcgatttaaatttttttttaagatcgacgcggtcgcgacgttgtaaaagttcgtttcggtttttttggttcgcggtcggcggttttttttgaaggcggcgtagtaggatcgggtttgttcgtttggggcgtttggtttttgtttcgcgtcgaggttcggttaggagtgcgtttgggagttttcggcgcggtttcggggataaaggttcgcgagtcgacgtgtagtagagtttatttaggttcgttcgattagaaaacgagaacgttcggaggcgggaggtcggaggtaggttgttggttggagaatcgcggtaacgacggcgtaaagtcggcgcggaaagggtaggcgtaggatttatttgacgtcgttttttttagtcggtttttttgattttttaagtttcgtattacggcggatttatagtttgagtaaaggttttattttagtcgcggatatggcggttgttttttttgcgtcgatcggagcgcgtcgaggggtttgttggagttcgtatttcggcggggattttcggcgtcggttagggggtcgttatatggttttggataagcgtttttttggttgacgggttggattattgggtatgttattaggggtagtgaattttaacg

SEQ ID NO: 7402 - DNA, 804 bp, Artificial Sequence
  chemically treated genomic DNA (Homo sapiens) CpG-island No: 7402
cgttaaaattcactacccctaataacatacccaataatccaacccgtcaaccaaaaaaacgcttatccaaaaccatataacgaccccctaaccgacgccgaaaatccccgccgaaatacgaactccaacaaacccctcgacgcgctccgatcgacgcaaaaaaaacaaccgccatatccgcgactaaaataaaacctttactcaaactataaatccgccgtaatacgaaacttaaaaaatcaaaaaaaccgactaaaaaaaacgacgtcaaataaatcctacgcctaccctttccgcgccgactttacgccgtcgttaccgcgattctccaaccaacaacctacctccgacctcccgcctccgaacgttctcgttttctaatcgaacgaacctaaataaactctactacacgtcgactcgcgaacctttatccccgaaaccgcgccgaaaactcccaaacgcactcctaaccgaacctcgacgcgaaacaaaaaccaaacgccccaaacgaacaaacccgatcctactacgccgccttcaaaaaaaaccgccgaccgcgaaccaaaaaaaccgaaacgaacttttacaacgtcgcgaccgcgtcgatcttaaaaaaaaatttaaatcgaaaactctaaaaacaaataataaaaatacttctaaaccattaataaaacgaataaccccgttcgttccccaaccgtcgtttctcccctaccaattcacacaaaacactataaaaaacgtcaaacctaaattaaaacaactccgaattcccttaaacatacaataacgacgacgatc

SEQ ID NO: 7403 - DNA, 804 bp, Artificial Sequence
  chemically treated genomic DNA (Homo sapiens) CpG-island No: 7403
cgttaaaatttattgtttttggtgatatgtttaatggtttaattcgttagttaggaaagcgtttgtttaggattatatggcggttttttggtcgacgtcggaagttttcgtcgggatacgagttttagtagatttttcggcgcgtttcggtcgacgtagggaaagtagtcgttatgttcgcggttgaggtgaggtttttgtttagattgtgggttcgtcgtagtgcggggtttggggggttaggagagtcggttgggagaggcggcgttaggtgggttttgcgtttgtttttttcgcgtcggttttgcgtcgtcgttgtcgcggttttttagttagtagtttgttttcggtttttcgttttcgggcgttttcgttttttggtcggacgggtttgggtgaattttgttgtacgtcggttcgcgggtttttgttttcgaggtcgcgtcgggagtttttaagcgtatttttggtcggatttcggcgcgggataaaagttaaacgttttaggcgggtagattcgattttgttgcgtcgtttttaagggggatcgtcggtcgcgagttagggaggtcgggacgagtttttgtagcgtcgcggtcgcgtcggttttgaggagaaatttgggtcgggagttttggaagtaggtgataaggatgtttttgagttattgatgggacgaataatttcgttcgttttttagtcgtcgttttttttttgttagtttatataaagtattgtgaaggacgttagatttgggttggaatagtttcgggtttttttaaatatgtagtgacggcggcggtt

SEQ ID NO: 7404 - DNA, 804 bp, Artificial Sequence
  chemically treated genomic DNA (Homo sapiens) CpG-island No: 7404
aaccgccgccgtcactacatatttaaaaaaacccgaaactattccaacccaaatctaacgtccttcacaatactttatataaactaacaaaaaaaaaacgacgactaaaaaacgaacgaaattattcgtcccatcaataactcaaaaacatccttatcacctacttccaaaactcccgacccaaatttctcctcaaaaccgacgcgaccgcgacgctacaaaaactcgtcccgacctccctaactcgcgaccgacgatcccccttaaaaacgacgcaacaaaatcgaatctacccgcctaaaacgtttaacttttatcccgcgccgaaatccgaccaaaaatacgcttaaaaactcccgacgcgacctcgaaaacaaaaacccgcgaaccgacgtacaacaaaattcacccaaacccgtccgaccaaaaaacgaaaacgcccgaaaacgaaaaaccgaaaacaaactactaactaaaaaaccgcgacaacgacgacgcaaaaccgacgcgaaaaaaacaaacgcaaaacccacctaacgccgcctctcccaaccgactctcctaaccccccaaaccccgcactacgacgaacccacaatctaaacaaaaacctcacctcaaccgcgaacataacgactactttccctacgtcgaccgaaacgcgccgaaaaatctactaaaactcgtatcccgacgaaaacttccgacgtcgaccaaaaaaccgccatataatcctaaacaaacgctttcctaactaacgaattaaaccattaaacatatcaccaaaaacaataaattttaacg

SEQ ID NO: 7405 - DNA, 783 bp, Artificial Sequence
  chemically treated genomic DNA (Homo sapiens) CpG-island No: 7405
ttttttaatatttttaggcgtatttattatcgggttaatatcggcgttagtgttcgcgtatttttagtaggtcgtcgggtattattataattagtgtatttttatatatcgttttagtatatgttcgttattatgtatttattacgttaggtggttatagttagcgcgtcgtaatatatattattatttgtggtaaagagtaatttttcgtggttttagaggtatgattatttttcgtgtggtacgtcgtagtatatattagacgttattacgtaggtatacgttatttagcggtgttacgttttatttagtagttatattttagtgcggcgttcgttatatttcgtacgtattttaggatggcgttgtatacgtattacgtttatgtacgtatatttagtaggtaggttcgtatatatttattcgtttacgtttatatagtagtcgatttattttttttagataattcggttcgaagggttacgttttttatttggtgcgttttcggttatttttatttcgtacgtatcgaatttacgtaatagggtatttttttattttaattaatataattggtaattcgtatttagtgttatttacgttgtatacggtgtttataaatcggtattttttttagggcgtcgtgcgtatagttggtaaataattaattcgtttagggggcgttttttagatttataaaggtgtattaattcgtaacgtataataatattgcgttttaggattattcgacgttttttattataatataaggtatgtggttag

SEQ ID NO: 7406 - DNA, 783 bp, Artificial Sequence
  chemically treated genomic DNA (Homo sapiens) CpG-island No: 7406
ctaaccacataccttatattataataaaaaacgtcgaataatcctaaaacgcaatattattatacgttacgaattaatacacctttataaatctaaaaaacgccccctaaacgaattaattatttaccaactatacgcacgacgccctaaaaaaaataccgatttataaacaccgtatacaacgtaaataacactaaatacgaattaccaattatattaattaaaataaaaaaataccctattacgtaaattcgatacgtacgaaataaaaataaccgaaaacgcaccaaataaaaaacgtaacccttcgaaccgaattatctaaaaaaaataaatcgactactatataaacgtaaacgaataaatatatacgaacctacctactaaatatacgtacataaacgtaatacgtatacaacgccatcctaaaatacgtacgaaatataacgaacgccgcactaaaatataactactaaataaaacgtaacaccgctaaataacgtatacctacgtaataacgtctaatatatactacgacgtaccacacgaaaaataatcatacctctaaaaccacgaaaaattactctttaccacaaataataatatatattacgacgcgctaactataaccacctaacgtaataaatacataataacgaacatatactaaaacgatatataaaaatacactaattataataatacccgacgacctactaaaaatacgcgaacactaacgccgatattaacccgataataaatacgcctaaaaatattaaaaaa

SEQ ID NO: 7407 - DNA, 783 bp, Artificial Sequence
  chemically treated genomic DNA (Homo sapiens) CpG-island No: 7407
ttagttatatattttgtgttgtaatgaggggcgtcgaatggttttgaggcgtaatgttgttgtgcgttgcgaattgatatatttttgtgaatttggggggcgttttttgggcgggttggttgtttgttagttgtgcgtacggcgttttggggggaatatcgatttgtgaatatcgtgtgtagcgtgggtggtattgggtgcgggttgttaattgtgttggttgggatggaagggtgttttgttgcgtgggttcggtgcgtacgggatggggataatcggggacgtattaagtggggaacgtggtttttcgggtcggattgtttggagaaaatgggtcggttgttgtgtaggcgtgggcgaatgaatgtatgcgaatttgtttgttaaatgtgcgtgtatgggcgtgatacgtgtgtaacgttattttaggatacgtgcgggatatgacgggcgtcgtattggggtgtgattgttgggtgggacgtgatatcgttgggtggcgtgtgtttgcgtggtggcgtttgatgtgtgttgcgacgtgttatacgggaaatgattatgtttttggggttacgggagattgttttttgttatagatgataatgtgtgttgcgacgcgttggttgtggttatttgacgtggtgaatgtatggtggcggatatgtgttggggcgatgtgtggggatgtattggttgtgatgatgttcgacgatttgttggggatgcgcgggtattggcgtcgatgttggttcggtgatgaatgcgtttgggaatattagaggg

SEQ ID NO: 7408 - DNA, 783 bp, Artificial Sequence
  chemically treated genomic DNA (Homo sapiens) CpG-island No: 7408
ccctctaatattcccaaacgcattcatcaccgaaccaacatcgacgccaatacccgcgcatccccaacaaatcgtcgaacatcatcacaaccaatacatccccacacatcgccccaacacatatccgccaccatacattcaccacgtcaaataaccacaaccaacgcgtcgcaacacacattatcatctataacaaaaaacaatctcccgtaaccccaaaaacataatcatttcccgtataacacgtcgcaacacacatcaaacgccaccacgcaaacacacgccacccaacgatatcacgtcccacccaacaatcacaccccaatacgacgcccgtcatatcccgcacgtatcctaaaataacgttacacacgtatcacgcccatacacgcacatttaacaaacaaattcgcatacattcattcgcccacgcctacacaacaaccgacccattttctccaaacaatccgacccgaaaaaccacgttccccacttaatacgtccccgattatccccatcccgtacgcaccgaacccacgcaacaaaacacccttccatcccaaccaacacaattaacaacccgcacccaataccacccacgctacacacgatattcacaaatcgatattccccccaaaacgccgtacgcacaactaacaaacaaccaacccgcccaaaaaacgccccccaaattcacaaaaatatatcaattcgcaacgcacaacaacattacgcctcaaaaccattcgacgcccctcattacaacacaaaatatataactaa

SEQ ID NO: 7409 - DNA, 536 bp, Artificial Sequence
  chemically treated genomic DNA (Homo sapiens) CpG-island No: 7409
ggtttatttgcgttataaattggtggagcgtttgcgtattatcggggtcgttaattattattttaattatcgtggtggttggcgtgcgttaggcgttggtaaatgtcgttttaagtttttgttagttttgcggacgatgatattttagttcgaatatcgcggcggcgtgtttaaaatggacgttttgcggtattagatagaaacgtttacgttcgttttgcggcgttggtaatagcgagaaaatttgttcgtcgttgttgtttattataattaatattagcggcgtagaaatttgacgtaataacgttagcgcgttgagatcgtaaagtgcggagagatcgtttataatcgttagcgtcggtttgtcgtttgttcgttgaacgtcggcggcggtcgaaagtagttcgtcgatatcgttggttttacggttgttgtatatcgggtaattttgtcgaaagttgcgaaaggaatacgttgatgggtttggttgtagtttttgtttttagcgtttgtttagttaggtttagtttcgttgt

SEQ ID NO: 7410 - DNA, 536 bp, Artificial Sequence
  chemically treated genomic DNA (Homo sapiens) CpG-island No: 7410
acaacgaaactaaacctaactaaacaaacgctaaaaacaaaaactacaaccaaacccatcaacgtattcctttcgcaactttcgacaaaattacccgatatacaacaaccgtaaaaccaacgatatcgacgaactactttcgaccgccgccgacgttcaacgaacaaacgacaaaccgacgctaacgattataaacgatctctccgcactttacgatctcaacgcgctaacgttattacgtcaaatttctacgccgctaatattaattataataaacaacaacgacgaacaaattttctcgctattaccaacgccgcaaaacgaacgtaaacgtttctatctaataccgcaaaacgtccattttaaacacgccgccgcgatattcgaactaaaatatcatcgtccgcaaaactaacaaaaacttaaaacgacatttaccaacgcctaacgcacgccaaccaccacgataattaaaataataattaacgaccccgataatacgcaaacgctccaccaatttataacgcaaataaacc

SEQ ID NO: 7411 - DNA, 536 bp, Artificial Sequence
  chemically treated genomic DNA (Homo sapiens) CpG-island No: 7411
ataacggggttgggtttggttgagtaggcgttaaaaataagggttgtagttaggtttattaacgtgtttttttcgtaattttcggtagggttattcggtgtatagtaatcgtggggttagcggtatcgacgggttgttttcgatcgtcgtcggcgtttagcgggtaagcggtaaatcgacgttggcgattgtgggcgattttttcgtattttacgattttaacgcgttggcgttattgcgttaggtttttgcgtcgttggtattaattgtggtgaataataacggcgggtaaattttttcgttgttgttaacgtcgtaaagcgagcgtgagcgtttttatttgatgtcgtaaaacgtttattttgagtacgtcgtcgcgatgttcgagttgaaatattatcgttcgtaaaattggtaggaatttgaaacggtatttgttaacgtttggcgtacgttaattattacggtgattgaaatggtggttaacgatttcgatggtgcgtaaacgttttattaatttgtggcgtaggtaagtt

SEQ ID NO: 7412 - DNA, 536 bp, Artificial Sequence
  chemically treated genomic DNA (Homo sapiens) CpG-island No: 7412
aacttacctacgccacaaattaataaaacgtttacgcaccatcgaaatcgttaaccaccatttcaatcaccgtaataattaacgtacgccaaacgttaacaaataccgtttcaaattcctaccaattttacgaacgataatatttcaactcgaacatcgcgacgacgtactcaaaataaacgttttacgacatcaaataaaaacgctcacgctcgctttacgacgttaacaacaacgaaaaaatttacccgccgttattattcaccacaattaataccaacgacgcaaaaacctaacgcaataacgccaacgcgttaaaatcgtaaaatacgaaaaaatcgcccacaatcgccaacgtcgatttaccgcttacccgctaaacgccgacgacgatcgaaaacaacccgtcgataccgctaaccccacgattactatacaccgaataaccctaccgaaaattacgaaaaaaacacgttaataaacctaactacaacccttatttttaacgcctactcaaccaaacccaaccccgttat

SEQ ID NO: 7413 - DNA, 520 bp, Artificial Sequence
  chemically treated genomic DNA (Homo sapiens) CpG-island No: 7413
cgtaaattttggtttagtcgtatgacgtaattagttggtagcggcggttttatcgtcggttatttgttagtaaattattcggattttgttggcgttagagatttagtcgttgtgatatttgttattttttagtaggttttttagacggtttagttggttacgggcgttatttaaattattacgggttagcgagtattgaattaatattgttaggtattgaagttggggttgtggttgataagacgataagattttaatttcgttacgcgtcgacgtttcggttttatttagtcgcgcgttaggtttataatagttgcgtacgaatgcgtattagatgtttgttgttgtaggtcgagcgattttaatttttgacgttttattgtattttgacgttttaggtttagtaaacgtttcggggttgttattagtatattaacgtcgttacgtagttttattatttgcgggttaatatttatattattaaatattattagcgaacgaatgtttaggtatttgttgt

SEQ ID NO: 7414 - DNA, 520 bp, Artificial Sequence
  chemically treated genomic DNA (Homo sapiens) CpG-island No: 7414
acaacaaatacctaaacattcgttcgctaataatatttaataatataaatattaacccgcaaataataaaactacgtaacgacgttaatatactaataacaaccccgaaacgtttactaaacctaaaacgtcaaaatacaataaaacgtcaaaaattaaaatcgctcgacctacaacaacaaacatctaatacgcattcgtacgcaactattataaacctaacgcgcgactaaataaaaccgaaacgtcgacgcgtaacgaaattaaaatcttatcgtcttatcaaccacaaccccaacttcaatacctaacaatattaattcaatactcgctaacccgtaataatttaaataacgcccgtaaccaactaaaccgtctaaaaaacctactaaaaaataacaaatatcacaacgactaaatctctaacgccaacaaaatccgaataatttactaacaaataaccgacgataaaaccgccgctaccaactaattacgtcatacgactaaaccaaaatttacg

SEQ ID NO: 7415 - DNA, 520 bp, Artificial Sequence
  chemically treated genomic DNA (Homo sapiens) CpG-island No: 7415
atagtaaatatttgaatattcgttcgttggtggtgtttggtggtgtgagtattaattcgtagatgatgaaattgcgtggcggcgttgatgtgttggtggtaatttcgggacgtttgttggatttggaacgttagaatgtaatagagcgttaaaggttgaaatcgttcgatttgtaatagtaagtatttggtgcgtattcgtgcgtagttgttatgggtttggcgcgcggttggatgaagtcgaagcgtcggcgcgtagcgggattgaagttttgtcgttttattagttatagttttagttttagtgtttggtaatgttgatttaatgttcgttggttcgtggtgatttagataacgttcgtagttagttgaatcgtttggaaaatttgttggggaatggtaaatattatagcgattggatttttaacgttaataaagttcgggtgatttattggtaaatgatcggcgataaagtcgtcgttgttaattggttgcgttatacggttaaattagagtttgcg

SEQ ID NO: 7416 - DNA, 520 bp, Artificial Sequence
  chemically treated genomic DNA (Homo sapiens) CpG-island No: 7416
cgcaaactctaatttaaccgtataacgcaaccaattaacaacgacgactttatcgccgatcatttaccaataaatcacccgaactttattaacgttaaaaatccaatcgctataatatttaccattccccaacaaattttccaaacgattcaactaactacgaacgttatctaaatcaccacgaaccaacgaacattaaatcaacattaccaaacactaaaactaaaactataactaataaaacgacaaaacttcaatcccgctacgcgccgacgcttcgacttcatccaaccgcgcgccaaacccataacaactacgcacgaatacgcaccaaatacttactattacaaatcgaacgatttcaacctttaacgctctattacattctaacgttccaaatccaacaaacgtcccgaaattaccaccaacacatcaacgccgccacgcaatttcatcatctacgaattaatactcacaccaccaaacaccaccaacgaacgaatattcaaatatttactat

SEQ ID NO: 7417 - DNA, 539 bp, Artificial Sequence
  chemically treated genomic DNA (Homo sapiens) CpG-island No: 7417
  misc_feature (236)..(236): n is either a, c, g or t
gttttattcggcgttagagatattttcgatcgttttatttttttttcggatttttcgttattgtttttttttttcggtatgtagtttcggttcgggttttagtttcgttttcggtcgcggtttcggtttcgttgaattcgcgtattagtttataggcggcggagtcggcgtaggtttcggcgaagatttagtaaacggagtagggtcgtgtttttttcgggttcggtttttttcgngttcgacgcgtcgttatcgcgtcgtagggttattcgaatttttttaggttttagttgtttcggtcgcgcggtttcgtttcgtcggaattcgagggcggtcggaagcggttcgtgcggagttaggtcggggtaatgcggcgtcgacgcgcgtatttggatcgtaaaggggcgggaattcgtgatcgttatttagtgcgtaagatcggtcgaaggaaacgagggaaaaggtaaatcggcgtagtttatattttttttttttttcgtttttttggtattatgtaaaaggtaatatagaagaagcga

SEQ ID NO: 7418 - DNA, 539 bp, Artificial Sequence
  chemically treated genomic DNA (Homo sapiens) CpG-island No: 7418
  misc_feature (304)..(304): n is either a, c, g or t
tcgcttcttctatattaccttttacataataccaaaaaaacgaaaaaaaaaaaaaatataaactacgccgatttaccttttccctcgtttccttcgaccgatcttacgcactaaataacgatcacgaattcccgcccctttacgatccaaatacgcgcgtcgacgccgcattaccccgacctaactccgcacgaaccgcttccgaccgccctcgaattccgacgaaacgaaaccgcgcgaccgaaacaactaaaacctaaaaaaattcgaataaccctacgacgcgataacgacgcgtcgaacncgaaaaaaaccgaacccgaaaaaaacacgaccctactccgtttactaaatcttcgccgaaacctacgccgactccgccgcctataaactaatacgcgaattcaacgaaaccgaaaccgcgaccgaaaacgaaactaaaacccgaaccgaaactacataccgaaaaaaaaaaacaataacgaaaaatccgaaaaaaaaataaaacgatcgaaaatatctctaacgccgaataaaac

SEQ ID NO: 7419 - DNA, 539 bp, Artificial Sequence
  chemically treated genomic DNA (Homo sapiens) CpG-island No: 7419
  misc_feature (304)..(304): n is either a, c, g or t
tcgttttttttgtgttgttttttgtatgatattaaaaaagcgagagaggaggaggatgtgagttacgtcggtttgttttttttttcgtttttttcggtcggttttgcgtattggatgacgattacgggttttcgtttttttacggtttaaatgcgcgcgtcggcgtcgtattgtttcggtttggtttcgtacgggtcgttttcggtcgttttcgggtttcggcggggcggggtcgcgcggtcgaggtaattggagtttgaaagagttcgggtagttttgcggcgcggtggcggcgcgtcgggtncgggaggagtcgagttcggggaggatacggttttgtttcgtttgttgggttttcgtcggggtttgcgtcggtttcgtcgtttgtgggttggtgcgcgagtttagcgaggtcgaggtcgcggtcggggacggggttggggttcgaatcgaggttgtatgtcggaggaagagagtagtgacggggaattcgaggaggaggtgaggcggtcggaggtgtttttagcgtcgggtagggt

SEQ ID NO: 7420 - DNA, 539 bp, Artificial Sequence
  chemically treated genomic DNA (Homo sapiens) CpG-island No: 7420
  misc_feature (236)..(236): n is either a, c, g or t
accctacccgacgctaaaaacacctccgaccgcctcacctcctcctcgaattccccgtcactactctcttcctccgacatacaacctcgattcgaaccccaaccccgtccccgaccgcgacctcgacctcgctaaactcgcgcaccaacccacaaacgacgaaaccgacgcaaaccccgacgaaaacccaacaaacgaaacaaaaccgtatcctccccgaactcgactcctcccgnacccgacgcgccgccaccgcgccgcaaaactacccgaactctttcaaactccaattacctcgaccgcgcgaccccgccccgccgaaacccgaaaacgaccgaaaacgacccgtacgaaaccaaaccgaaacaatacgacgccgacgcgcgcatttaaaccgtaaaaaaacgaaaacccgtaatcgtcatccaatacgcaaaaccgaccgaaaaaaacgaaaaaaaaaacaaaccgacgtaactcacatcctcctcctctctcgcttttttaatatcatacaaaaaacaacacaaaaaaaacga

SEQ ID NO: 7421 - DNA, 645 bp, Artificial Sequence
  chemically treated genomic DNA (Homo sapiens) CpG-island No: 7421
gtggagttgtcgattcggagtcgtttttgtcggatttggtttgtcgtagaatcgagagttcgcgtttttttgagcggtttatcgtcgttttagtcgttatttatacgttcgcgatttatggtcgtcgttttgttggtgacgttgtgttatcgttgttgtttgtcgttagttggtaggagtggatttataaagggttgacgttgttgttgattggttgttcgtgtgcgttagttattttaacgtttgtcggcgattattttcggtttgtcggcggtagcgcgtcgtggggcgttgattaaaggcggagcggcgttggaatagttgggtcgtgttatttaggtggcgtttgataaaatcggtacgttgatcgtcggtaaatcgcgcgttatcgcgatttattcggtaacgggtattagtgaatttgaattgttgatattggcggcggcggtcgagtaaggcgcgacgtatttattggcgtaagttatcgtacgcgaagtataggttgttgaattcgttatttttatcgtcgaattatagcgggcgttggtcgggtttggtattgaagcgtaggttaacggtgagcgcgtattgatttgcgttgtcgggaaatatttcgttgatgtatttattggtttaattaacgaa

SEQ ID NO: 7422 - DNA, 645 bp, Artificial Sequence
  chemically treated genomic DNA (Homo sapiens) CpG-island No: 7422
ttcgttaattaaaccaataaatacatcaacgaaatatttcccgacaacgcaaatcaatacgcgctcaccgttaacctacgcttcaataccaaacccgaccaacgcccgctataattcgacgataaaaataacgaattcaacaacctatacttcgcgtacgataacttacgccaataaatacgtcgcgccttactcgaccgccgccgccaatatcaacaattcaaattcactaatacccgttaccgaataaatcgcgataacgcgcgatttaccgacgatcaacgtaccgattttatcaaacgccacctaaataacacgacccaactattccaacgccgctccgcctttaatcaacgccccacgacgcgctaccgccgacaaaccgaaaataatcgccgacaaacgttaaaataactaacgcacacgaacaaccaatcaacaacaacgtcaaccctttataaatccactcctaccaactaacgacaaacaacaacgataacacaacgtcaccaacaaaacgacgaccataaatcgcgaacgtataaataacgactaaaacgacgataaaccgctcaaaaaaacgcgaactctcgattctacgacaaaccaaatccgacaaaaacgactccgaatcgacaactccac

SEQ ID NO: 7423 - DNA, 645 bp, Artificial Sequence
  chemically treated genomic DNA (Homo sapiens) CpG-island No: 7423
ttcgttaattaaattagtaaatgtattagcgggatgtttttcggtagcgtaaattaatacgcgtttatcgttaatttgcgttttaatgttagattcgattagcgttcgttgtgattcggcggtgggaatggcgagtttagtaatttgtgtttcgcgtacgatggtttgcgttagtggatgcgtcgcgttttgttcgatcgtcgtcgttagtgttagtagtttagatttattaatattcgttgtcggatgaatcgcggtaacgcgcggtttatcgacggttagcgtatcggttttattaaacgttatttgagtaatacgatttagttgttttagcgtcgtttcgtttttaattaacgttttacgacgcgttgtcgtcgatagatcggaggtaatcgtcgataggcgttgagataattaacgtatacgggtagttaattagtagtagcgttagttttttataaatttatttttgttagttggcggtaaatagtagcggtggtatagcgttattagtagagcgacggttataaatcgcgggcgtatagataacggttgaaacggcgataaatcgtttaagggagcgcgagttttcggttttacgataggttagattcggtaagggcggtttcgggtcgataattttat

SEQ ID NO: 7424 - DNA, 645 bp, Artificial Sequence
  chemically treated genomic DNA (Homo sapiens) CpG-island No: 7424
ataaaattatcgacccgaaaccgcccttaccgaatctaacctatcgtaaaaccgaaaactcgcgctcccttaaacgatttatcgccgtttcaaccgttatctatacgcccgcgatttataaccgtcgctctactaataacgctataccaccgctactatttaccgccaactaacaaaaataaatttataaaaaactaacgctactactaattaactacccgtatacgttaattatctcaacgcctatcgacgattacctccgatctatcgacgacaacgcgtcgtaaaacgttaattaaaaacgaaacgacgctaaaacaactaaatcgtattactcaaataacgtttaataaaaccgatacgctaaccgtcgataaaccgcgcgttaccgcgattcatccgacaacgaatattaataaatctaaactactaacactaacgacgacgatcgaacaaaacgcgacgcatccactaacgcaaaccatcgtacgcgaaacacaaattactaaactcgccattcccaccgccgaatcacaacgaacgctaatcgaatctaacattaaaacgcaaattaacgataaacgcgtattaatttacgctaccgaaaaacatcccgctaatacatttactaatttaattaacgaa

SEQ ID NO: 7425 - DNA, 672 bp, Artificial Sequence
  chemically treated genomic DNA (Homo sapiens) CpG-island No: 7425
tgcgcgtcgatgttgtaacgtattagtgaattgaacgcgttgggcgttaaggggtgatttttatcggcgataatttacgcgtagcggcggtaatgtcggggagttggggttggagtttaaagcgggtttgtgtcggaagataaagttaaagcggtgatcgagttgaattaatatgcgtcgttggcgatggtcggtgacggtattaacgacgcgttagcgatgaaagttgtcgttatcgggattgtaatgggtagcggtatagacgtggcgttggaaatcgtcgacgtagtattaatttataattatttgcgcggtttggtgtaaatgattgaattggtacgcgttatttacgttaatattcgttagaatattattattgcgttggggttgaaagggatttttttcgttattacgttgttagggatgatcgggttgtggttggtagtgttggtagatacgggggcgacggtgttggtgatagcgaatgcgtaagatgtggcgtaggagataaggtaaatcgatcgtaatatgagcgcgatcggttttttcgtttttttggggagagggtagggtgaggggataaggggtatcgaggttaattagtttattaacgtttacgagttaatacgataggtagtatcgttttataataatcggttttagtataaatta

SEQ ID NO: 7426 - DNA, 672 bp, Artificial Sequence
  chemically treated genomic DNA (Homo sapiens) CpG-island No: 7426
taatttatactaaaaccgattattataaaacgatactacctatcgtattaactcgtaaacgttaataaactaattaacctcgataccccttatcccctcaccctaccctctccccaaaaaaacgaaaaaaccgatcgcgctcatattacgatcgatttaccttatctcctacgccacatcttacgcattcgctatcaccaacaccgtcgcccccgtatctaccaacactaccaaccacaacccgatcatccctaacaacgtaataacgaaaaaaatccctttcaaccccaacgcaataataatattctaacgaatattaacgtaaataacgcgtaccaattcaatcatttacaccaaaccgcgcaaataattataaattaatactacgtcgacgatttccaacgccacgtctataccgctacccattacaatcccgataacgacaactttcatcgctaacgcgtcgttaataccgtcaccgaccatcgccaacgacgcatattaattcaactcgatcaccgctttaactttatcttccgacacaaacccgctttaaactccaaccccaactccccgacattaccgccgctacgcgtaaattatcgccgataaaaatcaccccttaacgcccaacgcgttcaattcactaatacgttacaacatcgacgcgca

SEQ ID NO: 7427 - DNA, 672 bp, Artificial Sequence
  chemically treated genomic DNA (Homo sapiens) CpG-island No: 7427
tggtttgtattaggatcgattgttgtagaacgatgttgtttatcgtattgattcgtaagcgttgataggttgattggtttcgatgttttttgtttttttattttattttttttttagaggggcgaggggatcgatcgcgtttatgttgcgatcggtttgttttattttttgcgttatattttacgtattcgttgttattagtatcgtcgttttcgtatttgttagtattgttagttataattcggttatttttaatagcgtggtgacgaggaagattttttttagttttagcgtaatagtgatgttttggcggatattggcgtgagtggcgcgtgttagtttaattatttgtattaggtcgcgtaggtggttatgggttaatgttgcgtcggcggtttttagcgttacgtttgtgtcgttatttattgtaatttcgatggcggtagtttttatcgttggcgcgtcgttaatatcgttatcgattatcgttagcggcgtatgttgatttagttcggttatcgttttgattttatttttcggtataggttcgttttaaattttagttttagtttttcggtattgtcgtcgttgcgcgtggattatcgtcggtgaggattattttttgacgtttagcgcgtttagtttattgatgcgttgtagtatcggcgcgta

SEQ ID NO: 7428 - DNA, 672 bp, Artificial Sequence
  chemically treated genomic DNA (Homo sapiens) CpG-island No: 7428
tacgcgccgatactacaacgcatcaataaactaaacgcgctaaacgtcaaaaaataatcctcaccgacgataatccacgcgcaacgacgacaataccgaaaaactaaaactaaaatttaaaacgaacctataccgaaaaataaaatcaaaacgataaccgaactaaatcaacatacgccgctaacgataatcgataacgatattaacgacgcgccaacgataaaaactaccgccatcgaaattacaataaataacgacacaaacgtaacgctaaaaaccgccgacgcaacattaacccataaccacctacgcgacctaatacaaataattaaactaacacgcgccactcacgccaatatccgccaaaacatcactattacgctaaaactaaaaaaaatcttcctcgtcaccacgctattaaaaataaccgaattataactaacaatactaacaaatacgaaaacgacgatactaataacaacgaatacgtaaaatataacgcaaaaaataaaacaaaccgatcgcaacataaacgcgatcgatcccctcgcccctctaaaaaaaaaataaaataaaaaaacaaaaaacatcgaaaccaatcaacctatcaacgcttacgaatcaatacgataaacaacatcgttctacaacaatcgatcctaatacaaacca

SEQ ID NO: 7429 - DNA, 569 bp, Artificial Sequence
  chemically treated genomic DNA (Homo sapiens) CpG-island No: 7429
gcgtcgttgtttatcgtgattaggtgtaatacggcggttagtgttggaacgtggaattagtcgggtgacgtatggtatagttagaaagggattatggcgacgtggcggtagagtttggtggatatgtcgacgtgtggttgaagttattttcggaaatgtaataatattacggtgattttgcgtaattttgagtcgtatggcgttggatgttatagagcgtttgtaagttggtgggaggagagcgaggcgttggagtcggagtttcgttttattgaaatttcggtggtttacggtggtgtaggcggatcggattaggcggtggtcgcggcgtatgcgggtgagcgtaaaatagggtgatgaatgtatttttcgaggaatacgtggtaggttattaggtataatcgggattttcgattcgggagtagcggaatatataataagataggaacgcgaacggattaattttattaggtagtacgaacggatcgaaggttaaaaggggtattcgcgggaattcgagtgaggaattacgggtattataaaagggtatcggtatgaaatatattgcg

SEQ ID NO: 7430 - DNA, 569 bp, Artificial Sequence
  chemically treated genomic DNA (Homo sapiens) CpG-island No: 7430
cgcaatatatttcataccgatacccttttataatacccgtaattcctcactcgaattcccgcgaataccccttttaaccttcgatccgttcgtactacctaataaaattaatccgttcgcgttcctatcttattatatattccgctactcccgaatcgaaaatcccgattatacctaataacctaccacgtattcctcgaaaaatacattcatcaccctattttacgctcacccgcatacgccgcgaccaccgcctaatccgatccgcctacaccaccgtaaaccaccgaaatttcaataaaacgaaactccgactccaacgcctcgctctcctcccaccaacttacaaacgctctataacatccaacgccatacgactcaaaattacgcaaaatcaccgtaatattattacatttccgaaaataacttcaaccacacgtcgacatatccaccaaactctaccgccacgtcgccataatccctttctaactataccatacgtcacccgactaattccacgttccaacactaaccgccgtattacacctaatcacgataaacaacgacgc

SEQ ID NO: 7431 - DNA, 569 bp, Artificial Sequence
  chemically treated genomic DNA (Homo sapiens) CpG-island No: 7431
cgtaatatgttttatgtcggtatttttttgtggtgttcgtagttttttattcgggttttcgcgggtattttttttggttttcgattcgttcgtattgtttggtggagttagttcgttcgcgtttttgttttgttatgtgtttcgttattttcggatcgggaatttcggttgtatttggtgatttgttacgtatttttcgaggagtgtatttattattttgttttgcgtttattcgtatgcgtcgcgattatcgtttaattcggttcgtttgtattatcgtaaattatcggaattttaataaagcgagatttcggttttagcgtttcgttttttttttattagtttgtaaacgttttatggtatttagcgttatgcgatttaggattacgtaaaattatcgtgatattgttgtattttcgggaatggttttaattatacgtcggtatatttattagattttgtcgttacgtcgttatgatttttttttggttatgttatgcgttattcggttggttttacgttttagtattgatcgtcgtgttgtatttgattacgatgaataacggcgt

SEQ ID NO: 7432 - DNA, 569 bp, Artificial Sequence
  chemically treated genomic DNA (Homo sapiens) CpG-island No: 7432
acgccgttattcatcgtaatcaaatacaacacgacgatcaatactaaaacgtaaaaccaaccgaataacgcataacataaccaaaaaaaaatcataacgacgtaacgacaaaatctaataaatataccgacgtataattaaaaccattcccgaaaatacaacaatatcacgataattttacgtaatcctaaatcgcataacgctaaataccataaaacgtttacaaactaataaaaaaaaaacgaaacgctaaaaccgaaatctcgctttattaaaattccgataatttacgataatacaaacgaaccgaattaaacgataatcgcgacgcatacgaataaacgcaaaacaaaataataaatacactcctcgaaaaatacgtaacaaatcaccaaatacaaccgaaattcccgatccgaaaataacgaaacacataacaaaacaaaaacgcgaacgaactaactccaccaaacaatacgaacgaatcgaaaaccaaaaaaaatacccgcgaaaacccgaataaaaaactacgaacaccacaaaaaaataccgacataaaacatattacg

SEQ ID NO: 7433 - DNA, 550 bp, Artificial Sequence
  chemically treated genomic DNA (Homo sapiens) CpG-island No: 7433
tcggtgacgttggttagttagaaacggatttggcgattggcgtagcgtttggtggatatgtcgaatgtggttgaagttattttcggtatgaataatattacggtgattttgcgtaattttgagtcgttggcgttggatgttatagagcgttgtgtaaacgttggtgggaggagagcgaggcgttggagtcggagtttcgttttattgaaatttcggtggtttacggtggtgtagggcggatcggatttggcgggggtcgcggcgtattgcgggttgagcgaaaatagggttgttgattgtatttttacgtggaatacggggtcggattttaggttttattcgggttttcgtatttcgggagttgtcggataatataacggtagggcgttgaacggttatcgttcgaagtttgacggaatcggcggtcgtaacggggttaattagggtagtcgcgtgggggcgacgatggtattatatatacgagatatgcgagacggaagtatattgtatatatcgaaaaaatggcggtttaatagagggtgagaaatag

SEQ ID NO: 7434 - DNA, 550 bp, Artificial Sequence
  chemically treated genomic DNA (Homo sapiens) CpG-island No: 7434
ctatttctcaccctctattaaaccgccattttttcgatatatacaatatacttccgtctcgcatatctcgtatatataataccatcgtcgcccccacgcgactaccctaattaaccccgttacgaccgccgattccgtcaaacttcgaacgataaccgttcaacgccctaccgttatattatccgacaactcccgaaatacgaaaacccgaataaaacctaaaatccgaccccgtattccacgtaaaaatacaatcaacaaccctattttcgctcaacccgcaatacgccgcgacccccgccaaatccgatccgccctacaccaccgtaaaccaccgaaatttcaataaaacgaaactccgactccaacgcctcgctctcctcccaccaacgtttacacaacgctctataacatccaacgccaacgactcaaaattacgcaaaatcaccgtaatattattcataccgaaaataacttcaaccacattcgacatatccaccaaacgctacgccaatcgccaaatccgtttctaactaaccaacgtcaccga

SEQ ID NO: 7435 - DNA, 550 bp, Artificial Sequence
  chemically treated genomic DNA (Homo sapiens) CpG-island No: 7435
ttattttttattttttgttgaatcgttattttttcgatatatatagtgtgttttcgtttcgtatatttcgtgtgtgtggtgttatcgtcgtttttacgcggttgttttggttaatttcgttgcggtcgtcgatttcgttagatttcggacgatagtcgtttagcgttttgtcgttgtattgttcggtaattttcgagatacggaagttcgggtgagatttgaaattcgatttcgtattttacgtaggagtgtagttaataattttgttttcgtttaattcgtaatgcgtcgcgattttcgttaaattcggttcgttttgtattatcgtaaattatcggaattttaataaagcgagatttcggttttagcgtttcgttttttttttattagcgtttgtataacgttttatggtatttagcgttagcgatttaggattacgtaaaattatcgtgatattgtttatgtcgggaatggttttaattatattcggtatatttattagacgttgcgttagtcgttagattcgtttttggttagttagcgttatcgg

SEQ ID NO: 7436 - DNA, 550 bp, Artificial Sequence
  chemically treated genomic DNA (Homo sapiens) CpG-island No: 7436
ccgataacgctaactaaccaaaaacgaatctaacgactaacgcaacgtctaataaatataccgaatataattaaaaccattcccgacataaacaatatcacgataattttacgtaatcctaaatcgctaacgctaaataccataaaacgttatacaaacgctaataaaaaaaaaacgaaacgctaaaaccgaaatctcgctttattaaaattccgataatttacgataatacaaaacgaaccgaatttaacgaaaatcgcgacgcattacgaattaaacgaaaacaaaattattaactacactcctacgtaaaatacgaaatcgaatttcaaatctcacccgaacttccgtatctcgaaaattaccgaacaatacaacgacaaaacgctaaacgactatcgtccgaaatctaacgaaatcgacgaccgcaacgaaattaaccaaaacaaccgcgtaaaaacgacgataacaccacacacacgaaatatacgaaacgaaaacacactatatatatcgaaaaaataacgattcaacaaaaaataaaaaataa

SEQ ID NO: 7437 - DNA, 586 bp, Artificial Sequence
  chemically treated genomic DNA (Homo sapiens) CpG-island No: 7437
cgtcgttgtaatatatttataacgggtagggcgcgtttcgtgtttgggatttcgtattgtttgaagaagtagtgttggcgtttgaatatggttatgttatcgtagaattacgtattttgattatttgggaagcgtagttcggtgatttcgttaacggtgcgtaggtggttatcgattagtttattttttttggcgaatagaaatggggtcggatgtgtggtttggtgatgttgttgtcgtacggttacgaagggtaggggtcggagtatttttgtcgcgcgtttggaacgttatttgtaattttgtgttgagtaaaatatgtaggtttgcgtatcgtttatttcggtataggtttattatatgttgcgtcgttaggcgttgcgcgggatgcgtcgttcgttggtcgtgatgtcgtcgaaatttttgttgcgttattcgttggcggtttttagtttcgaagaattggcgaacggtatttttttgttagttatcggtgaaatcgacgagtttgattcgaagggcgtgaagcgcgtagtgatgtgttttggtaaggtttattacgatttgttggaatagcgtcgtaaga

SEQ ID NO: 7438 - DNA, 586 bp, Artificial Sequence
  chemically treated genomic DNA (Homo sapiens) CpG-island No: 7438
tcttacgacgctattccaacaaatcgtaataaaccttaccaaaacacatcactacgcgcttcacgcccttcgaatcaaactcgtcgatttcaccgataactaacaaaaaaataccgttcgccaattcttcgaaactaaaaaccgccaacgaataacgcaacaaaaatttcgacgacatcacgaccaacgaacgacgcatcccgcgcaacgcctaacgacgcaacatataataaacctataccgaaataaacgatacgcaaacctacatattttactcaacacaaaattacaaataacgttccaaacgcgcgacaaaaatactccgacccctacccttcgtaaccgtacgacaacaacatcaccaaaccacacatccgaccccatttctattcgccaaaaaaaataaactaatcgataaccacctacgcaccgttaacgaaatcaccgaactacgcttcccaaataatcaaaatacgtaattctacgataacataaccatattcaaacgccaacactacttcttcaaacaatacgaaatcccaaacacgaaacgcgccctacccgttataaatatattacaacgacg

SEQ ID NO: 7439 - DNA, 586 bp, Artificial Sequence
  chemically treated genomic DNA (Homo sapiens) CpG-island No: 7439
ttttacgacgttgttttagtaggtcgtaataaattttattagaatatattattacgcgttttacgtttttcggattaagttcgtcgattttatcgatggttggtaggaaggtgtcgttcgttagtttttcgaggttggaaatcgttagcggatgacgtagtagggatttcggcgatattacgattagcggacgacgtatttcgcgtagcgtttgacgacgtagtatgtggtaaatttgtgtcggggtagacggtacgtaaatttgtatgttttgtttagtataaagttgtagataacgttttagacgcgcggtaggagtgtttcggtttttgtttttcgtaatcgtgcggtagtaatattattagattatatattcggttttatttttgttcgttagaggagatgaattggtcgataattatttgcgtatcgttggcgaagttatcgaattgcgttttttagatggttagagtgcgtggttttgcggtggtataattatatttaaacgttagtattgtttttttagatagtacggagttttagatacggaacgcgttttgttcgttatggatatgttgtagcggcg

SEQ ID NO: 7440 - DNA, 586 bp, Artificial Sequence
  chemically treated genomic DNA (Homo sapiens) CpG-island No: 7440
cgccgctacaacatatccataacgaacaaaacgcgttccgtatctaaaactccgtactatctaaaaaaacaatactaacgtttaaatataattataccaccgcaaaaccacgcactctaaccatctaaaaaacgcaattcgataacttcgccaacgatacgcaaataattatcgaccaattcatctcctctaacgaacaaaaataaaaccgaatatataatctaataatattactaccgcacgattacgaaaaacaaaaaccgaaacactcctaccgcgcgtctaaaacgttatctacaactttatactaaacaaaacatacaaatttacgtaccgtctaccccgacacaaatttaccacatactacgtcgtcaaacgctacgcgaaatacgtcgtccgctaatcgtaatatcgccgaaatccctactacgtcatccgctaacgatttccaacctcgaaaaactaacgaacgacaccttcctaccaaccatcgataaaatcgacgaacttaatccgaaaaacgtaaaacgcgtaataatatattctaataaaatttattacgacctactaaaacaacgtcgtaaaa

SEQ ID NO: 7441 - DNA, 618 bp, Artificial Sequence
  chemically treated genomic DNA (Homo sapiens) CpG-island No: 7441
tattaacgcggtaaaattttgcgttagcgtattatgaaacgtttacgcgcgttgattaatcggtgtttgttagtttagttattgttgttagaaagtggcgagatttagttgattgtttattcgcggtattgttatcggatgcgttatttcgtggtatgaggttgcgagcgtttttagagtataagtcgttttatttttataatttaacgtggttggcgtatagtttagtgtcgtcgttattgtatcgaaaaaacgtttatacgatgacgttagcggcgcgttaattttacgtttaatggttcgcgttagtacgttttagttttgttgttgtatatttgttgttttagagtaattttgttatttcggtataaagcgtaggtattgcgttagtaggtttcgttacggttgtttcgttgttaaatcgttattcggaagcgttattgtaggtaagtcgtttaggtgtttatattcgcgatagtttattcgtaggtattcgtcgttttataaagcgtcgtttttttttatatcgatatcgtcgagcgttacgcgttttcgggagtaattttttttttgtttttgttaacgtaattttgcgagttgtacgtttaaatagttgaa

SEQ ID NO: 7442 - DNA, 618 bp, Artificial Sequence
  chemically treated genomic DNA (Homo sapiens) CpG-island No: 7442
ttcaactatttaaacgtacaactcgcaaaattacgttaacaaaaacaaaaaaaaaattactcccgaaaacgcgtaacgctcgacgatatcgatataaaaaaaaacgacgctttataaaacgacgaatacctacgaataaactatcgcgaatataaacacctaaacgacttacctacaataacgcttccgaataacgatttaacaacgaaacaaccgtaacgaaacctactaacgcaatacctacgctttataccgaaataacaaaattactctaaaacaacaaatatacaacaacaaaactaaaacgtactaacgcgaaccattaaacgtaaaattaacgcgccgctaacgtcatcgtataaacgttttttcgatacaataacgacgacactaaactatacgccaaccacgttaaattataaaaataaaacgacttatactctaaaaacgctcgcaacctcataccacgaaataacgcatccgataacaataccgcgaataaacaatcaactaaatctcgccactttctaacaacaataactaaactaacaaacaccgattaatcaacgcgcgtaaacgtttcataatacgctaacgcaaaattttaccgcgttaata

SEQ ID NO: 7443 - DNA, 618 bp, Artificial Sequence
  chemically treated genomic DNA (Homo sapiens) CpG-island No: 7443
tttaattatttgagcgtataattcgtaaggttacgttaataaaagtaggaaaaaggttgttttcggaggcgcgtgacgttcgacggtatcggtatgggggagaacggcgttttgtggggcggcgagtgtttgcgggtgaattatcgcgaatgtgagtatttgggcggtttgtttgtagtggcgttttcgggtggcgatttggtagcgaagtagtcgtggcgaaatttgttggcgtagtgtttgcgttttgtgtcggagtggtagaattattttgaaatagtaagtgtgtaatagtaaaattggagcgtgttggcgcgggttattgagcgtggaattaacgcgtcgttggcgttatcgtgtgggcgttttttcgatgtagtggcggcggtattgggttgtgcgttagttacgttaagttatgaaggtgaagcggtttgtgttttggaggcgttcgtagttttatgttacggagtgacgtattcggtgataatgtcgcgggtggataattaattggatttcgttattttttggtagtagtggttgaattggtaggtatcggttaattaacgcgcgtgggcgttttatgatgcgttggcgtagggttttgtcgcgttgatg

SEQ ID NO: 7444 - DNA, 618 bp, Artificial Sequence
  chemically treated genomic DNA (Homo sapiens) CpG-island No: 7444
catcaacgcgacaaaaccctacgccaacgcatcataaaacgcccacgcgcgttaattaaccgatacctaccaattcaaccactactaccaaaaaataacgaaatccaattaattatccacccgcgacattatcaccgaatacgtcactccgtaacataaaactacgaacgcctccaaaacacaaaccgcttcaccttcataacttaacgtaactaacgcacaacccaataccgccgccactacatcgaaaaaacgcccacacgataacgccaacgacgcgttaattccacgctcaataacccgcgccaacacgctccaattttactattacacacttactatttcaaaataattctaccactccgacacaaaacgcaaacactacgccaacaaatttcgccacgactacttcgctaccaaatcgccacccgaaaacgccactacaaacaaaccgcccaaatactcacattcgcgataattcacccgcaaacactcgccgccccacaaaacgccgttctcccccataccgataccgtcgaacgtcacgcgcctccgaaaacaacctttttcctacttttattaacgtaaccttacgaattatacgctcaaataattaaa

SEQ ID NO: 7445 - DNA, 637 bp, Artificial Sequence
  chemically treated genomic DNA (Homo sapiens) CpG-island No: 7445
cggtatcgaacgttcgcgcggtagcgtacgtcgttcgcgatcggaatcggaatgatgtcgacgtcgttttgcggtatcgtgtgcgtttgtttcgtgtcgagtagcgtttcgggtcgcgcgcgcgcgaggtttacggtgtcgtcgggttcgttcgcgtttacggcgggcggtgttttcgtgagcgcgagcgcgacgttcgcgaacgggttggtcgtatcgagcgcgattagcggcgcgattttcgcgcgaagcgtcgtgtcgttcggcgcgagcgcgcgcgtacgtacggcgacgacgagttcggtcggcgcgtgcgtgaggcgaaagcgttttgcgttgtcgggtaggacggggatgatcgttttgtcgatttggacggtgacgtgtagtttcgagggcgtgatttcggtcggcgtcgtgacgttgtttgcgacggagaagtcgtcgcggcggacgacggcgttcgcgtcgtcgatcgcggcgttcgcgcggtacgtttggacggcgatgcggtagtacgacggcgcgtttttttcgcgcgggacgagcgacgggtcgacgagttacgcgcgtgatatttgatcgtaatcgtgcggtataaaaaagatagatagagtgataatattcgtttgtattt

SEQ ID NO: 7446 - DNA, 637 bp, Artificial Sequence
  chemically treated genomic DNA (Homo sapiens) CpG-island No: 7446
aaatacaaacgaatattatcactctatctatcttttttataccgcacgattacgatcaaatatcacgcgcgtaactcgtcgacccgtcgctcgtcccgcgcgaaaaaaacgcgccgtcgtactaccgcatcgccgtccaaacgtaccgcgcgaacgccgcgatcgacgacgcgaacgccgtcgtccgccgcgacgacttctccgtcgcaaacaacgtcacgacgccgaccgaaatcacgccctcgaaactacacgtcaccgtccaaatcgacaaaacgatcatccccgtcctacccgacaacgcaaaacgctttcgcctcacgcacgcgccgaccgaactcgtcgtcgccgtacgtacgcgcgcgctcgcgccgaacgacacgacgcttcgcgcgaaaatcgcgccgctaatcgcgctcgatacgaccaacccgttcgcgaacgtcgcgctcgcgctcacgaaaacaccgcccgccgtaaacgcgaacgaacccgacgacaccgtaaacctcgcgcgcgcgcgacccgaaacgctactcgacacgaaacaaacgcacacgataccgcaaaacgacgtcgacatcattccgattccgatcgcgaacgacgtacgctaccgcgcgaacgttcgataccg

SEQ ID NO: 7447 - DNA, 637 bp, Artificial Sequence
  chemically treated genomic DNA (Homo sapiens) CpG-island No: 7447
agatgtagacgaatattattattttatttgttttttttatatcgtacgattgcgattagatgttacgcgcgtggttcgtcgattcgtcgttcgtttcgcgcggggagaacgcgtcgtcgtgttatcgtatcgtcgtttaggcgtatcgcgcgggcgtcgcggtcggcggcgcgagcgtcgtcgttcgtcgcggcgattttttcgtcgtaggtaacgttacggcgtcggtcggggttacgttttcggggttgtacgttatcgtttaagtcgataaggcgattattttcgttttgttcgatagcgtaggacgttttcgttttacgtacgcgtcggtcgggttcgtcgtcgtcgtgcgtgcgcgcgcgttcgcgtcggacggtacggcgtttcgcgcggagatcgcgtcgttggtcgcgttcgatgcggttaattcgttcgcgaacgtcgcgttcgcgtttacgaaggtatcgttcgtcgtagacgcgaacgagttcgacgatatcgtgagtttcgcgcgcgcgcggttcggggcgttgttcggtacggagtagacgtatacgatgtcgtaaggcgacgtcgatattatttcgatttcggtcgcgagcggcgtgcgttatcgcgcgagcgttcgatgtcg

SEQ ID NO: 7448 - DNA, 637 bp, Artificial Sequence
  chemically treated genomic DNA (Homo sapiens) CpG-island No: 7448
cgacatcgaacgctcgcgcgataacgcacgccgctcgcgaccgaaatcgaaataatatcgacgtcgccttacgacatcgtatacgtctactccgtaccgaacaacgccccgaaccgcgcgcgcgcgaaactcacgatatcgtcgaactcgttcgcgtctacgacgaacgataccttcgtaaacgcgaacgcgacgttcgcgaacgaattaaccgcatcgaacgcgaccaacgacgcgatctccgcgcgaaacgccgtaccgtccgacgcgaacgcgcgcgcacgcacgacgacgacgaacccgaccgacgcgtacgtaaaacgaaaacgtcctacgctatcgaacaaaacgaaaataatcgccttatcgacttaaacgataacgtacaaccccgaaaacgtaaccccgaccgacgccgtaacgttacctacgacgaaaaaatcgccgcgacgaacgacgacgctcgcgccgccgaccgcgacgcccgcgcgatacgcctaaacgacgatacgataacacgacgacgcgttctccccgcgcgaaacgaacgacgaatcgacgaaccacgcgcgtaacatctaatcgcaatcgtacgatataaaaaaaacaaataaaataataatattcgtctacatct

SEQ ID NO: 7449 - DNA, 727 bp, Artificial Sequence
  chemically treated genomic DNA (Homo sapiens) CpG-island No: 7449
tggtttgtcggtgacgcgtgcgtatgttgagcgggacgtgtcggggttgatacgcgaggtttcggtacgttaacgtcggtatgcgtattagacgcgtatacggggtttttgattttcgttgcggcgtttgcggttgagtattacgaagaatttattgattgacggcggtttagtgcgcggttgttaacggatcgatttggtacgtatcgacgttcgttggggacgtgtcgtttacgtcgttattgtagtattttcgattatattgcggtagtgttacggaatagtaaattatttgcgttgaagttatttattgcgtttgggcgttttgggttaaatcgcgttcggcgaagttgagcgagattattattttatatatatatgttttttacgcgtttgggtagaattaataatgacggggcgggaggcgatgatatttttacgtgaagtttgggtatgttgcgtaagcgagaacggattatggtgatgatgttatttcgtaatagttacggttcgcgtttacgttgcgaggtgggttttcggtgcgcgtcgggttacgtcggcgttagcgcgcgtttaatttgcgaatgcggggatattaggtattgtttttaagattcgaattagatatgaagtcgatttgtttcgattatagcgtatcgttattgtttgattggttaatttgtatttttataaaaagtggttattacgtattcgggtttattttaat

SEQ ID NO: 7450 - DNA, 727 bp, Artificial Sequence
  chemically treated genomic DNA (Homo sapiens) CpG-island No: 7450
attaaaataaacccgaatacgtaataaccactttttataaaaatacaaattaaccaatcaaacaataacgatacgctataatcgaaacaaatcgacttcatatctaattcgaatcttaaaaacaatacctaatatccccgcattcgcaaattaaacgcgcgctaacgccgacgtaacccgacgcgcaccgaaaacccacctcgcaacgtaaacgcgaaccgtaactattacgaaataacatcatcaccataatccgttctcgcttacgcaacatacccaaacttcacgtaaaaatatcatcgcctcccgccccgtcattattaattctacccaaacgcgtaaaaaacatatatatataaaataataatctcgctcaacttcgccgaacgcgatttaacccaaaacgcccaaacgcaataaataacttcaacgcaaataatttactattccgtaacactaccgcaatataatcgaaaatactacaataacgacgtaaacgacacgtccccaacgaacgtcgatacgtaccaaatcgatccgttaacaaccgcgcactaaaccgccgtcaatcaataaattcttcgtaatactcaaccgcaaacgccgcaacgaaaatcaaaaaccccgtatacgcgtctaatacgcataccgacgttaacgtaccgaaacctcgcgtatcaaccccgacacgtcccgctcaacatacgcacgcgtcaccgacaaacca

SEQ ID NO: 7451 - DNA, 727 bp, Artificial Sequence
  chemically treated genomic DNA (Homo sapiens) CpG-island No: 7451
gttgaggtaaattcgggtacgtgatgattattttttgtgaaggtataggttagttagttaggtagtaacgatgcgttataatcgggataggtcggttttatgtttggttcgggttttgggggtagtatttggtgttttcgtattcgtaagttgggcgcgcgttggcgtcggcgtagttcggcgcgtatcgaaggtttatttcgtagcgtagacgcgggtcgtggttgttgcggggtggtattattattataattcgttttcgtttgcgtaatatgtttaagttttacgtgggggtattatcgtttttcgtttcgttattattggttttgtttaagcgcgtgaagggtatgtgtatgtagggtaatggtttcgtttagtttcgtcgggcgcggtttggtttagaacgtttaggcgtaataggtggttttagcgtaaatggtttgttgtttcgtggtattgtcgtagtatggtcgggggtgttgtagtagcggcgtgggcggtacgtttttaacgggcgtcggtacgtgttaggtcggttcgttggtagtcgcgtattgggtcgtcgttagttaatgagtttttcgtggtatttagtcgtaggcgtcgtagcgggggttaggggtttcgtgtgcgcgtttggtacgtatgtcggcgttggcgtatcggggtttcgcgtgttagtttcggtacgtttcgtttagtatgcgtacgcgttatcggtaggtta

SEQ ID NO: 7452 - DNA, 727 bp, Artificial Sequence
  chemically treated genomic DNA (Homo sapiens) CpG-island No: 7452
taacctaccgataacgcgtacgcatactaaacgaaacgtaccgaaactaacacgcgaaaccccgatacgccaacgccgacatacgtaccaaacgcgcacacgaaacccctaacccccgctacgacgcctacgactaaataccacgaaaaactcattaactaacgacgacccaatacgcgactaccaacgaaccgacctaacacgtaccgacgcccgttaaaaacgtaccgcccacgccgctactacaacacccccgaccatactacgacaataccacgaaacaacaaaccatttacgctaaaaccacctattacgcctaaacgttctaaaccaaaccgcgcccgacgaaactaaacgaaaccattaccctacatacacatacccttcacgcgcttaaacaaaaccaataataacgaaacgaaaaacgataatacccccacgtaaaacttaaacatattacgcaaacgaaaacgaattataataataataccaccccgcaacaaccacgacccgcgtctacgctacgaaataaaccttcgatacgcgccgaactacgccgacgccaacgcgcgcccaacttacgaatacgaaaacaccaaatactacccccaaaacccgaaccaaacataaaaccgacctatcccgattataacgcatcgttactacctaactaactaacctataccttcacaaaaaataatcatcacgtacccgaatttacctcaac

SEQ ID NO: 7453 - DNA, 500 bp, Artificial Sequence
  chemically treated genomic DNA (Homo sapiens) CpG-island No: 7453
tacggtcgcgaatatttgaattgtaatgtttatttacgtgcgcgggcgtattttatgggggggggggggggggggcgcggggcgggaaattaaatcggttgtacgtttataaataggggtggtaaggtcgtaaatcgaaaaataaaaataggtggtgtttcgtttggcgggagaagaagttttgtttgggtggtagcgcgttaaagtaaaaacgtcgacgacgtatacgtgttgtttatcgggcgaagggttgttgttcgcgggaagtatttgcggggaaggtaaggcgttataaagagtatggacgattttaagttatgcggttcgaagggtgtttgggtatgtattatcgttgattaaaattttcgcgtttattacgtacgaatcgtgatttttcgcgcgcgtgattgatgtcgtgtttgatgtaggataattattttagtagtaatatagtgaattggatgataattgcggttcgatcgcgaagtaaatgagaagtg

SEQ ID NO: 7454 - DNA, 500 bp, Artificial Sequence
  chemically treated genomic DNA (Homo sapiens) CpG-island No: 7454
cacttctcatttacttcgcgatcgaaccgcaattatcatccaattcactatattactactaaaataattatcctacatcaaacacgacatcaatcacgcgcgcgaaaaatcacgattcgtacgtaataaacgcgaaaattttaatcaacgataatacatacccaaacacccttcgaaccgcataacttaaaatcgtccatactctttataacgccttaccttccccgcaaatacttcccgcgaacaacaacccttcgcccgataaacaacacgtatacgtcgtcgacgtttttactttaacgcgctaccacccaaacaaaacttcttctcccgccaaacgaaacaccacctatttttatttttcgatttacgaccttaccacccctatttataaacgtacaaccgatttaatttcccgccccgcgcccccccccccccccccccataaaatacgcccgcgcacgtaaataaacattacaattcaaatattcgcgaccgta

SEQ ID NO: 7455 - DNA, 500 bp, Artificial Sequence
  chemically treated genomic DNA (Homo sapiens) CpG-island No: 7455
tattttttatttatttcgcggtcgggtcgtaattattatttagtttattgtgttgttgttaaggtaattgttttgtattaagtacggtattagttacgcgcgcggggggttacggttcgtacgtggtaagcgcgggggttttggttagcggtagtgtatgtttaagtatttttcgagtcgtatggtttaaggtcgtttatattttttgtggcgttttatttttttcgtaggtgtttttcgcgggtagtagtttttcgttcggtgggtagtacgtatacgtcgtcggcgtttttgttttagcgcgttattatttaggtagggttttttttttcgttaagcggggtattatttgtttttatttttcggtttgcggttttgttatttttgtttatggacgtgtagtcggtttggtttttcgtttcgcgtttttttttttttttttttatagaatacgttcgcgtacgtgggtaagtattatagtttaagtgttcgcgatcgtg

SEQ ID NO: 7456 - DNA, 500 bp, Artificial Sequence
  chemically treated genomic DNA (Homo sapiens) CpG-island No: 7456
cacgatcgcgaacacttaaactataatacttacccacgtacgcgaacgtattctataaaaaaaaaaaaaaaaaaacgcgaaacgaaaaaccaaaccgactacacgtccataaacaaaaataacaaaaccgcaaaccgaaaaataaaaacaaataataccccgcttaacgaaaaaaaaaaccctacctaaataataacgcgctaaaacaaaaacgccgacgacgtatacgtactacccaccgaacgaaaaactactacccgcgaaaaacacctacgaaaaaaataaaacgccacaaaaaatataaacgaccttaaaccatacgactcgaaaaatacttaaacatacactaccgctaaccaaaacccccgcgcttaccacgtacgaaccgtaaccccccgcgcgcgtaactaataccgtacttaatacaaaacaattaccttaacaacaacacaataaactaaataataattacgacccgaccgcgaaataaataaaaaata

SEQ ID NO: 7457 - DNA, 520 bp, Artificial Sequence
  chemically treated genomic DNA (Homo sapiens) CpG-island No: 7457
tcgtcgttcgtcgtttcggtttttttatcgttatcgtcgtcgttttcgtgttggtcgtcggcgttgttagttttgagtcgtttaggggttcggtcgtttttattgtcgtcgtcgtagtagcggttatcgtcgttttcgtcgttcgtcgtcgttatttttattatcgttttcgatcgttttcgttgttcgttcggttgttgtttttgttttagtcgtcgacgtcgttttttcgttcggggtagtagttttcgcgatatggcggcgtagaattcgttttttttcgttttttattgggggagggatacgttcgttattcgtcgtttttattcgatagggggagttattggtttcgtcgcggggggagggtaggtcgttatacgttttgcgcgtttattggatattgtttacgtcgttttgtaggagggttcgtttttgtttgtttgagatattttttataggtggtcgttttttgttagttttttcgtcgatttcgtcgttttaaaataaaatttaatttgat

SEQ ID NO: 7458 - DNA, 520 bp, Artificial Sequence
  chemically treated genomic DNA (Homo sapiens) CpG-island No: 7458
atcaaattaaattttattttaaaacgacgaaatcgacgaaaaaactaacaaaaaacgaccacctataaaaaatatctcaaacaaacaaaaacgaaccctcctacaaaacgacgtaaacaatatccaataaacgcgcaaaacgtataacgacctaccctccccccgcgacgaaaccaataactccccctatcgaataaaaacgacgaataacgaacgtatccctcccccaataaaaaacgaaaaaaaacgaattctacgccgccatatcgcgaaaactactaccccgaacgaaaaaacgacgtcgacgactaaaacaaaaacaacaaccgaacgaacaacgaaaacgatcgaaaacgataataaaaataacgacgacgaacgacgaaaacgacgataaccgctactacgacgacgacaataaaaacgaccgaacccctaaacgactcaaaactaacaacgccgacgaccaacacgaaaacgacgacgataacgataaaaaaaccgaaacgacgaacgacga

SEQ ID NO: 7459 - DNA, 520 bp, Artificial Sequence
  chemically treated genomic DNA (Homo sapiens) CpG-island No: 7459
attaaattggattttattttaaggcggcggggtcgacggaaagattggtagaaagcgattatttataaggagtgttttagataaataagggcgggtttttttgtagaacggcgtgggtaatgtttaataagcgcgtaaggcgtgtggcggtttatttttttttcgcggcgggattagtggttttttttatcgggtgggggcggcgggtgacgggcgtgttttttttttaatgagaggcggggggaggcgggttttgcgtcgttatgtcgcggaggttgttgtttcgggcggagaagcggcgtcggcggttggagtagaggtagtagtcggacgagtagcggaggcggtcgggagcgatggtgaagatggcggcggcgggcggcggaggcggcggtggtcgttattacggcggcggtagtgagggcggtcgggtttttaagcggtttaagattgataacgtcggcgattagtacggaggcggcggcggtggcggtggaggagtcggggcggcgggcggcgg

SEQ ID NO: 7460 - DNA, 520 bp, Artificial Sequence
  chemically treated genomic DNA (Homo sapiens) CpG-island No: 7460
ccgccgcccgccgccccgactcctccaccgccaccgccgccgcctccgtactaatcgccgacgttatcaatcttaaaccgcttaaaaacccgaccgccctcactaccgccgccgtaataacgaccaccgccgcctccgccgcccgccgccgccatcttcaccatcgctcccgaccgcctccgctactcgtccgactactacctctactccaaccgccgacgccgcttctccgcccgaaacaacaacctccgcgacataacgacgcaaaacccgcctccccccgcctctcattaaaaaaaaaacacgcccgtcacccgccgcccccacccgataaaaaaaaccactaatcccgccgcgaaaaaaaaataaaccgccacacgccttacgcgcttattaaacattacccacgccgttctacaaaaaaacccgcccttatttatctaaaacactccttataaataatcgctttctaccaatctttccgtcgaccccgccgccttaaaataaaatccaatttaat

SEQ ID NO: 7461 - DNA, 594 bp, Artificial Sequence
  chemically treated genomic DNA (Homo sapiens) CpG-island No: 7461
ggcggggtcgtttcggtggtggtggtcggtggttgtttgaagacgttcgtttgtagcgtaggcgcggggaagttcgatagtattacgttttggttcgtttttttcgtcgttatgaacgttaggttttgcggggttttgggttgttgcgggagcgttttcggttcgttttggatggtgagcgtggcgttcgcgggcgtaaacggtttgggcgttagttggtagagtttgggcggtagtattttcgcgggtttgggttggatgggcgtgggtgtgcgatgtaggattacgttgggcgtcgggattagtggcgacgagtcgaggtttggggttatcgttagcggttgtttcgagggcgtttcggtgggagtcgaggcggttttcgcgttttcgaatatagagtttttattgagcgtggtggttatagcggtcgagaggtttttttggatgattaggttagttttttgtggcgagatatcggtcgacgttagcgttacgggtttcgaggggttagtcgtcgaggttaggtagtcgttgacgggtatttgtttggttaggagttgggaggtgggcgtgttgagcgttatgacgggttgg

SEQ ID NO: 7462 - DNA, 594 bp, Artificial Sequence
  chemically treated genomic DNA (Homo sapiens) CpG-island No: 7462
ccaacccgtcataacgctcaacacgcccacctcccaactcctaaccaaacaaatacccgtcaacgactacctaacctcgacgactaacccctcgaaacccgtaacgctaacgtcgaccgatatctcgccacaaaaaactaacctaatcatccaaaaaaacctctcgaccgctataaccaccacgctcaataaaaactctatattcgaaaacgcgaaaaccgcctcgactcccaccgaaacgccctcgaaacaaccgctaacgataaccccaaacctcgactcgtcgccactaatcccgacgcccaacgtaatcctacatcgcacacccacgcccatccaacccaaacccgcgaaaatactaccgcccaaactctaccaactaacgcccaaaccgtttacgcccgcgaacgccacgctcaccatccaaaacgaaccgaaaacgctcccgcaacaacccaaaaccccgcaaaacctaacgttcataacgacgaaaaaaacgaaccaaaacgtaatactatcgaacttccccgcgcctacgctacaaacgaacgtcttcaaacaaccaccgaccaccaccaccgaaacgaccccgcc

SEQ ID NO: 7463 - DNA, 594 bp, Artificial Sequence
  chemically treated genomic DNA (Homo sapiens) CpG-island No: 7463
ttagttcgttatggcgtttaatacgtttattttttagtttttggttaagtaggtgttcgttagcggttatttggtttcggcggttggtttttcggagttcgtgacgttggcgtcggtcggtgtttcgttatagggggttggtttggttatttagaagaatttttcggtcgttgtggttattacgtttaatgggaattttgtgttcggaggcgcgggggtcgtttcggtttttatcgggacgttttcgggatagtcgttggcggtggttttaggtttcggttcgtcgttattggtttcggcgtttaacgtgattttgtatcgtatatttacgtttatttagtttaagttcgcgggggtgttgtcgtttaagttttattagttgacgtttaagtcgtttgcgttcgcgggcgttacgtttattatttagggcgagtcgggggcgttttcgtagtagtttaaggtttcgtagaatttgacgtttatggcggcggggaaggcgggttagaacgtggtgttgtcgggttttttcgcgtttgcgttgtaagcgaacgtttttaagtagttatcggttattattatcggagcggtttcgtt

SEQ ID NO: 7464 - DNA, 594 bp, Artificial Sequence
  chemically treated genomic DNA (Homo sapiens) CpG-island No: 7464
aacgaaaccgctccgataataataaccgataactacttaaaaacgttcgcttacaacgcaaacgcgaaaaaacccgacaacaccacgttctaacccgccttccccgccgccataaacgtcaaattctacgaaaccttaaactactacgaaaacgcccccgactcgccctaaataataaacgtaacgcccgcgaacgcaaacgacttaaacgtcaactaataaaacttaaacgacaacacccccgcgaacttaaactaaataaacgtaaatatacgatacaaaatcacgttaaacgccgaaaccaataacgacgaaccgaaacctaaaaccaccgccaacgactatcccgaaaacgtcccgataaaaaccgaaacgacccccgcgcctccgaacacaaaattcccattaaacgtaataaccacaacgaccgaaaaattcttctaaataaccaaaccaaccccctataacgaaacaccgaccgacgccaacgtcacgaactccgaaaaaccaaccgccgaaaccaaataaccgctaacgaacacctacttaaccaaaaactaaaaaataaacgtattaaacgccataacgaactaa

SEQ ID NO: 7465 - DNA, 911 bp, Artificial Sequence
  chemically treated genomic DNA (Homo sapiens) CpG-island No: 7465
ttggtattttatatttggcgtaacgcggagtacgtttacgcgtacgtacgcgtgacgatttaacgtaacgttcgtattaaggttaacgttttattttagggtttttttttcgggtaatcggggaacggattttcgcgtttttttattcgtcgtttacgacgattggggacgacgatcgcgagcgttttatttgatttacgacgtgtacgtacgcgtgcgttacggttttcgttcgcgttttatacgtgtttaggacgattttacgcggattcgacggttatatttcgacgttgggtttttacgcgggatttataattatattgcgtattacgattgattacggatacgcgattggttggcgcggttgttgttgattgattgcgggatacgattgatcggttgatttcgatttattacggtatacgcgattcgttttcgataacggatttattggtacgaacgtattttttcgggttattacgttcgggattgtcggtaacgcgattcgattggacgaacggatcgattcgcggaacgattcgattggacgaacggattgtttgcggaacggatcgattcggcggacgcgattgattgcggaacgtttttcgattgttaacgcgattgattgcggtacggattgattgcgcgaacggattgattgcggatcggattgattgtggatacggattgattggaggatacggattgattgtggatacggattgattgggatacggattgattgaggatacgggtgattggacgatacgggtgattaggatacggattgattggaggatacggttgattggagatcggattgattgggatacggattgatatggggtacggtatgtttggagataaggacgtttgaatatacgagtcgttaggagtaataggtagat

SEQ ID NO: 7466 - DNA, 911 bp, Artificial Sequence
  chemically treated genomic DNA (Homo sapiens) CpG-island No: 7466
atctacctattactcctaacgactcgtatattcaaacgtccttatctccaaacataccgtaccccatatcaatccgtatcccaatcaatccgatctccaatcaaccgtatcctccaatcaatccgtatcctaatcacccgtatcgtccaatcacccgtatcctcaatcaatccgtatcccaatcaatccgtatccacaatcaatccgtatcctccaatcaatccgtatccacaatcaatccgatccgcaatcaatccgttcgcgcaatcaatccgtaccgcaatcaatcgcgttaacaatcgaaaaacgttccgcaatcaatcgcgtccgccgaatcgatccgttccgcaaacaatccgttcgtccaatcgaatcgttccgcgaatcgatccgttcgtccaatcgaatcgcgttaccgacaatcccgaacgtaataacccgaaaaaatacgttcgtaccaataaatccgttatcgaaaacgaatcgcgtataccgtaataaatcgaaatcaaccgatcaatcgtatcccgcaatcaatcaacaacaaccgcgccaaccaatcgcgtatccgtaatcaatcgtaatacgcaatataattataaatcccgcgtaaaaacccaacgtcgaaatataaccgtcgaatccgcgtaaaatcgtcctaaacacgtataaaacgcgaacgaaaaccgtaacgcacgcgtacgtacacgtcgtaaatcaaataaaacgctcgcgatcgtcgtccccaatcgtcgtaaacgacgaataaaaaaacgcgaaaatccgttccccgattacccgaaaaaaaaaccctaaaataaaacgttaaccttaatacgaacgttacgttaaatcgtcacgcgtacgtacgcgtaaacgtactccgcgttacgccaaatataaaataccaa

SEQ ID NO: 7467 - DNA, 911 bp, Artificial Sequence
  chemically treated genomic DNA (Homo sapiens) CpG-island No: 7467
gtttgtttgttgtttttggcggttcgtgtgtttaggcgtttttgtttttaggtatgtcgtgttttatgttagttcgtgttttagttagttcggtttttagttaatcgtgttttttagttagttcgtgttttagttattcgtgtcgtttagttattcgtgtttttagttagttcgtgttttagttagttcgtgtttatagttagttcgtgttttttagttagttcgtgtttatagttagttcggttcgtagttagttcgttcgcgtagttagttcgtgtcgtagttagtcgcgttggtagtcggagggcgtttcgtagttagtcgcgttcgtcgagtcggttcgtttcgtaggtagttcgttcgtttagtcgagtcgtttcgcgagtcgattcgttcgtttagtcgagtcgcgttgtcggtagtttcgagcgtagtggttcgagggagtgcgttcgtgttagtgagttcgttgtcggaggcgagtcgcgtgtgtcgtagtggatcggggttagtcggttagtcgtgtttcgtagttagttagtagtagtcgcgttagttagtcgcgtgttcgtagttagtcgtggtgcgtagtgtggttgtgagtttcgcgtagggatttagcgtcggggtgtgatcgtcgagttcgcgtggggtcgttttgggtacgtgtgggacgcgagcgagggtcgtggcgtacgcgtgcgtgtacgtcgtgggttaggtgggacgttcgcggtcgtcgtttttagtcgtcgtgggcggcgggtgaaagagcgcgaaggttcgtttttcggttgttcgagggaggggttttggaatggagcgttggttttggtgcgagcgttgcgttgggtcgttacgcgtgcgtgcgcgtgggcgtgtttcgcgttgcgttaggtgtggggtgttag

SEQ ID NO: 7468 - DNA, 911 bp, Artificial Sequence
  chemically treated genomic DNA (Homo sapiens) CpG-island No: 7468
ctaacaccccacacctaacgcaacgcgaaacacgcccacgcgcacgcacgcgtaacgacccaacgcaacgctcgcaccaaaaccaacgctccattccaaaacccctccctcgaacaaccgaaaaacgaaccttcgcgctctttcacccgccgcccacgacgactaaaaacgacgaccgcgaacgtcccacctaacccacgacgtacacgcacgcgtacgccacgaccctcgctcgcgtcccacacgtacccaaaacgaccccacgcgaactcgacgatcacaccccgacgctaaatccctacgcgaaactcacaaccacactacgcaccacgactaactacgaacacgcgactaactaacgcgactactactaactaactacgaaacacgactaaccgactaaccccgatccactacgacacacgcgactcgcctccgacaacgaactcactaacacgaacgcactccctcgaaccactacgctcgaaactaccgacaacgcgactcgactaaacgaacgaatcgactcgcgaaacgactcgactaaacgaacgaactacctacgaaacgaaccgactcgacgaacgcgactaactacgaaacgccctccgactaccaacgcgactaactacgacacgaactaactacgcgaacgaactaactacgaaccgaactaactataaacacgaactaactaaaaaacacgaactaactataaacacgaactaactaaaacacgaactaactaaaaacacgaataactaaacgacacgaataactaaaacacgaactaactaaaaaacacgattaactaaaaaccgaactaactaaaacacgaactaacataaaacacgacatacctaaaaacaaaaacgcctaaacacacgaaccgccaaaaacaacaaacaaac

SEQ ID NO: 7469 - DNA, 806 bp, Artificial Sequence
  chemically treated genomic DNA (Homo sapiens) CpG-island No: 7469
tcggtttggtttatgcgtattcgttttcgtttttttgcgtataattcgattcggatgtcgagtcgtatttggcgcgatgtgggtacgttggaaattttatggaaagcgaatttcgatttggttttattcgcgtgttatgtatgtttgtaggtttatcgttgttattgttagtagtaaggttagaagcgtcgaaagtagtaggaattgttgcgagcgttttatcgatcgttttagcgcgttttcgttttgttttagatcgtattagcgttgttcgggtttaagttgaggtaataattattttttatagtcgtcgagttggttttcgttgtcgtcgaatttataacgttaggtgattcgatttttcggttgtacggtttcggttttatcgatattcgttagatttattattagacgcggagttatttggaaggggttaaaatcggaattcggtttttgaattattttttcggtaattcgtaaggtggtatcgtttacgttaatggtgtcgttcgtttttaggttaagtagtgttattaggcgtggggttagtaatacgttgttcgtttgcggttttaggttagggggattagtttgtagatcgttatatatcgggtagatattatttatcgttttgacgttcgttagttgcggtgtgtcgtttgtaaaggttattgtggtaaaagttagttgtttgtcgatttttaggtcgcgtttttgcgttttttttagttacgtttgcgaaaagtataatggttattgcgtttattcgtttaattttataattcggaagatgttttattttagag

SEQ ID NO: 7470 - DNA, 806 bp, Artificial Sequence
  chemically treated genomic DNA (Homo sapiens) CpG-island No: 7470
ctctaaaataaaacatcttccgaattataaaattaaacgaataaacgcaataaccattatacttttcgcaaacgtaactaaaaaaaacgcaaaaacgcgacctaaaaatcgacaaacaactaacttttaccacaataacctttacaaacgacacaccgcaactaacgaacgtcaaaacgataaataatatctacccgatatataacgatctacaaactaatccccctaacctaaaaccgcaaacgaacaacgtattactaaccccacgcctaataacactacttaacctaaaaacgaacgacaccattaacgtaaacgataccaccttacgaattaccgaaaaaataattcaaaaaccgaattccgattttaaccccttccaaataactccgcgtctaataataaatctaacgaatatcgataaaaccgaaaccgtacaaccgaaaaatcgaatcacctaacgttataaattcgacgacaacgaaaaccaactcgacgactataaaaaataattattacctcaacttaaacccgaacaacgctaatacgatctaaaacaaaacgaaaacgcgctaaaacgatcgataaaacgctcgcaacaattcctactactttcgacgcttctaaccttactactaacaataacaacgataaacctacaaacatacataacacgcgaataaaaccaaatcgaaattcgctttccataaaatttccaacgtacccacatcgcgccaaatacgactcgacatccgaatcgaattatacgcaaaaaaacgaaaacgaatacgcataaaccaaaccga

SEQ ID NO: 7471 - DNA, 806 bp, Artificial Sequence
  chemically treated genomic DNA (Homo sapiens) CpG-island No: 7471
ttttgaagtgaaatatttttcgggttgtgaggttaagcgaataagcgtaatgattattgtgtttttcgtaagcgtggttggaggaagcgtaaaagcgcggtttgaaagtcggtaagtagttgatttttgttataatgatttttgtaggcgatatatcgtagttggcgaacgttaaagcggtggatgatatttattcgatgtatggcgatttgtaaattaatttttttggtttgaaatcgtaggcgggtagcgtattgttggttttacgtttgatggtattgtttaatttgaaaacgggcgatattattgacgtgggcgatgttattttgcggattgtcggagaagtgatttaggaatcggatttcggttttaattttttttagatggtttcgcgtttgatgatgaatttggcggatgtcgataaaatcggagtcgtgtagtcggggagtcgggttatttggcgttataaattcggcggtaacgagaattagttcgacggttatgagaaatggttgttattttagtttaaattcgaataacgttggtacggtttggaataggacgaaggcgcgttggggcgatcgatggaacgttcgtaatagtttttgttgttttcggcgtttttgattttgttgttggtagtggtagcggtggatttgtaggtatgtatgatacgcggataaggttagatcgaggttcgttttttataaagtttttagcgtatttatatcgcgttaagtacggttcggtattcgggtcggattgtacgtaagagagcgggaacgggtgcgtataggttagatcgg

SEQ ID NO: 7472 - DNA, 806 bp, Artificial Sequence
  chemically treated genomic DNA (Homo sapiens) CpG-island No: 7472
ccgatctaacctatacgcacccgttcccgctctcttacgtacaatccgacccgaataccgaaccgtacttaacgcgatataaatacgctaaaaactttataaaaaacgaacctcgatctaaccttatccgcgtatcatacatacctacaaatccaccgctaccactaccaacaacaaaatcaaaaacgccgaaaacaacaaaaactattacgaacgttccatcgatcgccccaacgcgccttcgtcctattccaaaccgtaccaacgttattcgaatttaaactaaaataacaaccatttctcataaccgtcgaactaattctcgttaccgccgaatttataacgccaaataacccgactccccgactacacgactccgattttatcgacatccgccaaattcatcatcaaacgcgaaaccatctaaaaaaaattaaaaccgaaatccgattcctaaatcacttctccgacaatccgcaaaataacatcgcccacgtcaataatatcgcccgttttcaaattaaacaataccatcaaacgtaaaaccaacaatacgctacccgcctacgatttcaaaccaaaaaaattaatttacaaatcgccatacatcgaataaatatcatccaccgctttaacgttcgccaactacgatatatcgcctacaaaaatcattataacaaaaatcaactacttaccgactttcaaaccgcgcttttacgcttcctccaaccacgcttacgaaaaacacaataatcattacgcttattcgcttaacctcacaacccgaaaaatatttcacttcaaaa

SEQ ID NO: 7473 - DNA, 872 bp, Artificial Sequence
  chemically treated genomic DNA (Homo sapiens) CpG-island No: 7473
ttgacgcgttgcgcgagaagattgtgtatcgtcgttttataggtttcgacgtcgtttcgttttattatcgatattattacgttggtatttagttgatcggcgcgagatttaatcgtcgtttgatgtaaatgcgtcgttaggaagtcgttgcgtcggaagatgtttggcgtgatattattaatgtttggtaattacgtatacgttaattggtttgtttgtaattgttagtcgattggcgattgcgtaaggcgcgagagcgcgatttggcggtgaattttgtcgtgcgtgaagagtatttgtgggcggtagcgcgttatatgtcgggaagtttaggcgaattggatagtttgggtttattcggtagcgaaattcgtttttacggtaaaacgttgtttgcgttggtggaaaaagcgtaaaaattgtcggaagatgttttacggtatcgatgtttaattgatggatatgcggggttatgcgttatgatgtaaagtattcggtcgatgcgtagttgaaagtcgtattgatttagtcgttaaatgtattgcgggaatgggtagtaaatcgtttagaattgtaggcgttatgtacgtaatatggcgagttggcgtaggtaggaatataacgattgttgtcggggtcgacgggtgaacgtaatatttggacgttgttgtcgcgtgagcgcgtgttgtgtattgtcgatgatgagtaggatgcgttgatttagttcgtcgtcgtgttggcggtgggtagttaggtattgtggtcggatgacgcgttgtatcgttagttagtgaaggtattgttatcggtagttagcgaacgtatttaattggcgaaagcggaaaatataatcgtttaatcgtttgatgcgg

SEQ ID NO: 7474 - DNA, 872 bp, Artificial Sequence
  chemically treated genomic DNA (Homo sapiens) CpG-island No: 7474
ccgcatcaaacgattaaacgattatattttccgctttcgccaattaaatacgttcgctaactaccgataacaataccttcactaactaacgatacaacgcgtcatccgaccacaatacctaactacccaccgccaacacgacgacgaactaaatcaacgcatcctactcatcatcgacaatacacaacacgcgctcacgcgacaacaacgtccaaatattacgttcacccgtcgaccccgacaacaatcgttatattcctacctacgccaactcgccatattacgtacataacgcctacaattctaaacgatttactacccattcccgcaatacatttaacgactaaatcaatacgactttcaactacgcatcgaccgaatactttacatcataacgcataaccccgcatatccatcaattaaacatcgataccgtaaaacatcttccgacaatttttacgctttttccaccaacgcaaacaacgttttaccgtaaaaacgaatttcgctaccgaataaacccaaactatccaattcgcctaaacttcccgacatataacgcgctaccgcccacaaatactcttcacgcacgacaaaattcaccgccaaatcgcgctctcgcgccttacgcaatcgccaatcgactaacaattacaaacaaaccaattaacgtatacgtaattaccaaacattaataatatcacgccaaacatcttccgacgcaacgacttcctaacgacgcatttacatcaaacgacgattaaatctcgcgccgatcaactaaataccaacgtaataatatcgataataaaacgaaacgacgtcgaaacctataaaacgacgatacacaatcttctcgcgcaacgcgtcaa

SEQ ID NO: 7475 - DNA, 872 bp, Artificial Sequence
  chemically treated genomic DNA (Homo sapiens) CpG-island No: 7475
tcgtattaaacggttgagcggttatatttttcgttttcgttagttgaatacgttcgttgattgtcgatggtaatgtttttattaattgacgatgtagcgcgttattcggttatagtatttggttgtttatcgttagtacggcggcgagttgagttagcgtattttgtttattatcggtaatatataatacgcgtttacgcggtagtagcgtttaggtgttgcgtttattcgtcggtttcggtagtaatcgttgtgtttttgtttgcgttagttcgttatattgcgtatataacgtttgtaattttggacgatttgttgtttattttcgtagtgtatttagcggttgagttaatgcggtttttaattgcgtatcgatcggatattttgtattatgacgtataatttcgtatgtttattagttaagtatcggtgtcgtaaggtatttttcggtaatttttgcgttttttttattagcgtaagtagcgttttatcgtgaaagcggatttcgttatcggataaatttaggttgtttagttcgtttaaatttttcggtatataacgcgttatcgtttataaatgttttttacgtacgataaagtttatcgttagatcgcgttttcgcgttttgcgtagtcgttagtcggttaatagttgtagataggttagttggcgtgtgcgtaattgttaggtattggtgatattacgttaggtatttttcggcgtaacgattttttgacgacgtatttgtattaggcggcgattaaatttcgcgtcgattaattgggtgttagcgtggtggtgtcgatggtagaacgaagcggcgtcgaagtttgtaaagcggcggtgtataattttttcgcgtaacgcgttag

SEQ ID NO: 7476 - DNA, 872 bp, Artificial Sequence
  chemically treated genomic DNA (Homo sapiens) CpG-island No: 7476
ctaacgcgttacgcgaaaaaattatacaccgccgctttacaaacttcgacgccgcttcgttctaccatcgacaccaccacgctaacacccaattaatcgacgcgaaatttaatcgccgcctaatacaaatacgtcgtcaaaaaatcgttacgccgaaaaatacctaacgtaatatcaccaatacctaacaattacgcacacgccaactaacctatctacaactattaaccgactaacgactacgcaaaacgcgaaaacgcgatctaacgataaactttatcgtacgtaaaaaacatttataaacgataacgcgttatataccgaaaaatttaaacgaactaaacaacctaaatttatccgataacgaaatccgctttcacgataaaacgctacttacgctaataaaaaaaacgcaaaaattaccgaaaaataccttacgacaccgatacttaactaataaacatacgaaattatacgtcataatacaaaatatccgatcgatacgcaattaaaaaccgcattaactcaaccgctaaatacactacgaaaataaacaacaaatcgtccaaaattacaaacgttatatacgcaatataacgaactaacgcaaacaaaaacacaacgattactaccgaaaccgacgaataaacgcaacacctaaacgctactaccgcgtaaacgcgtattatatattaccgataataaacaaaatacgctaactcaactcgccgccgtactaacgataaacaaccaaatactataaccgaataacgcgctacatcgtcaattaataaaaacattaccatcgacaatcaacgaacgtattcaactaacgaaaacgaaaaatataaccgctcaaccgtttaatacga

SEQ ID NO: 7477 - DNA, 644 bp, Artificial Sequence
  chemically treated genomic DNA (Homo sapiens) CpG-island No: 7477
tgcggatttcgtttgcgaacgggtgattgcgttcgtaatcgcgttgggtggagtaggttagcgttagtaaatagttttcgtcgtcgcgtattaattgttgtaaacgggaggagcgtgagtaggggtaaatcggcggcgtgcgggtgatgttattcggttgtgcgtcgttattttttttaaatttcgttagtttttgacgcgttagtaggttgaaaacgtgcggcgacggttgttgttcgttgtcggcggtggttagcgtcggcgtttcgtcgtttgttagtagggtaaaatcgagtaggcgatgggtgtagtcgtaggttgggttaagtagttggtcgtcgggaatgtttttataaacggcggagatacggcgttcgagacgtatttcggtggtgtcgagcggttcgtttatcgttagtttttttaacgtggtgcggtaggcgcgtaataaggaaatcgttttaacgttatcgtcgtttggtttgttttagcgttagcgtcgttagttcgcggtcggtaatgtcgtttttcggttattacgcgatttatcgcgaggtaaattttttttacgtaagtatgtatgtttgtaggtttcgggttaagtatgtatgtttgtaggttttatttaaataacgcgaagtgta

SEQ ID NO: 7478 - DNA, 644 bp, Artificial Sequence
  chemically treated genomic DNA (Homo sapiens) CpG-island No: 7478
tacacttcgcgttatttaaataaaacctacaaacatacatacttaacccgaaacctacaaacatacatacttacgtaaaaaaaatttacctcgcgataaatcgcgtaataaccgaaaaacgacattaccgaccgcgaactaacgacgctaacgctaaaacaaaccaaacgacgataacgttaaaacgatttccttattacgcgcctaccgcaccacgttaaaaaaactaacgataaacgaaccgctcgacaccaccgaaatacgtctcgaacgccgtatctccgccgtttataaaaacattcccgacgaccaactacttaacccaacctacgactacacccatcgcctactcgattttaccctactaacaaacgacgaaacgccgacgctaaccaccgccgacaacgaacaacaaccgtcgccgcacgttttcaacctactaacgcgtcaaaaactaacgaaatttaaaaaaaataacgacgcacaaccgaataacatcacccgcacgccgccgatttacccctactcacgctcctcccgtttacaacaattaatacgcgacgacgaaaactatttactaacgctaacctactccacccaacgcgattacgaacgcaatcacccgttcgcaaacgaaatccgca

SEQ ID NO: 7479 - DNA, 644 bp, Artificial Sequence
  chemically treated genomic DNA (Homo sapiens) CpG-island No: 7479
tatatttcgcgttatttagatgagatttgtaggtatgtatgtttagttcgggatttgtaggtatgtatgtttgcgtaaaagaagtttatttcgcggtagatcgcgtgatgatcgaagggcggtattgtcgatcgcgaattggcggcgttggcgttgaaataggttaggcggcgataacgttgaagcgatttttttgttgcgcgtttatcgtattacgttggggaagttggcggtaagcgagtcgttcgatattatcgggatgcgtttcgaacgtcgtattttcgtcgtttataaagatattttcggcggttagttgtttggtttaatttacgattatatttatcgtttgttcgattttattttgttggtaaacggcgaagcgtcgacgttgattatcgtcgatagcgaatagtagtcgtcgtcgtacgtttttagtttgttggcgcgttaggggttggcgaagtttgaagaggatagcggcgtatagtcggatgatattattcgtacgtcgtcggtttatttttgtttacgtttttttcgtttgtagtagttgatgcgcggcgacgaaggttatttgttggcgttggtttattttatttaacgcggttacgggcgtaattattcgttcgtaggcgagattcgta

SEQ ID NO: 7480 - DNA, 644 bp, Artificial Sequence
  chemically treated genomic DNA (Homo sapiens) CpG-island No: 7480
tacgaatctcgcctacgaacgaataattacgcccgtaaccgcgttaaataaaataaaccaacgccaacaaataaccttcgtcgccgcgcatcaactactacaaacgaaaaaaacgtaaacaaaaataaaccgacgacgtacgaataatatcatccgactatacgccgctatcctcttcaaacttcgccaacccctaacgcgccaacaaactaaaaacgtacgacgacgactactattcgctatcgacgataatcaacgtcgacgcttcgccgtttaccaacaaaataaaatcgaacaaacgataaatataatcgtaaattaaaccaaacaactaaccgccgaaaatatctttataaacgacgaaaatacgacgttcgaaacgcatcccgataatatcgaacgactcgcttaccgccaacttccccaacgtaatacgataaacgcgcaacaaaaaaatcgcttcaacgttatcgccgcctaacctatttcaacgccaacgccgccaattcgcgatcgacaataccgcccttcgatcatcacgcgatctaccgcgaaataaacttcttttacgcaaacatacatacctacaaatcccgaactaaacatacatacctacaaatctcatctaaataacgcgaaatata

SEQ ID NO: 7481 - DNA, 509 bp, Artificial Sequence
  chemically treated genomic DNA (Homo sapiens) CpG-island No: 7481
tcgcgagatcggacgatgttagaatagatcgcggtaagagaatagggaattagtattcgggttacgatacgggttggatattaggttgattacgtcgaacgcgtcgaggttgttgaatagataatcggttaggtaaatttttatcgtttttatcgatatttcgtcggtttgtagcgaattagcgttattagtagatagtcgaggtgagagatagatgagtaatcgagtagacgtttgatattggtttggtttagcgttattaggttatcgaagatgatggaggtaaaggcgataatcgttagtattacgcgaatcgtttcgttgttatttatcggtgcgtagaggaatagacgtattattatatcgaagatagcgattttgttcgtcgtcgttaggaaagtggaaatcggcgtagaataatggtataggtttacggatatttttttattattttatttagtacgttttgaattttagatatatgcgtatcgaatatggtttttgttatt

SEQ ID NO: 7482 - DNA, 509 bp, Artificial Sequence
  chemically treated genomic DNA (Homo sapiens) CpG-island No: 7482
aataacaaaaaccatattcgatacgcatatatctaaaattcaaaacgtactaaataaaataataaaaaaatatccgtaaacctataccattattctacgccgatttccactttcctaacgacgacgaacaaaatcgctatcttcgatataataatacgtctattcctctacgcaccgataaataacaacgaaacgattcgcgtaatactaacgattatcgcctttacctccatcatcttcgataacctaataacgctaaaccaaaccaatatcaaacgtctactcgattactcatctatctctcacctcgactatctactaataacgctaattcgctacaaaccgacgaaatatcgataaaaacgataaaaatttacctaaccgattatctattcaacaacctcgacgcgttcgacgtaatcaacctaatatccaacccgtatcgtaacccgaatactaattccctattctcttaccgcgatctattctaacatcgtccgatctcgcga

SEQ ID NO: 7483 - DNA, 509 bp, Artificial Sequence
  chemically treated genomic DNA (Homo sapiens) CpG-island No: 7483
gatggtagaaattatgttcggtgcgtatatgtttgaaatttagggcgtattgggtgaaatggtgaaagagtattcgtgggtttatgttattgttttgcgtcggtttttatttttttggcgacggcgagtaaaatcgttattttcggtgtggtgatgcgtttgtttttttacgtatcggtgggtgatagcgaagcgattcgcgtggtgttggcgattatcgtttttgtttttattattttcggtaatttgatggcgttgagttagattaatattaaacgtttgttcggttatttatttattttttatttcggttatttgttggtagcgttgattcgttgtaaatcggcgagatgtcgatggaagcggtaggggtttatttggtcggttatttgtttagtagtttcggcgcgttcggcgtggttagtttgatgtttagttcgtatcgtggttcggatgttgattttttgtttttttatcgcggtttgttttggtatcgttcgatttcgcgg

SEQ ID NO: 7484 - DNA, 509 bp, Artificial Sequence
  chemically treated genomic DNA (Homo sapiens) CpG-island No: 7484
ccgcgaaatcgaacgataccaaaacaaaccgcgataaaaaaacaaaaaatcaacatccgaaccacgatacgaactaaacatcaaactaaccacgccgaacgcgccgaaactactaaacaaataaccgaccaaataaacccctaccgcttccatcgacatctcgccgatttacaacgaatcaacgctaccaacaaataaccgaaataaaaaataaataaataaccgaacaaacgtttaatattaatctaactcaacgccatcaaattaccgaaaataataaaaacaaaaacgataatcgccaacaccacgcgaatcgcttcgctatcacccaccgatacgtaaaaaaacaaacgcatcaccacaccgaaaataacgattttactcgccgtcgccaaaaaaataaaaaccgacgcaaaacaataacataaacccacgaatactctttcaccatttcacccaatacgccctaaatttcaaacatatacgcaccgaacataatttctaccatc

SEQ ID NO: 7485 - DNA, 594 bp, Artificial Sequence
  chemically treated genomic DNA (Homo sapiens) CpG-island No: 7485
tggcggggcgtttttcggcggtaaaacgacgtattaggaaacgttataaattaggatgtttttgattcgatggtcgtgttcgtggcgtatggttgttaggggtatcgggaaacggggatgttacgggcgtatgttatagtttatgtcgagggtgtcgttatcggcgttcgtgtgcgtggaagtagagcgcgtgtttataatcgaggggcgtatttcggcgatgtttagttattgtagacgtgtatgggtaaatgcgggtttcggttataggcgttttggcgcgtgtttagcgtgaatatgacgagaagtggggttggtacgtgtaagtcgatgtgggtgtagttcgcgggtaaggggcgattcggtgcgggacgttgacgatacgacgttcggtgtcgatagggtatgtcggtatatggtgtatttggcgggtaacgttagggttgttgtggatgggaattagaatcggtacgttaagtgttaagtaagagaggaggtagggcgttagatatgatgattgaaaggtatcgcgtcgagtatgaggggaatattgtttaaatagagatggaatagtggcgatttgaggtcgtagat

SEQ ID NO: 7486 - DNA, 594 bp, Artificial Sequence
  chemically treated genomic DNA (Homo sapiens) CpG-island No: 7486
atctacgacctcaaatcgccactattccatctctatttaaacaatattcccctcatactcgacgcgatacctttcaatcatcatatctaacgccctacctcctctcttacttaacacttaacgtaccgattctaattcccatccacaacaaccctaacgttacccgccaaatacaccatataccgacataccctatcgacaccgaacgtcgtatcgtcaacgtcccgcaccgaatcgccccttacccgcgaactacacccacatcgacttacacgtaccaaccccacttctcgtcatattcacgctaaacacgcgccaaaacgcctataaccgaaacccgcatttacccatacacgtctacaataactaaacatcgccgaaatacgcccctcgattataaacacgcgctctacttccacgcacacgaacgccgataacgacaccctcgacataaactataacatacgcccgtaacatccccgtttcccgatacccctaacaaccatacgccacgaacacgaccatcgaatcaaaaacatcctaatttataacgtttcctaatacgtcgttttaccgccgaaaaacgccccgcca

SEQ ID NO: 7487 - DNA, 594 bp, Artificial Sequence
  chemically treated genomic DNA (Homo sapiens) CpG-island No: 7487
gtttacggttttaaatcgttattattttatttttatttggataatattttttttatgttcggcgcgatgttttttaattattatatttggcgttttgtttttttttttgtttggtatttagcgtatcgattttagtttttatttataatagttttgacgttattcgttaggtatattatgtgtcggtatgttttgtcggtatcggacgtcgtgtcgttaacgtttcgtatcgggtcgttttttgttcgcgagttatatttatatcgatttgtacgtattagttttatttttcgttatgtttacgttagatacgcgttagagcgtttgtgatcggaattcgtatttgtttatatacgtttgtagtagttggatatcgtcgaaatgcgtttttcgattgtggatacgcgttttatttttacgtatacggacgtcggtaacggtattttcgatataagttgtgatatgcgttcgtgatattttcgtttttcgatgtttttggtagttatacgttacgggtacgattatcgggttaagagtattttggtttgtaacgttttttgatgcgtcgttttatcgtcggaaagcgtttcgtta

SEQ ID NO: 7488 - DNA, 594 bp, Artificial Sequence
  chemically treated genomic DNA (Homo sapiens) CpG-island No: 7488
taacgaaacgctttccgacgataaaacgacgcatcaaaaaacgttacaaaccaaaatactcttaacccgataatcgtacccgtaacgtataactaccaaaaacatcgaaaaacgaaaatatcacgaacgcatatcacaacttatatcgaaaataccgttaccgacgtccgtatacgtaaaaataaaacgcgtatccacaatcgaaaaacgcatttcgacgatatccaactactacaaacgtatataaacaaatacgaattccgatcacaaacgctctaacgcgtatctaacgtaaacataacgaaaaataaaactaatacgtacaaatcgatataaatataactcgcgaacaaaaaacgacccgatacgaaacgttaacgacacgacgtccgataccgacaaaacataccgacacataatatacctaacgaataacgtcaaaactattataaataaaaactaaaatcgatacgctaaataccaaacaaaaaaaaaaacaaaacgccaaatataataattaaaaaacatcgcgccgaacataaaaaaaatattatccaaataaaaataaaataataacgatttaaaaccgtaaac

SEQ ID NO: 7489 - DNA, 581 bp, Artificial Sequence
  chemically treated genomic DNA (Homo sapiens) CpG-island No: 7489
ttgggggttgaatgtttttgattcgtcgtagggtaatttatttttatttcgtttggaatggcgacgttgtggcggtaaagttacgttgcggttgacgttatttagcgaaatttcgatgtcggtttattatattttggggttgaagtaggttttaagggtatggttgttcgttatttaaagtggtacgcgagttgggtttagaacgtcgtgagatagttcggtttttatttgtcgtggcgaaattatagtttaatgcggcggcgtatcggtttttgatcggttataataaacggtatcgttgattagttcggtttttttatcgatatttgattacgtatcggatatcgtttgggattttcgtttgtcgcgtgtgaaatcgattagtgttttaggttataaattcggtatggtttcgttgggatgcggttgggttatttggcgtgacgaagaagcgttgtcgtaggaattggtgtttaacgttgatgtcgcgtagggtatttatttttcgattttcggttgttgcggtgataaatagttttgttttagtaaaatcgtattttcgtagaatttgaatagtgaaa

SEQ ID NO: 7490 - DNA, 581 bp, Artificial Sequence
  chemically treated genomic DNA (Homo sapiens) CpG-island No: 7490
tttcactattcaaattctacgaaaatacgattttactaaaacaaaactatttatcaccgcaacaaccgaaaatcgaaaaataaataccctacgcgacatcaacgttaaacaccaattcctacgacaacgcttcttcgtcacgccaaataacccaaccgcatcccaacgaaaccataccgaatttataacctaaaacactaatcgatttcacacgcgacaaacgaaaatcccaaacgatatccgatacgtaatcaaatatcgataaaaaaaccgaactaatcaacgataccgtttattataaccgatcaaaaaccgatacgccgccgcattaaactataatttcgccacgacaaataaaaaccgaactatctcacgacgttctaaacccaactcgcgtaccactttaaataacgaacaaccatacccttaaaacctacttcaaccccaaaatataataaaccgacatcgaaatttcgctaaataacgtcaaccgcaacgtaactttaccgccacaacgtcgccattccaaacgaaataaaaataaattaccctacgacgaatcaaaaacattcaacccccaa

SEQ ID NO: 7491 - DNA, 581 bp, Artificial Sequence
  chemically treated genomic DNA (Homo sapiens) CpG-island No: 7491
ttttattatttaggttttgcgggaatacggttttgttgaggtaaaattgtttattatcgtagtaatcgaaggtcggggaatggatgttttgcgcgatattaacgttgaatattagtttttgcggtagcgttttttcgttacgttagataatttagtcgtattttagcggagttatatcgaatttatggtttgaagtattgatcgattttatacgcggtaggcggaagttttagacgatattcggtgcgtaattaggtgtcggtagagaagtcggattggttaacggtgtcgtttattatggtcgattaggggtcggtacgtcgtcgtattgaattgtggtttcgttacggtagatagggatcgaattgttttacgacgttttaaatttagttcgcgtattattttaaatggcgaatagttatatttttgggatttattttagttttaggatgtgatgagtcgatatcgaggtttcgttgaatagcgttagtcgtagcgtggttttatcgttatagcgtcgttattttaggcggggtaaaagtaaattgttttgcgacgggttaaaagtatttagtttttaa

SEQ ID NO: 7492 - DNA, 581 bp, Artificial Sequence
  chemically treated genomic DNA (Homo sapiens) CpG-island No: 7492
ttaaaaactaaatacttttaacccgtcgcaaaacaatttacttttaccccgcctaaaataacgacgctataacgataaaaccacgctacgactaacgctattcaacgaaacctcgatatcgactcatcacatcctaaaactaaaataaatcccaaaaatataactattcgccatttaaaataatacgcgaactaaatttaaaacgtcgtaaaacaattcgatccctatctaccgtaacgaaaccacaattcaatacgacgacgtaccgacccctaatcgaccataataaacgacaccgttaaccaatccgacttctctaccgacacctaattacgcaccgaatatcgtctaaaacttccgcctaccgcgtataaaatcgatcaatacttcaaaccataaattcgatataactccgctaaaatacgactaaattatctaacgtaacgaaaaaacgctaccgcaaaaactaatattcaacgttaatatcgcgcaaaacatccattccccgaccttcgattactacgataataaacaattttacctcaacaaaaccgtattcccgcaaaacctaaataataaaa

SEQ ID NO: 7493 - DNA, 502 bp, Artificial Sequence
  chemically treated genomic DNA (Homo sapiens) CpG-island No: 7493
cgcggttgttggcggcgtacgttcgggatatgaagatcggattgtttggttgcgtaaattgattgcgtggtaggaagagatggttgatttcggcgaaatgttcgacgaagtacgtagttaggtttttgacgatcgggtgtacgtttttacgtcgaaaggtgatgtcgttgatttgtttgcgggattaacgtcgttggatttcgtttattatatttatagtgatgtcggatatcgttgtatcggggtaaaaattggcgggcgtattgtgtcgtttatttattagttgtagatgggcgattagattgaaattattatttagaaatagtcgaattttagtcgtgattggttaaatttaaatttcggttacgttataattagtcgtgggttgcgtatattaggtgtgcgtttgcgttaatattatgaaagtagtttgaaagtggttgaatggttggtagaatattcgtaagttgcgcgagttaattattttgttttgtttggtagt

SEQ ID NO: 7494 - DNA, 502 bp, Artificial Sequence
  chemically treated genomic DNA (Homo sapiens) CpG-island No: 7494
actaccaaacaaaacaaaataattaactcgcgcaacttacgaatattctaccaaccattcaaccactttcaaactactttcataatattaacgcaaacgcacacctaatatacgcaacccacgactaattataacgtaaccgaaatttaaatttaaccaatcacgactaaaattcgactatttctaaataataatttcaatctaatcgcccatctacaactaataaataaacgacacaatacgcccgccaatttttaccccgatacaacgatatccgacatcactataaatataataaacgaaatccaacgacgttaatcccgcaaacaaatcaacgacatcacctttcgacgtaaaaacgtacacccgatcgtcaaaaacctaactacgtacttcgtcgaacatttcgccgaaatcaaccatctcttcctaccacgcaatcaatttacgcaaccaaacaatccgatcttcatatcccgaacgtacgccgccaacaaccgcg

SEQ ID NO: 7495 - DNA, 502 bp, Artificial Sequence
  chemically treated genomic DNA (Homo sapiens) CpG-island No: 7495
attgttaggtagagtagggtggttaattcgcgtaatttgcggatgttttgttagttatttagttatttttagattgtttttatgatgttgacgtaaacgtatatttaatgtgcgtagtttacggttggttgtgacgtaatcgaggtttgggtttaattagttacggttggggttcggttgtttttgggtgataattttaatttggtcgtttatttgtagttggtaggtgaacggtataatgcgttcgttaatttttgtttcgatgtagcggtgttcgatattattgtggatgtggtaagcgaagtttagcggcgttgatttcgtaggtaaattaacgatattatttttcggcgtaaagacgtatattcggtcgttaaagatttgattacgtatttcgtcgagtatttcgtcggaattagttatttttttttgttacgtaattagtttacgtagttaggtaattcggtttttatgtttcgaacgtgcgtcgttagtagtcgcg

SEQ ID NO: 7496 - DNA, 502 bp, Artificial Sequence
  chemically treated genomic DNA (Homo sapiens) CpG-island No: 7496
cgcgactactaacgacgcacgttcgaaacataaaaaccgaattacctaactacgtaaactaattacgtaacaaaaaaaaataactaattccgacgaaatactcgacgaaatacgtaatcaaatctttaacgaccgaatatacgtctttacgccgaaaaataatatcgttaatttacctacgaaatcaacgccgctaaacttcgcttaccacatccacaataatatcgaacaccgctacatcgaaacaaaaattaacgaacgcattataccgttcacctaccaactacaaataaacgaccaaattaaaattatcacccaaaaacaaccgaaccccaaccgtaactaattaaacccaaacctcgattacgtcacaaccaaccgtaaactacgcacattaaatatacgtttacgtcaacatcataaaaacaatctaaaaataactaaataactaacaaaacatccgcaaattacgcgaattaaccaccctactctacctaacaat

SEQ ID NO: 7497 - DNA, 525 bp, Artificial Sequence
  chemically treated genomic DNA (Homo sapiens) CpG-island No: 7497
cgtaaattttggtttagtcgtatgacgtaattagttggtagcggcggttttattttttcgttggttatttttatcgggtagatcgtcgtcgtattggcggtaggtaatagcgtgttggtaaaatcggtagaataaacgtcgttgattgtcgcgtaagggatcgttattttgttggaagcgggtgtatcgttaggcgtggtgtaattgttgcgcggtgtaagtttataggttgtaggttttttttttatatgattcgtgttaatattattaaaggtttgggatcggtattgtaaatcgcggagggttggagcgtggaattgtcgaaggatgtgtattattttttttataaacgtattaatttaatttggttatattggagcgttttttgagtttgttgtcggtttttgaggtcgaggtatagatgacggatggttggtcgttgtatgaattacgtttgaagggaaagttgtacgttattagtaagcgttatatttagcgtattgagcgatataatttgaatttgag

SEQ ID NO: 7498 - DNA, 525 bp, Artificial Sequence
  chemically treated genomic DNA (Homo sapiens) CpG-island No: 7498
ctcaaattcaaattatatcgctcaatacgctaaatataacgcttactaataacgtacaactttcccttcaaacgtaattcatacaacgaccaaccatccgtcatctatacctcgacctcaaaaaccgacaacaaactcaaaaaacgctccaatataaccaaattaaattaatacgtttataaaaaaaataatacacatccttcgacaattccacgctccaaccctccgcgatttacaataccgatcccaaacctttaataatattaacacgaatcatataaaaaaaaaacctacaacctataaacttacaccgcgcaacaattacaccacgcctaacgatacacccgcttccaacaaaataacgatcccttacgcgacaatcaacgacgtttattctaccgattttaccaacacgctattacctaccgccaatacgacgacgatctacccgataaaaataaccaacgaaaaaataaaaccgccgctaccaactaattacgtcatacgactaaaccaaaatttacg

SEQ ID NO: 7499 - DNA, 525 bp, Artificial Sequence
  chemically treated genomic DNA (Homo sapiens) CpG-island No: 7499
tttagatttagattatgtcgtttaatgcgttgagtgtaacgtttgttgataacgtgtagttttttttttaggcgtgatttatatagcggttagttattcgttatttatatttcgattttaaaggtcgatagtaggtttagaagacgttttagtgtggttaggttgagttggtgcgtttgtagaagaagtaatgtatatttttcggtaattttacgttttagtttttcgcgatttgtagtatcggttttaggtttttgatgatgttgatacgagttatgtgaaaggaggatttgtagtttgtaagtttgtatcgcgtagtaattgtattacgtttggcggtatattcgtttttagtaaaatggcgattttttgcgcggtaattagcggcgtttgttttgtcggttttgttagtacgttgttatttgtcgttagtgcggcggcgatttgttcggtgaaaatagttagcgggaagataaagtcgtcgttgttaattggttgcgttatacggttaaattagagtttgcg

SEQ ID NO: 7500 - DNA, 525 bp, Artificial Sequence
  chemically treated genomic DNA (Homo sapiens) CpG-island No: 7500
cgcaaactctaatttaaccgtataacgcaaccaattaacaacgacgactttatcttcccgctaactattttcaccgaacaaatcgccgccgcactaacgacaaataacaacgtactaacaaaaccgacaaaacaaacgccgctaattaccgcgcaaaaaatcgccattttactaaaaacgaatataccgccaaacgtaatacaattactacgcgatacaaacttacaaactacaaatcctcctttcacataactcgtatcaacatcatcaaaaacctaaaaccgatactacaaatcgcgaaaaactaaaacgtaaaattaccgaaaaatatacattacttcttctacaaacgcaccaactcaacctaaccacactaaaacgtcttctaaacctactatcgacctttaaaatcgaaatataaataacgaataactaaccgctatataaatcacgcctaaaaaaaaaactacacgttatcaacaaacgttacactcaacgcattaaacgacataatctaaatctaaa

SEQ ID NO: 7501 - DNA, 556 bp, Artificial Sequence
  chemically treated genomic DNA (Homo sapiens) CpG-island No: 7501
cgtagggtgtttcgtaagagaaaatacgatggtagtaatatcgttcgcggcgatttcggaggagagtaggttttttagttatttaggggtaaattgtaaaattagcggttgttgagatacgtttagattaatcgttagcgatagcgcgataattagaatcgttcgacggtttagcggtttacgagaaacgatacgtatatcggagcgggcgatggtgttaaatattttagcggcgtgttagttagtcgggcgcgaaggcgattagtaaaataaagtcgatataaatatttagtcgcgagtagttgttaaattacgtttggggaattaacgtgtatgtggaagatcgtacggtcgatgtttatattcgtcgtttgcgtaaagtattggagttcggcgggtattcgtagtgatgagggtgatgtacggcgcgaaaaattggcggtatttattacgcgttttcgtgtcggagtataggatttgtcgtttacgtttgttgatttatgtagcgttatttagttattgattgtcggttgatataattcgtttttataaattg

SEQ ID NO: 7502 - DNA, 556 bp, Artificial Sequence
  chemically treated genomic DNA (Homo sapiens) CpG-island No: 7502
caatttataaaaacgaattatatcaaccgacaatcaataactaaataacgctacataaatcaacaaacgtaaacgacaaatcctatactccgacacgaaaacgcgtaataaataccgccaatttttcgcgccgtacatcaccctcatcactacgaatacccgccgaactccaatactttacgcaaacgacgaatataaacatcgaccgtacgatcttccacatacacgttaattccccaaacgtaatttaacaactactcgcgactaaatatttatatcgactttattttactaatcgccttcgcgcccgactaactaacacgccgctaaaatatttaacaccatcgcccgctccgatatacgtatcgtttctcgtaaaccgctaaaccgtcgaacgattctaattatcgcgctatcgctaacgattaatctaaacgtatctcaacaaccgctaattttacaatttacccctaaataactaaaaaacctactctcctccgaaatcgccgcgaacgatattactaccatcgtattttctcttacgaaacaccctacg

SEQ ID NO: 7503 - DNA, 556 bp, Artificial Sequence
  chemically treated genomic DNA (Homo sapiens) CpG-island No: 7503
tagtttgtaaggacgggttgtattaatcgataattaatggttggatggcgttgtatgaattagtaagcgtaaacggtaaattttgtatttcggtacgaaaacgcgtaatgagtgtcgttagtttttcgcgtcgtgtattatttttattattgcgaatgttcgtcgggttttagtgttttacgtaggcgacgaatgtggatatcgatcgtgcggttttttatatatacgttagttttttagacgtggtttaatagttgttcgcggttgggtgtttatatcggttttattttattgatcgttttcgcgttcggttggttggtacgtcgttgaaatgtttggtattatcgttcgtttcggtgtgcgtatcgtttttcgtgagtcgttgaatcgtcgggcgattttgattatcgcgttgtcgttggcggttggtttgggcgtgttttagtagtcgttgattttgtagtttgtttttgaatggttgaaaaatttgttttttttcgggatcgtcgcgggcggtattattgttatcgtgtttttttttgcggggtattttgcg

SEQ ID NO: 7504 - DNA, 556 bp, Artificial Sequence
  chemically treated genomic DNA (Homo sapiens) CpG-island No: 7504
cgcaaaataccccgcaaaaaaaaacacgataacaataataccgcccgcgacgatcccgaaaaaaaacaaatttttcaaccattcaaaaacaaactacaaaatcaacgactactaaaacacgcccaaaccaaccgccaacgacaacgcgataatcaaaatcgcccgacgattcaacgactcacgaaaaacgatacgcacaccgaaacgaacgataataccaaacatttcaacgacgtaccaaccaaccgaacgcgaaaacgatcaataaaataaaaccgatataaacacccaaccgcgaacaactattaaaccacgtctaaaaaactaacgtatatataaaaaaccgcacgatcgatatccacattcgtcgcctacgtaaaacactaaaacccgacgaacattcgcaataataaaaataatacacgacgcgaaaaactaacgacactcattacgcgttttcgtaccgaaatacaaaatttaccgtttacgcttactaattcatacaacgccatccaaccattaattatcgattaatacaacccgtccttacaaacta

SEQ ID NO: 7505 - DNA, 555 bp, Artificial Sequence
  chemically treated genomic DNA (Homo sapiens) CpG-island No: 7505
atagaaaggcgttgtagaggcgggggttcgttttcgggtgtgtttgcgagtgtgtgtcgggtgcgcgcgtttaggttagggggtgcgggcgggtagcggggaatcggatttgtaggcggcgattttttttatcgcggttttttttttagttttaaattttgcgcgttcgggattattattagcgcgatagttttttttgttaggtttcggattcgtggggtgggcgttagaggacgtatatttgttttattggagattttttttgattttgggcgttaagtcgggatttgtgtatttcgaagttttagttgcgtgagttcgtttttgatttcggaaattcgttagttttgtagggcgttcggtttagaataggggttagagtgcggggatttttataagcgcgcgcgcgcgcgcgcgtatatatatatatatatatatatatatatatatatatcgcgcggtaggaagtttcgagatcgttcgcgtggggagggtttattcgcggttaggattagtttacgtgggtaattttatttttgtattaggtttttgtgt

SEQ ID NO: 7506 - DNA, 555 bp, Artificial Sequence
  chemically treated genomic DNA (Homo sapiens) CpG-island No: 7506
acacaaaaacctaatacaaaaataaaattacccacgtaaactaatcctaaccgcgaataaaccctccccacgcgaacgatctcgaaacttcctaccgcgcgatatatatatatatatatatatatatatatatatatacgcgcgcgcgcgcgcgcgcttataaaaatccccgcactctaacccctattctaaaccgaacgccctacaaaactaacgaatttccgaaatcaaaaacgaactcacgcaactaaaacttcgaaatacacaaatcccgacttaacgcccaaaatcaaaaaaaatctccaataaaacaaatatacgtcctctaacgcccaccccacgaatccgaaacctaacaaaaaaaactatcgcgctaataataatcccgaacgcgcaaaatttaaaactaaaaaaaaaaccgcgataaaaaaaatcgccgcctacaaatccgattccccgctacccgcccgcaccccctaacctaaacgcgcgcacccgacacacactcgcaaacacacccgaaaacgaacccccgcctctacaacgcctttctat

SEQ ID NO: 7507 - DNA, 555 bp, Artificial Sequence
  chemically treated genomic DNA (Homo sapiens) CpG-island No: 7507
gtataaaggtttggtgtaagagtggggttgtttacgtgggttggttttggtcgcgggtggattttttttacgcgggcggtttcggagttttttgtcgcgcggtgtgtgtgtgtgtgtgtgtgtgtgtgtgtgtgtgtgcgcgcgcgcgcgcgcgcgtttgtggaggttttcgtattttggtttttgttttgggtcgagcgttttgtagagttggcgagttttcggggttagaaacgggtttacgtaattggggtttcgggatgtataagtttcggtttggcgtttaaaattagagaaagtttttagtgggatagatgtgcgttttttgacgtttattttacgagttcgaaatttggtaggaggggttgtcgcgttggtggtggtttcgggcgcgtagggtttggggttgggagaggggtcgcgatgggagggatcgtcgtttgtagattcggtttttcgttgttcgttcgtattttttgatttggacgcgcgtattcggtatatattcgtaaatatattcgggggcggattttcgtttttgtagcgtttttttgt

SEQ ID NO: 7508 - DNA, 555 bp, Artificial Sequence
  chemically treated genomic DNA (Homo sapiens) CpG-island No: 7508
acaaaaaaacgctacaaaaacgaaaatccgcccccgaatatatttacgaatatataccgaatacgcgcgtccaaatcaaaaaatacgaacgaacaacgaaaaaccgaatctacaaacgacgatccctcccatcgcgacccctctcccaaccccaaaccctacgcgcccgaaaccaccaccaacgcgacaacccctcctaccaaatttcgaactcgtaaaataaacgtcaaaaaacgcacatctatcccactaaaaactttctctaattttaaacgccaaaccgaaacttatacatcccgaaaccccaattacgtaaacccgtttctaaccccgaaaactcgccaactctacaaaacgctcgacccaaaacaaaaaccaaaatacgaaaacctccacaaacgcgcgcgcgcgcgcgcgcacacacacacacacacacacacacacacacacacaccgcgcgacaaaaaactccgaaaccgcccgcgtaaaaaaaatccacccgcgaccaaaaccaacccacgtaaacaaccccactcttacaccaaacctttatac

SEQ ID NO: 7509 - DNA, 960 bp, Artificial Sequence
  chemically treated genomic DNA (Homo sapiens) CpG-island No: 7509
tcgttttcgtttaggtttagattttggtcgggcgattttttcggtatcgtagttatttcggggtagggttgcgcggttttgagcggtggtcgttcgcgttgagtttatttcggagtcggtagatcgggttcgggcgtagttttcgttttacgtagttgtcggtttcgggcgtcgggcgtagtttcgtcgtttatgttcgttgcgcgggtcgtttcggtttcgttttggagttattttttttttcgtttttaattttttttttatttatttttttcgtttcggttttcgttttacgcggtttttcgcggcgcggcgcgtcggggttttttttttttatttttttttcgttttttttttttttcgcggtcgtcgttttcgtcgtcgtcgtttttttttcgcgtcgtttttcggttgttttttcgtcgtttttatttttttttttttttttttttttttcggcggtttttttcgattgttggagagaaaattagttttttattttagtttttagttagcgtttcgtcgcggtttagttcggacgtaaagggtagcgattcggttttaaattatttagcgcgaacgggcgcgcgcggcgatttttggttcggggttcggttgcgtcgcggggtagaggattagagtcgtaattagtttcgcgcgttcgcgtttggcgataaaaacgcgtcgtttttttttttttcgtcgggcgatttttattcgtttttttcgaagttcgcgttttttcgtcggggtcgcggttaggattttttcgggagcggtgcgtttaggttttagcgtttttcgcggtttagtttttcgtttttcgtcggtcggttacgcggcgttcgggtttttttcgggttcggggagggggcgggggagaggttgattttaattattgttattttatttgatgtaatattttttcgggcgtttttagttgggtataaattttcggtt

SEQ ID NO: 7510 - DNA, 960 bp, Artificial Sequence
  chemically treated genomic DNA (Homo sapiens) CpG-island No: 7510
aaccgaaaatttatacccaactaaaaacgcccgaaaaaatattacatcaaataaaataacaataattaaaatcaacctctcccccgccccctccccgaacccgaaaaaaacccgaacgccgcgtaaccgaccgacgaaaaacgaaaaactaaaccgcgaaaaacgctaaaacctaaacgcaccgctcccgaaaaaatcctaaccgcgaccccgacgaaaaaacgcgaacttcgaaaaaaacgaataaaaatcgcccgacgaaaaaaaaaaaaacgacgcgtttttatcgccaaacgcgaacgcgcgaaactaattacgactctaatcctctaccccgcgacgcaaccgaaccccgaaccaaaaatcgccgcgcgcgcccgttcgcgctaaataatttaaaaccgaatcgctaccctttacgtccgaactaaaccgcgacgaaacgctaactaaaaactaaaataaaaaactaattttctctccaacaatcgaaaaaaaccgccgaaaaaaaaaaaaaaaaaaaaaaaaataaaaacgacgaaaaaacaaccgaaaaacgacgcgaaaaaaaaacgacgacgacgaaaacgacgaccgcgaaaaaaaaaaaaaacgaaaaaaaaataaaaaaaaaaaaccccgacgcgccgcgccgcgaaaaaccgcgtaaaacgaaaaccgaaacgaaaaaaataaataaaaaaaaaattaaaaacgaaaaaaaaaataactccaaaacgaaaccgaaacgacccgcgcaacgaacataaacgacgaaactacgcccgacgcccgaaaccgacaactacgtaaaacgaaaactacgcccgaacccgatctaccgactccgaaataaactcaacgcgaacgaccaccgctcaaaaccgcgcaaccctaccccgaaataactacgataccgaaaaaatcgcccgaccaaaatctaaacctaaacgaaaacga

SEQ ID NO: 7511 - DNA, 960 bp, Artificial Sequence
  chemically treated genomic DNA (Homo sapiens) CpG-island No: 7511
agtcgaaaatttatgtttagttgaaagcgttcggggaaatattatattagatgaaatgataatgattaaaattagtttttttttcgtttttttttcgagttcggaggaggttcgggcgtcgcgtggtcggtcggcggggggcggggggttgggtcgcggagggcgttggggtttgggcgtatcgttttcgggagggttttggtcgcggtttcggcgggaaggcgcgggtttcgggagaggcgggtggggatcgttcggcgaaaggaggggaaacggcgcgtttttgtcgttaggcgcgggcgcgcggagttaattgcgattttaattttttgtttcgcggcgtagtcgagtttcgagttaggagtcgtcgcgcgcgttcgttcgcgttgggtaatttggggtcggatcgttgttttttacgttcgggttgggtcgcggcgaggcgttggttaggggttggagtggggggttggttttttttttagtaatcgagggaggtcgtcggagagagaggagggaggagaggaggtgggagcggcgggagggtagtcggagagcggcgcgaggaggaggcggcggcggcggaggcggcggtcgcgaagaggggaggaggcgaggggagggtggggaggggaggtttcggcgcgtcgcgtcgcgaggggtcgcgtgaagcgggggtcggggcgggaggggtgggtggggggagggttgggggcgagagagaaagtaattttaggacgagatcggagcgattcgcgtagcgagtataggcggcgaagttgcgttcggcgttcgagatcggtagttgcgtggggcgggggttgcgttcgagttcgatttgtcggtttcgaggtaagtttagcgcgggcggttatcgtttagagtcgcgtaattttgtttcgaagtggttgcgatatcgagaaagtcgttcggttagggtttggatttgggcgggggcgg

SEQ ID NO: 7512 - DNA, 960 bp, Artificial Sequence
  chemically treated genomic DNA (Homo sapiens) CpG-island No: 7512
ccgcccccgcccaaatccaaaccctaaccgaacgactttctcgatatcgcaaccacttcgaaacaaaattacgcgactctaaacgataaccgcccgcgctaaacttacctcgaaaccgacaaatcgaactcgaacgcaacccccgccccacgcaactaccgatctcgaacgccgaacgcaacttcgccgcctatactcgctacgcgaatcgctccgatctcgtcctaaaattactttctctctcgcccccaaccctccccccacccacccctcccgccccgacccccgcttcacgcgacccctcgcgacgcgacgcgccgaaacctcccctccccaccctcccctcgcctcctcccctcttcgcgaccgccgcctccgccgccgccgcctcctcctcgcgccgctctccgactaccctcccgccgctcccacctcctctcctccctcctctctctccgacgacctccctcgattactaaaaaaaaaaccaaccccccactccaacccctaaccaacgcctcgccgcgacccaacccgaacgtaaaaaacaacgatccgaccccaaattacccaacgcgaacgaacgcgcgcgacgactcctaactcgaaactcgactacgccgcgaaacaaaaaattaaaatcgcaattaactccgcgcgcccgcgcctaacgacaaaaacgcgccgtttcccctcctttcgccgaacgatccccacccgcctctcccgaaacccgcgccttcccgccgaaaccgcgaccaaaaccctcccgaaaacgatacgcccaaaccccaacgccctccgcgacccaaccccccgccccccgccgaccgaccacgcgacgcccgaacctcctccgaactcgaaaaaaaaacgaaaaaaaaactaattttaatcattatcatttcatctaatataatatttccccgaacgctttcaactaaacataaattttcgact

SEQ ID NO: 7513 - DNA, 548 bp, Artificial Sequence
  chemically treated genomic DNA (Homo sapiens) CpG-island No: 7513
gacgtttgcggatacgcggtcggtcgtcgcgggggagggacgcgttggggtatcgggtcgatcgttcgcggttagacgcgttattttttttacgcgcgcggcgcgatggagacggcggtagttaagatttttcgcggtcgaggttcgcgtttcggacgtttttttttagttttcgtttcggtcgttttttttttttttttttttatttttattttttttttttttttttttttttttgttttttttgcgtttcgttcgtgtttttttttttttttcggcgattatttttcggtttttaggaaacggagcgcgcgattggtcggtattgcgttttcgtttggttttagggacgttcgggtcggagatcggttgggatcgcggggcgggtgcgtacgggtcggaacggcgtttgggtttcgatcgtcggtttcggtcgggtttggacgttttttagcggtcgtattttcggggtggggggcgttcggggtcggtttggagttggggtgagggggattcggggtgttagtgggaggaaggtgaagtggggg

SEQ ID NO: 7514 - DNA, 548 bp, Artificial Sequence
  chemically treated genomic DNA (Homo sapiens) CpG-island No: 7514
cccccacttcaccttcctcccactaacaccccgaatccccctcaccccaactccaaaccgaccccgaacgccccccaccccgaaaatacgaccgctaaaaaacgtccaaacccgaccgaaaccgacgatcgaaacccaaacgccgttccgacccgtacgcacccgccccgcgatcccaaccgatctccgacccgaacgtccctaaaaccaaacgaaaacgcaataccgaccaatcgcgcgctccgtttcctaaaaaccgaaaaataatcgccgaaaaaaaaaaaaaaacacgaacgaaacgcaaaaaaaacaaaaaaaaaaaaaaaaaaaaaaaaaataaaaataaaaaaaaaaaaaaaaaaaacgaccgaaacgaaaactaaaaaaaaacgtccgaaacgcgaacctcgaccgcgaaaaatcttaactaccgccgtctccatcgcgccgcgcgcgtaaaaaaaataacgcgtctaaccgcgaacgatcgacccgataccccaacgcgtccctcccccgcgacgaccgaccgcgtatccgcaaacgtc

SEQ ID NO: 7515 - DNA, 548 bp, Artificial Sequence
  chemically treated genomic DNA (Homo sapiens) CpG-island No: 7515
tttttattttattttttttttattggtatttcgagttttttttattttagttttaggtcgatttcgagcgttttttatttcgggagtgcggtcgttagggggcgtttaggttcggtcggagtcggcggtcgggatttaggcgtcgtttcggttcgtgcgtattcgtttcgcggttttagtcggttttcggttcgggcgtttttggagttaggcgggggcgtagtgtcggttagtcgcgcgtttcgttttttaggagtcgggaaatggtcgtcgaggaggaggaggaggtacgggcggggcgtaaaggaaataggaggaagaggaaggggaggaggagtgggagtgggagaaaaggaggaaggggcggtcgaagcggagattggggaggggcgttcggggcgcggatttcggtcgcggggagttttggttgtcgtcgtttttatcgcgtcgcgcgcgtaaaggaaatggcgcgtttagtcgcgagcggtcggttcggtgttttagcgcgtttttttttcgcggcggtcgatcgcgtgttcgtagacgtt

SEQ ID NO: 7516 - DNA, 548 bp, Artificial Sequence
  chemically treated genomic DNA (Homo sapiens) CpG-island No: 7516
aacgtctacgaacacgcgatcgaccgccgcgaaaaaaaaacgcgctaaaacaccgaaccgaccgctcgcgactaaacgcgccatttcctttacgcgcgcgacgcgataaaaacgacgacaaccaaaactccccgcgaccgaaatccgcgccccgaacgcccctccccaatctccgcttcgaccgccccttcctccttttctcccactcccactcctcctccccttcctcttcctcctatttcctttacgccccgcccgtacctcctcctcctcctcgacgaccatttcccgactcctaaaaaacgaaacgcgcgactaaccgacactacgcccccgcctaactccaaaaacgcccgaaccgaaaaccgactaaaaccgcgaaacgaatacgcacgaaccgaaacgacgcctaaatcccgaccgccgactccgaccgaacctaaacgccccctaacgaccgcactcccgaaataaaaaacgctcgaaatcgacctaaaactaaaataaaaaaaactcgaaataccaataaaaaaaaaataaaataaaaa

SEQ ID NO: 7517 - DNA, 1436 bp, Artificial Sequence
  chemically treated genomic DNA (Homo sapiens) CpG-island No: 7517
  misc_feature (358)..(358): n is either a, c, g or t
  misc_feature (365)..(365): n is either a, c, g or t
  misc_feature (634)..(634): n is either a, c, g or t
  misc_feature (967)..(967): n is either a, c, g or t
cggggggaaaacggaagtcggatttatgggttttcggcgcgaaattatgaagacgaagttttaaatcgggtatcggggaaaaatttttaatggggggcgggatattaatacggggggcggtggtgtagttttcgggcgggcgtggagaaaagcgtttcgtaaaggtgatttacgagggggaggacgggagattcgggttcggggaggggggtcgagagggggggtcggaggttcggggaagaacggattttgtgggggtaaggggacgtacgtagcgcgatacgttacgatcgtaggtatatttcgagatagtttagatattagaggatacggatcgggtaattttcgtattagttangttttanttacgtaatattagaggagcgtagtagtaattaatcgaagtattagatatcgagtaacgatagtatataacgtacgatatataaatttagttatagcgttataggtattagcgagaggatatacgaagagacgacgagcgataggatatacgtcgacgcgagaatatatatcgtagataatacgagaagtacgagggtagatacgtatacgcgaataaaggtttaaggagacgacgaagagtatacgtaaagtacggagtatattacgnatattattattatataagatatataagataataagattcgatagtaaacgggtagacgcgaatatatacgcgagtaaggtacgaagcgacgaggagaaaattattagataaagatttaaaagtagaagagtagatagagcgagaagtagaggacgttagatataagtagtaaggaacgagaacgtatagatatacgtacgtataaagaatacgatacgatcgagtacgcgtataattagattaataggataatcgcgagatatattatatataggatatattaagagtatataacggtaagagtttatagtatagtcgtacgagtagacgatnagagcgcgtgataatatatagttgtattagtagatacgatcgagtacgagaacgacgttaatagcggcgcgaggatatcgaacgatacgtagatatagtgtaattgtagatattacgagatacgcgcgacgtatacgataattagatggattaacgagaaatacgttgaatatagtattatcggatagtagacgagacggagagtattacgcgacgcgagtatacgaatatagtaattatttataggaggataaagttagtgtgcgtacgaatatcgtcgagtaatatagaagcgatacgatcgatagagagatacgaaatattatagtagtataacgaatataattaataaggagacgcgatatcgcgcgataagagtatatagtacgtaatatcgtaggttatggttaggtaagggggaggtcgttacgggttaagcgggggaaagttaaatcgttgggtttaatat

SEQ ID NO: 7518 - DNA, 1436 bp, Artificial Sequence
  chemically treated genomic DNA (Homo sapiens) CpG-island No: 7518
  misc_feature (470)..(470): n is either a, c, g or t
  misc_feature (803)..(803): n is either a, c, g or t
  misc_feature (1072)..(1072): n is either a, c, g or t
  misc_feature (1079)..(1079): n is either a, c, g or t
atattaaacccaacgatttaactttcccccgcttaacccgtaacgacctcccccttacctaaccataacctacgatattacgtactatatactcttatcgcgcgatatcgcgtctccttattaattatattcgttatactactataatatttcgtatctctctatcgatcgtatcgcttctatattactcgacgatattcgtacgcacactaactttatcctcctataaataattactatattcgtatactcgcgtcgcgtaatactctccgtctcgtctactatccgataatactatattcaacgtatttctcgttaatccatctaattatcgtatacgtcgcgcgtatctcgtaatatctacaattacactatatctacgtatcgttcgatatcctcgcgccgctattaacgtcgttctcgtactcgatcgtatctactaatacaactatatattatcacgcgctctnatcgtctactcgtacgactatactataaactcttaccgttatatactcttaatatatcctatatataatatatctcgcgattatcctattaatctaattatacgcgtactcgatcgtatcgtattctttatacgtacgtatatctatacgttctcgttccttactacttatatctaacgtcctctacttctcgctctatctactcttctacttttaaatctttatctaataattttctcctcgtcgcttcgtaccttactcgcgtatatattcgcgtctacccgtttactatcgaatcttattatcttatatatcttatataataataatatncgtaatatactccgtactttacgtatactcttcgtcgtctccttaaacctttattcgcgtatacgtatctaccctcgtacttctcgtattatctacgatatatattctcgcgtcgacgtatatcctatcgctcgtcgtctcttcgtatatcctctcgctaatacctataacgctataactaaatttatatatcgtacgttatatactatcgttactcgatatctaatacttcgattaattactactacgctcctctaatattacgtaantaaaacntaactaatacgaaaattacccgatccgtatcctctaatatctaaactatctcgaaatatacctacgatcgtaacgtatcgcgctacgtacgtccccttacccccacaaaatccgttcttccccgaacctccgaccccccctctcgacccccctccccgaacccgaatctcccgtcctccccctcgtaaatcacctttacgaaacgcttttctccacgcccgcccgaaaactacaccaccgccccccgtattaatatcccgccccccattaaaaatttttccccgatacccgatttaaaacttcgtcttcataatttcgcgccgaaaacccataaatccgacttccgttttccccccg

SEQ ID NO: 7519 - DNA, 1436 bp, Artificial Sequence
  chemically treated genomic DNA (Homo sapiens) CpG-island No: 7519
  misc_feature (470)..(470): n is either a, c, g or t
  misc_feature (803)..(803): n is either a, c, g or t
  misc_feature (1072)..(1072): n is either a, c, g or t
  misc_feature (1079)..(1079): n is either a, c, g or t
gtattgggtttagcggtttagttttttttcgtttggttcgtggcgattttttttttatttggttatggtttgcgatgttgcgtgttgtgtgtttttgtcgcgcggtgtcgcgtttttttgttggttgtgttcgttgtgttgttgtggtgtttcgtgtttttttgtcggtcgtgtcgtttttgtgttgttcggcgatgttcgtgcgtatattggttttgtttttttgtgggtggttgttgtgttcgtatgttcgcgtcgcgtgatgtttttcgtttcgtttgttgttcggtggtgttgtgtttagcgtgtttttcgttagtttatttggttgtcgtgtgcgtcgcgcgtgtttcgtgatgtttgtagttgtattgtgtttgcgtgtcgttcggtgttttcgcgtcgttgttggcgtcgttttcgtgttcggtcgtatttgttggtgtagttgtgtgttgttacgcgttttngtcgtttgttcgtgcggttgtgttgtgggtttttgtcgttgtgtgtttttggtgtgttttgtgtgtggtgtgtttcgcggttgttttgttggtttggttgtgcgcgtgttcggtcgtgtcgtgttttttgtgcgtgcgtgtgtttgtgcgttttcgttttttgttgtttgtgtttggcgttttttgtttttcgttttgtttgtttttttgtttttgggtttttgtttggtggtttttttttcgtcgtttcgtgttttgttcgcgtgtgtgttcgcgtttgttcgtttgttgtcgggttttgttgttttgtgtgttttgtgtggtggtggtgtncgtggtgtgtttcgtgttttgcgtgtgtttttcgtcgtttttttgggtttttgttcgcgtgtgcgtgtttgttttcgtgtttttcgtgttgtttgcggtgtgtgttttcgcgtcggcgtgtgttttgtcgttcgtcgttttttcgtgtgttttttcgttggtgtttgtggcgttgtggttgggtttgtgtgtcgtgcgttgtgtgttgtcgttgttcggtgtttggtgtttcggttggttgttgttgcgtttttttggtgttgcgtggntggggtntggttaatgcggagattgttcgattcgtgttttttggtgtttgaattgtttcgaggtgtgtttgcggtcgtagcgtgtcgcgttgcgtgcgtttttttgtttttatagggttcgttttttttcgagttttcggttttttttttcggttttttttttcgggttcggatttttcgttttttttttcgtgggttatttttgcggggcgtttttttttacgttcgttcgggggttatattatcgtttttcgtgttggtatttcgttttttattaagggttttttttcggtgttcggtttagggtttcgtttttatggtttcgcgtcgaaggtttatggattcgattttcgtttttttttcg

SEQ ID NO: 7520 - DNA, 1436 bp, Artificial Sequence
  chemically treated genomic DNA (Homo sapiens) CpG-island No: 7520
  misc_feature (358)..(358): n is either a, c, g or t
  misc_feature (365)..(365): n is either a, c, g or t
  misc_feature (634)..(634): n is either a, c, g or t
  misc_feature (967)..(967): n is either a, c, g or t
cgaaaaaaaaacgaaaatcgaatccataaaccttcgacgcgaaaccataaaaacgaaaccctaaaccgaacaccgaaaaaaaacccttaataaaaaacgaaataccaacacgaaaaacgataatataacccccgaacgaacgtaaaaaaaaacgccccgcaaaaataacccacgaaaaaaaaaacgaaaaatccgaacccgaaaaaaaaaaccgaaaaaaaaaaccgaaaactcgaaaaaaaacgaaccctataaaaacaaaaaaacgcacgcaacgcgacacgctacgaccgcaaacacacctcgaaacaattcaaacaccaaaaaacacgaatcgaacaatctccgcattaaccanaccccanccacgcaacaccaaaaaaacgcaacaacaaccaaccgaaacaccaaacaccgaacaacgacaacacacaacgcacgacacacaaacccaaccacaacgccacaaacaccaacgaaaaaacacacgaaaaaacgacgaacgacaaaacacacgccgacgcgaaaacacacaccgcaaacaacacgaaaaacacgaaaacaaacacgcacacgcgaacaaaaacccaaaaaaacgacgaaaaacacacgcaaaacacgaaacacaccacgnacaccaccaccacacaaaacacacaaaacaacaaaacccgacaacaaacgaacaaacgcgaacacacacgcgaacaaaacacgaaacgacgaaaaaaaaaccaccaaacaaaaacccaaaaacaaaaaaacaaacaaaacgaaaaacaaaaaacgccaaacacaaacaacaaaaaacgaaaacgcacaaacacacgcacgcacaaaaaacacgacacgaccgaacacgcgcacaaccaaaccaacaaaacaaccgcgaaacacaccacacacaaaacacaccaaaaacacacaacgacaaaaacccacaacacaaccgcacgaacaaacgacnaaaacgcgtaacaacacacaactacaccaacaaatacgaccgaacacgaaaacgacgccaacaacgacgcgaaaacaccgaacgacacgcaaacacaatacaactacaaacatcacgaaacacgcgcgacgcacacgacaaccaaataaactaacgaaaaacacgctaaacacaacaccaccgaacaacaaacgaaacgaaaaacatcacgcgacgcgaacatacgaacacaacaaccacccacaaaaaaacaaaaccaatatacgcacgaacatcgccgaacaacacaaaaacgacacgaccgacaaaaaaacacgaaacaccacaacaacacaacgaacacaaccaacaaaaaaacgcgacaccgcgcgacaaaaacacacaacacgcaacatcgcaaaccataaccaaataaaaaaaaaatcgccacgaaccaaacgaaaaaaaactaaaccgctaaacccaatac

SEQ ID NO: 7521 - DNA, 1351 bp, Artificial Sequence
  chemically treated genomic DNA (Homo sapiens) CpG-island No: 7521
  misc_feature (17)..(17): n is either a, c, g or t
  misc_feature (19)..(19): n is either a, c, g or t
  misc_feature (23)..(23): n is either a, c, g or t
  misc_feature (25)..(25): n is either a, c, g or t
  misc_feature (28)..(28): n is either a, c, g or t
  misc_feature (30)..(30): n is either a, c, g or t
  misc_feature (33)..(33): n is either a, c, g or t
  misc_feature (36)..(36): n is either a, c, g or t
  misc_feature (52)..(52): n is either a, c, g or t
  misc_feature (64)..(64): n is either a, c, g or t
  misc_feature (99)..(99): n is either a, c, g or t
  misc_feature (106)..(106): n is either a, c, g or t
  misc_feature (108)..(108): n is either a, c, g or t
  misc_feature (156)..(156): n is either a, c, g or t
  misc_feature (228)..(228): n is either a, c, g or t
  misc_feature (236)..(236): n is either a, c, g or t
  misc_feature (398)..(398): n is either a, c, g or t
  misc_feature (510)..(510): n is either a, c, g or t
  misc_feature (651)..(651): n is either a, c, g or t
  misc_feature (687)..(687): n is either a, c, g or t
  misc_feature (772)..(772): n is either a, c, g or t
  misc_feature (835)..(835): n is either a, c, g or t
  misc_feature (893)..(893): n is either a, c, g or t
  misc_feature (1000)..(1000): n is either a, c, g or t
  misc_feature (1071)..(1071): n is either a, c, g or t
  misc_feature (1176)..(1176): n is either a, c, g or t
  misc_feature (1181)..(1181): n is either a, c, g or t
  misc_feature (1191)..(1191): n is either a, c, g or t
  misc_feature (1211)..(1211): n is either a, c, g or t
agtacgcgacgtagaananagtntncgntnttncgngtcgttcgggcgagtncgtcgcgcgcgncggtcgcggcgtaagcgcgcgcgcgtcgtcgtcgngcgcgtntngaattttcggcgacgagcgtagcgtagaggacgttagaatatagagtnatttattagcgcgaagcgcgtagtatatagatagagatacgagcgcgatagagagtattatacgagacgagngaacgttntagcgtatatcggaggtatagatagagatagcgagacgcgagtacgtacgtcgatatagagaagacgatatagaatagagtacgtacgaggatagatattagttaacgtagagatagcgttatacgttcgttatataggagatcgcggagcgcgaacgacgngtacgatacgacgacgagtacgtagagacggatacgaagagacgtatcgcgcgtaggatatacgagtatacgagacgtataaacgttatatatacgagtacgatcgtagatnagattatacgacgatagaacgagttattatagtagagcgatacgataggagcgagacgtatatatatataagagtaagataacgagagtataataacgagatacgcgacgagcgcgacgaggtacgtagcgtagcgagtangtagcgcgacgaacgagagacgcggatattcgcgancgtagacgcgcgtacgatacgacgagatatacgtcgagacgatagagcgagtatacgacgtaggtacgcgcgatagcgatagcgngatcgacggttagtagaagagatattagcgtcgtagaagatacgataatagtagtatataggngtcgagatcgagtatagagattagatcgtacgatataacggtacgatcgagcgacgtngtacgattaatagtattagacgacgggacgtaagaagtatagacgatatcgatatcgatagtagagatatcgatcgagacggcgcgttgacgagacgttcgtattanacgatattaagagatatatacgagtatagacgtatatattagcgaaacgtacgtagcgtatagagtaaatnagaatagtacgcgaggtatacgtaatatagtatagacgagcgatacgcgaaacgtatagtatacggcgtagaagagtatagtcgcgacgcggtatagacgatagnacgancgacgaggtnagcgacgcgcgtatcgtagntcgagatatacgtatagcgttgtttgcgtaggtgtagcgtcgtttttttgagagtatgtgttggcggagtagagttgtcgggttttttggtaattttttatttatttatttgaggacgtcgtgtgttttaggaggatagt

SEQ ID NO: 7522 - DNA, 1351 bp, Artificial Sequence
  chemically treated genomic DNA (Homo sapiens) CpG-island No: 7522
  misc_feature (141)..(141): n is either a, c, g or t
  misc_feature (161)..(161): n is either a, c, g or t
  misc_feature (171)..(171): n is either a, c, g or t
  misc_feature (176)..(176): n is either a, c, g or t
  misc_feature (281)..(281): n is either a, c, g or t
  misc_feature (352)..(352): n is either a, c, g or t
  misc_feature (459)..(459): n is either a, c, g or t
  misc_feature (517)..(517): n is either a, c, g or t
  misc_feature (580)..(580): n is either a, c, g or t
  misc_feature (665)..(665): n is either a, c, g or t
  misc_feature (701)..(701): n is either a, c, g or t
  misc_feature (842)..(842): n is either a, c, g or t
  misc_feature (954)..(954): n is either a, c, g or t
  misc_feature (1116)..(1116): n is either a, c, g or t
  misc_feature (1124)..(1124): n is either a, c, g or t
  misc_feature (1196)..(1196): n is either a, c, g or t
  misc_feature (1244)..(1244): n is either a, c, g or t
  misc_feature (1246)..(1246): n is either a, c, g or t
  misc_feature (1253)..(1253): n is either a, c, g or t
  misc_feature (1288)..(1288): n is either a, c, g or t
  misc_feature (1300)..(1300): n is either a, c, g or t
  misc_feature (1316)..(1316): n is either a, c, g or t
  misc_feature (1319)..(1319): n is either a, c, g or t
  misc_feature (1322)..(1322): n is either a, c, g or t
  misc_feature (1324)..(1324): n is either a, c, g or t
  misc_feature (1327)..(1327): n is either a, c, g or t
  misc_feature (1329)..(1329): n is either a, c, g or t
  misc_feature (1333)..(1333): n is either a, c, g or t
  misc_feature (1335)..(1335): n is either a, c, g or t
actatcctcctaaaacacacgacgtcctcaaataaataaataaaaaattaccaaaaaacccgacaactctactccgccaacacatactctcaaaaaaacgacgctacacctacgcaaacaacgctatacgtatatctcganctacgatacgcgcgtcgctnacctcgtcgntcgtnctatcgtctataccgcgtcgcgactatactcttctacgccgtatactatacgtttcgcgtatcgctcgtctatactatattacgtatacctcgcgtactattctnatttactctatacgctacgtacgtttcgctaatatatacgtctatactcgtatatatctcttaatatcgtntaatacgaacgtctcgtcaacgcgccgtctcgatcgatatctctactatcgatatcgatatcgtctatacttcttacgtcccgtcgtctaatactattaatcgtacnacgtcgctcgatcgtaccgttatatcgtacgatctaatctctatactcgatctcgacncctatatactactattatcgtatcttctacgacgctaatatctcttctactaaccgtcgatcncgctatcgctatcgcgcgtacctacgtcgtatactcgctctatcgtctcgacgtatatctcgtcgtatcgtacgcgcgtctacgntcgcgaatatccgcgtctctcgttcgtcgcgctacntactcgctacgctacgtacctcgtcgcgctcgtcgcgtatctcgttattatactctcgttatcttactcttatatatatatacgtctcgctcctatcgtatcgctctactataataactcgttctatcgtcgtataatctnatctacgatcgtactcgtatatataacgtttatacgtctcgtatactcgtatatcctacgcgcgatacgtctcttcgtatccgtctctacgtactcgtcgtcgtatcgtacncgtcgttcgcgctccgcgatctcctatataacgaacgtataacgctatctctacgttaactaatatctatcctcgtacgtactctattctatatcgtcttctctatatcgacgtacgtactcgcgtctcgctatctctatctatacctccgatatacgctanaacgttcnctcgtctcgtataatactctctatcgcgctcgtatctctatctatatactacgcgcttcgcgctaataaatnactctatattctaacgtcctctacgctacgctcgtcgccgaaaattcnanacgcgcncgacgacgacgcgcgcgcgcttacgccgcgaccgncgcgcgcgacgnactcgcccgaacgacncgnaanancgnanactntnttctacgtcgcgtact

SEQ ID NO: 7523 - DNA, 1351 bp, Artificial Sequence
  chemically treated genomic DNA (Homo sapiens) CpG-island No: 7523
  misc_feature (141)..(141): n is either a, c, g or t
  misc_feature (161)..(161): n is either a, c, g or t
  misc_feature (171)..(171): n is either a, c, g or t
  misc_feature (176)..(176): n is either a, c, g or t
  misc_feature (281)..(281): n is either a, c, g or t
  misc_feature (352)..(352): n is either a, c, g or t
  misc_feature (459)..(459): n is either a, c, g or t
  misc_feature (517)..(517): n is either a, c, g or t
  misc_feature (580)..(580): n is either a, c, g or t
  misc_feature (665)..(665): n is either a, c, g or t
  misc_feature (701)..(701): n is either a, c, g or t
  misc_feature (842)..(842): n is either a, c, g or t
  misc_feature (954)..(954): n is either a, c, g or t
  misc_feature (1116)..(1116): n is either a, c, g or t
  misc_feature (1124)..(1124): n is either a, c, g or t
  misc_feature (1196)..(1196): n is either a, c, g or t
  misc_feature (1244)..(1244): n is either a, c, g or t
  misc_feature (1246)..(1246): n is either a, c, g or t
  misc_feature (1253)..(1253): n is either a, c, g or t
  misc_feature (1288)..(1288): n is either a, c, g or t
  misc_feature (1300)..(1300): n is either a, c, g or t
  misc_feature (1316)..(1316): n is either a, c, g or t
  misc_feature (1319)..(1319): n is either a, c, g or t
  misc_feature (1322)..(1322): n is either a, c, g or t
  misc_feature (1324)..(1324): n is either a, c, g or t
  misc_feature (1327)..(1327): n is either a, c, g or t
  misc_feature (1329)..(1329): n is either a, c, g or t
  misc_feature (1333)..(1333): n is either a, c, g or t
  misc_feature (1335)..(1335): n is either a, c, g or t
gttatttttttgagatatacgacgtttttaaatggataaatggagagttattagaggattcggtaattttatttcgttagtatatgtttttaggaagacgacgttatatttacgtaggtagcgttgtgcgtgtgtttcggnttgcggtgcgcgcgtcgttngtttcgtcgntcgtnttgtcgtttgtgtcgcgtcgcggttgtgtttttttgcgtcgtgtgttgtgcgtttcgcgtgtcgttcgtttgtgttgtgttgcgtgtgtttcgcgtgttgttttngtttgttttgtgcgttgcgtgcgtttcgttggtgtgtgcgtttgtgttcgtgtgtgttttttggtgtcgtntggtgcgggcgtttcgttagcgcgtcgtttcggtcggtgtttttgttgtcggtgtcggtgtcgtttgtgttttttgcgtttcgtcgtttggtgttgttggtcgtgtngcgtcgttcggtcgtgtcgttgtgtcgtgcggtttggtttttgtgttcggtttcggtntttgtgtgttgttgttgtcgtgttttttgcggcgttggtgttttttttgttggtcgtcggttncgttgtcgttgtcgcgcgtgtttgcgtcgtgtgttcgttttgtcgtttcggcgtgtgtttcgtcgtgtcgtgcgcgcgtttgcgntcgcgggtgttcgcgtttttcgttcgtcgcgttgtntgttcgttgcgttgcgtgtttcgtcgcgttcgtcgcgtgtttcgttgttgtgttttcgttgttttgtttttgtgtgtgtgtgcgtttcgtttttgtcgtgtcgttttgttgtggtggttcgttttgtcgtcgtgtggtttngtttgcggtcgtgttcgtgtgtgtggcgtttgtgcgtttcgtgtgttcgtgtgttttgcgcgcggtgcgttttttcgtgttcgtttttgcgtgttcgtcgtcgtgtcgtgtncgtcgttcgcgtttcgcggttttttgtgtggcgggcgtgtggcgttgtttttgcgttggttggtgtttgttttcgtgcgtgttttgttttgtgtcgttttttttgtgtcggcgtgcgtgttcgcgtttcgttgtttttgtttgtgttttcggtgtgcgttgnggcgtttnttcgtttcgtgtggtgttttttgtcgcgttcgtgtttttgtttgtgtgttgcgcgtttcgcgttggtgggtngttttgtgttttggcgttttttgcgttgcgttcgtcgtcgggggtttngngcgcgtncggcggcggcgcgcgcgcgtttgcgtcgcggtcgncgcgcgcggcgngttcgttcgggcggtncgnggngncgngngttntnttttgcgtcgcgtgtt

SEQ ID NO: 7524 - DNA, 1351 bp, Artificial Sequence
  chemically treated genomic DNA (Homo sapiens) CpG-island No: 7524
  misc_feature (17)..(17): n is either a, c, g or t
  misc_feature (19)..(19): n is either a, c, g or t
  misc_feature (23)..(23): n is either a, c, g or t
  misc_feature (25)..(25): n is either a, c, g or t
  misc_feature (28)..(28): n is either a, c, g or t
  misc_feature (30)..(30): n is either a, c, g or t
  misc_feature (33)..(33): n is either a, c, g or t
  misc_feature (36)..(36): n is either a, c, g or t
  misc_feature (52)..(52): n is either a, c, g or t
  misc_feature (64)..(64): n is either a, c, g or t
  misc_feature (99)..(99): n is either a, c, g or t
  misc_feature (106)..(106): n is either a, c, g or t
  misc_feature (108)..(108): n is either a, c, g or t
  misc_feature (156)..(156): n is either a, c, g or t
  misc_feature (228)..(228): n is either a, c, g or t
  misc_feature (236)..(236): n is either a, c, g or t
  misc_feature (398)..(398): n is either a, c, g or t
  misc_feature (510)..(510): n is either a, c, g or t
  misc_feature (651)..(651): n is either a, c, g or t
  misc_feature (687)..(687): n is either a, c, g or t
  misc_feature (772)..(772): n is either a, c, g or t
  misc_feature (835)..(835): n is either a, c, g or t
  misc_feature (893)..(893): n is either a, c, g or t
  misc_feature (1000)..(1000): n is either a, c, g or t
  misc_feature (1071)..(1071): n is either a, c, g or t
  misc_feature (1176)..(1176): n is either a, c, g or t
  misc_feature (1181)..(1181): n is either a, c, g or t
  misc_feature (1191)..(1191): n is either a, c, g or t
  misc_feature (1211)..(1211): n is either a, c, g or t
aacacgcgacgcaaaananaacncncgncnccncgnaccgcccgaacgaacncgccgcgcgcgncgaccgcgacgcaaacgcgcgcgcgccgccgccgnacgcgcncnaaacccccgacgacgaacgcaacgcaaaaaacgccaaaacacaaaacnacccaccaacgcgaaacgcgcaacacacaaacaaaaacacgaacgcgacaaaaaacaccacacgaaacgaanaaacgccncaacgcacaccgaaaacacaaacaaaaacaacgaaacgcgaacacgcacgccgacacaaaaaaaacgacacaaaacaaaacacgcacgaaaacaaacaccaaccaacgcaaaaacaacgccacacgcccgccacacaaaaaaccgcgaaacgcgaacgacgnacacgacacgacgacgaacacgcaaaaacgaacacgaaaaaacgcaccgcgcgcaaaacacacgaacacacgaaacgcacaaacgccacacacacgaacacgaccgcaaacnaaaccacacgacgacaaaacgaaccaccacaacaaaacgacacgacaaaaacgaaacgcacacacacacaaaaacaaaacaacgaaaacacaacaacgaaacacgcgacgaacgcgacgaaacacgcaacgcaacgaacanacaacgcgacgaacgaaaaacgcgaacacccgcgancgcaaacgcgcgcacgacacgacgaaacacacgccgaaacgacaaaacgaacacacgacgcaaacacgcgcgacaacgacaacgnaaccgacgaccaacaaaaaaaacaccaacgccgcaaaaaacacgacaacaacaacacacaaanaccgaaaccgaacacaaaaaccaaaccgcacgacacaacgacacgaccgaacgacgcnacacgaccaacaacaccaaacgacgaaacgcaaaaaacacaaacgacaccgacaccgacaacaaaaacaccgaccgaaacgacgcgctaacgaaacgcccgcaccanacgacaccaaaaaacacacacgaacacaaacgcacacaccaacgaaacgcacgcaacgcacaaaacaaacnaaaacaacacgcgaaacacacgcaacacaacacaaacgaacgacacgcgaaacgcacaacacacgacgcaaaaaaacacaaccgcgacgcgacacaaacgacaanacgancgacgaaacnaacgacgcgcgcaccgcaanccgaaacacacgcacaacgctacctacgtaaatataacgtcgtcttcctaaaaacatatactaacgaaataaaattaccgaatcctctaataactctccatttatccatttaaaaacgtcgtatatctcaaaaaaataac

SEQ ID NO: 7525 - DNA, 544 bp, Artificial Sequence
  chemically treated genomic DNA (Homo sapiens) CpG-island No: 7525
  misc_feature (3)..(3): n is either a, c, g or t
  misc_feature (6)..(6): n is either a, c, g or t
  misc_feature (20)..(20): n is either a, c, g or t
  misc_feature (460)..(460): n is either a, c, g or t
  misc_feature (531)..(531): n is either a, c, g or t
  misc_feature (539)..(539): n is either a, c, g or t
agngangcgtatacgagttngatcgttatttgatagtgtgcgttttcgatatatatgtttatttagttgtatgttgtaatatttatcgcgttgatgattatcgtcgattatatatagttgttacgatttgtttcgatcgtcgtatcgtagtattcgaagatgtcgtcgtcgatatacgttatttagtatttgtttttatgtgttttattagattgacgatgtattttcgatgttgtatcgtttatcgtgaggatcgtatcgttcgattttatgatttggtgtatcgtaatcgagtgagtattgatgtacggacgtgtgatttacgattttcgtatttcgttgattttgcgatacgtatatgttatgtcgataattttacgtatcgatatagttcgtacgagtagcgtttcgatcgttgttgtgattacgagagttttttatgtgaggttgattcgtagtntagattgagtagatgttgtcgtacgcgtattttgttttgtatgttatgtcgttatatataagtatgatgtngcgtcgantagtt

SEQ ID NO: 7526 - DNA, 544 bp, Artificial Sequence
  chemically treated genomic DNA (Homo sapiens) CpG-island No: 7526
  misc_feature (6)..(6): n is either a, c, g or t
  misc_feature (14)..(14): n is either a, c, g or t
  misc_feature (85)..(85): n is either a, c, g or t
  misc_feature (525)..(525): n is either a, c, g or t
  misc_feature (539)..(539): n is either a, c, g or t
  misc_feature (542)..(542): n is either a, c, g or t
aactantcgacgcnacatcatacttatatataacgacataacatacaaaacaaaatacgcgtacgacaacatctactcaatctanactacgaatcaacctcacataaaaaactctcgtaatcacaacaacgatcgaaacgctactcgtacgaactatatcgatacgtaaaattatcgacataacatatacgtatcgcaaaatcaacgaaatacgaaaatcgtaaatcacacgtccgtacatcaatactcactcgattacgatacaccaaatcataaaatcgaacgatacgatcctcacgataaacgatacaacatcgaaaatacatcgtcaatctaataaaacacataaaaacaaatactaaataacgtatatcgacgacgacatcttcgaatactacgatacgacgatcgaaacaaatcgtaacaactatatataatcgacgataatcatcaacgcgataaatattacaacatacaactaaataaacatatatatcgaaaacgcacactatcaaataacgatcnaactcgtatacgcntcnct

SEQ ID NO: 7527 - DNA, 544 bp, Artificial Sequence
  chemically treated genomic DNA (Homo sapiens) CpG-island No: 7527
  misc_feature (6)..(6): n is either a, c, g or t
  misc_feature (14)..(14): n is either a, c, g or t
  misc_feature (85)..(85): n is either a, c, g or t
  misc_feature (525)..(525): n is either a, c, g or t
  misc_feature (539)..(539): n is either a, c, g or t
  misc_feature (542)..(542): n is either a, c, g or t
agttantcgacgtnatattatgtttgtgtatgacgatatgatatgtagagtaagatacgcgtacgatagtatttgtttagtttgngttacgagttagttttatatgaggaattttcgtagttatagtagcgatcgaagcgttattcgtacgagttatgtcgatgcgtgagattatcgatatagtatatgcgtgtcgtaggattagcgagatgcgagagtcgtgaattatacgttcgtatattagtgtttattcgattacgatgtattagattatagagtcgagcgatacgatttttacgatgagcgatgtagtatcgaggatgtatcgttagtttgatagagtatatgaagataggtgttgagtagcgtgtgtcgacgacgatattttcgagtattacgatgcgacgatcgaggtagatcgtagtagttatgtgtagtcgacgatgattattagcgcgatgggtgttgtagtatatagttagatgagtatatgtgtcgaggacgtatattgttagatgacgattngattcgtgtgcgtnttntt

SEQ ID NO: 7528 - DNA, 544 bp, Artificial Sequence
  chemically treated genomic DNA (Homo sapiens) CpG-island No: 7528
  misc_feature (3)..(3): n is either a, c, g or t
  misc_feature (6)..(6): n is either a, c, g or t
  misc_feature (20)..(20): n is either a, c, g or t
  misc_feature (460)..(460): n is either a, c, g or t
  misc_feature (531)..(531): n is either a, c, g or t
  misc_feature (539)..(539): n is either a, c, g or t
aanaanacgcacacgaatcnaatcgtcatctaacaatatacgtcctcgacacatatactcatctaactatatactacaacacccatcgcgctaataatcatcgtcgactacacataactactacgatctacctcgatcgtcgcatcgtaatactcgaaaatatcgtcgtcgacacacgctactcaacacctatcttcatatactctatcaaactaacgatacatcctcgatactacatcgctcatcgtaaaaatcgtatcgctcgactctataatctaatacatcgtaatcgaataaacactaatatacgaacgtataattcacgactctcgcatctcgctaatcctacgacacgcatatactatatcgataatctcacgcatcgacataactcgtacgaataacgcttcgatcgctactataactacgaaaattcctcatataaaactaactcgtaacncaaactaaacaaatactatcgtacgcgtatcttactctacatatcatatcgtcatacacaaacataatatnacgtcgantaact

SEQ ID NO: 7529 - DNA, 1762 bp, Artificial Sequence
  chemically treated genomic DNA (Homo sapiens) CpG-island No: 7529
  misc_feature (1426)..(1426): n is either a, c, g or t
  misc_feature (1496)..(1496): n is either a, c, g or t
  misc_feature (1732)..(1732): n is either a, c, g or t
  misc_feature (1741)..(1742): n is either a, c, g or t
  misc_feature (1745)..(1745): n is either a, c, g or t
aacggcgtttatattttttatttcggttttttttttggcggtcgtttaattacgtacgtgaggtttacgtattttttttatttttttttggttggcgttttatatttttttttttttttgttttcgttttttttttttttgttttttggcgtgacgtttcgtttttttcgcggttttttttaatttttcgttttattttttttttttttttttgtttttttttttttttattttcgtagtttttttttttttatcggcgttttttttttttttcgcgtttttacgtttacggtatttatatttttttttattattttttacgcgtttttttttttttttttcgttttttttttttttttttttttgttttttcgcgtttttttttttttttgtttttttttttttttttttttttttttttttttttttttttttttttttttttcgttttttttgcggtcgtttttttttttttttcgcgtttttttttttttttttgcgttcgtttttttttcgcgcgcgtttttttcgtgattttcgtttttttttattcgcgttttttattttttattgttttgtttttttcggttttcggttgtttttttttcgttttcgtcgcgtttttattttgttttttttttattttgtttttttcggtttttttttcgtttttttttttttttcgtttttcgtttttcgttttttttttttttttttttttttttttgttttagtttcgtttcgttattttcgttttcgttttttcgtttttttttgcgttttttttttattcgcggttttgttcgtcgttttcgtttcgtttttttttttcgtgtttttttttttgtttttttcgcgttttttttcgtttttttcgttttcgttttttttcgtcgtcggtttttcgttttgttttttttcgtttcgtttttttggtttttttgttcggcgtttttttcgtttgtcgtgtattcgcgtttcgtcggttttcgcgttttcgtttttgtcgttttcgtttttttttttttttttttcgttttttttttttttttttttttgcgttttcgttttgtcgtttgttattttttttttttttttttttttcgttttttttcgtttttttgtttttttttttttcgtttttttttttttttttttcgtcgtttgttcgttttttttttttacgtcgttgtggtttcggttttttgtttgttttcgttgtttttttgtttttgtcggttttgcgtcgttattgtttcgtttttatacgcgtttttttttttcgttttttcgtttttacgtttgttgtttttgttcgtgcgtcgttttttttagtaagttgttcgtattttttgtttatttcgttttttgacgcgttatattatttcgttttgttttttgttttttttattatcgttttttttancgttttgtagcgtgtttatttgcgttttcgtgttattttttttttacgtttattttattttgttgttttnattttgttttcgtgcgcgttgttgtttacgtgttcgcgttgttttttcgtatttttttttgttgttttcgattttttcgtgtttttttttgatttttatcgtttttatcgttttgatttgttgtttcgagtacgatatttcgtttgttcggtcgtcgtcgttttgtttttcgttttattgtttttcgcgcgtcgacgagtatttttttcgtcgtattcgtcgagttgtatttggtntttttttannttntttagaatttattttat

SEQ ID NO: 7530 - DNA, 1762 bp, Artificial Sequence
  chemically treated genomic DNA (Homo sapiens) CpG-island No: 7530
  misc_feature (18)..(18): n is either a, c, g or t
  misc_feature (21)..(22): n is either a, c, g or t
  misc_feature (31)..(31): n is either a, c, g or t
  misc_feature (267)..(267): n is either a, c, g or t
  misc_feature (337)..(337): n is either a, c, g or t
ataaaataaattctaaanaanntaaaaaaanaccaaatacaactcgacgaatacgacgaaaaaaatactcgtcgacgcgcgaaaaacaataaaacgaaaaacaaaacgacgacgaccgaacaaacgaaatatcgtactcgaaacaacaaatcaaaacgataaaaacgataaaaatcaaaaaaaaacacgaaaaaatcgaaaacaacaaaaaaaaatacgaaaaaacaacgcgaacacgtaaacaacaacgcgcacgaaaacaaaatnaaaacaacaaaataaaataaacgtaaaaaaaaaataacacgaaaacgcaaataaacacgctacaaaacgntaaaaaaaacgataataaaaaaaacaaaaaacaaaacgaaataatataacgcgtcaaaaaacgaaataaacaaaaaatacgaacaacttactaaaaaaaacgacgcacgaacaaaaacaacaaacgtaaaaacgaaaaaacgaaaaaaaaaaacgcgtataaaaacgaaacaataacgacgcaaaaccgacaaaaacaaaaaaacaacgaaaacaaacaaaaaaccgaaaccacaacgacgtaaaaaaaaaaaacgaacaaacgacgaaaaaaaaaaaaaaaaaaacgaaaaaaaaaaaaacaaaaaaacgaaaaaaaacgaaaaaaaaaaaaaaaaaaaaaataacaaacgacaaaacgaaaacgcaaaaaaaaaaaaaaaaaaaaaacgaaaaaaaaaaaaaaaaaaacgaaaacgacaaaaacgaaaacgcgaaaaccgacgaaacgcgaatacacgacaaacgaaaaaaacgccgaacaaaaaaaccaaaaaaacgaaacgaaaaaaaacaaaacgaaaaaccgacgacgaaaaaaaacgaaaacgaaaaaaacgaaaaaaaacgcgaaaaaaacaaaaaaaaaaacacgaaaaaaaaaaacgaaacgaaaacgacgaacaaaaccgcgaataaaaaaaaaacgcaaaaaaaaacgaaaaaacgaaaacgaaaataacgaaacgaaactaaaacaaaaaaaaaaaaaaaaaaaaaaaaaaaacgaaaaacgaaaaacgaaaaaaaaaaaaaaacgaaaaaaaaaccgaaaaaaacaaaataaaaaaaaaacaaaataaaaacgcgacgaaaacgaaaaaaaaacaaccgaaaaccgaaaaaaacaaaacaataaaaaataaaaaacgcgaataaaaaaaaacgaaaatcacgaaaaaaacgcgcgcgaaaaaaaaacgaacgcaaaaaaaaaaaaaaaaacgcgaaaaaaaaaaaaaaacgaccgcaaaaaaaacgaaaaaaaaaaaaaaaaaaaaaaaaaaaaaaaaaaaaaaaaaaaaaaaaaaaaacaaaaaaaaaaaaaaacgcgaaaaaacaaaaaaaaaaaaaaaaaaaaaacgaaaaaaaaaaaaaaaaacgcgtaaaaaataataaaaaaaaatataaataccgtaaacgtaaaaacgcgaaaaaaaaaaaaaacgccgataaaaaaaaaaaaactacgaaaataaaaaaaaaaaaaaacaaaaaaaaaaaaaaaaaataaaacgaaaaattaaaaaaaaccgcgaaaaaaacgaaacgtcacgccaaaaaacaaaaaaaaaaaaaacgaaaacaaaaaaaaaaaaaaatataaaacgccaaccaaaaaaaaataaaaaaaatacgtaaacctcacgtacgtaattaaacgaccgccaaaaaaaaaaccgaaataaaaaatataaacgccgtt

SEQ ID NO: 7531 - DNA, 1762 bp, Artificial Sequence
  chemically treated genomic DNA (Homo sapiens) CpG-island No: 7531
  misc_feature (18)..(18): n is either a, c, g or t
  misc_feature (21)..(22): n is either a, c, g or t
  misc_feature (31)..(31): n is either a, c, g or t
  misc_feature (267)..(267): n is either a, c, g or t
  misc_feature (337)..(337): n is either a, c, g or t
atagagtgaattttgggnaanntaggagganattaaatatagttcgacgagtacgacggagagagtgttcgtcgacgcgcggagagtagtagagcgagaggtaagacgacgacgatcgagtaagcgagatgtcgtattcgaagtagtagattaagacgatgagagcgatagagattagaagagagtacggaagagtcgaggatagtagagagagatacgagagagtagcgcgagtacgtgagtagtagcgcgtacgagagtagagtnagagtagtagagtggagtgaacgtagagaagagatggtacgaggacgtagatggatacgttatagagcgntgagagagacggtagtgaagagagtagagagtagagcggagtagtgtagcgcgttaggaggcggagtgagtaagaagtacgagtagtttgttaagagagacgacgtacgagtagaggtagtaggcgtgagagcgaaaggacgagagagagaagcgcgtgtaaaggcggagtagtggcggcgtaggatcgatagagatagggaggtagcgggagtaggtagggagtcgagattatagcgacgtggagagagaggacgggtaggcggcgagaaggagggaggagagagcgagagaggggaggataggggggcgaggagaggcggggaagggggagagaagaggggtagtaggcggtagagcgggagcgtaggggaggggaggagggaggagcggggaaggagggggggaagacgagagcggtaagggcgagagcgcggaggtcgacgggacgcgggtgtacggtaggcggagagagcgtcgggtagaggagttagagaggcgggacgagggagggtaggacggggagtcgacggcgagagggaacgagggcgagagaggcggggggaggcgcgggggaggtagaggagaaggtacgagaagaaagggcggaacggagacggcgagtagagtcgcgagtgggggagaagcgtagaaaggagcgagggagcgggaacgagggtggcggagcgaggttgaaatagaagggagaaaggagagaagaggggagcgaggagcggagggcgggaagaaggagagggcgggagggaggtcggagggggtagagtagggaaggggtagggtggggacgcggcggaggcggagaggaagtagtcgggagtcgagaaagataagatagtggagggtggggaacgcggataaggggaagcggaggttacggggggagcgcgcgcggagagggagcgggcgtagaggggaagaaaagggcgcgagggaggggaggaagcggtcgtagggagggcgggggagaggaggaagggggagagggaggggggagagggaggagagagagagagtagaggggaagaagggcgcgaagagataggagagggagggagggaggggcgggagaggagggaagagacgcgtggagagtgatggggaagagtgtgggtgtcgtgggcgtgggggcgcgggaaaagaaaagagcgtcggtaaaaaaaaaaaaattgcgggggtgggggggagggggggtagagagaggggaggagggtaaagcggggagttggagggaatcgcggggggggcggagcgttacgttagagggtaggaggggaggaggcgggagtagggggggggagaagtgtaagacgttagttaggagaaggtagggagagtgcgtggattttacgtgcgtggttaggcggtcgttaaggaggaggtcgaggtagggggtgtgaacgtcgtt

SEQ ID NO: 7532 - DNA, 1762 bp, Artificial Sequence
  chemically treated genomic DNA (Homo sapiens) CpG-island No: 7532
  misc_feature (1426)..(1426): n is either a, c, g or t
  misc_feature (1496)..(1496): n is either a, c, g or t
  misc_feature (1732)..(1732): n is either a, c, g or t
  misc_feature (1741)..(1742): n is either a, c, g or t
  misc_feature (1745)..(1745): n is either a, c, g or t
aacgacgttcacaccccctacctcgacctcctccttaacgaccgcctaaccacgcacgtaaaatccacgcactctccctaccttctcctaactaacgtcttacacttctccccccccctactcccgcctcctcccctcctaccctctaacgtaacgctccgccccccccgcgattccctccaactccccgctttaccctcctcccctctctctaccccccctcccccccacccccgcaatttttttttttttaccgacgctcttttcttttcccgcgcccccacgcccacgacacccacactcttccccatcactctccacgcgtctcttccctcctctcccgcccctccctccctccctctcctatctcttcgcgcccttcttcccctctactctctctctctcctccctctcccccctccctctcccccttcctcctctcccccgccctccctacgaccgcttcctcccctccctcgcgcccttttcttcccctctacgcccgctccctctccgcgcgcgctccccccgtaacctccgcttccccttatccgcgttccccaccctccactatcttatctttctcgactcccgactacttcctctccgcctccgccgcgtccccaccctaccccttccctactctaccccctccgacctccctcccgccctctccttcttcccgccctccgctcctcgctcccctcttctctcctttctcccttctatttcaacctcgctccgccaccctcgttcccgctccctcgctcctttctacgcttctcccccactcgcgactctactcgccgtctccgttccgccctttcttctcgtaccttctcctctacctcccccgcgcctccccccgcctctctcgccctcgttccctctcgccgtcgactccccgtcctaccctccctcgtcccgcctctctaactcctctacccgacgctctctccgcctaccgtacacccgcgtcccgtcgacctccgcgctctcgcccttaccgctctcgtcttccccccctccttccccgctcctccctcctcccctcccctacgctcccgctctaccgcctactacccctcttctctcccccttccccgcctctcctcgcccccctatcctcccctctctcgctctctcctccctccttctcgccgcctacccgtcctctctctccacgtcgctataatctcgactccctacctactcccgctacctccctatctctatcgatcctacgccgccactactccgcctttacacgcgcttctctctctcgtcctttcgctctcacgcctactacctctactcgtacgtcgtctctcttaacaaactactcgtacttcttactcactccgcctcctaacgcgctacactactccgctctactctctactctcttcactaccgtctctctcancgctctataacgtatccatctacgtcctcgtaccatctcttctctacgttcactccactctactactctnactctactctcgtacgcgctactactcacgtactcgcgctactctctcgtatctctctctactatcctcgactcttccgtactctcttctaatctctatcgctctcatcgtcttaatctactacttcgaatacgacatctcgcttactcgatcgtcgtcgtcttacctctcgctctactactctccgcgcgtcgacgaacactctctccgtcgtactcgtcgaactatatttaatntcctcctannttncccaaaattcactctat

SEQ ID NO: 7533 - DNA, 1995 bp, Artificial Sequence
  chemically treated genomic DNA (Homo sapiens) CpG-island No: 7533
tattcgggtttttttttttttcgtatttttttttttttttgggttcggttttttttttcgtttttttttttaattgcgttttattattcgtattgcgtgcgtcgttgtttcggtttttttttttttttattttttttcgttgttttttttttttttttttttttttcgtgcgtcgtggggtttcgttcgttttttttttttttttttttttttttatatcgtttttttttttcgttcgtttttttttgttttcgcgtttgtttttttttcgtttttttttttttttttttttcgcgttttttttttttcggtttgtttttttttgtttcgtttttttttttttttttttttttttttgttgcgtttttttcgtttcgtttgtacgttttcgttttgttgttttttttttttttttttttttcggtttttttttttttttttttcgttgcgtatttttttcgttttgttttcgtttttacgttttgtttcgtttttttcgtttttttcgttttcggttttttcgtttttttttttttatttttttgtttttttttttttttttttttttttatttttttgtttttttcgttttgtttttttttcgggttttttatcgtttttttcgcgttgtcgtttttttttgtgtttttttttttatttcgttttcgcgttattttttttttgttttttgtcgttgcgatttcgttttttttttttattttttttcgtttttgttttttttttttttcgtcgttttcgcgtttcgtatatcggtcgtttcggtcgttttttgcgtttttttttttttttttttttatttttcgttcgtttgtcgtttatttcgcgttttcggttttgttcgtttttttttttttatgttttcgcgcgttcgtgtttttttttttttttttttttcgttttcgcgtttttcgtttcgttttttttttttttcgttttttttttttcgtttttgatttgttttttttcgtttcgtcgtgtttgatattttttttttcgttattttcgtgtttttgagttatcgtcgttttatttttcgtttttttattttttttcgattttttttttatcgtgttatatgcgtcgtgttgatttacgtgtcgattttcgttttgttttttttcgtttttcgcgcgttttttttttttgttgtatttgatttttttttttttttttttttttcgttttttatacgtcgtttttttttttttttttcgttcgtttgttttcgtttttttttttttttttttttttcgttttttttttatgttttattttgttttttttcgtttttttttttttttcgttttcgtttgtttgtcggtatgtcgtcgtgggttttgtagggttcgcgatatgttcgtgagagttaacgcgtttattatgttcgtttttttttcgtttgtcgtaatattagtcgatatgtgttgtttttagcgatcgtttttcgatattattttagttatcgtattgtcgtgagatgttattagatagtttaataatagttcgttgcgtggcggatattatatcgtggttgtatggttagagttgtattatattatatgtcgacgttttgttttttttagttatgcgttgtttttttttatgtacgttgttatatttttgatcgtcgtttagtttgttatttagtcgttttcgtgttaatcgtgacggtggagtagtgtcggttttgcgttatttatggcgttttttatcgtttattttcgtttaagtcgaatttttatgtttgtgtgttgttgcggttcgcggttgatgcggtttatttattttcgatttaagagcgtcgttttataacgtgtttagttttagtatgaacgttacggggttatgaatcggttgaggatatatgtgatcgacgtcgttcgtttatatagtgtttatattataggagtgttttacgttaatttttcgaataatacggtgttagttgttttattttggttttggtgttttgtt

SEQ ID NO: 7534 - DNA, 1995 bp, Artificial Sequence
  chemically treated genomic DNA (Homo sapiens) CpG-island No: 7534
aacaaaacaccaaaaccaaaataaaacaactaacaccgtattattcgaaaaattaacgtaaaacactcctataatataaacactatataaacgaacgacgtcgatcacatatatcctcaaccgattcataaccccgtaacgttcatactaaaactaaacacgttataaaacgacgctcttaaatcgaaaataaataaaccgcatcaaccgcgaaccgcaacaacacacaaacataaaaattcgacttaaacgaaaataaacgataaaaaacgccataaataacgcaaaaccgacactactccaccgtcacgattaacacgaaaacgactaaataacaaactaaacgacgatcaaaaatataacaacgtacataaaaaaaaacaacgcataactaaaaaaaacaaaacgtcgacatataatataatacaactctaaccatacaaccacgatataatatccgccacgcaacgaactattattaaactatctaataacatctcacgacaatacgataactaaaataatatcgaaaaacgatcgctaaaaacaacacatatcgactaatattacgacaaacgaaaaaaaaacgaacataataaacgcgttaactctcacgaacatatcgcgaaccctacaaaacccacgacgacataccgacaaacaaacgaaaacgaaaaaaaaaaaaaaacgaaaaaaaacaaaataaaacataaaaaaaaaacgaaaaaaaaaaaaaaaaaaaaaaacgaaaacaaacgaacgaaaaaaaaaaaaaaaaacgacgtataaaaaacgaaaaaaaaaaaaaaaaaaaaaaatcaaatacaacaaaaaaaaaaaacgcgcgaaaaacgaaaaaaaacaaaacgaaaatcgacacgtaaatcaacacgacgcatataacacgataaaaaaaaaatcgaaaaaaaataaaaaaacgaaaaataaaacgacgataactcaaaaacacgaaaataacgaaaaaaaaaatatcaaacacgacgaaacgaaaaaaaacaaatcaaaaacgaaaaaaaaaaaacgaaaaaaaaaaaaaacgaaacgaaaaacgcgaaaacgaaaaaaaaaaaaaaaaaaaaacacgaacgcgcgaaaacataaaaaaaaaaaaacgaacaaaaccgaaaacgcgaaataaacgacaaacgaacgaaaaataaaaaaaaaaaaaaaaaaaaacgcaaaaaacgaccgaaacgaccgatatacgaaacgcgaaaacgacgaaaaaaaaaaaaaacaaaaacgaaaaaaaataaaaaaaaaaaacgaaatcgcaacgacaaaaaacaaaaaaaaaataacgcgaaaacgaaataaaaaaaaaaacacaaaaaaaaacgacaacgcgaaaaaaacgataaaaaacccgaaaaaaaaacaaaacgaaaaaaacaaaaaaataaaaaaaaaaaaaaaaaaaaaaaaacaaaaaaataaaaaaaaaaaaacgaaaaaaccgaaaacgaaaaaaacgaaaaaaacgaaacaaaacgtaaaaacgaaaacaaaacgaaaaaaatacgcaacgaaaaaaaaaaaaaaaaaaaccgaaaaaaaaaaaaaaaaaaaaaacaacaaaacgaaaacgtacaaacgaaacgaaaaaaacgcaacaaaaaaaaaaaaaaaaaaaaaaaaaaacgaaacaaaaaaaaacaaaccgaaaaaaaaaaaacgcgaaaaaaaaaaaaaaaaaaaaacgaaaaaaaaacaaacgcgaaaacaaaaaaaaacgaacgaaaaaaaaaaacgatataaaaaaaaaaaaaaaaaaaaaaaaaacgaacgaaaccccacgacgcacgaaaaaaaaaaaaaaaaaaaaaaaacaacgaaaaaaaataaaaaaaaaaaaaaaccgaaacaacgacgcacgcaatacgaataataaaacgcaattaaaaaaaaaaacgaaaaaaaaaaccgaacccaaaaaaaaaaaaaaatacgaaaaaaaaaaaaacccgaata

SEQ ID NO: 7535 - DNA, 1995 bp, Artificial Sequence
  chemically treated genomic DNA (Homo sapiens) CpG-island No: 7535
agtagggtattaggattaggatgaagtagttggtatcgtgttgttcgaggagttgacgtggaatatttttatggtgtgggtattatataggcgaacggcgtcgattatatatatttttagtcgatttataatttcgtggcgtttatgttgaggttggatacgttatagaacggcgtttttgagtcggaggtagatagatcgtattaatcgcggatcgtaatagtatataggtatgagagttcggtttagacgagggtagacggtaagaggcgttatgagtaacgtagagtcgatattgttttatcgttacgattggtacgaagacgattaggtgatagattggacgacgattagggatgtgatagcgtgtatggaggaggatagcgtatggttgagagagataggacgtcggtatatagtgtgatgtagttttggttatgtaattacgatgtggtgttcgttacgtagcgagttgttgttgaattgtttggtggtattttacggtagtacgatagttgagatgatgtcgggagacgatcgttggagatagtatatatcgattgatattgcgataggcgagggagggacgagtatggtggacgcgttgatttttacggatatatcgcgagttttgtaaggtttacggcgatatgtcggtagatagacgaggacgagagagggagaggggcggaaggagatagagtgaggtataggagagaggcggagaggagaagaaggagaaaggacggaggtagacggacgaagagaagaaggagaagcgacgtatgggaggcgggaaggagagagaggagagagagttaagtgtagtagagagaggaggcgcgcgagagacgagagaggataggacgagagtcggtacgtgagttagtacggcgtatgtgatacgatgagaagagagtcgaagagagatgagagaacgagagatgaagcgacggtgatttagaggtacgagagtgacgagagaggaagtgttagatacgacgaggcgagagagagtagattagagacgagagaggagagacgagagaggggagggacgagacggagagcgcggagacgagaaagagagagggagaagggtacgggcgcgcgagagtatgagaaggagaagacgagtagagtcgaggacgcggagtgagcggtaggcgagcgagggatggaagagagaagagagagagacgtagaggacgatcgagacgatcgatgtacgagacgcgaaggcgacgaaggggaggagagataagaacgagagagagtgagagagagagacgaaatcgtaacgatagaggatagaggagagatagcgcggaggcgagatgagaagaggggtatagagagagacggtagcgcggagagagcggtgagaggttcgaaaggagaatagagcgaggagggtagaagggtgaagagagagggagggagggagaggtagagggatagagaaggaggagcgaaggagtcgaggacggaggaagcgaggagaacggagtagggcgtggagacgagaataggacgaagggaatgcgtagcggggggagagaggagagggatcgaggaggaaaagggagagagagatagtagaacggagacgtgtaggcgggacggagaaggcgtaataggaagaggaggagaaaggggggggagcgggataaggggaagtaggtcgagagaggagaagcgcggaagaggaagaagggaaagaacgaaggggagataagcgcggaagtagaagagagcgagcggggaagagaggcggtgtggagggaagaaaggaaggagggagggcgagcgagattttacggcgtacgggagagggggagaaaagggaggaatagcgaaggagagtgagagggaggagagatcgaaatagcgacgtacgtagtacggataatagagcgtaattgaaaggggaagcggagaggagggtcgaatttaaaggagggagaaggtgcgagagagaagggggttcgggtg

SEQ ID NO: 7536 - DNA, 1995 bp, Artificial Sequence
  chemically treated genomic DNA (Homo sapiens) CpG-island No: 7536
cacccgaacccccttctctctcgcaccttctccctcctttaaattcgaccctcctctccgcttcccctttcaattacgctctattatccgtactacgtacgtcgctatttcgatctctcctccctctcactctccttcgctattcctcccttttctccccctctcccgtacgccgtaaaatctcgctcgccctccctccttcctttcttccctccacaccgcctctcttccccgctcgctctcttctacttccgcgcttatctccccttcgttctttcccttcttcctcttccgcgcttctcctctctcgacctacttccccttatcccgctcccccccctttctcctcctcttcctattacgccttctccgtcccgcctacacgtctccgttctactatctctctctcccttttcctcctcgatccctctcctctctccccccgctacgcattcccttcgtcctattctcgtctccacgccctactccgttctcctcgcttcctccgtcctcgactccttcgctcctccttctctatccctctacctctccctccctccctctctcttcacccttctaccctcctcgctctattctcctttcgaacctctcaccgctctctccgcgctaccgtctctctctatacccctcttctcatctcgcctccgcgctatctctcctctatcctctatcgttacgatttcgtctctctctctcactctctctcgttcttatctctcctccccttcgtcgccttcgcgtctcgtacatcgatcgtctcgatcgtcctctacgtctctctctcttctctcttccatccctcgctcgcctaccgctcactccgcgtcctcgactctactcgtcttctccttctcatactctcgcgcgcccgtacccttctccctctctctttctcgtctccgcgctctccgtctcgtccctcccctctctcgtctctcctctctcgtctctaatctactctctctcgcctcgtcgtatctaacacttcctctctcgtcactctcgtacctctaaatcaccgtcgcttcatctctcgttctctcatctctcttcgactctcttctcatcgtatcacatacgccgtactaactcacgtaccgactctcgtcctatcctctctcgtctctcgcgcgcctcctctctctactacacttaactctctctcctctctctccttcccgcctcccatacgtcgcttctccttcttctcttcgtccgtctacctccgtcctttctccttcttctcctctccgcctctctcctatacctcactctatctccttccgcccctctccctctctcgtcctcgtctatctaccgacatatcgccgtaaaccttacaaaactcgcgatatatccgtaaaaatcaacgcgtccaccatactcgtccctccctcgcctatcgcaatatcaatcgatatatactatctccaacgatcgtctcccgacatcatctcaactatcgtactaccgtaaaataccaccaaacaattcaacaacaactcgctacgtaacgaacaccacatcgtaattacataaccaaaactacatcacactatataccgacgtcctatctctctcaaccatacgctatcctcctccatacacgctatcacatccctaatcgtcgtccaatctatcacctaatcgtcttcgtaccaatcgtaacgataaaacaatatcgactctacgttactcataacgcctcttaccgtctaccctcgtctaaaccgaactctcatacctatatactattacgatccgcgattaatacgatctatctacctccgactcaaaaacgccgttctataacgtatccaacctcaacataaacgccacgaaattataaatcgactaaaaatatatataatcgacgccgttcgcctatataatacccacaccataaaaatattccacgtcaactcctcgaacaacacgataccaactacttcatcctaatcctaataccctact

SEQ ID NO: 7537 - DNA, 517 bp, Artificial Sequence
  chemically treated genomic DNA (Homo sapiens) CpG-island No: 7537
  misc_feature (365)..(365): n is either a, c, g or t
agcgtttttacgatatattttagcgtcgttttatgtagttattttcgtttggtgtatcgtcgatcgttttttgttttaatacgttgtagatatcgtttattttttttttagttcgcgatagatattattttcgttgttatttattttagtattttgttacgacggttgtttagtcgtcgtaattttcgcgttatcggttagagtttagttatagttttgtttagttattttttttattcgtattaatttggttcgtgacgcgtttcgtcgatttgttacgttgtttttcgtagattgtgcgtcgattcgatattcgtttatttagttttgttgatgcgtggtagatagttgttgttttagattgnttagcgtttttaggatataaggtggtttttagatcgcgtatgattttgtatatttcgtttatgttcgttggttgttatttgtttagagcggttagcgtttatatggattatagttttatcgtagtgttgttttgatttatatatatattgtg

SEQ ID NO: 7538 - DNA, 517 bp, Artificial Sequence
  chemically treated genomic DNA (Homo sapiens) CpG-island No: 7538
  misc_feature (153)..(153): n is either a, c, g or t
cacaatatatatataaatcaaaacaacactacgataaaactataatccatataaacgctaaccgctctaaacaaataacaaccaacgaacataaacgaaatatacaaaatcatacgcgatctaaaaaccaccttatatcctaaaaacgctaancaatctaaaacaacaactatctaccacgcatcaacaaaactaaataaacgaatatcgaatcgacgcacaatctacgaaaaacaacgtaacaaatcgacgaaacgcgtcacgaaccaaattaatacgaataaaaaaaataactaaacaaaactataactaaactctaaccgataacgcgaaaattacgacgactaaacaaccgtcgtaacaaaatactaaaataaataacaacgaaaataatatctatcgcgaactaaaaaaaaaataaacgatatctacaacgtattaaaacaaaaaacgatcgacgatacaccaaacgaaaataactacataaaacgacgctaaaatatatcgtaaaaacgct

SEQ ID NO: 7539 - DNA, 517 bp, Artificial Sequence
  chemically treated genomic DNA (Homo sapiens) CpG-island No: 7539
  misc_feature (153)..(153): n is either a, c, g or t
tatagtgtgtatgtgagttagagtagtattgcggtagaattatgatttatgtggacgttagtcgttttgagtaggtgatagttagcgagtatagacgaggtatgtagagttatacgcgatttagagattattttatattttgagagcgttgantagtttagagtagtagttgtttattacgtattagtaggattagatgagcgagtgtcggatcgacgtataatttacgagaagtagcgtgatagatcgacggagcgcgttacgaattagattagtgcgagtggagagaatgattgaatagaattgtggttagattttggtcgatagcgcggagattacggcgattagatagtcgtcgtagtaagatgttggagtggatggtagcgagagtgatatttatcgcgagttgagaagaaggtaagcgatatttgtagcgtattgaagtagagggcggtcgacgatgtattaggcgaggatagttatatagagcggcgttgagatgtgtcgtgaggacgtt

SEQ ID NO: 7540 - DNA, 517 bp, Artificial Sequence
  chemically treated genomic DNA (Homo sapiens) CpG-island No: 7540
  misc_feature (365)..(365): n is either a, c, g or t
aacgtcctcacgacacatctcaacgccgctctatataactatcctcgcctaatacatcgtcgaccgccctctacttcaatacgctacaaatatcgcttaccttcttctcaactcgcgataaatatcactctcgctaccatccactccaacatcttactacgacgactatctaatcgccgtaatctccgcgctatcgaccaaaatctaaccacaattctattcaatcattctctccactcgcactaatctaattcgtaacgcgctccgtcgatctatcacgctacttctcgtaaattatacgtcgatccgacactcgctcatctaatcctactaatacgtaataaacaactactactctaaactantcaacgctctcaaaatataaaataatctctaaatcgcgtataactctacatacctcgtctatactcgctaactatcacctactcaaaacgactaacgtccacataaatcataattctaccgcaatactactctaactcacatacacactata

SEQ ID NO: 7541 - DNA, 816 bp, Artificial Sequence
  chemically treated genomic DNA (Homo sapiens) CpG-island No: 7541
agcgatcgataggtaatcggagaagttcgaaatgtttcgtaagagtacgtcggtatttttttttgagtgataggtattcgattttttgatttcgtcggtcgttatttttatattaaaaagcgttcggtttgtacgtatttttcgacgttttgatggaacgattttttcgagtttattttggcgcggtacgtttcgttaagttttaattttcgtttattttcgagcgtttcgtcgagaaaacgcgcggcgtcgcgggtagcgttttcgttttcgtacgtttcggtagcgcggggtcgcggatatcgcgttttttagcgttaatcgggtcgggggttacgcgttttttcggttttattcggtcgacgtcgtttattacgaggcgcgcggcggcggtcgcgggtttatttatcgtagaggcgcgtatcggttcggatttcgtttttcgtcgttttttttttttgttatcgcgtagtcgtcgtcggattttttgttcgtcgttcgtcgttcgtcggcgggcgcggcggtttttttttttttttcgtcgttttttttcgcgcgtatttcgtttgttttcgcggttcgtacggacggcggggggcggtttcgtacgtcgtttcgttcgcggtatttttcgtagtttcgcgcgtcggttttttttcgttttttacgtttcgtcgttgttcgtcgtttcggttcgttttttttttttcgttttttttcgcgcggcgttcgcggcgggcggggggattatatacgaattttagattttaatatataggggtattttagagagtttatcgtcgttgtattttttat

SEQ ID NO: 7542 - DNA, 816 bp, Artificial Sequence
  chemically treated genomic DNA (Homo sapiens) CpG-island No: 7542
ataaaaaatacaacgacgataaactctctaaaatacccctatatattaaaatctaaaattcgtatataatccccccgcccgccgcgaacgccgcgcgaaaaaaaacgaaaaaaaaaaaacgaaccgaaacgacgaacaacgacgaaacgtaaaaaacgaaaaaaaaccgacgcgcgaaactacgaaaaataccgcgaacgaaacgacgtacgaaaccgccccccgccgtccgtacgaaccgcgaaaacaaacgaaatacgcgcgaaaaaaaacgacgaaaaaaaaaaaaaaaccgccgcgcccgccgacgaacgacgaacgacgaacaaaaaatccgacgacgactacgcgataacaaaaaaaaaaaacgacgaaaaacgaaatccgaaccgatacgcgcctctacgataaataaacccgcgaccgccgccgcgcgcctcgtaataaacgacgtcgaccgaataaaaccgaaaaaacgcgtaacccccgacccgattaacgctaaaaaacgcgatatccgcgaccccgcgctaccgaaacgtacgaaaacgaaaacgctacccgcgacgccgcgcgttttctcgacgaaacgctcgaaaataaacgaaaattaaaacttaacgaaacgtaccgcgccaaaataaactcgaaaaaatcgttccatcaaaacgtcgaaaaatacgtacaaaccgaacgctttttaatataaaaataacgaccgacgaaatcaaaaaatcgaatacctatcactcaaaaaaaaataccgacgtactcttacgaaacatttcgaacttctccgattacctatcgatcgct

SEQ ID NO: 7543 - DNA, 816 bp, Artificial Sequence
  chemically treated genomic DNA (Homo sapiens) CpG-island No: 7543
gtggagggtgtagcgacgatggattttttagagtgtttttgtgtgttagagtttagaattcgtatgtaattttttcgttcgtcgcgggcgtcgcgcggggggggacgggggagggggggcgggtcggggcggcgggtagcggcgaggcgtggggggcgggggggggtcggcgcgcggggttgcggggggtgtcgcgggcggggcggcgtgcggggtcgtttttcgtcgttcgtgcgggtcgcgggggtaggcggggtgcgcgcggggaggggcggcgaggggagggggggggtcgtcgcgttcgtcggcgggcggcgggcggcgggtagggggttcggcggcggttgcgcggtggtagggaggaggggcggcgaggggcggggttcggatcgatgcgcgtttttgcggtgggtgggttcgcggtcgtcgtcgcgcgtttcgtggtgggcgacgtcgatcgggtggggtcgggggggcgcgtggttttcggttcgattggcgttgagggacgcggtgttcgcggtttcgcgttgtcggggcgtacgggagcgggggcgttgttcgcggcgtcgcgcgttttttcggcggggcgttcggaagtgggcggggattagggtttggcggggcgtgtcgcgttagggtgggttcgggggggtcgttttattagggcgtcggaggatacgtgtaggtcggacgttttttggtgtggggatggcggtcggcggggttagggggtcgggtgtttgttatttaggggggggtgtcgacgtgtttttgcggggtatttcgggttttttcggttgtttatcggtcgtt

SEQ ID NO: 7544 - DNA, 816 bp, Artificial Sequence
  chemically treated genomic DNA (Homo sapiens) CpG-island No: 7544
aacgaccgataaacaaccgaaaaaacccgaaataccccgcaaaaacacgtcgacacccccccctaaataacaaacacccgaccccctaaccccgccgaccgccatccccacaccaaaaaacgtccgacctacacgtatcctccgacgccctaataaaacgacccccccgaacccaccctaacgcgacacgccccgccaaaccctaatccccgcccacttccgaacgccccgccgaaaaaacgcgcgacgccgcgaacaacgcccccgctcccgtacgccccgacaacgcgaaaccgcgaacaccgcgtccctcaacgccaatcgaaccgaaaaccacgcgcccccccgaccccacccgatcgacgtcgcccaccacgaaacgcgcgacgacgaccgcgaacccacccaccgcaaaaacgcgcatcgatccgaaccccgcccctcgccgcccctcctccctaccaccgcgcaaccgccgccgaaccccctacccgccgcccgccgcccgccgacgaacgcgacgaccccccccctcccctcgccgcccctccccgcgcgcaccccgcctacccccgcgacccgcacgaacgacgaaaaacgaccccgcacgccgccccgcccgcgacaccccccgcaaccccgcgcgccgacccccccccgccccccacgcctcgccgctacccgccgccccgacccgccccccctcccccgtccccccccgcgcgacgcccgcgacgaacgaaaaaattacatacgaattctaaactctaacacacaaaaacactctaaaaaatccatcgtcgctacaccctccac

SEQ ID NO: 7545 - DNA, 515 bp, Artificial Sequence
  chemically treated genomic DNA (Homo sapiens) CpG-island No: 7545
agagatttcgcgtttttcgttggtatttggtatcgtacgcgttttatttgcgagggttgcgggtcgaggtcgcggtcgcggtatcgtagttggtagttttgcgtgttttcgagttggggggcgaagggatcgcgggcggacggcgcggaggcggcgggcggcgacgttaatagtagtagtagtagtagcggcggtggtattagcgttatcgtagttatggtcgggcggaacgcggggggcgcgggggattttagtttaggtcgggtacggaggatgtagcggttgcggcggggatcggggcgttgacgttattcgagcgaggtagtttgggaagcggggggtgggagatgcggagagcgggcggggtagttgcgttgcggtattcgaggcgtgcgggtcgggcggggtaggtgtatcgcggtttttatcgtttattttatcgcgggggttttaggatatttttttggtgtttacgggcgggggatttttgttggcgtttggggttaaaaggaaat

SEQ ID NO: 7546 - DNA, 515 bp, Artificial Sequence
  chemically treated genomic DNA (Homo sapiens) CpG-island No: 7546
atttccttttaaccccaaacgccaacaaaaatcccccgcccgtaaacaccaaaaaaatatcctaaaacccccgcgataaaataaacgataaaaaccgcgatacacctaccccgcccgacccgcacgcctcgaataccgcaacgcaactaccccgcccgctctccgcatctcccaccccccgcttcccaaactacctcgctcgaataacgtcaacgccccgatccccgccgcaaccgctacatcctccgtacccgacctaaactaaaatcccccgcgccccccgcgttccgcccgaccataactacgataacgctaataccaccgccgctactactactactactattaacgtcgccgcccgccgcctccgcgccgtccgcccgcgatcccttcgccccccaactcgaaaacacgcaaaactaccaactacgataccgcgaccgcgacctcgacccgcaaccctcgcaaataaaacgcgtacgataccaaataccaacgaaaaacgcgaaatctct

SEQ ID NO: 7547 - DNA, 515 bp, Artificial Sequence
  chemically treated genomic DNA (Homo sapiens) CpG-island No: 7547
atttttttttggttttaagcgttagtagagatttttcgttcgtgggtattagggaggtgttttgggattttcgcgatgggatagacggtgggggtcgcgatgtatttgtttcgttcgattcgtacgtttcgggtgtcgtagcgtagttatttcgttcgtttttcgtattttttatttttcgttttttaggttgtttcgttcgggtgacgttagcgtttcggttttcgtcgtagtcgttgtatttttcgtgttcggtttgagttggagtttttcgcgtttttcgcgtttcgttcggttatggttgcggtggcgttgatgttatcgtcgttgttgttgttgttgttgttggcgtcgtcgttcgtcgttttcgcgtcgttcgttcgcgattttttcgttttttagttcggggatacgtagaattgttagttgcggtgtcgcgatcgcgatttcggttcgtagttttcgtaggtgaggcgcgtgcggtgttaggtgttagcgggggacgcgggattttt

SEQ ID NO: 7548 - DNA, 515 bp, Artificial Sequence
  chemically treated genomic DNA (Homo sapiens) CpG-island No: 7548
aaaaatcccgcgtcccccgctaacacctaacaccgcacgcgcctcacctacgaaaactacgaaccgaaatcgcgatcgcgacaccgcaactaacaattctacgtatccccgaactaaaaaacgaaaaaatcgcgaacgaacgacgcgaaaacgacgaacgacgacgccaacaacaacaacaacaacaacgacgataacatcaacgccaccgcaaccataaccgaacgaaacgcgaaaaacgcgaaaaactccaactcaaaccgaacacgaaaaatacaacgactacgacgaaaaccgaaacgctaacgtcacccgaacgaaacaacctaaaaaacgaaaaataaaaaatacgaaaaacgaacgaaataactacgctacgacacccgaaacgtacgaatcgaacgaaacaaatacatcgcgacccccaccgtctatcccatcgcgaaaatcccaaaacacctccctaatacccacgaacgaaaaatctctactaacgcttaaaaccaaaaaaaaat

SEQ ID NO: 7549 - DNA, 720 bp, Artificial Sequence
  chemically treated genomic DNA (Homo sapiens) CpG-island No: 7549
cgcgcggaagtatattttagacgatttcgatattcgtaatatcgatcgttttgtcggcgcgtcgtttttaggttatatcgtttagacgtacggcgattaggggttggtagtcgattttattaaagcgtattttaacggtatcgtaggttagagtttcggcgtgtggaacgcgggcggcgtggaattgtatttgatcggtgatgttaacgattatgtcggtaaaggtatggcgggcggtttaatcgttattcgtttttcggttggtttcgtttttcgtagttatgaagtaagtattatcggtaatatttgtttgtatggcgcgatcggtggtcgtttgtatgtcgtaggtcgcgcgggtgaacgtttcggcgtgcgtaatttcggtgttattatcgtggtagaaggtattggcgataacggttgtgaatatatgacgggtggtatcgtttgtattttgggtaaaatcggcgttaatttcggtgcgggtatgaacggcggatttatttacgttttcgatgaaagcggcgattttcgtaaacgcgttaaaacgggaattggtcggagttttaagcgttgacgttttggcgatttatgaagagtatttgcgtggttttattatcgagtaagggtagtatatcgtttttagcgcggtgaaaagattttggcgaattgggtaattatttaggattggaaatttatagtttagatagtgaagattag

SEQ ID NO: 7550 - DNA, 720 bp, Artificial Sequence
  chemically treated genomic DNA (Homo sapiens) CpG-island No: 7550
ctaatcttcactatctaaactataaatttccaatcctaaataattacccaattcgccaaaatcttttcaccgcgctaaaaacgatatactacccttactcgataataaaaccacgcaaatactcttcataaatcgccaaaacgtcaacgcttaaaactccgaccaattcccgttttaacgcgtttacgaaaatcgccgctttcatcgaaaacgtaaataaatccgccgttcatacccgcaccgaaattaacgccgattttacccaaaatacaaacgataccacccgtcatatattcacaaccgttatcgccaataccttctaccacgataataacaccgaaattacgcacgccgaaacgttcacccgcgcgacctacgacatacaaacgaccaccgatcgcgccatacaaacaaatattaccgataatacttacttcataactacgaaaaacgaaaccaaccgaaaaacgaataacgattaaaccgcccgccatacctttaccgacataatcgttaacatcaccgatcaaatacaattccacgccgcccgcgttccacacgccgaaactctaacctacgataccgttaaaatacgctttaataaaatcgactaccaacccctaatcgccgtacgtctaaacgatataacctaaaaacgacgcgccgacaaaacgatcgatattacgaatatcgaaatcgtctaaaatatacttccgcgcg

SEQ ID NO: 7551 - DNA, 720 bp, Artificial Sequence
  chemically treated genomic DNA (Homo sapiens) CpG-island No: 7551
ttaatttttattgtttaagttgtgggtttttaattttggatggttgtttagttcgttagaatttttttatcgcgttgagagcggtatgttgtttttgttcggtgataagattacgtagatgttttttatggatcgttagagcgttaacgtttaagatttcgattagttttcgttttaacgcgtttgcggaaatcgtcgtttttatcgagaacgtaagtgaattcgtcgtttatgttcgtatcgaagttaacgtcggttttatttagaatgtagacgatattattcgttatatatttataatcgttgtcgttaatgttttttattacggtgatagtatcggagttacgtacgtcgaaacgtttattcgcgcggtttgcggtatatagacgattatcggtcgcgttatataggtaggtgttgtcgataatgtttgttttatggttgcggaaggcggaattaatcggaggacgaatggcgattaagtcgttcgttatgtttttatcgatatagtcgttggtattatcggttaggtatagttttacgtcgttcgcgttttatacgtcgaagttttggtttgcggtgtcgttgaagtacgttttgataggatcggttgttagtttttgatcgtcgtgcgtttgggcgatatagtttgaaagcgacgcgtcgatagaacggtcggtgttgcgaatatcggggtcgtttagagtgtattttcgcgcg

SEQ ID NO: 7552 - DNA, 720 bp, Artificial Sequence
  chemically treated genomic DNA (Homo sapiens) CpG-island No: 7552
cgcgcgaaaatacactctaaacgaccccgatattcgcaacaccgaccgttctatcgacgcgtcgctttcaaactatatcgcccaaacgcacgacgatcaaaaactaacaaccgatcctatcaaaacgtacttcaacgacaccgcaaaccaaaacttcgacgtataaaacgcgaacgacgtaaaactatacctaaccgataataccaacgactatatcgataaaaacataacgaacgacttaatcgccattcgtcctccgattaattccgccttccgcaaccataaaacaaacattatcgacaacacctacctatataacgcgaccgataatcgtctatataccgcaaaccgcgcgaataaacgtttcgacgtacgtaactccgatactatcaccgtaataaaaaacattaacgacaacgattataaatatataacgaataatatcgtctacattctaaataaaaccgacgttaacttcgatacgaacataaacgacgaattcacttacgttctcgataaaaacgacgatttccgcaaacgcgttaaaacgaaaactaatcgaaatcttaaacgttaacgctctaacgatccataaaaaacatctacgtaatcttatcaccgaacaaaaacaacataccgctctcaacgcgataaaaaaattctaacgaactaaacaaccatccaaaattaaaaacccacaacttaaacaataaaaattaa

SEQ ID NO: 7553 - DNA, 601 bp, Artificial Sequence
  chemically treated genomic DNA (Homo sapiens) CpG-island No: 7553
agttttgtcgtcgttttttaatcgttgttcgggttaatttagtttattttaacggtattatggcggttttttagggcgttgaagttgtagcggaacggcgcgttattattcggtattattatattattgcggttataggtttacgttttattcgacggtcggttttgtacgaacgttagcgtttgttcgttttatatcggtatatagcgtatcgtcgagtagaaatcgttgagtatattttacgttttacgttgtgtggttaggtacgtattataggtgatgcgcggtttcgtgtcgttaaagtcgttcggtattgattggtcgtagtattggtcgatgatatatagcgtttatttatttatattcgtcgtattaagacgtttttttatgtcgtagcgcggatgggttagtatattttatagatattaggttatgttgttgttgtatgcggggttaaacgtttcgttttagatacgttgtattgtcgcgtttgcgggttatatttcgacggtatttgtagaatacgttcgcgtagatgataattacggtttaattggtggttgtcgattttttttgttttattgatgtaagattacgattt

SEQ ID NO: 7554 - DNA, 601 bp, Artificial Sequence
  chemically treated genomic DNA (Homo sapiens) CpG-island No: 7554
aaatcgtaatcttacatcaataaaacaaaaaaaatcgacaaccaccaattaaaccgtaattatcatctacgcgaacgtattctacaaataccgtcgaaatataacccgcaaacgcgacaatacaacgtatctaaaacgaaacgtttaaccccgcatacaacaacaacataacctaatatctataaaatatactaacccatccgcgctacgacataaaaaaacgtcttaatacgacgaatataaataaataaacgctatatatcatcgaccaatactacgaccaatcaataccgaacgactttaacgacacgaaaccgcgcatcacctataatacgtacctaaccacacaacgtaaaacgtaaaatatactcaacgatttctactcgacgatacgctatataccgatataaaacgaacaaacgctaacgttcgtacaaaaccgaccgtcgaataaaacgtaaacctataaccgcaataatataataataccgaataataacgcgccgttccgctacaacttcaacgccctaaaaaaccgccataataccgttaaaataaactaaattaacccgaacaacgattaaaaaacgacgacaaaact

SEQ ID NO: 7555 - DNA, 601 bp, Artificial Sequence
  chemically treated genomic DNA (Homo sapiens) CpG-island No: 7555
ggatcgtggttttatattagtaaaatagaggggatcggtagttattagttgagtcgtaattattatttgcgcgggcgtattttgtaggtgtcgtcgaaatataattcgtagacgcggtaatatagcgtatttgggacgaaacgtttaatttcgtatatagtaataatatggtttggtgtttgtgggatatgttgatttattcgcgttacggtatggggaaacgttttggtgcggcggatgtggataaatgggcgttgtatgttatcggttagtattgcgattagttagtgtcggacggttttggcggtacggagtcgcgtattatttgtaatgcgtatttgattatatagcgtaaggcgtgggatgtgtttagcgatttttgttcggcgatgcgttgtatgtcggtatggaacgggtagacgttgacgttcgtgtaggatcgatcgtcggataagacgtggatttataatcgtagtaatgtggtgatgtcggatgatggcgcgtcgtttcgttatagttttagcgttttgaaggatcgttataatgtcgttgaggtgaattggattgattcgaataacggttgggagacggcgatagagtt

SEQ ID NO: 7556 - DNA, 601 bp, Artificial Sequence
  chemically treated genomic DNA (Homo sapiens) CpG-island No: 7556
aactctatcgccgtctcccaaccgttattcgaatcaatccaattcacctcaacgacattataacgatccttcaaaacgctaaaactataacgaaacgacgcgccatcatccgacatcaccacattactacgattataaatccacgtcttatccgacgatcgatcctacacgaacgtcaacgtctacccgttccataccgacatacaacgcatcgccgaacaaaaatcgctaaacacatcccacgccttacgctatataatcaaatacgcattacaaataatacgcgactccgtaccgccaaaaccgtccgacactaactaatcgcaatactaaccgataacatacaacgcccatttatccacatccgccgcaccaaaacgtttccccataccgtaacgcgaataaatcaacatatcccacaaacaccaaaccatattattactatatacgaaattaaacgtttcgtcccaaatacgctatattaccgcgtctacgaattatatttcgacgacacctacaaaatacgcccgcgcaaataataattacgactcaactaataactaccgatcccctctattttactaatataaaaccacgatcc

SEQ ID NO: 7557 - DNA, 824 bp, Artificial Sequence
  chemically treated genomic DNA (Homo sapiens) CpG-island No: 7557
atttggtttagttagatattgagcggtatatggcgtgtaaattttcgcgtcgtacgtatattttagacgattttttcgtttgaacgtaatttggggcgttttcgtaaaacgtcgaacgaaggtacgttgttttatggtttggtgtaggatggtaacgatatgtgggacgttatttttttttgcggtttttgtgcggtgattcgtcgtaagtcgttggatgaaattggcggtattgttgtcgaaatcgtgattgaagatgcgtatatttttttgcggttgtatcgtcgtggttatattttcgcgtatatgcgtatttcgtaggcggcggggttggcgatcgaaagtttgtcggcgtatatcggttagcgtattcgttgggcgcgcgggatggtataaatttttcgtttcgataattcgtttatcggtaaagggttgaagtttgtttagcggttatgttacgttaacgttatgttttattttttgtcgggtattttacggttgatttttttgattgcgtcgttggcgtttttgttgttttatgtttatattatttatgcgttagcgttgatgatcgttttattcgtgttgtcgtatatgatttatgttagtttgattaattttaagatttagggtaaatatcgttattttttttggagtgaaatttacgaaacggtgttggcgtggtataatcgtatatcgaagtcgcgtatttagaagatttttatcgatggttatttgagttatttattgattcgtagttgttgatgatagttgttgacgttgtatgcgtttatttgtgtacgtaaatgcgttcgatggtataa

SEQ ID NO: 7558 - DNA, 824 bp, Artificial Sequence
  chemically treated genomic DNA (Homo sapiens) CpG-island No: 7558
ttataccatcgaacgcatttacgtacacaaataaacgcatacaacgtcaacaactatcatcaacaactacgaatcaataaataactcaaataaccatcgataaaaatcttctaaatacgcgacttcgatatacgattataccacgccaacaccgtttcgtaaatttcactccaaaaaaaataacgatatttaccctaaatcttaaaattaatcaaactaacataaatcatatacgacaacacgaataaaacgatcatcaacgctaacgcataaataatataaacataaaacaacaaaaacgccaacgacgcaatcaaaaaaatcaaccgtaaaatacccgacaaaaaataaaacataacgttaacgtaacataaccgctaaacaaacttcaaccctttaccgataaacgaattatcgaaacgaaaaatttataccatcccgcgcgcccaacgaatacgctaaccgatatacgccgacaaactttcgatcgccaaccccgccgcctacgaaatacgcatatacgcgaaaatataaccacgacgatacaaccgcaaaaaaatatacgcatcttcaatcacgatttcgacaacaataccgccaatttcatccaacgacttacgacgaatcaccgcacaaaaaccgcaaaaaaaaataacgtcccacatatcgttaccatcctacaccaaaccataaaacaacgtaccttcgttcgacgttttacgaaaacgccccaaattacgttcaaacgaaaaaatcgtctaaaatatacgtacgacgcgaaaatttacacgccatataccgctcaatatctaactaaaccaaat

SEQ ID NO: 7559 - DNA, 824 bp, Artificial Sequence
  chemically treated genomic DNA (Homo sapiens) CpG-island No: 7559
ttgtgttatcgagcgtatttacgtatatagatgagcgtatatagcgttagtagttattattagtagttgcgagttagtaaatagtttaggtagttatcggtgggggttttttaggtgcgcggtttcggtgtgcgattatattacgttagtatcgtttcgtagattttattttagaaagagtggcgatatttgttttggattttggagttggttaggttggtatggattatatgcggtagtacgaatagggcgattattaacgttggcgtatagatgatgtaggtatgaagtagtaggaacgttagcggcgtagttaggaagattagtcgtggaatgttcgataagaagtggaatatggcgttgacgtaatatagtcgttgagtaaattttagttttttatcggtgagcgggttatcgagacggaagatttgtattatttcgcgcgtttagcgaatacgttgatcgatatgcgtcgatagattttcggtcgttagtttcgtcgtttgcggaatacgtatatacgcggaggtatagttacgacggtgtaatcgtagagaagtatgcgtatttttagttacggtttcgatagtaatgtcgttaattttatttagcggtttacgacgaattatcgtataggaatcgtagaagaaagtggcgttttatatatcgttgttattttgtattagattatagaatagcgtgttttcgttcggcgttttacggaaacgttttaggttgcgtttaaacggagagatcgtttagagtgtacgtgcggcgcgaaagtttgtacgttatgtgtcgtttaatatttggttggattaagt

SEQ ID NO: 7560 - DNA, 824 bp, Artificial Sequence
  chemically treated genomic DNA (Homo sapiens) CpG-island No: 7560
acttaatccaaccaaatattaaacgacacataacgtacaaactttcgcgccgcacgtacactctaaacgatctctccgtttaaacgcaacctaaaacgtttccgtaaaacgccgaacgaaaacacgctattctataatctaatacaaaataacaacgatatataaaacgccactttcttctacgattcctatacgataattcgtcgtaaaccgctaaataaaattaacgacattactatcgaaaccgtaactaaaaatacgcatacttctctacgattacaccgtcgtaactatacctccgcgtatatacgtattccgcaaacgacgaaactaacgaccgaaaatctatcgacgcatatcgatcaacgtattcgctaaacgcgcgaaataatacaaatcttccgtctcgataacccgctcaccgataaaaaactaaaatttactcaacgactatattacgtcaacgccatattccacttcttatcgaacattccacgactaatcttcctaactacgccgctaacgttcctactacttcatacctacatcatctatacgccaacgttaataatcgccctattcgtactaccgcatataatccataccaacctaaccaactccaaaatccaaaacaaatatcgccactctttctaaaataaaatctacgaaacgatactaacgtaatataatcgcacaccgaaaccgcgcacctaaaaaacccccaccgataactacctaaactatttactaactcgcaactactaataataactactaacgctatatacgctcatctatatacgtaaatacgctcgataacacaa

SEQ ID NO: 7561 - DNA, 556 bp, Artificial Sequence
  chemically treated genomic DNA (Homo sapiens) CpG-island No: 7561
tatcgttagtagaatcggatggtttgttagcgtatattatacgcgttcgaattacggtagaatgattacgtaataaacgtcgttaatacgtaggttgttgatatcggattcgcggattatcgcgatcgaatcgaatatggtggcgcgtttgtcgttatcgtttatcgtatcgttaagtattttataatcgcgtgggttatttgttaatagcgtaattacgttgcgttgggcgttatacggtaattggaaattaattatcgtcgttaatcgtaacgggagaggttagttttgatcgtgtttttgtcgcgcgatcgtttttttttcggtataatggcgggggaacggggggtttagatatcgcgttataaatatttttgaggattttttttggaaggcgcgggaatatttcgttttatcggaatcgttggtcggatcgatggatatgatcgttgcgttgtcggcgatttttttttcggtatttgttttggggatgtttttaatttaggtatttttcgttgaattggattggttatttatcgtgggtattagatagttt

SEQ ID NO: 7562 - DNA, 556 bp, Artificial Sequence
  chemically treated genomic DNA (Homo sapiens) CpG-island No: 7562
aaactatctaatacccacgataaataaccaatccaattcaacgaaaaatacctaaattaaaaacatccccaaaacaaataccgaaaaaaaaatcgccgacaacgcaacgatcatatccatcgatccgaccaacgattccgataaaacgaaatattcccgcgccttccaaaaaaaatcctcaaaaatatttataacgcgatatctaaaccccccgttcccccgccattataccgaaaaaaaaacgatcgcgcgacaaaaacacgatcaaaactaacctctcccgttacgattaacgacgataattaatttccaattaccgtataacgcccaacgcaacgtaattacgctattaacaaataacccacgcgattataaaatacttaacgatacgataaacgataacgacaaacgcgccaccatattcgattcgatcgcgataatccgcgaatccgatatcaacaacctacgtattaacgacgtttattacgtaatcattctaccgtaattcgaacgcgtataatatacgctaacaaaccatccgattctactaacgata

SEQ ID NO: 7563 - DNA, 556 bp, Artificial Sequence
  chemically treated genomic DNA (Homo sapiens) CpG-island No: 7563
aaattgtttggtatttacggtaggtagttagtttagtttaacggagaatatttgaattaaaagtatttttagagtaaatgtcggaaaggagatcgtcgatagcgtaacggttatatttatcgattcggttaacggtttcgatgaggcggggtattttcgcgttttttaaaaagggtttttaagggtatttgtggcgcgatgtttgagtttttcgttttttcgttattgtgtcggaagaagagcgatcgcgcggtagaaatacggttaaagttgatttttttcgttgcgattggcggcggtgattggtttttagttgtcgtataacgtttagcgtagcgtgattgcgttgttggtagatagtttacgcggttatgaaatgtttaacgatgcggtgaacgatagcggtaaacgcgttattatgttcggttcggtcgcggtgattcgcgagttcggtattaatagtttacgtgttggcgacgtttattacgtagttattttgtcgtggttcgagcgcgtgtggtatgcgttggtaaattattcgattttgttggcggtg

SEQ ID NO: 7564 - DNA, 556 bp, Artificial Sequence
  chemically treated genomic DNA (Homo sapiens) CpG-island No: 7564
caccgccaacaaaatcgaataatttaccaacgcataccacacgcgctcgaaccacgacaaaataactacgtaataaacgtcgccaacacgtaaactattaataccgaactcgcgaatcaccgcgaccgaaccgaacataataacgcgtttaccgctatcgttcaccgcatcgttaaacatttcataaccgcgtaaactatctaccaacaacgcaatcacgctacgctaaacgttatacgacaactaaaaaccaatcaccgccgccaatcgcaacgaaaaaaatcaactttaaccgtatttctaccgcgcgatcgctcttcttccgacacaataacgaaaaaacgaaaaactcaaacatcgcgccacaaatacccttaaaaaccctttttaaaaaacgcgaaaataccccgcctcatcgaaaccgttaaccgaatcgataaatataaccgttacgctatcgacgatctcctttccgacatttactctaaaaatacttttaattcaaatattctccgttaaactaaactaactacctaccgtaaataccaaacaattt

SEQ ID NO: 7565 - DNA, 699 bp, Artificial Sequence
  chemically treated genomic DNA (Homo sapiens) CpG-island No: 7565
tagaacgggtttgagtagtattattaatacgttttcgaataataggtttatggttttatcggtaacggttgaaagcgttagtattattaattattgatcgacgattagtttacgtagttgcgttcgttttgtttttagcgttttgaggatcgttattagatcgtagcgattgcgatagtaatgatttatcgttatcgttatcgttgttattgttagtagtaaggttagaagcgtcgaaagtagtaggaattgttgcgagcgttttatcgatcgttttagcgcgttttcgttttgttttagatcgtattagcgttgttcgggtttaagttgaggtaataattattttttatagtcgtcgagttggttttcgttgtcgtcgaatttataacgttagggtgattcgatttttcggttgtacggtttcggttttatcgatattcgttagatttattattagacgcggagttatttggaaggggttaaaatcggaattcggtttttgaattattttttcggtaattcgtaaggtggtatcgtttacgttaatggtgtcgttcgttttttagttaagtagggttattaggcgtgggggtagtaatacgttgttcgtttgcggggggcggtaaatatgtacgtttaatagtttattttagaggttttttatgtaagttagatatagcgaattttaaattattttat

SEQ ID NO: 7566 - DNA, 699 bp, Artificial Sequence
  chemically treated genomic DNA (Homo sapiens) CpG-island No: 7566
ataaaataatttaaaattcgctatatctaacttacataaaaaacctctaaaataaactattaaacgtacatatttaccgccccccgcaaacgaacaacgtattactacccccacgcctaataaccctacttaactaaaaaacgaacgacaccattaacgtaaacgataccaccttacgaattaccgaaaaaataattcaaaaaccgaattccgattttaaccccttccaaataactccgcgtctaataataaatctaacgaatatcgataaaaccgaaaccgtacaaccgaaaaatcgaatcaccctaacgttataaattcgacgacaacgaaaaccaactcgacgactataaaaaataattattacctcaacttaaacccgaacaacgctaatacgatctaaaacaaaacgaaaacgcgctaaaacgatcgataaaacgctcgcaacaattcctactactttcgacgcttctaaccttactactaacaataacaacgataacgataacgataaatcattactatcgcaatcgctacgatctaataacgatcctcaaaacgctaaaaacaaaacgaacgcaactacgtaaactaatcgtcgatcaataattaataatactaacgctttcaaccgttaccgataaaaccataaacctattattcgaaaacgtattaataatactactcaaacccgttcta

SEQ ID NO: 7567 - DNA, 699 bp, Artificial Sequence
  chemically treated genomic DNA (Homo sapiens) CpG-island No: 7567
ataaaataatttgaggttcgttatgtttgatttatatagggagtttttagagtggattattaggcgtgtatgtttgtcgtttttcgtaggcgggtagcgtattgttgtttttacgtttgatggttttgtttaattgaaaaacgggcgatattattgacgtgggcgatgttattttgcggattgtcggagaagtgatttaggaatcggatttcggttttaattttttttagatggtttcgcgtttgatgatgaatttggcggatgtcgataaaatcggagtcgtgtagtcggggagtcgggttattttggcgttataaattcggcggtaacgagaattagttcgacggttatgagaaatggttgttattttagtttaaattcgaataacgttggtacggtttggaataggacgaaggcgcgttggggcgatcgatggaacgttcgtaatagtttttgttgttttcggcgtttttgattttgttgttggtagtggtagcggtggcggtagcgatgaattattattgtcgtagtcgttacgatttggtggcgatttttaaaacgttgggggtagggcgagcgtaattgcgtaagttaatcgtcggttagtggttgatggtgttgacgtttttagtcgttatcggtggggttataggtttgttgttcgaaaacgtgttgatggtgttgtttaagttcgttttg

SEQ ID NO: 7568 - DNA, 699 bp, Artificial Sequence
  chemically treated genomic DNA (Homo sapiens) CpG-island No: 7568
caaaacgaacttaaacaacaccatcaacacgttttcgaacaacaaacctataaccccaccgataacgactaaaaacgtcaacaccatcaaccactaaccgacgattaacttacgcaattacgctcgccctacccccaacgttttaaaaatcgccaccaaatcgtaacgactacgacaataataattcatcgctaccgccaccgctaccactaccaacaacaaaatcaaaaacgccgaaaacaacaaaaactattacgaacgttccatcgatcgccccaacgcgccttcgtcctattccaaaccgtaccaacgttattcgaatttaaactaaaataacaaccatttctcataaccgtcgaactaattctcgttaccgccgaatttataacgccaaaataacccgactccccgactacacgactccgattttatcgacatccgccaaattcatcatcaaacgcgaaaccatctaaaaaaaattaaaaccgaaatccgattcctaaatcacttctccgacaatccgcaaaataacatcgcccacgtcaataatatcgcccgtttttcaattaaacaaaaccatcaaacgtaaaaacaacaatacgctacccgcctacgaaaaacgacaaacatacacgcctaataatccactctaaaaactccctatataaatcaaacataacgaacctcaaattattttat

SEQ ID NO: 7569 - DNA, 1082 bp, Artificial Sequence
  chemically treated genomic DNA (Homo sapiens) CpG-island No: 7569
  misc_feature (170)..(170): n is either a, c, g or t
tcgagagtttttcgacggggtttgagttacggacgattttttttttataaggaatttttgaaattatttttttcgagttttttacgtagggttcgaatttttttatagatattcgttgggttttcgggatcgtttagagtgttttgtaggcggtcgtatttcgtagtatnttcgcgttagtaggttcgggagttttataaggttcggttaaggttttttttaacggatttcgtttttttgatttcgagtttcggtttaagagtttcgttcgtcgtttatattcgttgttcgagttttcgaaaggtttttgtttaaggcgcggcgtattttggcggtcgcgtaaataggaagcgtcgcgtttagtcgggtcgttttcgttatagtttttgtattagtagcgggcgttcggagtcgtttagtacgcgtaggtgtttcgttcgttattcgtcgttttttacgttcgtcgtcgcgggtcggtttagagcgtcgtataaagcgaaggcgtttacgtagttgttttcgtcggggttatcgtcggggttgtttgttaggtcgtagcgttttagcgtatcggttacgagttcgcgcgtcgtggagcgcgtcgtggttagtacgtttttgtagttggcgttcgatgttagttcggcgtcgaagattttgaggattttcggagggcgtcgtggcgcgggtagttagcgggggttcgggggttacgttcgtcgttagtttcggtagttttttttcgttggtttagcgttgtcgcgttttttcgggggtttttagggttttttgcgtcgttggatttcgtggtttcggttttcgagtttcggaagagttgggagatgcgtttggcgcggttatcggaggttttttcggtcgttttgatagcgtttattcgtcgtagttttacgtgcggcgggggcggaggtagcggttcgttgttgcggtttttcgtgttcgacgaagaagatttgggagttcgtcggggaatagagtcgcgggagagagatttaggacgatacgttaagacgggggtgggggtatattaggagggaagtgggtagagatttagagggaggata

SEQ ID NO: 7570 - DNA, 1082 bp, Artificial Sequence
  chemically treated genomic DNA (Homo sapiens) CpG-island No: 7570
  misc_feature (913)..(913): n is either a, c, g or t
tatcctccctctaaatctctacccacttccctcctaatatacccccacccccgtcttaacgtatcgtcctaaatctctctcccgcgactctattccccgacgaactcccaaatcttcttcgtcgaacacgaaaaaccgcaacaacgaaccgctacctccgcccccgccgcacgtaaaactacgacgaataaacgctatcaaaacgaccgaaaaaacctccgataaccgcgccaaacgcatctcccaactcttccgaaactcgaaaaccgaaaccacgaaatccaacgacgcaaaaaaccctaaaaacccccgaaaaaacgcgacaacgctaaaccaacgaaaaaaaactaccgaaactaacgacgaacgtaacccccgaacccccgctaactacccgcgccacgacgccctccgaaaatcctcaaaatcttcgacgccgaactaacatcgaacgccaactacaaaaacgtactaaccacgacgcgctccacgacgcgcgaactcgtaaccgatacgctaaaacgctacgacctaacaaacaaccccgacgataaccccgacgaaaacaactacgtaaacgccttcgctttatacgacgctctaaaccgacccgcgacgacgaacgtaaaaaacgacgaataacgaacgaaacacctacgcgtactaaacgactccgaacgcccgctactaatacaaaaactataacgaaaacgacccgactaaacgcgacgcttcctatttacgcgaccgccaaaatacgccgcgccttaaacaaaaacctttcgaaaactcgaacaacgaatataaacgacgaacgaaactcttaaaccgaaactcgaaatcaaaaaaacgaaatccgttaaaaaaaaccttaaccgaaccttataaaactcccgaacctactaacgcgaanatactacgaaatacgaccgcctacaaaacactctaaacgatcccgaaaacccaacgaatatctataaaaaaattcgaaccctacgtaaaaaactcgaaaaaaataatttcaaaaattccttataaaaaaaaaatcgtccgtaactcaaaccccgtcgaaaaactctcga

SEQ ID NO: 7571 - DNA, 1082 bp, Artificial Sequence
  chemically treated genomic DNA (Homo sapiens) CpG-island No: 7571
  misc_feature (913)..(913): n is either a, c, g or t
tgttttttttttgggtttttgtttattttttttttaatatgtttttattttcgttttggcgtgtcgttttgggtttttttttcgcgattttgtttttcggcggatttttaggtttttttcgtcggatacggggagtcgtagtagcgagtcgttattttcgttttcgtcgtacgtggagttgcggcgagtgggcgttgttaaggcggtcgggggagttttcggtagtcgcgttaagcgtattttttagttttttcggggttcggggatcgggattacggggtttagcggcgtaggaggttttggggattttcgggggggcgcggtagcgttgggttagcgagaagaagttgtcggagttggcggcgggcgtggttttcgagttttcgttggttattcgcgttacggcgtttttcgggggtttttaagattttcggcgtcggattggtatcgggcgttaattataagagcgtgttggttacggcgcgttttacggcgcgcgagttcgtggtcgatgcgttagagcgttacggtttagtaggtagtttcggcggtggtttcggcgagagtagttgcgtggacgttttcgttttgtgcgacgttttgggtcggttcgcggcggcgggcgtgggaagcggcgagtggcgggcggagtatttgcgcgtgttgggcgatttcgagcgttcgttgttggtgtaggagttgtggcgggggcggttcggttgggcgcggcgttttttatttgcgcggtcgttaagatgcgtcgcgttttgaataggagtttttcgggggttcggatagcgaatgtgaacggcgggcggggtttttgggtcgggattcggggttaaaaaagcggggttcgttggggggggttttggtcgggttttgtgggattttcgggtttgttggcgcgaanatgttgcgaaatgcgatcgtttgtaggatattttagacgatttcgaaaatttaacgaatatttataaaggaattcgggttttacgtgagaagttcggagggggtggttttaggagttttttgtggagaggggatcgttcgtgatttagatttcgtcgaaaagttttcga

SEQ ID NO: 7572 - DNA, 1082 bp, Artificial Sequence
  chemically treated genomic DNA (Homo sapiens) CpG-island No: 7572
  misc_feature (170)..(170): n is either a, c, g or t
tcgaaaacttttcgacgaaatctaaatcacgaacgatcccctctccacaaaaaactcctaaaaccaccccctccgaacttctcacgtaaaacccgaattcctttataaatattcgttaaattttcgaaatcgtctaaaatatcctacaaacgatcgcatttcgcaacatnttcgcgccaacaaacccgaaaatcccacaaaacccgaccaaaaccccccccaacgaaccccgcttttttaaccccgaatcccgacccaaaaaccccgcccgccgttcacattcgctatccgaacccccgaaaaactcctattcaaaacgcgacgcatcttaacgaccgcgcaaataaaaaacgccgcgcccaaccgaaccgcccccgccacaactcctacaccaacaacgaacgctcgaaatcgcccaacacgcgcaaatactccgcccgccactcgccgcttcccacgcccgccgccgcgaaccgacccaaaacgtcgcacaaaacgaaaacgtccacgcaactactctcgccgaaaccaccgccgaaactacctactaaaccgtaacgctctaacgcatcgaccacgaactcgcgcgccgtaaaacgcgccgtaaccaacacgctcttataattaacgcccgataccaatccgacgccgaaaatcttaaaaacccccgaaaaacgccgtaacgcgaataaccaacgaaaactcgaaaaccacgcccgccgccaactccgacaacttcttctcgctaacccaacgctaccgcgcccccccgaaaatccccaaaacctcctacgccgctaaaccccgtaatcccgatccccgaaccccgaaaaaactaaaaaatacgcttaacgcgactaccgaaaactcccccgaccgccttaacaacgcccactcgccgcaactccacgtacgacgaaaacgaaaataacgactcgctactacgactccccgtatccgacgaaaaaaacctaaaaatccgccgaaaaacaaaatcgcgaaaaaaaaacccaaaacgacacgccaaaacgaaaataaaaacatattaaaaaaaaaataaacaaaaacccaaaaaaaaaaca

SEQ ID NO: 7573 - DNA, 521 bp, Artificial Sequence
  chemically treated genomic DNA (Homo sapiens) CpG-island No: 7573
cggtttcgattattacgttaagtatttgagggacgaacggtattggttgcgtatcgtaaattcgtttcgtcgagtttttttcgggcgttaggacgttttggaatttattttttttcgttattttcgttttcgaggagttcgtagttagttcgtgattcgatgtttttatttgtagaatgggttagtgttgtttttttttcgggggcgcgatttttttttgaggttcgtgcggttcgtagtgtatgtcgggaaacgtagtttcgttcgagcggattgtagcgcgttatcgttagattacgtaatgcgcgttgagtacgtcgggagttgtagtttttttggcgttttacgtcggtatttattcggttttcgttttattttttattattttagtttgtagcggagtttttatcggttgattttagttggacggtcgatttggtagttcggagttttgggaaattaaggagtcgaaggaattcgtgtaagtcgttaatttgggtttattttttttttgttttaag

SEQ ID NO: 7574 - DNA, 521 bp, Artificial Sequence
  chemically treated genomic DNA (Homo sapiens) CpG-island No: 7574
cttaaaacaaaaaaaaaataaacccaaattaacgacttacacgaattccttcgactccttaatttcccaaaactccgaactaccaaatcgaccgtccaactaaaatcaaccgataaaaactccgctacaaactaaaataataaaaaataaaacgaaaaccgaataaataccgacgtaaaacgccaaaaaaactacaactcccgacgtactcaacgcgcattacgtaatctaacgataacgcgctacaatccgctcgaacgaaactacgtttcccgacatacactacgaaccgcacgaacctcaaaaaaaaatcgcgcccccgaaaaaaaaacaacactaacccattctacaaataaaaacatcgaatcacgaactaactacgaactcctcgaaaacgaaaataacgaaaaaaaataaattccaaaacgtcctaacgcccgaaaaaaactcgacgaaacgaatttacgatacgcaaccaataccgttcgtccctcaaatacttaacgtaataatcgaaaccg

SEQ ID NO: 7575 - DNA, 521 bp, Artificial Sequence
  chemically treated genomic DNA (Homo sapiens) CpG-island No: 7575
tttgaggtaggggagaggtgggtttagattgacgatttgtacgggttttttcgattttttgattttttaggatttcgggttattagatcggtcgtttagttggaattaatcgatggaggtttcgttgtaaattggaatggtaaggggtggggcggagatcgggtaggtgtcggcgtggggcgttaagaggattataattttcggcgtgtttagcgcgtattacgtggtttggcgataacgcgttgtagttcgttcgggcggaattacgtttttcggtatgtattgcgggtcgtacgggttttagggaagagtcgcgttttcggggagggagtagtattggtttattttgtagatggggatatcgagttacgggttggttacgaatttttcgggggcgaaggtggcggagagggatgggttttaggacgttttggcgttcggggaaggttcggcgggacggatttgcggtgcgtagttagtgtcgttcgttttttaggtgtttggcgtgatgatcggggtcg

SEQ ID NO: 7576 - DNA, 521 bp, Artificial Sequence
  chemically treated genomic DNA (Homo sapiens) CpG-island No: 7576
cgaccccgatcatcacgccaaacacctaaaaaacgaacgacactaactacgcaccgcaaatccgtcccgccgaaccttccccgaacgccaaaacgtcctaaaacccatccctctccgccaccttcgcccccgaaaaattcgtaaccaacccgtaactcgatatccccatctacaaaataaaccaatactactccctccccgaaaacgcgactcttccctaaaacccgtacgacccgcaatacataccgaaaaacgtaattccgcccgaacgaactacaacgcgttatcgccaaaccacgtaatacgcgctaaacacgccgaaaattataatcctcttaacgccccacgccgacacctacccgatctccgccccaccccttaccattccaatttacaacgaaacctccatcgattaattccaactaaacgaccgatctaataacccgaaatcctaaaaaatcaaaaaatcgaaaaaacccgtacaaatcgtcaatctaaacccacctctcccctacctcaaa

SEQ ID NO: 7577 - DNA, 809 bp, Artificial Sequence
  chemically treated genomic DNA (Homo sapiens) CpG-island No: 7577
agggaaagaaggtcgcgattggttcgtttcgaaaggtgggcggggtttttttcgatttgtgcgcgcgcgtcgcggggaggtgttgtcgagggcggagcgggagggggcgtggtttcgcgcgggcggtcgttgacggcgaggtttcgtttcggatgtcgcgtgtcgttgaaagggcggcggcgattggtcggcgtcgcgggggcgggcggggcggaaggttttggagggggttggcgggttttggaagttttcgtcggacgggtatatagagttcgggattggtcggcggcggagtcgggggacggcgatagcgggtcggcgggtcgtaggagggggttatgggtaaagattattattagacgttgggtttggttcgcggcgcgtcggacgaggagattaagcgggtttatcgtcgttaggcgttgcgttattattcggataagaataaggagttcggcgtcgaggagaagtttaaggagatcgttgaggtttacgacgtgtttagcgattcgcgtaagcgcgagattttcgatcgttacggggaggaaggtgtgtgttcgcggttaggggcgcggtttcgttttttgatagatagggaaattgaggtacgttggtttttttcggcggtttttcgggaaggacgtttcgggtcgtggggtcgagttgtttcgtttttcggtttcgcgggttttcgttttcggattggcggtcgcgcggtgggaggaggagttttggtttagtcgttcggttagaagtttttagtatgtttggggttgttttttttcgggcgttttttttcgcggtttcga

SEQ ID NO: 7578 - DNA, 809 bp, Artificial Sequence
  chemically treated genomic DNA (Homo sapiens) CpG-island No: 7578
tcgaaaccgcgaaaaaaaacgcccgaaaaaaaacaaccccaaacatactaaaaacttctaaccgaacgactaaaccaaaactcctcctcccaccgcgcgaccgccaatccgaaaacgaaaacccgcgaaaccgaaaaacgaaacaactcgaccccacgacccgaaacgtccttcccgaaaaaccgccgaaaaaaaccaacgtacctcaatttccctatctatcaaaaaacgaaaccgcgcccctaaccgcgaacacacaccttcctccccgtaacgatcgaaaatctcgcgcttacgcgaatcgctaaacacgtcgtaaacctcaacgatctccttaaacttctcctcgacgccgaactccttattcttatccgaataataacgcaacgcctaacgacgataaacccgcttaatctcctcgtccgacgcgccgcgaaccaaacccaacgtctaataataatctttacccataaccccctcctacgacccgccgacccgctatcgccgtcccccgactccgccgccgaccaatcccgaactctatatacccgtccgacgaaaacttccaaaacccgccaaccccctccaaaaccttccgccccgcccgcccccgcgacgccgaccaatcgccgccgccctttcaacgacacgcgacatccgaaacgaaacctcgccgtcaacgaccgcccgcgcgaaaccacgccccctcccgctccgccctcgacaacacctccccgcgacgcgcgcgcacaaatcgaaaaaaaccccgcccacctttcgaaacgaaccaatcgcgaccttctttccct

SEQ ID NO: 7579 - DNA, 809 bp, Artificial Sequence
  chemically treated genomic DNA (Homo sapiens) CpG-island No: 7579
tcggggtcgcgggaggaggcgttcggggaggggtagttttagatatgttagaagtttttggtcgagcggttgggttaaggtttttttttttatcgcgcggtcgttaattcgagggcggaggttcgcgaggtcggagggcggggtagttcggttttacggttcggggcgtttttttcggggggtcgtcgagaggggttagcgtgttttagtttttttgtttgttaaaaggcggggtcgcgtttttggtcgcgagtatatattttttttttcgtagcggtcgaagatttcgcgtttgcgcgggtcgttgagtacgtcgtaggttttagcgatttttttgaattttttttcggcgtcgggttttttgtttttgttcgggtggtagcgtagcgtttggcggcggtaggttcgtttgattttttcgttcgacgcgtcgcgggttaggtttaacgtttggtagtagtttttatttatgatttttttttgcggttcgtcgattcgttgtcgtcgtttttcggtttcgtcgtcgattagtttcggattttatatattcgttcggcggaagtttttagagttcgttagttttttttagaatttttcgtttcgttcgttttcgcggcgtcggttaatcgtcgtcgtttttttagcgatacgcgatattcggggcggggtttcgtcgttaacggtcgttcgcgcggggttacgttttttttcgtttcgttttcggtaatattttttcgcggcgcgcgcgtataggtcggaggaggtttcgtttatttttcgggacgagttaatcgcgatttttttttttt

SEQ ID NO: 7580 - DNA, 809 bp, Artificial Sequence
  chemically treated genomic DNA (Homo sapiens) CpG-island No: 7580
aaaaaaaaaaaatcgcgattaactcgtcccgaaaaataaacgaaacctcctccgacctatacgcgcgcgccgcgaaaaaatattaccgaaaacgaaacgaaaaaaaacgtaaccccgcgcgaacgaccgttaacgacgaaaccccgccccgaatatcgcgtatcgctaaaaaaacgacgacgattaaccgacgccgcgaaaacgaacgaaacgaaaaattctaaaaaaaactaacgaactctaaaaacttccgccgaacgaatatataaaatccgaaactaatcgacgacgaaaccgaaaaacgacgacaacgaatcgacgaaccgcaaaaaaaaatcataaataaaaactactaccaaacgttaaacctaacccgcgacgcgtcgaacgaaaaaatcaaacgaacctaccgccgccaaacgctacgctaccacccgaacaaaaacaaaaaacccgacgccgaaaaaaaattcaaaaaaatcgctaaaacctacgacgtactcaacgacccgcgcaaacgcgaaatcttcgaccgctacgaaaaaaaaaatatatactcgcgaccaaaaacgcgaccccgccttttaacaaacaaaaaaactaaaacacgctaacccctctcgacgaccccccgaaaaaaacgccccgaaccgtaaaaccgaactaccccgccctccgacctcgcgaacctccgccctcgaattaacgaccgcgcgataaaaaaaaaaaccttaacccaaccgctcgaccaaaaacttctaacatatctaaaactacccctccccgaacgcctcctcccgcgaccccga

SEQ ID NO: 7581 - DNA, 1096 bp, Artificial Sequence
  chemically treated genomic DNA (Homo sapiens) CpG-island No: 7581
tttgtttgcgtttatattattgtttatcggtgtatatcggtttcgggcgtatacgcgtagttcgttatttggttttaatatatataaattatacgttttattaaaataatttatcggaggcgtatacgttcgcgattattacgtaaatatatttttgagatatattttttcggttataggttcgcgtttcgggaatttcgtcgcggtacgggtttttgtttatatatagtttacggggatacgcgtcggtttcgttttcggttatagtacgtatagtttaggaattacgatcgtaaatattagtgcggtggtttcgcgtcggttttgtttcgagttttttacgtattagtcggtggatttatagcggcgtttatatatttatcgtcgtatgcgcgtatcgtcgcggttcgggtggagcggttttcggggatatagtttggggattcgtacgtttttaggttcgcggtttcgggcgcgttttttcgtaggcggggcgcgggggacgtcgtgggagtcgtttaattttttttttttcggtttttttggggtcgtttttttcgggcgtttttcgttttttttttttttcgtttcgtcgttttttggggtttacgtttttttttattcgttttttttgtttttttgcgttcgattttggttttgcggtttattttattcgtcgcgtcgtagggcggaggagtcggggtgcgtgggaggggggcgtttcgcggttattcggggagttttttagaggcggagtttcgcgcgtcggggttatttcggggcgggtttcggatcgttcgaggttatcgaggagtttcgaggttatcggttcggcgcgtcgttcgttttttttaggcgttttaaggacggtttttcgcgcgttcggtttttcggttttttcgcgtcgatcggttttttcgaggcggtattttgaagtcgtttacgggtgatatttaggttttcgtcgattgggattttttagagattgggggtttgttcggaagttggattttacggagatgaaacggaagattacgaggatatgatttttatatagaatttttttatttacgtggttttgcgcgagttattttat

SEQ ID NO: 7582 - DNA, 1096 bp, Artificial Sequence
  chemically treated genomic DNA (Homo sapiens) CpG-island No: 7582
ataaaataactcgcgcaaaaccacgtaaataaaaaaattctatataaaaatcatatcctcgtaatcttccgtttcatctccgtaaaatccaacttccgaacaaacccccaatctctaaaaaatcccaatcgacgaaaacctaaatatcacccgtaaacgacttcaaaataccgcctcgaaaaaaccgatcgacgcgaaaaaaccgaaaaaccgaacgcgcgaaaaaccgtccttaaaacgcctaaaaaaaacgaacgacgcgccgaaccgataacctcgaaactcctcgataacctcgaacgatccgaaacccgccccgaaataaccccgacgcgcgaaactccgcctctaaaaaactccccgaataaccgcgaaacgcccccctcccacgcaccccgactcctccgccctacgacgcgacgaataaaataaaccgcaaaaccaaaatcgaacgcaaaaaaacaaaaaaaacgaataaaaaaaaacgtaaaccccaaaaaacgacgaaacgaaaaaaaaaaaaaacgaaaaacgcccgaaaaaaacgaccccaaaaaaaccgaaaaaaaaaaaattaaacgactcccacgacgtcccccgcgccccgcctacgaaaaaacgcgcccgaaaccgcgaacctaaaaacgtacgaatccccaaactatatccccgaaaaccgctccacccgaaccgcgacgatacgcgcatacgacgataaatatataaacgccgctataaatccaccgactaatacgtaaaaaactcgaaacaaaaccgacgcgaaaccaccgcactaatatttacgatcgtaattcctaaactatacgtactataaccgaaaacgaaaccgacgcgtatccccgtaaactatatataaacaaaaacccgtaccgcgacgaaattcccgaaacgcgaacctataaccgaaaaaatatatctcaaaaatatatttacgtaataatcgcgaacgtatacgcctccgataaattattttaataaaacgtataatttatatatattaaaaccaaataacgaactacgcgtatacgcccgaaaccgatatacaccgataaacaataatataaacgcaaacaaa

SEQ ID NO: 7583 - DNA, 1096 bp, Artificial Sequence
  chemically treated genomic DNA (Homo sapiens) CpG-island No: 7583
atggagtgattcgcgtagggttacgtagatgagaaagttttgtatggagattatattttcgtgatttttcgttttattttcgtgaggtttagttttcgggtaggtttttaatttttagaggattttagtcggcgggggtttggatattattcgtaagcgattttagggtatcgtttcgggagggtcggtcggcgcgagggggtcggggagtcgggcgcgcggggagtcgtttttggagcgtttggggagggcgggcggcgcgtcgggtcggtgatttcggggtttttcggtgatttcgggcggttcgggattcgtttcggagtgatttcggcgcgcgaggtttcgtttttggggggtttttcgggtgatcgcggagcgttttttttttacgtatttcgattttttcgttttgcggcgcggcgggtggggtgggtcgtagggttagggtcgagcgtagaggggtagagaggacgaatagaggggaacgtgggttttagaaggcggcggagcgggagggaggaggaacgaagggcgttcgggaaggacggttttagggaggtcgggggagagggggttaagcggtttttacggcgtttttcgcgtttcgtttgcgaggaggcgcgttcggggtcgcgggtttggaaacgtgcgggtttttaggttgtgttttcgggagtcgttttattcgagtcgcggcggtgcgcgtatgcggcggtgggtgtgtagacgtcgttgtggatttatcggttaatgcgtggaaggttcggagtagggtcggcgcggggttatcgtattgatgtttgcggtcgtggtttttgggttgtgcgtgttgtggtcggaggcgagatcggcgcgtgttttcgtgggttgtgtgtgaataggggttcgtgtcgcggcggggttttcggggcgcgagtttgtggtcggagaggtgtgttttaggagtgtgtttgcgtggtggtcgcgggcgtgtgcgttttcggtgggttattttggtgggacgtgtggtttgtgtgtgttgggattaggtggcgggttgcgcgtgtacgttcggggtcggtgtgtatcggtgggtagtagtgtgagcgtaggtagg

SEQ ID NO: 7584 - DNA, 1096 bp, Artificial Sequence
  chemically treated genomic DNA (Homo sapiens) CpG-island No: 7584
cctacctacgctcacactactacccaccgatacacaccgaccccgaacgtacacgcgcaacccgccacctaatcccaacacacacaaaccacacgtcccaccaaaataacccaccgaaaacgcacacgcccgcgaccaccacgcaaacacactcctaaaacacacctctccgaccacaaactcgcgccccgaaaaccccgccgcgacacgaacccctattcacacacaacccacgaaaacacgcgccgatctcgcctccgaccacaacacgcacaacccaaaaaccacgaccgcaaacatcaatacgataaccccgcgccgaccctactccgaaccttccacgcattaaccgataaatccacaacgacgtctacacacccaccgccgcatacgcgcaccgccgcgactcgaataaaacgactcccgaaaacacaacctaaaaacccgcacgtttccaaacccgcgaccccgaacgcgcctcctcgcaaacgaaacgcgaaaaacgccgtaaaaaccgcttaaccccctctcccccgacctccctaaaaccgtccttcccgaacgcccttcgttcctcctccctcccgctccgccgccttctaaaacccacgttcccctctattcgtcctctctacccctctacgctcgaccctaaccctacgacccaccccacccgccgcgccgcaaaacgaaaaaatcgaaatacgtaaaaaaaaaacgctccgcgatcacccgaaaaaccccccaaaaacgaaacctcgcgcgccgaaatcactccgaaacgaatcccgaaccgcccgaaatcaccgaaaaaccccgaaatcaccgacccgacgcgccgcccgccctccccaaacgctccaaaaacgactccccgcgcgcccgactccccgaccccctcgcgccgaccgaccctcccgaaacgataccctaaaatcgcttacgaataatatccaaacccccgccgactaaaatcctctaaaaattaaaaacctacccgaaaactaaacctcacgaaaataaaacgaaaaatcacgaaaatataatctccatacaaaactttctcatctacgtaaccctacgcgaatcactccat

SEQ ID NO: 7585 - DNA, 892 bp, Artificial Sequence
  chemically treated genomic DNA (Homo sapiens) CpG-island No: 7585
atgttgtcgttagcgtttattaataaggggcgtttgattatttgtttaaatcgtttgatatcgacgaagtagtggcgttggttgagcgcgttattagttattattaggaatagtagtagtcgcgtaatgtttagtttaacggtttaacgatcgatattatcggcgaagcgttagttatgtaggacgtgtttcgtattatcggtcggttttcgcgtttttttattagcgtgttgattaacggcgaattcggtatcggtaaagaattggtcgtttatgttttgtatcgtttagttcgcgcgcggtaatttgtaaaaaatggcgcgttagacggggaatattttttcgacgtttcgtagcggcggtagatgaacgcggataacgtttaggcggtggaatagatttttacggaatttatttttttgtattcgttgttcgagatttaggttttttacggcgatatttcgcgttatatggcgggtgattcgattgcgggtaaattgtttggtggttttttgtttaaaatgtacggtttgttagttgtcgtaattgttatttggtattttgttaaattagaaaatcgcgcgaaagtgggcggtattatgattttcgcggcgttgatttcgtttttggatcggtattatcgagtcgatcgagtttttttttatgttcgttcggcggattagttataggttttcgatgaaacgattttcgttagtgggatcgtgtcgcgtattggtttttagggtttgaggaaatggcgattttttgcgtaataattcgtaagacgttaggtattacgattatgtattagacgtacgattagtcggttttcgaaagcgatattcggggatgttaaaatgtttgaaattataattttattttatttgtgatt

SEQ ID NO: 7586 - DNA, 892 bp, Artificial Sequence
  chemically treated genomic DNA (Homo sapiens) CpG-island No: 7586
aatcacaaataaaataaaattataatttcaaacattttaacatccccgaatatcgctttcgaaaaccgactaatcgtacgtctaatacataatcgtaatacctaacgtcttacgaattattacgcaaaaaatcgccatttcctcaaaccctaaaaaccaatacgcgacacgatcccactaacgaaaatcgtttcatcgaaaacctataactaatccgccgaacgaacataaaaaaaaactcgatcgactcgataataccgatccaaaaacgaaatcaacgccgcgaaaatcataataccgcccactttcgcgcgattttctaatttaacaaaataccaaataacaattacgacaactaacaaaccgtacattttaaacaaaaaaccaccaaacaatttacccgcaatcgaatcacccgccatataacgcgaaatatcgccgtaaaaaacctaaatctcgaacaacgaatacaaaaaaataaattccgtaaaaatctattccaccgcctaaacgttatccgcgttcatctaccgccgctacgaaacgtcgaaaaaatattccccgtctaacgcgccattttttacaaattaccgcgcgcgaactaaacgatacaaaacataaacgaccaattctttaccgataccgaattcgccgttaatcaacacgctaataaaaaaacgcgaaaaccgaccgataatacgaaacacgtcctacataactaacgcttcgccgataatatcgatcgttaaaccgttaaactaaacattacgcgactactactattcctaataataactaataacgcgctcaaccaacgccactacttcgtcgatatcaaacgatttaaacaaataatcaaacgccccttattaataaacgctaacgacaacat

SEQ ID NO: 7587 - DNA, 892 bp, Artificial Sequence
  chemically treated genomic DNA (Homo sapiens) CpG-island No: 7587
agttataagtaaggtagggttatgattttaggtattttagtattttcgggtatcgttttcggagatcgattggtcgtgcgtttggtgtatgatcgtgatgtttggcgttttgcggattattacgtagagaatcgttatttttttaagttttgggagttagtgcgcggtacgattttattggcgaggatcgttttatcgaaagtttgtaattgattcgtcgaacgaatatgaaggagaattcgatcggttcggtgatatcggtttaggaacgaggttagcgtcgcggagattataatatcgtttattttcgcgcggttttttggtttagtagagtgttagatagtaattgcggtagttggtagatcgtatattttgaataggaagttattagatagtttattcgtagtcgggttattcgttatataacgcggaatgtcgtcgtggaaaatttgaatttcgaatagcgagtgtaggaaggtaagtttcgtgaggatttgttttatcgtttgaacgttattcgcgtttatttgtcgtcgttgcggaacgtcgggaagatatttttcgtttggcgcgttattttttataggttgtcgcgcgcgaattgggcgatgtagggtatgagcgattagttttttatcggtgtcggattcgtcgttaattagtacgttaatagaagaacgcgaaagtcgatcgataatacggaatacgttttgtatggttggcgtttcgtcgatgatatcggtcgttgggtcgttaagttgaatattacgcggttgttgttgtttttggtaatgattgatagcgcgtttaattagcgttattgtttcgtcgatattaaacggtttgggtagataattaaacgttttttgttgataggcgttgacggtagtat

SEQ ID NO: 7588 - DNA, 892 bp, Artificial Sequence
  chemically treated genomic DNA (Homo sapiens) CpG-island No: 7588
atactaccgtcaacgcctatcaacaaaaaacgtttaattatctacccaaaccgtttaatatcgacgaaacaataacgctaattaaacgcgctatcaatcattaccaaaaacaacaacaaccgcgtaatattcaacttaacgacccaacgaccgatatcatcgacgaaacgccaaccatacaaaacgtattccgtattatcgatcgactttcgcgttcttctattaacgtactaattaacgacgaatccgacaccgataaaaaactaatcgctcataccctacatcgcccaattcgcgcgcgacaacctataaaaaataacgcgccaaacgaaaaatatcttcccgacgttccgcaacgacgacaaataaacgcgaataacgttcaaacgataaaacaaatcctcacgaaacttaccttcctacactcgctattcgaaattcaaattttccacgacgacattccgcgttatataacgaataacccgactacgaataaactatctaataacttcctattcaaaatatacgatctaccaactaccgcaattactatctaacactctactaaaccaaaaaaccgcgcgaaaataaacgatattataatctccgcgacgctaacctcgttcctaaaccgatatcaccgaaccgatcgaattctccttcatattcgttcgacgaatcaattacaaactttcgataaaacgatcctcgccaataaaatcgtaccgcgcactaactcccaaaacttaaaaaaataacgattctctacgtaataatccgcaaaacgccaaacatcacgatcatacaccaaacgcacgaccaatcgatctccgaaaacgatacccgaaaatactaaaatacctaaaatcataaccctaccttacttataact

SEQ ID NO: 7589 - DNA, 516 bp, Artificial Sequence
  chemically treated genomic DNA (Homo sapiens) CpG-island No: 7589
attgtatcggattatattttattttttgtcgtgttgtgtgtatgttcgtatttttgtcgatagttgtttggagatttttttgattttagtcgagttatttcgtgtgtaggttcgtcggttcgagttattttattttattgcgtatcggtatttttattcgttcgtttgttgtttcgtattcgtattatatgtttgttgtgtttttttttggtttcgttgtattgcgtaattttggcgtagtcgatgcgttaatcgttagttaatgtcgcgtttttagttttatattagttggttatcgttcgcggttttagtatttatttcgtttcggttttttgtatgatgttgtggtattgattagcggattttataatttttcggcgtgaaatcgttatgtttttgattacgtattcgaggttcgttattcggggattttttagagtattaattagtttttggtaaaatttttttttgtcgagcggtttcgtttaatggttggataaaatgaataaatggagt

SEQ ID NO: 7590 - DNA, 516 bp, Artificial Sequence
  chemically treated genomic DNA (Homo sapiens) CpG-island No: 7590
actccatttattcattttatccaaccattaaacgaaaccgctcgacaaaaaaaaattttaccaaaaactaattaatactctaaaaaatccccgaataacgaacctcgaatacgtaatcaaaaacataacgatttcacgccgaaaaattataaaatccgctaatcaataccacaacatcatacaaaaaaccgaaacgaaataaatactaaaaccgcgaacgataaccaactaatataaaactaaaaacgcgacattaactaacgattaacgcatcgactacgccaaaattacgcaatacaacgaaaccaaaaaaaaacacaacaaacatataatacgaatacgaaacaacaaacgaacgaataaaaataccgatacgcaataaaataaaataactcgaaccgacgaacctacacacgaaataactcgactaaaatcaaaaaaatctccaaacaactatcgacaaaaatacgaacatacacacaacacgacaaaaaataaaatataatccgatacaat

SEQ ID NO: 7591 - DNA, 516 bp, Artificial Sequence
  chemically treated genomic DNA (Homo sapiens) CpG-island No: 7591
gttttatttatttattttatttaattattgagcgaagtcgttcggtagggagaggttttgttaggagttagttggtgttttagaaggttttcgagtgacgagtttcggatgcgtaattagaggtatagcggttttacgtcgagagattgtagagttcgttgattagtgttatagtattatatagaggatcgaagcgagataggtgttaaagtcgcgagcggtgattaattgatgtgagattgagaacgcgatattaattagcggttgacgtatcgattacgttagagttgcgtaatatagcgaaattaagaggagatatagtaggtatgtgatgcgaatgcgggatagtaggcgagcgagtagaagtatcggtacgtagtgagatggagtagttcggatcgacgagtttgtatacgagataattcgattagagttagggaagtttttagatagttgtcgatagaggtgcgaatatgtatataatacgatagagagtaaagtgtagttcgatgtaat

SEQ ID NO: 7592 - DNA, 516 bp, Artificial Sequence
  chemically treated genomic DNA (Homo sapiens) CpG-island No: 7592
attacatcgaactacactttactctctatcgtattatatacatattcgcacctctatcgacaactatctaaaaacttccctaactctaatcgaattatctcgtatacaaactcgtcgatccgaactactccatctcactacgtaccgatacttctactcgctcgcctactatcccgcattcgcatcacatacctactatatctcctcttaatttcgctatattacgcaactctaacgtaatcgatacgtcaaccgctaattaatatcgcgttctcaatctcacatcaattaatcaccgctcgcgactttaacacctatctcgcttcgatcctctatataatactataacactaatcaacgaactctacaatctctcgacgtaaaaccgctatacctctaattacgcatccgaaactcgtcactcgaaaaccttctaaaacaccaactaactcctaacaaaacctctccctaccgaacgacttcgctcaataattaaataaaataaataaataaaac

SEQ ID NO: 7593 - DNA, 548 bp, Artificial Sequence
  chemically treated genomic DNA (Homo sapiens) CpG-island No: 7593
tttttttcgatttcgtatttgtttgttttcgagggtgaacgttaagtagtagattttatttttttattaatatttgcggcgtattcggggaggaggagcgggaaacggcgagggatttgagttagggttagagcgtggggcgaggggcggtttcgagggaggtatttttcgcggagcgcggtcggcgcgcggggattaaggggcggggtaggaggggagtttttcgattcggtttcgcggttttttttgacgtttttttcgttcggttatcgttgattcgggttgattgcgcgcgaggtttttcgggcgcgtatttttttttttttttttacgttacggattagaaaatagatttcgggaggagaggggacggggggttgaaattcggttttcgaggttattttttcggggagcggtcgggtaggtttcggaggtttttcggttcgggttcgcgttattaatttttatgcgtagtagttgggtttgaggtttcgattacggggttggtttcggtttggagggattgagggtggcgaggttcgaggttt

SEQ ID NO: 7594 - DNA, 548 bp, Artificial Sequence
  chemically treated genomic DNA (Homo sapiens) CpG-island No: 7594
aaacctcgaacctcgccaccctcaatccctccaaaccgaaaccaaccccgtaatcgaaacctcaaacccaactactacgcataaaaattaataacgcgaacccgaaccgaaaaacctccgaaacctacccgaccgctccccgaaaaaataacctcgaaaaccgaatttcaaccccccgtcccctctcctcccgaaatctattttctaatccgtaacgtaaaaaaaaaaaaaaaaatacgcgcccgaaaaacctcgcgcgcaatcaacccgaatcaacgataaccgaacgaaaaaaacgtcaaaaaaaaccgcgaaaccgaatcgaaaaactcccctcctaccccgccccttaatccccgcgcgccgaccgcgctccgcgaaaaatacctccctcgaaaccgcccctcgccccacgctctaaccctaactcaaatccctcgccgtttcccgctcctcctccccgaatacgccgcaaatattaataaaaaaataaaatctactacttaacgttcaccctcgaaaacaaacaaatacgaaatcgaaaaaaa

SEQ ID NO: 7595 - DNA, 548 bp, Artificial Sequence
  chemically treated genomic DNA (Homo sapiens) CpG-island No: 7595
gggtttcgagtttcgttatttttagtttttttaggtcggggttaatttcgtagtcgaggttttaggtttagttgttgcgtatgggggttgatggcgcgggttcggatcggagagttttcgaggtttattcgatcgtttttcgggagggtgatttcgggggtcgggttttagtttttcgtttttttttttttcggggtttgttttttgattcgtaacgtggggggaggagagggggtgcgcgttcgggaggtttcgcgcgtagttagttcgagttaacggtaatcgagcgagggaagcgttaggaagggtcgcgaagtcgggtcggggggttttttttttgtttcgttttttagttttcgcgcgtcgatcgcgtttcgcgggaagtgtttttttcggaatcgtttttcgttttacgttttggttttggtttaagtttttcgtcgtttttcgtttttttttttcgggtgcgtcgtaggtattagtggagagatgggatttgttgtttagcgtttattttcggaagtagatagatacgaagtcgggggagg

SEQ ID NO: 7596 - DNA, 548 bp, Artificial Sequence
  chemically treated genomic DNA (Homo sapiens) CpG-island No: 7596
cctcccccgacttcgtatctatctacttccgaaaataaacgctaaacaacaaatcccatctctccactaatacctacgacgcacccgaaaaaaaaaaacgaaaaacgacgaaaaacttaaaccaaaaccaaaacgtaaaacgaaaaacgattccgaaaaaaacacttcccgcgaaacgcgatcgacgcgcgaaaactaaaaaacgaaacaaaaaaaaaaccccccgacccgacttcgcgacccttcctaacgcttccctcgctcgattaccgttaactcgaactaactacgcgcgaaacctcccgaacgcgcaccccctctcctccccccacgttacgaatcaaaaaacaaaccccgaaaaaaaaaaaaacgaaaaactaaaacccgacccccgaaatcaccctcccgaaaaacgatcgaataaacctcgaaaactctccgatccgaacccgcgccatcaacccccatacgcaacaactaaacctaaaacctcgactacgaaattaaccccgacctaaaaaaactaaaaataacgaaactcgaaaccc

SEQ ID NO: 7597 - DNA, 624 bp, Artificial Sequence
  chemically treated genomic DNA (Homo sapiens) CpG-island No: 7597
ggacgattttggaggttttttcggtttttcgtttacggttttggacgtcgttattttgagtaggcggtacgggaatagtcggggtcgaggtcgcgtcggggttaggtcgttaatagatttaacggagtcgtcgttcgcgtcggtcgcggagaggaatttttattcgtggtaaaggatcgtgggatatttattttttagggttcggagtttcgttgtcgttcggtacgtcgggcgcgtcgttttttttttttattttgattttcgtcgtcgttattttcgtcgtcgtttcgatttttgtcgttatttttttcgcgtttgggttttgtgtgagcgaacgggttgtatcgcgttgcgtttgcgcgtttacgtgattcgacgtaattagtaatatttgcgttcgtcgttttcggttgtttttttggttttattcgtttcgggttacgttttcgtcgcgcgtaggcgtagatcggtagttgttgatcgtttttttttcgagatatattcgcgttaggtatcgattggttgttttcggcgcgcgttttttgagttcgatagaggaggtatttttttattttattttatataaatatttagatttagttatttttagttttttgtaattag

SEQ ID NO: 7598 - DNA, 624 bp, Artificial Sequence
  chemically treated genomic DNA (Homo sapiens) CpG-island No: 7598
ctaattacaaaaaactaaaaataactaaatctaaatatttatataaaataaaataaaaaaatacctcctctatcgaactcaaaaaacgcgcgccgaaaacaaccaatcgatacctaacgcgaatatatctcgaaaaaaaaacgatcaacaactaccgatctacgcctacgcgcgacgaaaacgtaacccgaaacgaataaaaccaaaaaaacaaccgaaaacgacgaacgcaaatattactaattacgtcgaatcacgtaaacgcgcaaacgcaacgcgatacaacccgttcgctcacacaaaacccaaacgcgaaaaaaataacgacaaaaatcgaaacgacgacgaaaataacgacgacgaaaatcaaaataaaaaaaaaaaacgacgcgcccgacgtaccgaacgacaacgaaactccgaaccctaaaaaataaatatcccacgatcctttaccacgaataaaaattcctctccgcgaccgacgcgaacgacgactccgttaaatctattaacgacctaaccccgacgcgacctcgaccccgactattcccgtaccgcctactcaaaataacgacgtccaaaaccgtaaacgaaaaaccgaaaaaacctccaaaatcgtcc

SEQ ID NO: 7599 - DNA, 624 bp, Artificial Sequence
  chemically treated genomic DNA (Homo sapiens) CpG-island No: 7599
ttggttatagaaagttgagagtgattaggtttaggtgtttgtgtggggtggggtggggagatgttttttttatcggatttagaggacgcgcgtcgggaatagttagtcggtgtttaacgcgagtgtatttcgagagagaagcgattaatagttgtcggtttgcgtttgcgcgcggcgggggcgtggttcggggcgagtggggttaaggaggtagtcgggagcggcgggcgtaggtgttattggttgcgtcgggttacgtgggcgcgtaggcgtagcgcggtgtagttcgttcgtttatataaagtttagacgcggagaaaatggcggtaggggtcgaagcggcggcggaggtggcggcgacggagattaaaatggaggaagagagcggcgcgttcggcgtgtcgagcggtaacggggtttcgggttttaaggggtgagtattttacggttttttgttacgggtaagggttttttttcgcggtcgacgcgggcggcggtttcgttaggtttgttggcggtttagtttcggcgcggtttcggtttcggttgttttcgtatcgtttgtttagggtagcggcgtttagggtcgtgagcggggagtcgggggagtttttagaatcgttt

SEQ ID NO: 7600 - DNA, 624 bp, Artificial Sequence
  chemically treated genomic DNA (Homo sapiens) CpG-island No: 7600
aaacgattctaaaaactcccccgactccccgctcacgaccctaaacgccgctaccctaaacaaacgatacgaaaacaaccgaaaccgaaaccgcgccgaaactaaaccgccaacaaacctaacgaaaccgccgcccgcgtcgaccgcgaaaaaaaacccttacccgtaacaaaaaaccgtaaaatactcaccccttaaaacccgaaaccccgttaccgctcgacacgccgaacgcgccgctctcttcctccattttaatctccgtcgccgccacctccgccgccgcttcgacccctaccgccattttctccgcgtctaaactttatataaacgaacgaactacaccgcgctacgcctacgcgcccacgtaacccgacgcaaccaataacacctacgcccgccgctcccgactacctccttaaccccactcgccccgaaccacgcccccgccgcgcgcaaacgcaaaccgacaactattaatcgcttctctctcgaaatacactcgcgttaaacaccgactaactattcccgacgcgcgtcctctaaatccgataaaaaaaacatctccccaccccaccccacacaaacacctaaacctaatcactctcaactttctataaccaa

SEQ ID NO: 7601 - DNA, 587 bp, Artificial Sequence
  chemically treated genomic DNA (Homo sapiens) CpG-island No: 7601
tcgacggttagcggttagaggtcgttcgttcgattttaagatggcgttcgttatagttgttaggtgttaagatggcggcgcggggtcgcgttcgcgtttttaggttttttttttttagttttttttcggttggtagtacgattcgcgtagtcgtgcgtcgattgtttttcggtttgggtaatggtttcggttgtcggtcgacgatcgtttcgcgttatgcggtttttcggttggtggtaagtattgttgtgggtgttgggatttttcgttcgcggcgtggagggtgagtgtgggtcgggggcggtgtatgagatgatggggcgagttgaggtttattcgggcgacgttttggatttgcgcgaaggtcggcggtgcgcgattcgtttttttttggcgttttttcgggcgcgttttttcgattttttttttcgcgtatcgttcgttggtggttcgcgaaagggggtcggtgggttgagggtcggtggacgggagttcgggggtggttgggtcgcgtttaggtcgtttttagttcgtggttggtagttaggagggatagtgcggtaagcgttgttgaggtatattttttg

SEQ ID NO: 7602 - DNA, 587 bp, Artificial Sequence
  chemically treated genomic DNA (Homo sapiens) CpG-island No: 7602
caaaaaatatacctcaacaacgcttaccgcactatccctcctaactaccaaccacgaactaaaaacgacctaaacgcgacccaaccacccccgaactcccgtccaccgaccctcaacccaccgaccccctttcgcgaaccaccaacgaacgatacgcgaaaaaaaaaatcgaaaaaacgcgcccgaaaaaacgccaaaaaaaaacgaatcgcgcaccgccgaccttcgcgcaaatccaaaacgtcgcccgaataaacctcaactcgccccatcatctcatacaccgcccccgacccacactcaccctccacgccgcgaacgaaaaatcccaacacccacaacaatacttaccaccaaccgaaaaaccgcataacgcgaaacgatcgtcgaccgacaaccgaaaccattacccaaaccgaaaaacaatcgacgcacgactacgcgaatcgtactaccaaccgaaaaaaaactaaaaaaaaaaaacctaaaaacgcgaacgcgaccccgcgccgccatcttaacacctaacaactataacgaacgccatcttaaaatcgaacgaacgacctctaaccgctaaccgtcga

SEQ ID NO: 7603 - DNA, 587 bp, Artificial Sequence
  chemically treated genomic DNA (Homo sapiens) CpG-island No: 7603
tagagggtatgttttagtagcgtttatcgtattgttttttttggttattagttacgggttgagggcggtttgaacgcggtttaattattttcgggttttcgtttatcggtttttagtttatcggttttttttcgcgggttattagcgggcggtgcgcggggagagaagtcggggagacgcgttcggggagacgttaagaaggggcgagtcgcgtatcgtcggttttcgcgtaggtttagagcgtcgttcgggtggattttagttcgttttattattttatgtatcgttttcggtttatatttattttttacgtcgcggacgggaagttttagtatttatagtaatatttgttattagtcgaggagtcgtatgacgcggggcggtcgtcgatcggtagtcgggattattgtttaggtcgagaggtaatcggcgtacggttacgcgagtcgtgttgttagtcggaggaaggttgggggaggagagtttgggagcgcgggcgcggtttcgcgtcgttattttaatatttggtagttgtggcgggcgttattttggagtcgggcggacggtttttagtcgttggtcgtcgg

SEQ ID NO: 7604 - DNA, 587 bp, Artificial Sequence
  chemically treated genomic DNA (Homo sapiens) CpG-island No: 7604
ccgacgaccaacgactaaaaaccgtccgcccgactccaaaataacgcccgccacaactaccaaatattaaaataacgacgcgaaaccgcgcccgcgctcccaaactctcctcccccaaccttcctccgactaacaacacgactcgcgtaaccgtacgccgattacctctcgacctaaacaataatcccgactaccgatcgacgaccgccccgcgtcatacgactcctcgactaataacaaatattactataaatactaaaacttcccgtccgcgacgtaaaaaataaatataaaccgaaaacgatacataaaataataaaacgaactaaaatccacccgaacgacgctctaaacctacgcgaaaaccgacgatacgcgactcgccccttcttaacgtctccccgaacgcgtctccccgacttctctccccgcgcaccgcccgctaataacccgcgaaaaaaaaccgataaactaaaaaccgataaacgaaaacccgaaaataattaaaccgcgttcaaaccgccctcaacccgtaactaataaccaaaaaaaacaatacgataaacgctactaaaacataccctcta

SEQ ID NO: 7605 - DNA, 532 bp, Artificial Sequence
  chemically treated genomic DNA (Homo sapiens) CpG-island No: 7605
  misc_feature (431)..(431): n is either a, c, g or t
aacgtgatgttgtatttcggagcgtttcgttttttggttatgaatacgtttggtatggtgaagttgttttagggtttgggcgttatttttcgtaagaatttgttgattacgcggaaggcgaataataatttgttatttttgtcgggaggtaattatttgggcgtggtcggttagttggttcgtatatcgtcgtcgttttcgttagcgttaagtaacggtttgtcgggtaagaatttcgtttcgggtagaattatttacgtttagcgatcgaatgttattgtataagatcgtttgaggtgtaataagagggcgttggtatgaagaaaagttggtggtggattaagcggatcgtcgggagttatgatagttaagcgtttgaatgaattgttaatgggaaaggcgaagaaggaggagaagttattatcggatancgaggatggcggcgagtagtcgacgaaggataaggaacgcgataaattgaggatgttattttaagattatagggaattgtgtataatgaggattaagagaa

SEQ ID NO: 7606 - DNA, 532 bp, Artificial Sequence
  chemically treated genomic DNA (Homo sapiens) CpG-island No: 7606
  misc_feature (102)..(102): n is either a, c, g or t
ttctcttaatcctcattatacacaattccctataatcttaaaataacatcctcaatttatcgcgttccttatccttcgtcgactactcgccgccatcctcgntatccgataataacttctcctccttcttcgcctttcccattaacaattcattcaaacgcttaactatcataactcccgacgatccgcttaatccaccaccaacttttcttcataccaacgccctcttattacacctcaaacgatcttatacaataacattcgatcgctaaacgtaaataattctacccgaaacgaaattcttacccgacaaaccgttacttaacgctaacgaaaacgacgacgatatacgaaccaactaaccgaccacgcccaaataattacctcccgacaaaaataacaaattattattcgccttccgcgtaatcaacaaattcttacgaaaaataacgcccaaaccctaaaacaacttcaccataccaaacgtattcataaccaaaaaacgaaacgctccgaaatacaacatcacgtt

SEQ ID NO: 7607 - DNA, 532 bp, Artificial Sequence
  chemically treated genomic DNA (Homo sapiens) CpG-island No: 7607
  misc_feature (102)..(102): n is either a, c, g or t
tttttttgatttttattatgtatagttttttgtagttttagagtgatatttttaatttgtcgcgttttttgtttttcgtcggttgttcgtcgttattttcgntattcggtggtggtttttttttttttttcgttttttttattagtagtttatttaaacgtttggttgttatgattttcggcgattcgtttgatttattattagtttttttttatattagcgtttttttattgtattttaggcgattttgtgtaatgatattcgatcgttgagcgtaaatggttttgttcgaggcgggatttttattcggtagatcgttgtttaacgttggcgagggcggcggcggtgtgcgggttagttgatcgattacgtttaggtgattatttttcgatagggatagtaaattgttgttcgtttttcgcgtggttaatagatttttgcggaaggtgacgtttaggttttggggtaattttattatgttaaacgtgtttatggttaagggacgaggcgtttcggagtatagtattacgtt

SEQ ID NO: 7608 - DNA, 532 bp, Artificial Sequence
  chemically treated genomic DNA (Homo sapiens) CpG-island No: 7608
  misc_feature (431)..(431): n is either a, c, g or t
aacgtaatactatactccgaaacgcctcgtcccttaaccataaacacgtttaacataataaaattaccccaaaacctaaacgtcaccttccgcaaaaatctattaaccacgcgaaaaacgaacaacaatttactatccctatcgaaaaataatcacctaaacgtaatcgatcaactaacccgcacaccgccgccgccctcgccaacgttaaacaacgatctaccgaataaaaatcccgcctcgaacaaaaccatttacgctcaacgatcgaatatcattacacaaaatcgcctaaaatacaataaaaaaacgctaatataaaaaaaaactaataataaatcaaacgaatcgccgaaaatcataacaaccaaacgtttaaataaactactaataaaaaaaacgaaaaaaaaaaaaaaaccaccaccgaatancgaaaataacgacgaacaaccgacgaaaaacaaaaaacgcgacaaattaaaaatatcactctaaaactacaaaaaactatacataataaaaatcaaaaaaa

SEQ ID NO: 7609 - DNA, 616 bp, Artificial Sequence
  chemically treated genomic DNA (Homo sapiens) CpG-island No: 7609
cggataattcgtatattcggtttatcgttttattttgattggtaggtcgttttaaatatttgtatttgacgcgcggtgtcgttttttagcgttagcgtttgatagtgttcggtggtgatgcggttttttgttagcgtatcgaggatgataggcgtaaggtttgttagttttagtattcgttgaacgtggcggggcgaataatttagtaaattatcgatttgtgtaggtgttttgtttttttgcgttattgtacggaattcggtaatttgttcggtagggtgtatatttcgacgatgatcgttttcggttatcgatgcggtagtcgttagtttttgcggaatgatttttatacggataggttagttaatttgaatgatgttacgttttgttagtatgttgagtgttgttagtcggcgattatttgcggcgatatcgtaacggttatttggtagggtatgaataattagattttgtaataggtcgatattttttatggagttcgttagttcgttgacggatttcggagaatacgggatcgtgcgtatatttaggggagatttaaatagtgtagtagtcgatttgtttcgttttatttatattttttgttatgataggt

SEQ ID NO: 7610 - DNA, 616 bp, Artificial Sequence
  chemically treated genomic DNA (Homo sapiens) CpG-island No: 7610
acctatcataacaaaaaatataaataaaacgaaacaaatcgactactacactatttaaatctcccctaaatatacgcacgatcccgtattctccgaaatccgtcaacgaactaacgaactccataaaaaatatcgacctattacaaaatctaattattcataccctaccaaataaccgttacgatatcgccgcaaataatcgccgactaacaacactcaacatactaacaaaacgtaacatcattcaaattaactaacctatccgtataaaaatcattccgcaaaaactaacgactaccgcatcgataaccgaaaacgatcatcgtcgaaatatacaccctaccgaacaaattaccgaattccgtacaataacgcaaaaaaacaaaacacctacacaaatcgataatttactaaattattcgccccgccacgttcaacgaatactaaaactaacaaaccttacgcctatcatcctcgatacgctaacaaaaaaccgcatcaccaccgaacactatcaaacgctaacgctaaaaaacgacaccgcgcgtcaaatacaaatatttaaaacgacctaccaatcaaaataaaacgataaaccgaatatacgaattatccg

SEQ ID NO: 7611 - DNA, 616 bp, Artificial Sequence
  chemically treated genomic DNA (Homo sapiens) CpG-island No: 7611
gtttgttataatagagaatatgggtaaagcggggtagatcggttattgtattatttaagttttttttaaatgtgcgtacggtttcgtatttttcggagttcgttagcgaattggcggattttataaaaggtgtcggtttgttatagaatttggttgtttatgttttgttaggtgatcgttacggtgtcgtcgtaggtggtcgtcgattggtagtatttaatatgttggtagagcgtgatattatttaggttgattggtttgttcgtgtgaaggttatttcgtaggagttggcgattgtcgtatcgatgatcgagaacggttatcgtcgggatatgtattttgtcgaatagattgtcggatttcgtgtaatggcgtaggaaggtaaaatatttgtataaatcggtgatttgttgggttattcgtttcgttacgtttagcgaatgttgaaattggtagattttgcgtttgttattttcgatgcgttggtagaagatcgtattattatcgagtattgttaggcgttggcgttggagaacgatatcgcgcgttaggtgtaggtgtttgaagcggtttgttagttaggatggggcggtaaatcggatgtgcgggttattcg

SEQ ID NO: 7612 - DNA, 616 bp, Artificial Sequence
  chemically treated genomic DNA (Homo sapiens) CpG-island No: 7612
cgaataacccgcacatccgatttaccgccccatcctaactaacaaaccgcttcaaacacctacacctaacgcgcgatatcgttctccaacgccaacgcctaacaatactcgataataatacgatcttctaccaacgcatcgaaaataacaaacgcaaaatctaccaatttcaacattcgctaaacgtaacgaaacgaataacccaacaaatcaccgatttatacaaatattttaccttcctacgccattacacgaaatccgacaatctattcgacaaaatacatatcccgacgataaccgttctcgatcatcgatacgacaatcgccaactcctacgaaataaccttcacacgaacaaaccaatcaacctaaataatatcacgctctaccaacatattaaatactaccaatcgacgaccacctacgacgacaccgtaacgatcacctaacaaaacataaacaaccaaattctataacaaaccgacaccttttataaaatccgccaattcgctaacgaactccgaaaaatacgaaaccgtacgcacatttaaaaaaaacttaaataatacaataaccgatctaccccgctttacccatattctctattataacaaac

SEQ ID NO: 7613 - DNA, 629 bp, Artificial Sequence
  chemically treated genomic DNA (Homo sapiens) CpG-island No: 7613
cgttttgcgtagttttttatgcgagagcgggatatttcgttgcgttacgttttttagtaatacgtttcggatatcgtaggttagaagtcggggcgtgttatcgttaaataatttcggttattagggttttagggtgtttacggtattatttagcgtgggtagatttagataaatggatagcgtttgtttggtttgcgttttttttgtcgttagttttgtttttcgggcggttttttcggttagtttttgtttttttattttttattttggtggcgtggtgatattgatgatggtttttcggttgcggataagcgtttttttttttgtttttcgttttagtgttagtatcggtcgtttttgttttgttatgttgtgttttgtttttgacgaattatttttttgcggttaaagatattatattcgttatagcgttagaacgtttagtatagttagatgataggtatagaacgtcgggaaaaagttttcgggttagaaacgggataataatttttttgtatacgatattagattaacggttagtatcgttattataaggtcggttatagtcgtcgtattattggtggtttttagagtatagtggagatgatttttaatattttttttattgg

SEQ ID NO: 7614 - DNA, 629 bp, Artificial Sequence
  chemically treated genomic DNA (Homo sapiens) CpG-island No: 7614
ccaataaaaaaaatattaaaaatcatctccactatactctaaaaaccaccaataatacgacgactataaccgaccttataataacgatactaaccgttaatctaatatcgtatacaaaaaaattattatcccgtttctaacccgaaaactttttcccgacgttctatacctatcatctaactatactaaacgttctaacgctataacgaatataatatctttaaccgcaaaaaaataattcgtcaaaaacaaaacacaacataacaaaacaaaaacgaccgatactaacactaaaacgaaaaacaaaaaaaaaaacgcttatccgcaaccgaaaaaccatcatcaatatcaccacgccaccaaaataaaaaataaaaaaacaaaaactaaccgaaaaaaccgcccgaaaaacaaaactaacgacaaaaaaaacgcaaaccaaacaaacgctatccatttatctaaatctacccacgctaaataataccgtaaacaccctaaaaccctaataaccgaaattatttaacgataacacgccccgacttctaacctacgatatccgaaacgtattactaaaaaacgtaacgcaacgaaatatcccgctctcgcataaaaaactacgcaaaacg

SEQ ID NO: 7615 - DNA, 629 bp, Artificial Sequence
  chemically treated genomic DNA (Homo sapiens) CpG-island No: 7615
ttagtaaaaaggatgttgggaattatttttattgtgttttaaaggttattagtgatgcggcggttgtagtcggttttgtgatgacggtgttgatcgttggtttggtgtcgtgtgtagggaaattattatttcgtttttggttcggagattttttttcgacgttttatgtttgttatttggttgtgttgggcgttttggcgttgtgacgggtgtggtatttttggtcgtaagaggatgattcgttagaggtagaatatagtatgatagagtagaagcgatcggtattgatattgaagcggaagatagaaggggagacgtttgttcgtagtcggaaaattattattaatgttattacgttattaaagtggaaggtgaaaaagtagaagttggtcgagaaagtcgttcgggaagtagagttggcggtaaaaaaagcgtaggttagataggcgttgtttatttatttgaatttgtttacgttggatgatgtcgtgaatattttgaagttttggtggtcgggattatttgacggtgatacgtttcggtttttggtttgcggtattcgggacgtgttattggaagacgtggcgtagcggaatatttcgttttcgtataaaaaattgcgtagggcg

SEQ ID NO: 7616 - DNA, 629 bp, Artificial Sequence
  chemically treated genomic DNA (Homo sapiens) CpG-island No: 7616
cgccctacgcaattttttatacgaaaacgaaatattccgctacgccacgtcttccaataacacgtcccgaataccgcaaaccaaaaaccgaaacgtatcaccgtcaaataatcccgaccaccaaaacttcaaaatattcacgacatcatccaacgtaaacaaattcaaataaataaacaacgcctatctaacctacgctttttttaccgccaactctacttcccgaacgactttctcgaccaacttctactttttcaccttccactttaataacgtaataacattaataataattttccgactacgaacaaacgtctccccttctatcttccgcttcaatatcaataccgatcgcttctactctatcatactatattctacctctaacgaatcatcctcttacgaccaaaaataccacacccgtcacaacgccaaaacgcccaacacaaccaaataacaaacataaaacgtcgaaaaaaaatctccgaaccaaaaacgaaataataatttccctacacacgacaccaaaccaacgatcaacaccgtcatcacaaaaccgactacaaccgccgcatcactaataacctttaaaacacaataaaaataattcccaacatcctttttactaa

SEQ ID NO: 7617 - DNA, 513 bp, Artificial Sequence
  chemically treated genomic DNA (Homo sapiens) CpG-island No: 7617
tagacggcgagcgattgagggtgatagggaaaattttcggatttcgcgttttcggcggtgatcgtttgtaggtggtattcgttagtgaagatgcgatgacggttgttgtgtcgggacgggttgaatcggttattttgtttgtgagcgatttatcgtttacggtattgaagttggagaacggttgggtggaaacgttcgggtatttcgttagcgatagtgcgacggtttttgttttcgttatatagatggtaatggataatgttattttgaacggtttggttcgtagtggtcgtgatgttcggttgtattttttattggatgaaattcgtattgcggaaaaatttgttcgttattcgttttttacggtggtttttgagtagataaagacgcgggtcggtgagatatcgttggaaacggttattagttattagaagttcgtattttatacgtcggtatagtaggttatttattttgttttttcggtggtggaaagtaaaaaattggtttttagta

SEQ ID NO: 7618 - DNA, 513 bp, Artificial Sequence
  chemically treated genomic DNA (Homo sapiens) CpG-island No: 7618
tactaaaaaccaattttttactttccaccaccgaaaaaacaaaataaataacctactataccgacgtataaaatacgaacttctaataactaataaccgtttccaacgatatctcaccgacccgcgtctttatctactcaaaaaccaccgtaaaaaacgaataacgaacaaatttttccgcaatacgaatttcatccaataaaaaatacaaccgaacatcacgaccactacgaaccaaaccgttcaaaataacattatccattaccatctatataacgaaaacaaaaaccgtcgcactatcgctaacgaaatacccgaacgtttccacccaaccgttctccaacttcaataccgtaaacgataaatcgctcacaaacaaaataaccgattcaacccgtcccgacacaacaaccgtcatcgcatcttcactaacgaataccacctacaaacgatcaccgccgaaaacgcgaaatccgaaaattttccctatcaccctcaatcgctcgccgtcta

SEQ ID NO: 7619 - DNA, 513 bp, Artificial Sequence
  chemically treated genomic DNA (Homo sapiens) CpG-island No: 7619
tgttgaaggttagttttttattttttattatcggaagggtaagatgaatggtttgttgtgtcggcgtgtgaagtgcggatttttgatgattgatagtcgtttttagcgatgttttatcggttcgcgtttttatttgtttagaaattatcgtaaaggacggatggcgggtaagttttttcgtagtacgggttttatttagtgaggaatatagtcggatattacgattattgcgggttagatcgtttagggtggtattgtttattgttatttgtgtgacggaggtaaaaatcgtcgtattgtcgttgacggaatgttcgggcgtttttatttagtcgttttttagttttagtgtcgtgaacggtgaatcgtttataggtagggtggtcggtttagttcgtttcggtataataatcgttatcgtatttttattgacggatgttatttgtaggcggttatcgtcggagacgcggagttcgggaattttttttgttatttttagtcgttcgtcgtttg

SEQ ID NO: 7620 - DNA, 513 bp, Artificial Sequence
  chemically treated genomic DNA (Homo sapiens) CpG-island No: 7620
caaacgacgaacgactaaaaataacaaaaaaaattcccgaactccgcgtctccgacgataaccgcctacaaataacatccgtcaataaaaatacgataacgattattataccgaaacgaactaaaccgaccaccctacctataaacgattcaccgttcacgacactaaaactaaaaaacgactaaataaaaacgcccgaacattccgtcaacgacaatacgacgatttttacctccgtcacacaaataacaataaacaataccaccctaaacgatctaacccgcaataatcgtaatatccgactatattcctcactaaataaaacccgtactacgaaaaaacttacccgccatccgtcctttacgataatttctaaacaaataaaaacgcgaaccgataaaacatcgctaaaaacgactatcaatcatcaaaaatccgcacttcacacgccgacacaacaaaccattcatcttacccttccgataataaaaaataaaaaactaaccttcaaca

SEQ ID NO: 7621 - DNA, 568 bp, Artificial Sequence
  chemically treated genomic DNA (Homo sapiens) CpG-island No: 7621
ggtatgtgggaaatgtcgggtgtatcggtggaggtttttttcggacgtttatagattattcgggaggtcgtcggggaagacgtttcgttgaaatttcgggatgtggcggcgttggatacgcgtaaatttaaatagtatgtcgattcggagattaaaatggtcgagtggatgtagacgttgaaggaaatcgggttcgatattcgggtatatcgtgacgcggcggattagcgtgcggattttcgtacgttgacgttcgggtttgttttataggacgggtcggatgtgtagtaggcggtgatataggcgattgtcggattaagtgaacgaaaagtgtagtttacgtatacggacgtattggttagaacggtcggtatattgtcgtcggaaaatggtgtgattgaacgggtacgcgtcggtatcgatgaggttattagtcgtgagtagtttatttttttcgatcgggtgaaggggtaatttagcgaacgggatttatgtgttgaaaaatttgggaaaattggcggttaattcgggatataatggaggtaaaattcgggtgaatttacgattt

SEQ ID NO: 7622 - DNA, 568 bp, Artificial Sequence
  chemically treated genomic DNA (Homo sapiens) CpG-island No: 7622
aaatcgtaaattcacccgaattttacctccattatatcccgaattaaccgccaattttcccaaatttttcaacacataaatcccgttcgctaaattaccccttcacccgatcgaaaaaaataaactactcacgactaataacctcatcgataccgacgcgtacccgttcaatcacaccattttccgacgacaatataccgaccgttctaaccaatacgtccgtatacgtaaactacacttttcgttcacttaatccgacaatcgcctatatcaccgcctactacacatccgacccgtcctataaaacaaacccgaacgtcaacgtacgaaaatccgcacgctaatccgccgcgtcacgatatacccgaatatcgaacccgatttccttcaacgtctacatccactcgaccattttaatctccgaatcgacatactatttaaatttacgcgtatccaacgccgccacatcccgaaatttcaacgaaacgtcttccccgacgacctcccgaataatctataaacgtccgaaaaaaacctccaccgatacacccgacatttcccacatacc

SEQ ID NO: 7623 - DNA, 568 bp, Artificial Sequence
  chemically treated genomic DNA (Homo sapiens) CpG-island No: 7623
gaatcgtgggtttattcgggttttgtttttattatgtttcgaattagtcgttaatttttttaggttttttagtatatgaatttcgttcgttgaattgtttttttattcggtcgagggggataagttgtttacggttgatggttttatcgatatcggcgcgtgttcgtttaattatattatttttcggcgatagtatgtcgatcgttttggttagtacgttcgtgtacgtgaattgtatttttcgtttatttaattcggtaatcgtttgtgttatcgtttgttgtatattcggttcgttttgtgaagtaggttcgggcgttagcgtgcggagattcgtacgttgattcgtcgcgttacgatatgttcggatgtcgaattcggttttttttagcgtttgtatttattcggttattttgattttcggatcgatatgttgtttggatttacgcgtatttagcgtcgttatatttcgggattttagcgaggcgtttttttcgacggtttttcggatagtttgtgagcgttcggaaaaggtttttatcggtatattcggtattttttatatatt

SEQ ID NO: 7624 - DNA, 568 bp, Artificial Sequence
  chemically treated genomic DNA (Homo sapiens) CpG-island No: 7624
aatatataaaaaataccgaatataccgataaaaaccttttccgaacgctcacaaactatccgaaaaaccgtcgaaaaaaacgcctcgctaaaatcccgaaatataacgacgctaaatacgcgtaaatccaaacaacatatcgatccgaaaatcaaaataaccgaataaatacaaacgctaaaaaaaaccgaattcgacatccgaacatatcgtaacgcgacgaatcaacgtacgaatctccgcacgctaacgcccgaacctacttcacaaaacgaaccgaatatacaacaaacgataacacaaacgattaccgaattaaataaacgaaaaatacaattcacgtacacgaacgtactaaccaaaacgatcgacatactatcgccgaaaaataatataattaaacgaacacgcgccgatatcgataaaaccatcaaccgtaaacaacttatccccctcgaccgaataaaaaaacaattcaacgaacgaaattcatatactaaaaaacctaaaaaaattaacgactaattcgaaacataataaaaacaaaacccgaataaacccacgattc

SEQ ID NO: 7625 - DNA, 756 bp, Artificial Sequence
  chemically treated genomic DNA (Homo sapiens) CpG-island No: 7625
aacgtattgatttgtcgttacgttcgtaatttgttgttggcgtagggttggtcggaagagacggatgtcgattagcgtaattcgaagtattcgggttggattagtatttatgttttgttggatgcgtttcggttggcgacgttattcgttaatcgttacggcggcgtattgtcgtcgtatttggttttcgttatttagaaattgatcggaatcggagcggaatttgttttgttcggtagttagtggtagtcgttgtcggtgttttcgttagacggaacgtaggtgtttttttcgtatgtcggtgaatggttgatcgaagacgaaattagggttgtatttgtcgcggtgcgcgatgtcgtacgtagtgttagttgtcgggtggtagaagatatacggcgtattcggacggcgttgattattatcggttagacgttattgattcgttagattcgtcgttttcgtttggtcgtgaaggaaagcgattatttttgttggttcgatgaggacgacgaaaatttgttcgtggtgttcgatgttattttgaatcggggcgtacgtttttcggcggtggaaatgtatttggttagcgattgtattgaatatattttgtttagtgggttggtttgcgatgtgttgcgtatatcggatgaatcgtttcgttttagagtatattaataaagtttgtggtttcggttgaggttgacgttgaattgtgtttttttttcggttgagtttgagtatttgcggtacgtatta

SEQ ID NO: 7626 - DNA, 756 bp, Artificial Sequence
  chemically treated genomic DNA (Homo sapiens) CpG-island No: 7626
taatacgtaccgcaaatactcaaactcaaccgaaaaaaaaacacaattcaacgtcaacctcaaccgaaaccacaaactttattaatatactctaaaacgaaacgattcatccgatatacgcaacacatcgcaaaccaacccactaaacaaaatatattcaatacaatcgctaaccaaatacatttccaccgccgaaaaacgtacgccccgattcaaaataacatcgaacaccacgaacaaattttcgtcgtcctcatcgaaccaacaaaaataatcgctttccttcacgaccaaacgaaaacgacgaatctaacgaatcaataacgtctaaccgataataatcaacgccgtccgaatacgccgtatatcttctaccacccgacaactaacactacgtacgacatcgcgcaccgcgacaaatacaaccctaatttcgtcttcgatcaaccattcaccgacatacgaaaaaaacacctacgttccgtctaacgaaaacaccgacaacgactaccactaactaccgaacaaaacaaattccgctccgattccgatcaatttctaaataacgaaaaccaaatacgacgacaatacgccgccgtaacgattaacgaataacgtcgccaaccgaaacgcatccaacaaaacataaatactaatccaacccgaatacttcgaattacgctaatcgacatccgtctcttccgaccaaccctacgccaacaacaaattacgaacgtaacgacaaatcaatacgtt

SEQ ID NO: 7627 - DNA, 756 bp, Artificial Sequence
  chemically treated genomic DNA (Homo sapiens) CpG-island No: 7627
tggtacgtgtcgtaggtgtttagatttagtcggaagaggggtatagtttagcgttagttttagtcggaattataggttttattgatgtgttttaaggcggggcggtttattcggtatacgtagtatatcgtaggttagtttattagataggatatgtttaatataatcgttgattagatatatttttatcgtcgaaaaacgtgcgtttcggtttaggatggtatcgagtattacgggtaggttttcgtcgtttttatcgagttagtaggggtgatcgtttttttttacgattaggcgaaagcggcgagtttggcgggttagtaacgtttgatcggtggtggttagcgtcgttcggatacgtcgtatattttttgttattcggtaattgatattgcgtacggtatcgcgtatcgcggtaagtatagttttgatttcgttttcggttagttatttatcggtatacggaaaagatatttgcgtttcgtttgacggaagtatcggtagcgattgttattgattgtcggatagaataagtttcgtttcggtttcggttagtttttgaatggcggaggttaggtgcggcggtagtacgtcgtcgtggcggttaacgagtaacgtcgttagtcggggcgtatttagtagaatataaatgttgatttagttcggatatttcgggttacgttggtcgatattcgtttttttcggttagttttgcgttagtagtaggttacgggcgtgacgataaattagtgcgtt

SEQ ID NO: 7628 - DNA, 756 bp, Artificial Sequence
  chemically treated genomic DNA (Homo sapiens) CpG-island No: 7628
aacgcactaatttatcgtcacgcccgtaacctactactaacgcaaaactaaccgaaaaaaacgaatatcgaccaacgtaacccgaaatatccgaactaaatcaacatttatattctactaaatacgccccgactaacgacgttactcgttaaccgccacgacgacgtactaccgccgcacctaacctccgccattcaaaaactaaccgaaaccgaaacgaaacttattctatccgacaatcaataacaatcgctaccgatacttccgtcaaacgaaacgcaaatatcttttccgtataccgataaataactaaccgaaaacgaaatcaaaactatacttaccgcgatacgcgataccgtacgcaatatcaattaccgaataacaaaaaatatacgacgtatccgaacgacgctaaccaccaccgatcaaacgttactaacccgccaaactcgccgctttcgcctaatcgtaaaaaaaaacgatcacccctactaactcgataaaaacgacgaaaacctacccgtaatactcgataccatcctaaaccgaaacgcacgtttttcgacgataaaaatatatctaatcaacgattatattaaacatatcctatctaataaactaacctacgatatactacgtataccgaataaaccgccccgccttaaaacacatcaataaaacctataattccgactaaaactaacgctaaactatacccctcttccgactaaatctaaacacctacgacacgtacca

SEQ ID NO: 7629 - DNA, 1034 bp, Artificial Sequence
  chemically treated genomic DNA (Homo sapiens) CpG-island No: 7629
tgagcgcgacgaagggaagtcgggtcgggtagaaatttatcgttttttaggggttttggaagtttgttcgggaagagtttttgcgtagcgtgttttcgttcgagagtttggagggagaatcggaggggagtgaggggcggtgggatcgcgggggtcggggtcgacgtcggggtagggacgttttgcgcgttggagatttcgagggtcgcgcgtaattggggcggcgcggttcggcgatcgcgggggaggagtcgggcgtcggcgggggtttatttttgtttcgtttggggtttcggcgtttgttttcgggattttcgggatttttgcgtcgtcggtcgcgttttcggattcgtttacgagcgacgatttgagttcggttaggtcgcgttcgggatcggcggcgttgtcgcggtttttgtcgttttgtttttcgtttttattttggaaggttattagttcgttcggcgcgtcgaggtcgtcgtcgtcgttcgcgtcgttttcgtcggagtttagttgcggtatggtgcgtttcgttcgtcggagcgcggggcgttgggcgtcgggagtgcggggcgcggagtcggttcggggggcggcgagttcggagttcgaattttcgagttcggatcgcggcgggcggagcgcgggttgatttcgtttgggcgggttgtaggcgcgggttagggcgcggggtagagcggtttcgcgagttggcgggtcggaatattaaaggcgtcgtcggtcgagtgtcgggggcggggcgggtattgggggcgggtcgggtcgggggcgggatataggttcgtttcgttttttttttttcgggagaggtcgggacgcgtttattcggtatagttttaaagggttcgttttttcggagcgtattttgagagagacgtcggataagtttgggaatgattatttttttttcgaaacgtagagattttaacgggaatttttgatttcgtttatttatttataattagatattttttttgttttttgcgtttaggtttttttttcggttgtggagg

SEQ ID NO: 7630 - DNA, 1034 bp, Artificial Sequence
  chemically treated genomic DNA (Homo sapiens) CpG-island No: 7630
cctccacaaccgaaaaaaaaacctaaacgcaaaaaacaaaaaaaatatctaattataaataaataaacgaaatcaaaaattcccgttaaaatctctacgtttcgaaaaaaaaataatcattcccaaacttatccgacgtctctctcaaaatacgctccgaaaaaacgaaccctttaaaactataccgaataaacgcgtcccgacctctcccgaaaaaaaaaaaacgaaacgaacctatatcccgcccccgacccgacccgcccccaatacccgccccgcccccgacactcgaccgacgacgcctttaatattccgacccgccaactcgcgaaaccgctctaccccgcgccctaacccgcgcctacaacccgcccaaacgaaatcaacccgcgctccgcccgccgcgatccgaactcgaaaattcgaactccgaactcgccgccccccgaaccgactccgcgccccgcactcccgacgcccaacgccccgcgctccgacgaacgaaacgcaccataccgcaactaaactccgacgaaaacgacgcgaacgacgacgacgacctcgacgcgccgaacgaactaataaccttccaaaataaaaacgaaaaacaaaacgacaaaaaccgcgacaacgccgccgatcccgaacgcgacctaaccgaactcaaatcgtcgctcgtaaacgaatccgaaaacgcgaccgacgacgcaaaaatcccgaaaatcccgaaaacaaacgccgaaaccccaaacgaaacaaaaataaacccccgccgacgcccgactcctcccccgcgatcgccgaaccgcgccgccccaattacgcgcgaccctcgaaatctccaacgcgcaaaacgtccctaccccgacgtcgaccccgacccccgcgatcccaccgcccctcactcccctccgattctccctccaaactctcgaacgaaaacacgctacgcaaaaactcttcccgaacaaacttccaaaacccctaaaaaacgataaatttctacccgacccgacttcccttcgtcgcgctca

SEQ ID NO: 7631 - DNA, 1034 bp, Artificial Sequence
  chemically treated genomic DNA (Homo sapiens) CpG-island No: 7631
tttttatagtcggaggagaaatttgggcgtagaaagtagggggaatatttggttgtaggtgagtaagcggggttaggagttttcgttagagtttttgcgtttcgggagaagggtgattatttttaggtttgttcgacgttttttttagggtgcgtttcggaagagcgagttttttaaggttatgtcgagtgggcgcgtttcggtttttttcgggagaggagaggcggggcggatttgtgtttcgttttcggttcggttcgtttttagtgttcgtttcgttttcggtattcggtcggcggcgtttttgatgtttcgattcgttagttcgcggagtcgttttgtttcgcgttttagttcgcgtttgtagttcgtttaggcggagttagttcgcgtttcgttcgtcgcgattcgggttcggaggttcggatttcgggttcgtcgtttttcgggtcggtttcgcgtttcgtattttcggcgtttagcgtttcgcgtttcggcgggcggagcgtattatgtcgtagttggatttcggcgggggcggcgcgggcggcggcgacgatttcggcgcgtcggacgagttggtggttttttaggatgaaggcgaggagtaggacgataagagtcgcgatagcgtcgtcggtttcgagcgcgatttggtcgagtttaagtcgtcgttcgtgaacgagttcgagggcgcggtcggcggcgtagggatttcgggggtttcggggataggcgtcggggttttaggcgagatagaggtgaattttcgtcggcgttcggtttttttttcgcggtcgtcgagtcgcgtcgttttagttgcgcgcggttttcggggtttttagcgcgtagagcgtttttgtttcggcgtcggtttcgattttcgcggttttatcgttttttattttttttcggttttttttttaggttttcgggcgggaatacgttgcgtagagatttttttcggataaatttttagagtttttggaggacggtgagtttttgttcggttcggttttttttcgtcgcgttta

SEQ ID NO: 7632 - DNA, 1034 bp, Artificial Sequence
  chemically treated genomic DNA (Homo sapiens) CpG-island No: 7632
taaacgcgacgaaaaaaaaccgaaccgaacaaaaactcaccgtcctccaaaaactctaaaaatttatccgaaaaaaatctctacgcaacgtattcccgcccgaaaacctaaaaaaaaaaccgaaaaaaaataaaaaacgataaaaccgcgaaaatcgaaaccgacgccgaaacaaaaacgctctacgcgctaaaaaccccgaaaaccgcgcgcaactaaaacgacgcgactcgacgaccgcgaaaaaaaaaccgaacgccgacgaaaattcacctctatctcgcctaaaaccccgacgcctatccccgaaacccccgaaatccctacgccgccgaccgcgccctcgaactcgttcacgaacgacgacttaaactcgaccaaatcgcgctcgaaaccgacgacgctatcgcgactcttatcgtcctactcctcgccttcatcctaaaaaaccaccaactcgtccgacgcgccgaaatcgtcgccgccgcccgcgccgcccccgccgaaatccaactacgacataatacgctccgcccgccgaaacgcgaaacgctaaacgccgaaaatacgaaacgcgaaaccgacccgaaaaacgacgaacccgaaatccgaacctccgaacccgaatcgcgacgaacgaaacgcgaactaactccgcctaaacgaactacaaacgcgaactaaaacgcgaaacaaaacgactccgcgaactaacgaatcgaaacatcaaaaacgccgccgaccgaataccgaaaacgaaacgaacactaaaaacgaaccgaaccgaaaacgaaacacaaatccgccccgcctctcctctcccgaaaaaaaccgaaacgcgcccactcgacataaccttaaaaaactcgctcttccgaaacgcaccctaaaaaaaacgtcgaacaaacctaaaaataatcacccttctcccgaaacgcaaaaactctaacgaaaactcctaaccccgcttactcacctacaaccaaatattccccctactttctacgcccaaatttctcctccgactataaaaa

SEQ ID NO: 7633 - DNA, 708 bp, Artificial Sequence
  chemically treated genomic DNA (Homo sapiens) CpG-island No: 7633
cgttcggcggtcgtggtttagttttaagttatatcggtcgcgttttttagggcgcgcgggcgtcgcgtagcgagcggtcgtggggtagcgcggcgaaggtcgaatggcgtagttggtaatcgatgaagaggacgacgagcgttatcgagagtagtagtaggaagaagagtagtaggtaggtgggtaggtcgggttttgtggtcgcgtcgttttttatatcgcgcgtagtggttagttttagcggtaaagcgttttttgttttgatcgtggtttttggggttagcgcgttgtttatcgtcgtttcggggtcgttcgtggcgttgaatatgtcgtcgtatatggttcgcgggtttcgtcgattttagtcggatcgttttatttggtttggagtatattggcgcgattcggcgtttttatggcgcgtttttttcgttttgtcgcgtttaattgatcgagagtcggtgttttggggtcggcggggattgtaaagatttcgggacgcgttcgtttattcgttttcgcgtttagttgtttttttcgtcggttggcggattttagttttcggagttggatagttttgtgttcgcgtttttcgggtttattgttttttttcgtcgttattaggatagaggttttagttattgattcgtttttcggttttataatagttcgtttagttcggatttttagttttagtgagttttaggt

SEQ ID NO: 7634 - DNA, 708 bp, Artificial Sequence
  chemically treated genomic DNA (Homo sapiens) CpG-island No: 7634
acctaaaactcactaaaactaaaaatccgaactaaacgaactattataaaaccgaaaaacgaatcaataactaaaacctctatcctaataacgacgaaaaaaaacaataaacccgaaaaacgcgaacacaaaactatccaactccgaaaactaaaatccgccaaccgacgaaaaaaacaactaaacgcgaaaacgaataaacgaacgcgtcccgaaatctttacaatccccgccgaccccaaaacaccgactctcgatcaattaaacgcgacaaaacgaaaaaaacgcgccataaaaacgccgaatcgcgccaatatactccaaaccaaataaaacgatccgactaaaatcgacgaaacccgcgaaccatatacgacgacatattcaacgccacgaacgaccccgaaacgacgataaacaacgcgctaaccccaaaaaccacgatcaaaacaaaaaacgctttaccgctaaaactaaccactacgcgcgatataaaaaacgacgcgaccacaaaacccgacctacccacctacctactactcttcttcctactactactctcgataacgctcgtcgtcctcttcatcgattaccaactacgccattcgaccttcgccgcgctaccccacgaccgctcgctacgcgacgcccgcgcgccctaaaaaacgcgaccgatataacttaaaactaaaccacgaccgccgaacg

SEQ ID NO: 7635 - DNA, 708 bp, Artificial Sequence
  chemically treated genomic DNA (Homo sapiens) CpG-island No: 7635
atttggagtttattggagttgagggttcgagttgagcgggttgttgtaaagtcgaaaggcgagttagtgattgggatttttgttttggtggcgacggagagaaatagtgagttcgaggggcgcgggtatagaattgtttagtttcgagaattggggttcgttagtcggcggggaaagtagttgagcgcggaggcgagtgagcggacgcgtttcggggtttttgtagttttcgtcggttttaaggtatcgattttcggttagttgggcgcggtagggcgggaggggcgcgttatggaggcgtcgggtcgcgttagtatgttttaggttaagtgaagcggttcggttggggtcggcgggattcgcgggttatgtacggcgatatatttaacgttacgggcggtttcgaggcggcggtaggtagcgcgttggttttaggagttacggttaaggtagaaggcgttttgtcgttggagttggttattgcgcgcggtatgagggacggcgcggttataaagttcgatttgtttatttatttgttgtttttttttttgttgttgttttcggtggcgttcgtcgttttttttatcggttgttagttgcgttattcggttttcgtcgcgttgttttacgatcgttcgttgcgcgacgttcgcgcgttttggaagacgcggtcggtgtagtttgggattgagttacggtcgtcgggcg

SEQ ID NO: 7636 - DNA, 708 bp, Artificial Sequence
  chemically treated genomic DNA (Homo sapiens) CpG-island No: 7636
cgcccgacgaccgtaactcaatcccaaactacaccgaccgcgtcttccaaaacgcgcgaacgtcgcgcaacgaacgatcgtaaaacaacgcgacgaaaaccgaataacgcaactaacaaccgataaaaaaaacgacgaacgccaccgaaaacaacaacaaaaaaaaaaacaacaaataaataaacaaatcgaactttataaccgcgccgtccctcataccgcgcgcaataaccaactccaacgacaaaacgccttctaccttaaccgtaactcctaaaaccaacgcgctacctaccgccgcctcgaaaccgcccgtaacgttaaatatatcgccgtacataacccgcgaatcccgccgaccccaaccgaaccgcttcacttaacctaaaacatactaacgcgacccgacgcctccataacgcgcccctcccgccctaccgcgcccaactaaccgaaaatcgataccttaaaaccgacgaaaactacaaaaaccccgaaacgcgtccgctcactcgcctccgcgctcaactactttccccgccgactaacgaaccccaattctcgaaactaaacaattctatacccgcgcccctcgaactcactatttctctccgtcgccaccaaaacaaaaatcccaatcactaactcgcctttcgactttacaacaacccgctcaactcgaaccctcaactccaataaactccaaat

SEQ ID NO: 7637 - DNA, 588 bp, Artificial Sequence
  chemically treated genomic DNA (Homo sapiens) CpG-island No: 7637
tttcgggtagttagcgaggttttcgtagtcgttgggtcgtatcgtgttcgttagtcgggatttcggtaggttaggattcggtttatttttcgttcgataggttttgggtcgttttcgtttcgttcgcggtcgaacgttttcgtttcggttcgagttcgtcggggtagagtttgtagtttttagtttttttcgttcgcgcgcgtcggggatttttatttattcgcgagtcggttaggcgcgttttttcgacgtcgtcgttgcgttttttttcgttgtaattttattagtagttcggtcgcgggatacgcgtacggcgttcgttcgtttaggattcggatgagggagggagggagagggagttcgggaggacgttcgttggggtcggcgtatgcgcgttagaggcggagtgatcgttgcgggatcgagggaggggtgttttgttcgggcggttgaaagaagttttcgcgtcgggtttcgcgtcggttaacgtcgattttcgattagttggaggttttcgcgtcgatggttaggtttgggaatgggaattagatagtttttattattattatagtaggcgttagaagtttt

SEQ ID NO: 7638 - DNA, 588 bp, Artificial Sequence
  chemically treated genomic DNA (Homo sapiens) CpG-island No: 7638
aaaacttctaacgcctactataataataataaaaactatctaattcccattcccaaacctaaccatcgacgcgaaaacctccaactaatcgaaaatcgacgttaaccgacgcgaaacccgacgcgaaaacttctttcaaccgcccgaacaaaacacccctccctcgatcccgcaacgatcactccgcctctaacgcgcatacgccgaccccaacgaacgtcctcccgaactccctctccctccctccctcatccgaatcctaaacgaacgaacgccgtacgcgtatcccgcgaccgaactactaataaaattacaacgaaaaaaaacgcaacgacgacgtcgaaaaaacgcgcctaaccgactcgcgaataaataaaaatccccgacgcgcgcgaacgaaaaaaactaaaaactacaaactctaccccgacgaactcgaaccgaaacgaaaacgttcgaccgcgaacgaaacgaaaacgacccaaaacctatcgaacgaaaaataaaccgaatcctaacctaccgaaatcccgactaacgaacacgatacgacccaacgactacgaaaacctcgctaactacccgaaa

SEQ ID NO: 7639 - DNA, 588 bp, Artificial Sequence
  chemically treated genomic DNA (Homo sapiens) CpG-island No: 7639
gaagtttttagcgtttattgtggtggtggtgggagttatttgatttttatttttaggtttggttatcgacgcgaaggtttttagttgatcggaagtcggcgttggtcggcgcggagttcggcgcggaggttttttttagtcgttcgggtaagatatttttttttcggtttcgtagcggttatttcgtttttggcgcgtatgcgtcgattttagcgggcgttttttcgggtttttttttttttttttttttattcgggttttgggcgagcgggcgtcgtgcgcgtgtttcgcggtcgagttgttaataaagttgtagcgaggagaagcgtagcgacggcgtcgggagagcgcgtttagtcggttcgcgagtgagtgagggttttcggcgcgcgcgggcgaggggaattgggggttgtaggttttgtttcggcggattcgggtcgaggcgggggcgttcggtcgcggacggagcggaaacgatttagggtttgtcgggcgggaggtaggtcgagttttggtttgtcggggtttcggttggcggatacggtgcggtttagcggttgcggaggtttcgttggttgttcgggg

SEQ ID NO: 7640 - DNA, 588 bp, Artificial Sequence
  chemically treated genomic DNA (Homo sapiens) CpG-island No: 7640
ccccgaacaaccaacgaaacctccgcaaccgctaaaccgcaccgtatccgccaaccgaaaccccgacaaaccaaaactcgacctacctcccgcccgacaaaccctaaatcgtttccgctccgtccgcgaccgaacgcccccgcctcgacccgaatccgccgaaacaaaacctacaacccccaattcccctcgcccgcgcgcgccgaaaaccctcactcactcgcgaaccgactaaacgcgctctcccgacgccgtcgctacgcttctcctcgctacaactttattaacaactcgaccgcgaaacacgcgcacgacgcccgctcgcccaaaacccgaataaaaaaaaaaaaaaaaaaaaacccgaaaaaacgcccgctaaaatcgacgcatacgcgccaaaaacgaaataaccgctacgaaaccgaaaaaaaaatatcttacccgaacgactaaaaaaaacctccgcgccgaactccgcgccgaccaacgccgacttccgatcaactaaaaaccttcgcgtcgataaccaaacctaaaaataaaaatcaaataactcccaccaccaccacaataaacgctaaaaacttc

SEQ ID NO: 7641 - DNA, 902 bp, Artificial Sequence
  chemically treated genomic DNA (Homo sapiens) CpG-island No: 7641
gtttacgcgtgggttgatattcggttttcggtacggcgtgtggatgcgcgggacgaatatagcgggttatttataggtttttggcggttgcgcgtacgtagatttgcgaaagttgtcgggcgtcggtagtttcgttcgggtgggcggtttacgtcgcgtttcgtttttttcgcgtcgcggttcgcggttcgtagttttttcggcgtttttcggagttcgcgcggaggttcgggtaacgtcgcgcgtcggcgagtttttagtttggagttttcgattttttattttttggtgtttcgcgcgttttttattcgacgtcgtcggtgtttcgcgttttaaaggcgtatttatttttgttgtaggagcgattcggcggtcgcgcgcgagggtttcggcgacgtaggggttgtagtgagggcgcgcggagcgcgatttcgagtggaagagggaagaaggtagaggttgtcgggtttttaaggtcgtcgggtacggtcggcgtggattgggtacggtttcgggtggtttcggttcggcggggttcgggcgtacgttttgtttcgattaaggagtggcgagttttgttagggtagcggcgttatcgagtaatttaaatatttagcgggattttttagttttggtcggtttcgttttcggatagtcgcgcgggcgtttattggtcggttgcgtgtcgttatttcggggaaattaggttgttgtagagttagcggcgaaggggaagtatagggcggttgtttcgttttatttttttcggtcgggcgttatcgtttcggggttatcgcgggttcgtttcgagcgtttttaatttatttttgtttcggtttgttcggaggagggttgttcgggatagtttagcgttttcggttttagtttgtttttttatttcg

SEQ ID NO: 7642 - DNA, 902 bp, Artificial Sequence
  chemically treated genomic DNA (Homo sapiens) CpG-island No: 7642
cgaaataaaaaaacaaactaaaaccgaaaacgctaaactatcccgaacaaccctcctccgaacaaaccgaaacaaaaataaattaaaaacgctcgaaacgaacccgcgataaccccgaaacgataacgcccgaccgaaaaaaataaaacgaaacaaccgccctatacttccccttcgccgctaactctacaacaacctaatttccccgaaataacgacacgcaaccgaccaataaacgcccgcgcgactatccgaaaacgaaaccgaccaaaactaaaaaatcccgctaaatatttaaattactcgataacgccgctaccctaacaaaactcgccactccttaatcgaaacaaaacgtacgcccgaaccccgccgaaccgaaaccacccgaaaccgtacccaatccacgccgaccgtacccgacgaccttaaaaacccgacaacctctaccttcttccctcttccactcgaaatcgcgctccgcgcgccctcactacaacccctacgtcgccgaaaccctcgcgcgcgaccgccgaatcgctcctacaacaaaaataaatacgcctttaaaacgcgaaacaccgacgacgtcgaataaaaaacgcgcgaaacaccaaaaaataaaaaatcgaaaactccaaactaaaaactcgccgacgcgcgacgttacccgaacctccgcgcgaactccgaaaaacgccgaaaaaactacgaaccgcgaaccgcgacgcgaaaaaaacgaaacgcgacgtaaaccgcccacccgaacgaaactaccgacgcccgacaactttcgcaaatctacgtacgcgcaaccgccaaaaacctataaataacccgctatattcgtcccgcgcatccacacgccgtaccgaaaaccgaatatcaacccacgcgtaaac

SEQ ID NO: 7643 - DNA, 902 bp, Artificial Sequence
  chemically treated genomic DNA (Homo sapiens) CpG-island No: 7643
cggagtgagaggataggttggggtcgggggcgttgggttgtttcgggtagttttttttcgggtaagtcggagtaggggtggattgggagcgttcggggcgggttcgcggtggtttcggggcggtggcgttcggtcggagagggtggggcggagtagtcgttttgtatttttttttcgtcgttagttttataatagtttgattttttcgaaatgacggtacgtagtcggttaatgggcgttcgcgcggttgttcgggggcggggtcggttagggttggggaatttcgttaagtgtttggattgttcggtggcgtcgttgttttggtagagttcgttattttttagtcgaggtaagacgtgcgttcgagtttcgtcgaatcgaggttattcggagtcgtgtttagtttacgtcggtcgtgttcggcggttttaagaattcggtaatttttgttttttttttttttttattcggagtcgcgtttcgcgcgtttttattgtagtttttgcgtcgtcgggattttcgcgcgcgatcgtcgaatcgtttttgtagtagaggtgagtacgtttttgaggcgcggggtatcggcggcgtcgaataaaaggcgcgcggggtattaggaagtggggggtcgaaagttttaggttggagattcgtcggcgcgcggcgttgttcgggttttcgcgcgggtttcggggggcgtcggaggagttgcgagtcgcgggtcgcggcgcggggagggcgggacgcggcgtggatcgtttattcggacgaggttgtcggcgttcggtagttttcgtagatttgcgtgcgcgtagtcgttaggggtttgtaggtggttcgttatgttcgtttcgcgtatttatacgtcgtgtcggggatcgagtgttagtttacgcgtgggt

SEQ ID NO: 7644 - DNA, 902 bp, Artificial Sequence
  chemically treated genomic DNA (Homo sapiens) CpG-island No: 7644
acccacgcgtaaactaacactcgatccccgacacgacgtataaatacgcgaaacgaacataacgaaccacctacaaacccctaacgactacgcgcacgcaaatctacgaaaactaccgaacgccgacaacctcgtccgaataaacgatccacgccgcgtcccgccctccccgcgccgcgacccgcgactcgcaactcctccgacgccccccgaaacccgcgcgaaaacccgaacaacgccgcgcgccgacgaatctccaacctaaaactttcgaccccccacttcctaataccccgcgcgccttttattcgacgccgccgataccccgcgcctcaaaaacgtactcacctctactacaaaaacgattcgacgatcgcgcgcgaaaatcccgacgacgcaaaaactacaataaaaacgcgcgaaacgcgactccgaataaaaaaaaaaaaaaaacaaaaattaccgaattcttaaaaccgccgaacacgaccgacgtaaactaaacacgactccgaataacctcgattcgacgaaactcgaacgcacgtcttacctcgactaaaaaataacgaactctaccaaaacaacgacgccaccgaacaatccaaacacttaacgaaattccccaaccctaaccgaccccgcccccgaacaaccgcgcgaacgcccattaaccgactacgtaccgtcatttcgaaaaaatcaaactattataaaactaacgacgaaaaaaaaatacaaaacgactactccgccccaccctctccgaccgaacgccaccgccccgaaaccaccgcgaacccgccccgaacgctcccaatccacccctactccgacttacccgaaaaaaaactacccgaaacaacccaacgcccccgaccccaacctatcctctcactccg

SEQ ID NO: 7645 - DNA, 716 bp, Artificial Sequence
  chemically treated genomic DNA (Homo sapiens) CpG-island No: 7645
cgtggcgtttaggtacggaattttagagggtttcgtttattattatagggtttcgtttcgtcgtttcgtcgttttttaattattaggttcggtagtcggcggcgtcgtttggtagttttttttttttttcgtttcgttggtcgcgggcgcgggggacgttagcgttgttagcgtggaaagagttgcggggcgcgggaggaggaagtagagttcgggatcgtcgggttattatcggtcgttttagttatggacgcgtttttggagaaggtgcgtgtcgggagggggcgatggggacggtgttgcggttcggggttttcgttttcgaggtaattattttttagtcgcgagttgttattgtgattcggatagggggacgcgggttgataggtttcgtttgaggaggtttcgtcgggagggcggttggggttcgggcgcgttacggggtcgggtgttttttgggttttcgtgggtcgaagaggttgggcggggtttcgtgggggtcgcgaggggttcggagtttaggattgggatcgcggggtcgattttgggttttgtcgaggtttcgcgagtggtcggtttgagttcggttggttttttcggaggatcgggagtttttcgttggcggttttagatgttttcggaaagaagtcgtagttattttagagttagttgtaaatttgtgggttttttttggttttcgagttaggaatgaaaat

SEQ ID NO: 7646 - DNA, 716 bp, Artificial Sequence
  chemically treated genomic DNA (Homo sapiens) CpG-island No: 7646
attttcattcctaactcgaaaaccaaaaaaaacccacaaatttacaactaactctaaaataactacgacttctttccgaaaacatctaaaaccgccaacgaaaaactcccgatcctccgaaaaaaccaaccgaactcaaaccgaccactcgcgaaacctcgacaaaacccaaaatcgaccccgcgatcccaatcctaaactccgaacccctcgcgacccccacgaaaccccgcccaacctcttcgacccacgaaaacccaaaaaacacccgaccccgtaacgcgcccgaaccccaaccgccctcccgacgaaacctcctcaaacgaaacctatcaacccgcgtccccctatccgaatcacaataacaactcgcgactaaaaaataattacctcgaaaacgaaaaccccgaaccgcaacaccgtccccatcgccccctcccgacacgcaccttctccaaaaacgcgtccataactaaaacgaccgataataacccgacgatcccgaactctacttcctcctcccgcgccccgcaactctttccacgctaacaacgctaacgtcccccgcgcccgcgaccaacgaaacgaaaaaaaaaaaaaactaccaaacgacgccgccgactaccgaacctaataattaaaaaacgacgaaacgacgaaacgaaaccctataataataaacgaaaccctctaaaattccgtacctaaacgccacg

SEQ ID NO: 7647 - DNA, 716 bp, Artificial Sequence
  chemically treated genomic DNA (Homo sapiens) CpG-island No: 7647
atttttatttttaattcggagattaagaaaaatttataggtttgtagttggttttgaaataattgcggttttttttcgggagtatttggggtcgttaacggagagttttcggtttttcgaaagggttagtcgagtttaggtcggttattcgcggaatttcggtagggtttaaggtcggtttcgcggttttagttttgggtttcgggtttttcgcggtttttacggaatttcgtttagttttttcggtttacggggatttaagagatattcggtttcgtgacgcgttcgggttttagtcgttttttcggcgaggtttttttaggcgaggtttgttagttcgcgtttttttgttcgggttataatggtagttcgcgattgggaaatagttgtttcggaagcgggagtttcgggtcgtagtatcgtttttatcgttttttttcggtacgtattttttttagggacgcgtttatggttgaggcggtcggtggtggttcggcggtttcgggttttatttttttttttcgcgtttcgtagttttttttacgttggtagcgttgacgtttttcgcgttcgcggttagcggggcggagaagaggaggagttgttaggcggcgtcgtcggttgtcgaatttgatggttgaggggcggcggggcggcggggcggggttttgtaatggtgggcggagttttttgggatttcgtatttgggcgttacg

SEQ ID NO: 7648 - DNA, 716 bp, Artificial Sequence
  chemically treated genomic DNA (Homo sapiens) CpG-island No: 7648
cgtaacgcccaaatacgaaatcccaaaaaactccgcccaccattacaaaaccccgccccgccgccccgccgcccctcaaccatcaaattcgacaaccgacgacgccgcctaacaactcctcctcttctccgccccgctaaccgcgaacgcgaaaaacgtcaacgctaccaacgtaaaaaaaactacgaaacgcgaaaaaaaaaaataaaacccgaaaccgccgaaccaccaccgaccgcctcaaccataaacgcgtccctaaaaaaaatacgtaccgaaaaaaaacgataaaaacgatactacgacccgaaactcccgcttccgaaacaactatttcccaatcgcgaactaccattataacccgaacaaaaaaacgcgaactaacaaacctcgcctaaaaaaacctcgccgaaaaaacgactaaaacccgaacgcgtcacgaaaccgaatatctcttaaatccccgtaaaccgaaaaaactaaacgaaattccgtaaaaaccgcgaaaaacccgaaacccaaaactaaaaccgcgaaaccgaccttaaaccctaccgaaattccgcgaataaccgacctaaactcgactaaccctttcgaaaaaccgaaaactctccgttaacgaccccaaatactcccgaaaaaaaaccgcaattatttcaaaaccaactacaaacctataaatttttcttaatctccgaattaaaaataaaaat

SEQ ID NO: 7649 - DNA, 789 bp, Artificial Sequence
  chemically treated genomic DNA (Homo sapiens) CpG-island No: 7649
atttcggtcgttttggtatcggggttgaagtgtaggtttttggaggagcggtgcgtacgtttaggggtagtcgagaatataagttaaggtacgagcggataattttacggggacgagtattggcgttcggacgcgatttcgcgagaggttaggcggaatttattggaagcgtgagttagcggggattattttcgggcgaaattaaaggagaaagaggggaatttaggggtttcggggcgtttaggttcgcgcggacggggaggttagagttgtttcgaagttatttttttattttatcggtttttacgggtttcgcgtttagttatagttcggcgggagtaatgcggtagttataatagttgtttggggtcgtcgcgggtcggaaagcggggttcggggatgggaagggggcggggcgaagcgagtaaaaagtttcggggaagtcgagatcgcgatttttcgcgttttacggttttcgggtaagggtattgtcggcgcgtgattttagtagcgtacgagcgcgtcgtgacgttttcgcggagtttcgtttttgttacgtgggtttgtttgggtttcgcgaggtatcgttttcgcggtttttttgttatttttagaggcgagttgtggaagttttgatttttagggtcgttttagaatcggggtttcggatcggcggggtttttgtacgtggaatcggaatatttgagatgatcgtaggttttgtggagtgtggggagcgcgggagtttttttttttttcgaggttcgtgttagggtttattttaaagtt

SEQ ID NO: 7650 - DNA, 789 bp, Artificial Sequence
  chemically treated genomic DNA (Homo sapiens) CpG-island No: 7650
aactttaaaataaaccctaacacgaacctcgaaaaaaaaaaaaactcccgcgctccccacactccacaaaacctacgatcatctcaaatattccgattccacgtacaaaaaccccgccgatccgaaaccccgattctaaaacgaccctaaaaatcaaaacttccacaactcgcctctaaaaataacaaaaaaaccgcgaaaacgatacctcgcgaaacccaaacaaacccacgtaacaaaaacgaaactccgcgaaaacgtcacgacgcgctcgtacgctactaaaatcacgcgccgacaatacccttacccgaaaaccgtaaaacgcgaaaaatcgcgatctcgacttccccgaaactttttactcgcttcgccccgcccccttcccatccccgaaccccgctttccgacccgcgacgaccccaaacaactattataactaccgcattactcccgccgaactataactaaacgcgaaacccgtaaaaaccgataaaataaaaaaataacttcgaaacaactctaacctccccgtccgcgcgaacctaaacgccccgaaacccctaaattcccctctttctcctttaatttcgcccgaaaataatccccgctaactcacgcttccaataaattccgcctaacctctcgcgaaatcgcgtccgaacgccaatactcgtccccgtaaaattatccgctcgtaccttaacttatattctcgactacccctaaacgtacgcaccgctcctccaaaaacctacacttcaaccccgataccaaaacgaccgaaat

SEQ ID NO: 7651 - DNA, 789 bp, Artificial Sequence
  chemically treated genomic DNA (Homo sapiens) CpG-island No: 7651
ggttttggagtaagttttggtacgggtttcgagggaagaaagaattttcgcgttttttatattttatagggtttgcgattattttagatgtttcggttttacgtgtagaaatttcgtcggttcgaggtttcggttttaaaacggttttaagagttaaggtttttatagttcgtttttgagggtggtaaagaggtcgcgggggcggtgtttcgcgagatttaaataagtttacgtggtaggggcggggtttcgcgaaggcgttacggcgcgttcgtgcgttgttgaggttacgcgtcggtagtatttttgttcgggggtcgtaaagcgcggaaggtcgcggtttcggttttttcggaattttttgttcgtttcgtttcgttttttttttattttcgaatttcgtttttcggttcgcggcgattttaggtaattgttgtggttgtcgtattgttttcgtcgggttgtagttgagcgcggagttcgtggggatcggtgaggtaaggagatagtttcggggtaattttggttttttcgttcgcgcgggtttaagcgtttcgggatttttgggttttttttttttttttttggtttcgttcgggggtggttttcgttagtttacgtttttagtgggtttcgtttggtttttcgcgaagtcgcgttcgggcgttagtattcgttttcgtaaggttgttcgttcgtgttttggtttgtgttttcggttatttttgggcgtgcgtatcgtttttttaggagtttgtattttagtttcgatgttagggcggtcggggt

SEQ ID NO: 7652 - DNA, 789 bp, Artificial Sequence
  chemically treated genomic DNA (Homo sapiens) CpG-island No: 7652
accccgaccgccctaacatcgaaactaaaatacaaactcctaaaaaaacgatacgcacgcccaaaaataaccgaaaacacaaaccaaaacacgaacgaacaaccttacgaaaacgaatactaacgcccgaacgcgacttcgcgaaaaaccaaacgaaacccactaaaaacgtaaactaacgaaaaccacccccgaacgaaaccaaaaaaaaaaaaaaaaaacccaaaaatcccgaaacgcttaaacccgcgcgaacgaaaaaaccaaaattaccccgaaactatctccttacctcaccgatccccacgaactccgcgctcaactacaacccgacgaaaacaatacgacaaccacaacaattacctaaaatcgccgcgaaccgaaaaacgaaattcgaaaataaaaaaaaaacgaaacgaaacgaacaaaaaattccgaaaaaaccgaaaccgcgaccttccgcgctttacgacccccgaacaaaaatactaccgacgcgtaacctcaacaacgcacgaacgcgccgtaacgccttcgcgaaaccccgcccctaccacgtaaacttatttaaatctcgcgaaacaccgcccccgcgacctctttaccaccctcaaaaacgaactataaaaaccttaactcttaaaaccgttttaaaaccgaaacctcgaaccgacgaaatttctacacgtaaaaccgaaacatctaaaataatcgcaaaccctataaaatataaaaaacgcgaaaattctttcttccctcgaaacccgtaccaaaacttactccaaaacc

SEQ ID NO: 7653 - DNA, 747 bp, Artificial Sequence
  chemically treated genomic DNA (Homo sapiens) CpG-island No: 7653
agttttcgtagtcgttttttacgttttttttttaatttattagcggttttacgttttttttttcggtgttcgttttttttcgtttcggttttacgtgcgcgcgcgtttttaggttttgtttcggaagtgtttttggcgtatagtcggaagtgcgtaggtagtgttcgcggcggcggcgacggcggcgggaggttcggttgtcgttcgttggtcgcgcggcgtcgcgttcggcggtcgttattgtaggttaggtcgcgggcggggggtacgggaggttgcggggagcgagggtcgagtcgggattgggggcgagggcgcgagggagcgggaagttagggagtcggggtcgggcggggcgcgcggttcggagagaagaatggcgagtcgaggggcggggagcgcgggcgggggaggggtggtcgggaagggggagggcggcgggagggcggcgcggaggtgggggtaagttcggaggggttttcggggtgggagggttaggagtgtgggggaagggagcggtgtggagacggaaggcggagggaaggaagggagcgagcggggcggagcgggagaagggcggaaagggtggtcgagcgcgggcggaggacggagaagggggcggcgagggtcggaatttcgaggtacgtgcgggaaggggtttttttcggggttgggagggagtttagttcgttatgtttgcgggagcggagtagaattggaatttaggaagtagcgggaagagtagaa

SEQ ID NO: 7654 - DNA, 747 bp, Artificial Sequence
  chemically treated genomic DNA (Homo sapiens) CpG-island No: 7654
ttctactcttcccgctacttcctaaattccaattctactccgctcccgcaaacataacgaactaaactccctcccaaccccgaaaaaaaccccttcccgcacgtacctcgaaattccgaccctcgccgcccccttctccgtcctccgcccgcgctcgaccaccctttccgcccttctcccgctccgccccgctcgctcccttccttccctccgccttccgtctccacaccgctcccttcccccacactcctaaccctcccaccccgaaaacccctccgaacttacccccacctccgcgccgccctcccgccgccctcccccttcccgaccacccctcccccgcccgcgctccccgcccctcgactcgccattcttctctccgaaccgcgcgccccgcccgaccccgactccctaacttcccgctccctcgcgccctcgcccccaatcccgactcgaccctcgctccccgcaacctcccgtaccccccgcccgcgacctaacctacaataacgaccgccgaacgcgacgccgcgcgaccaacgaacgacaaccgaacctcccgccgccgtcgccgccgccgcgaacactacctacgcacttccgactatacgccaaaaacacttccgaaacaaaacctaaaaacgcgcgcgcacgtaaaaccgaaacgaaaaaaaacgaacaccgaaaaaaaaaacgtaaaaccgctaataaattaaaaaaaaaacgtaaaaaacgactacgaaaact

SEQ ID NO: 7655 - DNA, 747 bp, Artificial Sequence
  chemically treated genomic DNA (Homo sapiens) CpG-island No: 7655
ttttgtttttttcgttattttttaggttttagttttatttcgttttcgtaagtatagcgggttgggtttttttttaatttcgggaagagttttttttcgtacgtatttcgagatttcggttttcgtcgttttttttttcgtttttcgttcgcgttcggttatttttttcgtttttttttcgtttcgtttcgttcgttttttttttttttttcgtttttcgtttttatatcgttttttttttttatatttttggtttttttatttcggaggttttttcgggtttgtttttattttcgcgtcgttttttcgtcgtttttttttttttcggttatttttttttcgttcgcgtttttcgtttttcggttcgttattttttttttcgagtcgcgcgtttcgttcggtttcggttttttagtttttcgttttttcgcgttttcgtttttaatttcggttcggttttcgtttttcgtagtttttcgtgtttttcgttcgcggtttgatttgtaatggcggtcgtcgagcgcggcgtcgcgcggttaacgggcgataatcgaatttttcgtcgtcgtcgtcgtcgtcgcgagtattgtttgcgtattttcgattatgcgttaggagtattttcggggtagagtttgagagcgcgcgcgtacgtggggtcggggcggagagaggcgagtatcgggaaggggagcgtggggtcgttggtgagttggggaaggggcgtgggaagcggttgcgagagtt

SEQ ID NO: 7656 - DNA, 747 bp, Artificial Sequence
  chemically treated genomic DNA (Homo sapiens) CpG-island No: 7656
aactctcgcaaccgcttcccacgccccttccccaactcaccaacgaccccacgctccccttcccgatactcgcctctctccgccccgaccccacgtacgcgcgcgctctcaaactctaccccgaaaatactcctaacgcataatcgaaaatacgcaaacaatactcgcgacgacgacgacgacgacgaaaaattcgattatcgcccgttaaccgcgcgacgccgcgctcgacgaccgccattacaaatcaaaccgcgaacgaaaaacacgaaaaactacgaaaaacgaaaaccgaaccgaaattaaaaacgaaaacgcgaaaaaacgaaaaactaaaaaaccgaaaccgaacgaaacgcgcgactcgaaaaaaaaaataacgaaccgaaaaacgaaaaacgcgaacgaaaaaaaaataaccgaaaaaaaaaaaaacgacgaaaaaacgacgcgaaaataaaaacaaacccgaaaaaacctccgaaataaaaaaaccaaaaatataaaaaaaaaaaacgatataaaaacgaaaaacgaaaaaaaaaaaaaaaacgaacgaaacgaaacgaaaaaaaaacgaaaaaaataaccgaacgcgaacgaaaaacgaaaaaaaaaacgacgaaaaccgaaatctcgaaatacgtacgaaaaaaaactcttcccgaaattaaaaaaaaacccaacccgctatacttacgaaaacgaaataaaactaaaacctaaaaaataacgaaaaaaacaaaa

SEQ ID NO: 7657 - DNA, 569 bp, Artificial Sequence
  chemically treated genomic DNA (Homo sapiens) CpG-island No: 7657
ttcgcgtcggacgcggcgttcgtagggttgggagttggtcgggtgcggggggttcggcgagaggtatttttgttattcggcgcgtttcggtttcggcgtagtttcgcgcggttttttttttttgggtgtcggtcggttcgcgtttatcgtgtcgtcggttgtcgcgtttcggagtttagtaggttcgcggcggttttatgttttttttttcgtttcgtttcgcgtcgtcgcgcgtttcgattgtcgtttgtttagtcgagtcgtttttaagtattcggcgcgtgttcgttaggagaggcgtttttttcggttttggggtcgggaaagttgattagagtgggagggttttcgcgggcgtattttcgatttcgcgcggtttttagggagcgttataagttagcgttcggcggggacgtttagtttcgggtggacgcggtttcggttcgtaagattcgtagtttttgcgtttttttcgaagttgggtttttcgagtggggtcgaaggttacgcggttttgtaatcgttttgggattagttgttaaggtaagacggttattgggtttaattta

SEQ ID NO: 7658 - DNA, 569 bp, Artificial Sequence
  chemically treated genomic DNA (Homo sapiens) CpG-island No: 7658
taaattaaacccaataaccgtcttaccttaacaactaatcccaaaacgattacaaaaccgcgtaaccttcgaccccactcgaaaaacccaacttcgaaaaaaacgcaaaaactacgaatcttacgaaccgaaaccgcgtccacccgaaactaaacgtccccgccgaacgctaacttataacgctccctaaaaaccgcgcgaaatcgaaaatacgcccgcgaaaaccctcccactctaatcaactttcccgaccccaaaaccgaaaaaaacgcctctcctaacgaacacgcgccgaatacttaaaaacgactcgactaaacaaacgacaatcgaaacgcgcgacgacgcgaaacgaaacgaaaaaaaaaacataaaaccgccgcgaacctactaaactccgaaacgcgacaaccgacgacacgataaacgcgaaccgaccgacacccaaaaaaaaaaaaccgcgcgaaactacgccgaaaccgaaacgcgccgaataacaaaaatacctctcgccgaaccccccgcacccgaccaactcccaaccctacgaacgccgcgtccgacgcgaa

SEQ ID NO: 7659 - DNA, 569 bp, Artificial Sequence
  chemically treated genomic DNA (Homo sapiens) CpG-island No: 7659
taggttgagtttaatgatcgttttgttttggtagttggttttagggcgattgtagagtcgcgtggttttcggttttattcgggggatttagtttcggagagggcgtaggggttgcgagttttgcgagtcggagtcgcgtttattcgggattaggcgttttcgtcgagcgttggtttgtggcgttttttggggatcgcgcggggtcgggggtgcgttcgcgggggtttttttattttggttaattttttcggttttagggtcgggggaggcgttttttttggcgggtacgcgtcgggtatttaagggcggttcggttgggtaggcggtagtcggagcgcgcggcggcgcggagcggagcgggaggaggggtatggagtcgtcgcgggtttgttgagtttcggagcgcggtagtcggcggtacggtgagcgcgggtcggtcggtatttaggaggggagggtcgcgcggggttgcgtcgaggtcggggcgcgtcgggtggtaggggtgtttttcgtcgagtttttcgtattcggttagtttttagttttgcgggcgtcgcgttcggcgcggg

SEQ ID NO: 7660 - DNA, 569 bp, Artificial Sequence
  chemically treated genomic DNA (Homo sapiens) CpG-island No: 7660
cccgcgccgaacgcgacgcccgcaaaactaaaaactaaccgaatacgaaaaactcgacgaaaaacacccctaccacccgacgcgccccgacctcgacgcaaccccgcgcgaccctcccctcctaaataccgaccgacccgcgctcaccgtaccgccgactaccgcgctccgaaactcaacaaacccgcgacgactccatacccctcctcccgctccgctccgcgccgccgcgcgctccgactaccgcctacccaaccgaaccgcccttaaatacccgacgcgtacccgccaaaaaaaacgcctcccccgaccctaaaaccgaaaaaattaaccaaaataaaaaaacccccgcgaacgcacccccgaccccgcgcgatccccaaaaaacgccacaaaccaacgctcgacgaaaacgcctaatcccgaataaacgcgactccgactcgcaaaactcgcaacccctacgccctctccgaaactaaatcccccgaataaaaccgaaaaccacgcgactctacaatcgccctaaaaccaactaccaaaacaaaacgatcattaaactcaaccta

SEQ ID NO: 7661 - DNA, 557 bp, Artificial Sequence
  chemically treated genomic DNA (Homo sapiens) CpG-island No: 7661
ggcgcgttttttcgtttttcgggggtcgttacggttttttcgcgttttcgggtattttttttcgcgtttgcgttgtgttttacgggggcggggtttagatttttgttagcggcggcggcggtggcggcgatcgttagttttcgttgaggagaaatacgaaacggattttttggttttttttttttttttttttcgttttgaattttttttttggttatcgagaattagttttcgtggagttttttttttatttcgttatcgttttttcggttttcggtttagtggaagttattattttcgaggaggaggtagcggtagtcgttttcgcgtcgtcgttttcggttcggtgttcgcggtttcggagaggaggtgtcgtcgttatcgtcgttttttttttttcgttgttttcgggtcgggttgggtcgagttgcgatgttttcggattttattttattgtttagcgcggatttagatttggaatcgtttaagtttttttattcgcgaggtgagttaggttgtggggggtggggcgtgggggcggggagatagggagatag

SEQ ID NO: 7662 - DNA, 557 bp, Artificial Sequence
  chemically treated genomic DNA (Homo sapiens) CpG-island No: 7662
ctatctccctatctccccgcccccacgccccaccccccacaacctaactcacctcgcgaataaaaaaacttaaacgattccaaatctaaatccgcgctaaacaataaaataaaatccgaaaacatcgcaactcgacccaacccgacccgaaaacaacgaaaaaaaaaaaacgacgataacgacgacacctcctctccgaaaccgcgaacaccgaaccgaaaacgacgacgcgaaaacgactaccgctacctcctcctcgaaaataataacttccactaaaccgaaaaccgaaaaaacgataacgaaataaaaaaaaaactccacgaaaactaattctcgataaccaaaaaaaaaattcaaaacgaaaaaaaaaaaaaaaaaaaaccaaaaaatccgtttcgtatttctcctcaacgaaaactaacgatcgccgccaccgccgccgccgctaacaaaaatctaaaccccgcccccgtaaaacacaacgcaaacgcgaaaaaaaatacccgaaaacgcgaaaaaaccgtaacgacccccgaaaaacgaaaaaacgcgcc

SEQ ID NO: 7663 - DNA, 557 bp, Artificial Sequence
  chemically treated genomic DNA (Homo sapiens) CpG-island No: 7663
ttgtttttttgttttttcgtttttacgttttattttttatagtttgatttatttcgcgagtagagggatttgggcgattttaggtttaggttcgcgttgagtaatgagatgaagttcgagggtatcgtagttcgatttagttcggttcgagggtagcgggagggggggagcggcggtggcggcggtatttttttttcgggatcgcgggtatcgaatcgggggcggcgacgcgagggcggttgtcgttgtttttttttcgagggtagtgatttttattgggtcgaggatcgaggaaacgatggcgaggtggagggggaattttacggggattgattttcggtgattaggagaggggtttaggacggggaaggggaagggggagagttaaagggttcgtttcgtgtttttttttagcgaaaattgacggtcgtcgttatcgtcgtcgtcgttgataggaatttgagtttcgttttcgtggggtatagcgtaggcgcggaggggggtgttcgggagcgcggaagagtcgtggcggttttcggagggcggggaggcgcgtt

SEQ ID NO: 7664 - DNA, 557 bp, Artificial Sequence
  chemically treated genomic DNA (Homo sapiens) CpG-island No: 7664
aacgcgcctccccgccctccgaaaaccgccacgactcttccgcgctcccgaacacccccctccgcgcctacgctataccccacgaaaacgaaactcaaattcctatcaacgacgacgacgataacgacgaccgtcaattttcgctaaaaaaaaacacgaaacgaaccctttaactctcccccttccccttccccgtcctaaacccctctcctaatcaccgaaaatcaatccccgtaaaattccccctccacctcgccatcgtttcctcgatcctcgacccaataaaaatcactaccctcgaaaaaaaaacaacgacaaccgccctcgcgtcgccgcccccgattcgatacccgcgatcccgaaaaaaaaataccgccgccaccgccgctccccccctcccgctaccctcgaaccgaactaaatcgaactacgataccctcgaacttcatctcattactcaacgcgaacctaaacctaaaatcgcccaaatccctctactcgcgaaataaatcaaactataaaaaataaaacgtaaaaacgaaaaaacaaaaaaacaa

SEQ ID NO: 7665 - DNA, 666 bp, Artificial Sequence
  chemically treated genomic DNA (Homo sapiens) CpG-island No: 7665
tgttgcgcgtaatttaatagtttatgcgcggtagatcgtagagtatataacgaggcgttagcgtaagcggtatgaagtacgtttgaattggttgggcgaatagcgaatttttttataattgatcggtagtatgacgaatatgttcgaggttcgttagatcggtatgacgttagcgtttgttaagcgcggtatgggtaaaattttttatttagcgttgttgttttggcggtggtaatttatcgttgttggttaatttatagcgcgttcgattcgttaggtagttttatatcgaacgatatcggaaatatttgttgtggcgtaatatagttttttattagcgtttcggaaattagtgttcgtatttggtcggcgtcgttattgttacgattttgttgatcgaatttattgattagtacgtatagcggtatcgattgttttatcgttaaaatcgttttacggatttttttatcggagatcgattttagttgcgtataatttagtatcgttagtatcgtcgaggcgcgtgttagttgttggttaagtattttttgtagatgcggttgttcggttttatttggttcgggggtatttagtaacgttaattgatcgggataattttttagtttcgttagatgataaattttattttaattacgggaatatgtt

SEQ ID NO: 7666 - DNA, 666 bp, Artificial Sequence
  chemically treated genomic DNA (Homo sapiens) CpG-island No: 7666
aacatattcccgtaattaaaataaaatttatcatctaacgaaactaaaaaattatcccgatcaattaacgttactaaatacccccgaaccaaataaaaccgaacaaccgcatctacaaaaaatacttaaccaacaactaacacgcgcctcgacgatactaacgatactaaattatacgcaactaaaatcgatctccgataaaaaaatccgtaaaacgattttaacgataaaacaatcgataccgctatacgtactaatcaataaattcgatcaacaaaatcgtaacaataacgacgccgaccaaatacgaacactaatttccgaaacgctaataaaaaactatattacgccacaacaaatatttccgatatcgttcgatataaaactacctaacgaatcgaacgcgctataaattaaccaacaacgataaattaccaccgccaaaacaacaacgctaaataaaaaattttacccataccgcgcttaacaaacgctaacgtcataccgatctaacgaacctcgaacatattcgtcatactaccgatcaattataaaaaaattcgctattcgcccaaccaattcaaacgtacttcataccgcttacgctaacgcctcgttatatactctacgatctaccgcgcataaactattaaattacgcgcaaca

SEQ ID NO: 7667 - DNA, 666 bp, Artificial Sequence
  chemically treated genomic DNA (Homo sapiens) CpG-island No: 7667
agtatattttcgtgattgaagtggagtttgttatttagcggggttggagagttatttcggttagttgacgttattggatattttcgggttaaatgaagtcgggtaatcgtatttgtaaaaaatgtttaattagtagttggtacgcgtttcggcggtattggcggtgttggattatacgtaattgaaatcgattttcgatgaagaggttcgtgaggcgattttggcggtggggtaatcggtgtcgttgtacgtgttggttaataagttcgattaataggatcgtaatagtgacgacgtcgattaggtgcgggtattgattttcgggacgttgatgaaaggttgtattacgttatagtagatattttcggtgtcgttcgatgtggggttatttggcgaatcgggcgcgttatgagttagttaataacggtaagttattatcgttagagtaataacgttgggtggaagattttgtttatgtcgcgtttggtaggcgttggcgttatgtcgatttggcggatttcgaatatattcgttatgttgtcgattagttgtgggaagattcgttgttcgtttagttaatttaggcgtgttttatgtcgtttacgttaacgtttcgttgtatgttttgcgatttgtcgcgtataaattgttgaattacgcgtagta

SEQ ID NO: 7668 - DNA, 666 bp, Artificial Sequence
  chemically treated genomic DNA (Homo sapiens) CpG-island No: 7668
tactacgcgtaattcaacaatttatacgcgacaaatcgcaaaacatacaacgaaacgttaacgtaaacgacataaaacacgcctaaattaactaaacgaacaacgaatcttcccacaactaatcgacaacataacgaatatattcgaaatccgccaaatcgacataacgccaacgcctaccaaacgcgacataaacaaaatcttccacccaacgttattactctaacgataataacttaccgttattaactaactcataacgcgcccgattcgccaaataaccccacatcgaacgacaccgaaaatatctactataacgtaatacaacctttcatcaacgtcccgaaaatcaatacccgcacctaatcgacgtcgtcactattacgatcctattaatcgaacttattaaccaacacgtacaacgacaccgattaccccaccgccaaaatcgcctcacgaacctcttcatcgaaaatcgatttcaattacgtataatccaacaccgccaataccgccgaaacgcgtaccaactactaattaaacattttttacaaatacgattacccgacttcatttaacccgaaaatatccaataacgtcaactaaccgaaataactctccaaccccgctaaataacaaactccacttcaatcacgaaaatatact

SEQ ID NO: 7669 - DNA, 507 bp, Artificial Sequence
  chemically treated genomic DNA (Homo sapiens) CpG-island No: 7669
  misc_feature (66)..(66): n is either a, c, g or t
  misc_feature (94)..(94): n is either a, c, g or t
ggtgtaacgcgcggtacgtttgcgttatgaattggttttggattggtcggggatcgcggtggcgtntgacgttatggatgatattgcgtatttnaagtaggaaaatcgtttgttgcgttagcggttttttcggtttgtagtttattcgtgatgtgtgtttgtcggatgcgatgacgtattttaatcggtttataaagattatagtttttgtgggtcggataaggcgtttacgtcgtattcggtaattgcgttataatgtttgatgcgacgttgttcgcgtttttttaggtttacgtgcggtattagataaatgttattgttttggtttttcgttttagttatcgttttcggaaagatcgttattgttggggattcgtttttttttagtagtttatttttcgaggtcgattagttgataacgtttggagtaaaatggtcgaaacgggttgattttattttatattatcgttttttcgtaggttgggtaatttatcgtaatagtttttg

SEQ ID NO: 7670 - DNA, 507 bp, Artificial Sequence
  chemically treated genomic DNA (Homo sapiens) CpG-island No: 7670
  misc_feature (414)..(414): n is either a, c, g or t
  misc_feature (442)..(442): n is either a, c, g or t
caaaaactattacgataaattacccaacctacgaaaaaacgataatataaaataaaatcaacccgtttcgaccattttactccaaacgttatcaactaatcgacctcgaaaaataaactactaaaaaaaaacgaatccccaacaataacgatctttccgaaaacgataactaaaacgaaaaaccaaaacaataacatttatctaataccgcacgtaaacctaaaaaaacgcgaacaacgtcgcatcaaacattataacgcaattaccgaatacgacgtaaacgccttatccgacccacaaaaactataatctttataaaccgattaaaatacgtcatcgcatccgacaaacacacatcacgaataaactacaaaccgaaaaaaccgctaacgcaacaaacgattttcctacttnaaatacgcaatatcatccataacgtcanacgccaccgcgatccccgaccaatccaaaaccaattcataacgcaaacgtaccgcgcgttacacc

SEQ ID NO: 7671 - DNA, 507 bp, Artificial Sequence
  chemically treated genomic DNA (Homo sapiens) CpG-island No: 7671
  misc_feature (414)..(414): n is either a, c, g or t
  misc_feature (442)..(442): n is either a, c, g or t
tagaaattattacggtgaattgtttaatttgcgggaaaacggtggtgtggggtgaaattagttcgtttcggttattttgttttaaacgttgttagttgatcgatttcggagaatgggttgttgaagaaaaacgaatttttagtagtggcgattttttcgaaagcgatgattggagcgaagaattaaagtagtgatatttgtttgatgtcgtacgtaggtttgaaaagacgcggatagcgtcgtattaggtattatggcgtagttgtcggatgcggcgtgaacgttttattcggtttataggaattgtaatttttgtagatcggttaagatgcgttatcgtattcggtaaatatatattacggatgagttataaatcgggaaagtcgttggcgtagtaggcggtttttttgtttnaggtgcgtaatattatttataacgttangcgttatcgcgattttcggttagtttagagttagtttatgacgtaggcgtatcgcgcgttgtatt

SEQ ID NO: 7672 - DNA, 507 bp, Artificial Sequence
  chemically treated genomic DNA (Homo sapiens) CpG-island No: 7672
  misc_feature (66)..(66): n is either a, c, g or t
  misc_feature (94)..(94): n is either a, c, g or t
aatacaacgcgcgatacgcctacgtcataaactaactctaaactaaccgaaaatcgcgataacgcntaacgttataaataatattacgcacctnaaacaaaaaaaccgcctactacgccaacgactttcccgatttataactcatccgtaatatatatttaccgaatacgataacgcatcttaaccgatctacaaaaattacaattcctataaaccgaataaaacgttcacgccgcatccgacaactacgccataatacctaatacgacgctatccgcgtcttttcaaacctacgtacgacatcaaacaaatatcactactttaattcttcgctccaatcatcgctttcgaaaaaatcgccactactaaaaattcgtttttcttcaacaacccattctccgaaatcgatcaactaacaacgtttaaaacaaaataaccgaaacgaactaatttcaccccacaccaccgttttcccgcaaattaaacaattcaccgtaataatttcta

SEQ ID NO: 7673 - DNA, 572 bp, Artificial Sequence
  chemically treated genomic DNA (Homo sapiens) CpG-island No: 7673
agcgttacgtcgtgcgttcgttaggttagtttcgtttttgttcgttcgtttttgtttaaattagattagttttagttttagttttagttttttttttttttggatcgagcgttcgtattttcggttttgtagttattcgagtttcgtttattgtcgtttgtatacgagttttttttggtatagcgtttttatatttcgggatcgttttaacggtttattgcgttttttttgggattatattcgattgtttcgcgcgttttgggatcggatttatttatttcgcgtggtatttagttgtttgttcggagcgttagttagcgtttttcgtttttcgtttttcggtattttcggggggttcgttcgttttgtattttggagtttcgggtcgcgagtttttgttaatttttttggattttcgcggtcgtgggtagcggttgtcgcgtttgtttgttcgagggaggtaggtgtggatcgcggtcggtaaggttgtggggggttgggagttcgcgttgtaggtttgtgcgttcgggtgtagttggcgtttggagcgtgttgggtttgggtttgggaat

SEQ ID NO: 7674 - DNA, 572 bp, Artificial Sequence
  chemically treated genomic DNA (Homo sapiens) CpG-island No: 7674
attcccaaacccaaacccaacacgctccaaacgccaactacacccgaacgcacaaacctacaacgcgaactcccaaccccccacaaccttaccgaccgcgatccacacctacctccctcgaacaaacaaacgcgacaaccgctacccacgaccgcgaaaatccaaaaaaattaacaaaaactcgcgacccgaaactccaaaatacaaaacgaacgaaccccccgaaaataccgaaaaacgaaaaacgaaaaacgctaactaacgctccgaacaaacaactaaataccacgcgaaataaataaatccgatcccaaaacgcgcgaaacaatcgaatataatcccaaaaaaaacgcaataaaccgttaaaacgatcccgaaatataaaaacgctataccaaaaaaaactcgtatacaaacgacaataaacgaaactcgaataactacaaaaccgaaaatacgaacgctcgatccaaaaaaaaaaaaaactaaaactaaaactaaaactaatctaatttaaacaaaaacgaacgaacaaaaacgaaactaacctaacgaacgcacgacgtaacgct

SEQ ID NO: 7675 - DNA, 572 bp, Artificial Sequence
  chemically treated genomic DNA (Homo sapiens) CpG-island No: 7675
atttttaagtttagatttagtacgttttagacgttagttgtattcgggcgtataggtttgtagcgcgggtttttagttttttatagttttgtcggtcgcggtttatatttatttttttcgggtagataggcgcggtagtcgttgtttacggtcgcgagggtttagaggagttggtagaggttcgcggttcggagttttagggtgtagggcgggcgggtttttcgagagtgtcggggagcggagagcggggagcgttagttggcgtttcgggtaagtagttgggtgttacgcggggtagatggattcgattttagggcgcgcggggtagtcggatgtgattttaggaagggcgtagtgggtcgttgggacgatttcgggatgtgggagcgttgtgttaggggggattcgtgtgtaggcgatagtgagcgggattcgggtggttgtagggtcgggagtgcgggcgttcgatttaggaaggaggggagttgaggttgaagttggggttggtttagtttgagtagaagcgggcgggtaggggcggggttggtttggcgggcgtacggcgtggcgtt

SEQ ID NO: 7676 - DNA, 572 bp, Artificial Sequence
  chemically treated genomic DNA (Homo sapiens) CpG-island No: 7676
aacgccacgccgtacgcccgccaaaccaaccccgcccctacccgcccgcttctactcaaactaaaccaaccccaacttcaacctcaactcccctccttcctaaatcgaacgcccgcactcccgaccctacaaccacccgaatcccgctcactatcgcctacacacgaatcccccctaacacaacgctcccacatcccgaaatcgtcccaacgacccactacgcccttcctaaaatcacatccgactaccccgcgcgccctaaaatcgaatccatctaccccgcgtaacacccaactacttacccgaaacgccaactaacgctccccgctctccgctccccgacactctcgaaaaacccgcccgccctacaccctaaaactccgaaccgcgaacctctaccaactcctctaaaccctcgcgaccgtaaacaacgactaccgcgcctatctacccgaaaaaaataaatataaaccgcgaccgacaaaactataaaaaactaaaaacccgcgctacaaacctatacgcccgaatacaactaacgtctaaaacgtactaaatctaaacttaaaaat

SEQ ID NO: 7677 - DNA, 679 bp, Artificial Sequence
  chemically treated genomic DNA (Homo sapiens) CpG-island No: 7677
gatttttcgtggtcgtaatcgtatatttaggtcgtatcgcgggaacgcgatggtaaacgatcgtttttgtaaatcgttataatgataatggtagtagcgggtaggtaattagtagtaacgtgattatcggttgagaaacggtggtgttagtaggttttagcggtagaggtatagtagtagagagtatcggtagtagttacggcgtagtaatatcgttaattacgtagtaaatcgttagtgttattacgtttacgtttattaggagcggcgtataggtggcgttttcggtttttttggtgcgcggcgcgtcgaggaacgtgacgttatagattttcgttatatatattatcgttagcgtatcggtaattgttagttttatagcgagtagcggttttagtagacgggtaataaacgcgttattattgtttagtttgaaaaatgattgatagatatttatttttcggtaaaattatttagcggcggtagcgtagttattgttattagttcgattaatatggcgatggagataatcggtatttttttggttaagtattatcgagtttttcgatatcgcgaatatcgggtataggaattagaacgatttttcggtatttcggacgaggaattaggtgatcggtttttgtagtaaaattaaggggttttaattgggggtttaaaa

SEQ ID NO: 7678 - DNA, 679 bp, Artificial Sequence
  chemically treated genomic DNA (Homo sapiens) CpG-island No: 7678
ttttaaacccccaattaaaaccccttaattttactacaaaaaccgatcacctaattcctcgtccgaaataccgaaaaatcgttctaattcctatacccgatattcgcgatatcgaaaaactcgataatacttaaccaaaaaaataccgattatctccatcgccatattaatcgaactaataacaataactacgctaccgccgctaaataattttaccgaaaaataaatatctatcaatcatttttcaaactaaacaataataacgcgtttattacccgtctactaaaaccgctactcgctataaaactaacaattaccgatacgctaacgataatatatataacgaaaatctataacgtcacgttcctcgacgcgccgcgcaccaaaaaaaccgaaaacgccacctatacgccgctcctaataaacgtaaacgtaataacactaacgatttactacgtaattaacgatattactacgccgtaactactaccgatactctctactactatacctctaccgctaaaacctactaacaccaccgtttctcaaccgataatcacgttactactaattacctacccgctactaccattatcattataacgatttacaaaaacgatcgtttaccatcgcgttcccgcgatacgacctaaatatacgattacgaccacgaaaaatc

SEQ ID NO: 7679 - DNA, 679 bp, Artificial Sequence
  chemically treated genomic DNA (Homo sapiens) CpG-island No: 7679
ttttgaatttttaattaaggttttttggttttgttataaaggtcggttatttggtttttcgttcggggtgtcggggagtcgttttggtttttgtattcggtattcgcgatatcgaaaaattcggtggtatttggttaagaaaatgtcggttatttttatcgttatgttagtcgggttgatggtaatggttgcgttgtcgtcgttgaatggttttgtcggggaatgggtatttattaattattttttaaattgagtaatagtggcgcgtttgttgttcgtttgttggggtcgttgttcgttgtggggttggtaattatcggtgcgttggcggtgatgtgtatggcgaaagtttatggcgttacgtttttcggcgcgtcgcgtattaaagaagtcgaaaacgttatttgtgcgtcgtttttgatgagcgtaagcgtagtggtattggcgatttgttgcgtaattggcggtgttgttgcgtcgtggttattgtcgatgttttttgttgttgtatttttgtcgttggagtttgttaatattatcgttttttaatcgatgattacgttgttgttgattgtttgttcgttgttgttattattattatggcgatttgtaaaggcgatcgtttgttatcgcgttttcgcggtgcggtttgggtgtgcggttacgattacgaaaaatt

SEQ ID NO: 7680 - DNA, 679 bp, Artificial Sequence
  chemically treated genomic DNA (Homo sapiens) CpG-island No: 7680
aatttttcgtaatcgtaaccgcacacccaaaccgcaccgcgaaaacgcgataacaaacgatcgcctttacaaatcgccataataataataacaacaacgaacaaacaatcaacaacaacgtaatcatcgattaaaaaacgataatattaacaaactccaacgacaaaaatacaacaacaaaaaacatcgacaataaccacgacgcaacaacaccgccaattacgcaacaaatcgccaataccactacgcttacgctcatcaaaaacgacgcacaaataacgttttcgacttctttaatacgcgacgcgccgaaaaacgtaacgccataaactttcgccatacacatcaccgccaacgcaccgataattaccaaccccacaacgaacaacgaccccaacaaacgaacaacaaacgcgccactattactcaatttaaaaaataattaataaatacccattccccgacaaaaccattcaacgacgacaacgcaaccattaccatcaacccgactaacataacgataaaaataaccgacattttcttaaccaaataccaccgaatttttcgatatcgcgaataccgaatacaaaaaccaaaacgactccccgacaccccgaacgaaaaaccaaataaccgacctttataacaaaaccaaaaaaccttaattaaaaattcaaaa

SEQ ID NO: 7681 - DNA, 707 bp, Artificial Sequence
  chemically treated genomic DNA (Homo sapiens) CpG-island No: 7681
  misc_feature (68)..(68): n is either a, c, g or t
gtcgttgttgtaatcgggtaaagcgtcgttgtatatgttaatttaagcgtaggaagtgtatgacgtantcggtgcgggcgatacggtgattggcgttttggcggtaacgttggtagcgggtaattcgttggaagaagtttgtttttttgttaatgcggcggttggcgtggtggtcggtaaattgggaatttttacggtttcgtcgatcgagttggaaaatgttgtacgtggacgtgtagatataggttttggcgtgatgatcgaagaggaattgaagttggtcgtagcggtagcgcgtaaacgtggtgaaaaagtggtgatgattaacggtgtttttgatattttgtacgtcgggtacgttttttatttggtaaatgttcgtaagttgggtgatcgtttgattgttgtcgttaatagcgatgtttttattaaacggttgaaaggggattttcgttcggtaaatttattcgaatagcgtatgattgtgttgggcgtattggaagcggtcgattgggtagtgtcgtttgaagaggatacgtcgtagcgtttgatcgtcgggattttgttagatttgttggtgaaaggcggcgattataattagaagagattgtcgggagtaaagaagtttgggttaacggtggcgaagtgttggtgtttaattttgaagacggttgttcgacgattaatattattaagaagatttaata

SEQ ID NO: 7682 - DNA, 707 bp, Artificial Sequence
  chemically treated genomic DNA (Homo sapiens) CpG-island No: 7682
  misc_feature (640)..(640): n is either a, c, g or t
tattaaatcttcttaataatattaatcgtcgaacaaccgtcttcaaaattaaacaccaacacttcgccaccgttaacccaaacttctttactcccgacaatctcttctaattataatcgccgcctttcaccaacaaatctaacaaaatcccgacgatcaaacgctacgacgtatcctcttcaaacgacactacccaatcgaccgcttccaatacgcccaacacaatcatacgctattcgaataaatttaccgaacgaaaatcccctttcaaccgtttaataaaaacatcgctattaacgacaacaatcaaacgatcacccaacttacgaacatttaccaaataaaaaacgtacccgacgtacaaaatatcaaaaacaccgttaatcatcaccactttttcaccacgtttacgcgctaccgctacgaccaacttcaattcctcttcgatcatcacgccaaaacctatatctacacgtccacgtacaacattttccaactcgatcgacgaaaccgtaaaaattcccaatttaccgaccaccacgccaaccgccgcattaacaaaaaaacaaacttcttccaacgaattacccgctaccaacgttaccgccaaaacgccaatcaccgtatcgcccgcaccgantacgtcatacacttcctacgcttaaattaacatatacaacgacgctttacccgattacaacaacgac

SEQ ID NO: 7683 - DNA, 707 bp, Artificial Sequence
  chemically treated genomic DNA (Homo sapiens) CpG-island No: 7683
  misc_feature (640)..(640): n is either a, c, g or t
tgttggatttttttgatgatgttggtcgtcgagtaatcgtttttaaagttgagtattaatatttcgttatcgttggtttagatttttttattttcggtaattttttttggttatagtcgtcgttttttattagtagatttggtaagatttcggcgattaagcgttgcggcgtgttttttttaaacgatattatttagtcgatcgtttttagtgcgtttagtataattatacgttgttcgagtgggtttatcgggcgggaatttttttttagtcgtttggtggaggtatcgttgttgacggtaataattaagcggttatttagtttgcgggtatttgttagataagagacgtgttcggcgtgtaggatgttaaagatatcgttggttattattatttttttattacgtttacgcgttgtcgttacggttagttttagttttttttcggttattacgttaaagtttgtatttgtacgtttacgtatagtattttttagttcgatcggcgaaatcgtggaggtttttagtttgtcgattattacgttagtcgtcgtattggtaaagaagtaggttttttttagcgaattattcgttgttagcgttgtcgttaggacgttaattatcgtgtcgttcgtatcggntacgttatatattttttgcgtttgggttggtatatgtagcggcgttttattcggttgtagtagcgat

SEQ ID NO: 7684 - DNA, 707 bp, Artificial Sequence
  chemically treated genomic DNA (Homo sapiens) CpG-island No: 7684
  misc_feature (68)..(68): n is either a, c, g or t
atcgctactacaaccgaataaaacgccgctacatataccaacccaaacgcaaaaaatatataacgtanccgatacgaacgacacgataattaacgtcctaacgacaacgctaacaacgaataattcgctaaaaaaaacctacttctttaccaatacgacgactaacgtaataatcgacaaactaaaaacctccacgatttcgccgatcgaactaaaaaatactatacgtaaacgtacaaatacaaactttaacgtaataaccgaaaaaaaactaaaactaaccgtaacgacaacgcgtaaacgtaataaaaaaataataataaccaacgatatctttaacatcctacacgccgaacacgtctcttatctaacaaatacccgcaaactaaataaccgcttaattattaccgtcaacaacgatacctccaccaaacgactaaaaaaaaattcccgcccgataaacccactcgaacaacgtataattatactaaacgcactaaaaacgatcgactaaataatatcgtttaaaaaaaacacgccgcaacgcttaatcgccgaaatcttaccaaatctactaataaaaaacgacgactataaccaaaaaaaattaccgaaaataaaaaaatctaaaccaacgataacgaaatattaatactcaactttaaaaacgattactcgacgaccaacatcatcaaaaaaatccaaca

SEQ ID NO: 7685 - DNA, 1003 bp, Artificial Sequence
  chemically treated genomic DNA (Homo sapiens) CpG-island No: 7685
taatattttcggttcgtttattaggtataggttagacgagttttggttttattttatcggagagtttgttcgttaggcgttcggtaaacggtttaagagacgtaaattttagtaggcgagtaaaagtttgtttacgtgtttcgtcggtgacgttgcgtaaattcgcgtatagattgaggttttttattatcgtgagatttttatatagattaaatttttgcggtatataatcgagtacggcgtgtagcgcgtcgtcgtttttgatcggattaaagttaattatcgtggtattgtcgttgtcgggttttagtaatttcgttaatattcgtattagcgtggttttatttgtatcgttcggttttattaatttcgttatataatcggcgtgaatggtataatcgagcgggcgcgacggcgggtttgtttatgttcggaaagcgtttttttaggtcgtttagcgtgataacggtattatttatgttttgtttcgttatcgaattgtatcgttattggtattttttggcgtaacgtattatcggcgtcggttattataatacgtaggcgatagacgaggtcggtacgtagattcggcgtttcgacggttttcggggtaaatttagtagtcggcgaaacgaaattaatttgttcgtgatacggtttgttcgggcgattatcggtataaagtagtattttgcgtttcggttgggtttggttaagattacgtttattaatataagcgcgtatttatatcggacgcgttagtgaaacggtaaatatcgtgttatttttattgaggatcgtgtttggttttatcgcgcgcgttaatagcgtgttattagacggggttattaacgttgagttttgtaaatttaatttcgtttgcgttagttgcgtttgcgtttgttcgaggttggttttcgtttgagcgatgttttgtttacggttatcggaacggtattgacgtaatttattttgtgttgattttagcgttgtttgcgtttgg

SEQ ID NO: 7686 - DNA, 1003 bp, Artificial Sequence
  chemically treated genomic DNA (Homo sapiens) CpG-island No: 7686
ccaaacgcaaacaacgctaaaatcaacacaaaataaattacgtcaataccgttccgataaccgtaaacaaaacatcgctcaaacgaaaaccaacctcgaacaaacgcaaacgcaactaacgcaaacgaaattaaatttacaaaactcaacgttaataaccccgtctaataacacgctattaacgcgcgcgataaaaccaaacacgatcctcaataaaaataacacgatatttaccgtttcactaacgcgtccgatataaatacgcgcttatattaataaacgtaatcttaaccaaacccaaccgaaacgcaaaatactactttataccgataatcgcccgaacaaaccgtatcacgaacaaattaatttcgtttcgccgactactaaatttaccccgaaaaccgtcgaaacgccgaatctacgtaccgacctcgtctatcgcctacgtattataataaccgacgccgataatacgttacgccaaaaaataccaataacgatacaattcgataacgaaacaaaacataaataataccgttatcacgctaaacgacctaaaaaaacgctttccgaacataaacaaacccgccgtcgcgcccgctcgattataccattcacgccgattatataacgaaattaataaaaccgaacgatacaaataaaaccacgctaatacgaatattaacgaaattactaaaacccgacaacgacaataccacgataattaactttaatccgatcaaaaacgacgacgcgctacacgccgtactcgattatataccgcaaaaatttaatctatataaaaatctcacgataataaaaaacctcaatctatacgcgaatttacgcaacgtcaccgacgaaacacgtaaacaaacttttactcgcctactaaaatttacgtctcttaaaccgtttaccgaacgcctaacgaacaaactctccgataaaataaaaccaaaactcgtctaacctatacctaataaacgaaccgaaaatatta

SEQ ID NO: 7687 - DNA, 1003 bp, Artificial Sequence
  chemically treated genomic DNA (Homo sapiens) CpG-island No: 7687
ttaggcgtaggtaacgttgaaattagtataggataaattgcgttagtatcgtttcggtaatcgtgaataggatatcgtttaggcgaaagttagtttcgaataggcgtaggcgtaattggcgtaggcggagttgaatttataggatttaacgttgatagtttcgtttgatggtacgttgttaacgcgcgcggtggagttaggtacggtttttaatgaaggtggtacggtgtttatcgttttattaacgcgttcggtgtgggtgcgcgtttatgttgatgaacgtaattttgattaggtttagtcggggcgtaaagtgttgttttatatcgatggtcgttcggataagtcgtattacgggtagattggtttcgtttcgtcgattgttgaatttatttcgaaaatcgtcgaaacgtcggatttgcgtatcgatttcgtttatcgtttgcgtattgtggtgatcgacgtcgatgatgcgttacgttagggaatgttagtgacggtataattcggtgacgaggtaggatatgaatgatgtcgttattacgttgaacggtttggaaaaacgtttttcgggtatggataagttcgtcgtcgcgttcgttcgattgtattatttacgtcggttatgtgacggggttggtggggtcggacggtgtaggtaaaattacgttgatgcggatgttggcgggattattgaaattcgatagcggtagtgttacggtgattggttttgattcgattaaaaacgacggcgcgttgtacgtcgtgttcggttatatgtcgtagaaatttggtttgtatgaagattttacggtgatggagaattttaatttgtacgcggatttgcgtagcgttatcggcgaggtacgtgagtaaatttttgttcgtttgttggagtttacgttttttgggtcgtttatcggacgtttggcgggtaagtttttcggtgggatgaaattaaaattcgtttggtttgtatttggtgggcgaatcgaaagtgttg

SEQ ID NO: 7688 - DNA, 1003 bp, Artificial Sequence
  chemically treated genomic DNA (Homo sapiens) CpG-island No: 7688
caacactttcgattcgcccaccaaatacaaaccaaacgaattttaatttcatcccaccgaaaaacttacccgccaaacgtccgataaacgacccaaaaaacgtaaactccaacaaacgaacaaaaatttactcacgtacctcgccgataacgctacgcaaatccgcgtacaaattaaaattctccatcaccgtaaaatcttcatacaaaccaaatttctacgacatataaccgaacacgacgtacaacgcgccgtcgtttttaatcgaatcaaaaccaatcaccgtaacactaccgctatcgaatttcaataatcccgccaacatccgcatcaacgtaattttacctacaccgtccgaccccaccaaccccgtcacataaccgacgtaaataatacaatcgaacgaacgcgacgacgaacttatccatacccgaaaaacgtttttccaaaccgttcaacgtaataacgacatcattcatatcctacctcgtcaccgaattataccgtcactaacattccctaacgtaacgcatcatcgacgtcgatcaccacaatacgcaaacgataaacgaaatcgatacgcaaatccgacgtttcgacgattttcgaaataaattcaacaatcgacgaaacgaaaccaatctacccgtaatacgacttatccgaacgaccatcgatataaaacaacactttacgccccgactaaacctaatcaaaattacgttcatcaacataaacgcgcacccacaccgaacgcgttaataaaacgataaacaccgtaccaccttcattaaaaaccgtacctaactccaccgcgcgcgttaacaacgtaccatcaaacgaaactatcaacgttaaatcctataaattcaactccgcctacgccaattacgcctacgcctattcgaaactaactttcgcctaaacgatatcctattcacgattaccgaaacgatactaacgcaatttatcctatactaatttcaacgttacctacgcctaa

SEQ ID NO: 7689 - DNA, 625 bp, Artificial Sequence
  chemically treated genomic DNA (Homo sapiens) CpG-island No: 7689
gttcgagttcggttttcgggtcgtcgtttagttttttttcgcgtttttttgcgtttgggttattttcgatttttgttgttcggtttttagtttttttttatttatttcgtttcgttatgtttcgttttagtcgttcggtttttttttttttgtacgtttcgttttcgatttttcggttttttttcggtttgttcgttatatttttggttttttttgtaagtttcgtttttggtttttgtttttttttttttcgtcggttttaattcgcgtttggttaaggttcgcgggaattcgagagttatcgagagagtagagaattcggcgtcgttaaatagtttagttcgcgttttagcgtttcggcgtcgtcgacgttattttttcgagtaagtggtttttgggcgcgttcgtttcgcgtatattttagcgcgtttttttcgtcgttgggttgcgggttgttttcggggagcgttttcggtttaggagagtttttgaagcgagtgtgagtgagtgtgattgggtgcgtatgaataatttgtataggtgggtgtgcgtacgagtgtgtgtaggagcgtatagtttagagatttcgcgaaattattcggttagtgacggatgacgattagat

SEQ ID NO: 7690 - DNA, 625 bp, Artificial Sequence
  chemically treated genomic DNA (Homo sapiens) CpG-island No: 7690
atctaatcgtcatccgtcactaaccgaataatttcgcgaaatctctaaactatacgctcctacacacactcgtacgcacacccacctatacaaattattcatacgcacccaatcacactcactcacactcgcttcaaaaactctcctaaaccgaaaacgctccccgaaaacaacccgcaacccaacgacgaaaaaaacgcgctaaaatatacgcgaaacgaacgcgcccaaaaaccacttactcgaaaaaataacgtcgacgacgccgaaacgctaaaacgcgaactaaactatttaacgacgccgaattctctactctctcgataactctcgaattcccgcgaaccttaaccaaacgcgaattaaaaccgacgaaaaaaaaaaaaacaaaaaccaaaaacgaaacttacaaaaaaaaccaaaaatataacgaacaaaccgaaaaaaaaccgaaaaatcgaaaacgaaacgtacaaaaaaaaaaaaaccgaacgactaaaacgaaacataacgaaacgaaataaataaaaaaaaactaaaaaccgaacaacaaaaatcgaaaataacccaaacgcaaaaaaacgcgaaaaaaaactaaacgacgacccgaaaaccgaactcgaac

SEQ ID NO: 7691 - DNA, 625 bp, Artificial Sequence
  chemically treated genomic DNA (Homo sapiens) CpG-island No: 7691
gtttgatcgttattcgttattgatcgagtaatttcgcggagtttttgagttgtgcgtttttgtatatattcgtacgtatatttatttatataagttgtttatacgtatttagttatatttatttatattcgttttagaaatttttttgagtcggaggcgtttttcgagagtagttcgtagtttagcggcgggagaggcgcgttggagtgtgcgcgggacgggcgcgtttaggagttatttattcggaggagtggcgtcgacggcgtcgggacgttgaagcgcgagttgggttgtttggcggcgtcgagttttttgttttttcggtggttttcgggttttcgcggattttagttaagcgcgggttagagtcggcgggagaaaaggaggtagaggttaggggcggaatttgtaggagggattaagggtgtggcgggtaggtcggggaggagtcgggaggtcgggggcggagcgtgtagggaaggaggagtcgagcggttggggcggggtatggcggggcggagtgggtgaggaggagttggggatcggatagtaggagtcggaagtggtttaggcgtaggagagcgcggagaagggttgggcggcggttcgggagtcggattcggat

SEQ ID NO: 7692 - DNA, 625 bp, Artificial Sequence
  chemically treated genomic DNA (Homo sapiens) CpG-island No: 7692
atccgaatccgactcccgaaccgccgcccaacccttctccgcgctctcctacgcctaaaccacttccgactcctactatccgatccccaactcctcctcacccactccgccccgccataccccgccccaaccgctcgactcctccttccctacacgctccgcccccgacctcccgactcctccccgacctacccgccacacccttaatccctcctacaaattccgcccctaacctctacctccttttctcccgccgactctaacccgcgcttaactaaaatccgcgaaaacccgaaaaccaccgaaaaaacaaaaaactcgacgccgccaaacaacccaactcgcgcttcaacgtcccgacgccgtcgacgccactcctccgaataaataactcctaaacgcgcccgtcccgcgcacactccaacgcgcctctcccgccgctaaactacgaactactctcgaaaaacgcctccgactcaaaaaaatttctaaaacgaatataaataaatataactaaatacgtataaacaacttatataaataaatatacgtacgaatatatacaaaaacgcacaactcaaaaactccgcgaaattactcgatcaataacgaataacgatcaaac

SEQ ID NO: 7693 - DNA, 609 bp, Artificial Sequence
  chemically treated genomic DNA (Homo sapiens) CpG-island No: 7693
gttttagaattggtcgttggtatgtagtgcggtggtagcgatgcgttttttggtgtaacggtaaattcggcggttggttatgcgtttgatttattggtgcgttgcggcgtaacggtgatgtttttagaagtaacggaagtgcgtgacgcgatttatttgttgatattacgcgtagtgaacgaagaggtcggtaaacggttgttggaggagatggagtggtacgataattattttaatatgggaaaaatcgatcgtagcgttaatttttcgtcgggtaataagaaaggcggtttggtaaacgtggtagagaaggtattcggttttattgttaaatcgggtaaaagcgtaattgttgaagtgttgtcgttcggttaacgttcgattaaacgcggattaatttacgtcgcgacgttagttagcgattttgtttgtggtacgtaataggtggtttcgggtattatagtgtaagtgtttacgatcggtcgtggtacgtcgtacggtttgatggcggtattcgttattaaaatggtaattcgtatcgagttggcgaatcgttggtttgatttaatggatattaatgcgggtattatcgttatcggcgaagaaatt

SEQ ID NO: 7694 - DNA, 609 bp, Artificial Sequence
  chemically treated genomic DNA (Homo sapiens) CpG-island No: 7694
aatttcttcgccgataacgataatacccgcattaatatccattaaatcaaaccaacgattcgccaactcgatacgaattaccattttaataacgaataccgccatcaaaccgtacgacgtaccacgaccgatcgtaaacacttacactataatacccgaaaccacctattacgtaccacaaacaaaatcgctaactaacgtcgcgacgtaaattaatccgcgtttaatcgaacgttaaccgaacgacaacacttcaacaattacgcttttacccgatttaacaataaaaccgaataccttctctaccacgtttaccaaaccgcctttcttattacccgacgaaaaattaacgctacgatcgatttttcccatattaaaataattatcgtaccactccatctcctccaacaaccgtttaccgacctcttcgttcactacgcgtaatatcaacaaataaatcgcgtcacgcacttccgttacttctaaaaacatcaccgttacgccgcaacgcaccaataaatcaaacgcataaccaaccgccgaatttaccgttacaccaaaaaacgcatcgctaccaccgcactacataccaacgaccaattctaaaac

SEQ ID NO: 7695 - DNA, 609 bp, Artificial Sequence
  chemically treated genomic DNA (Homo sapiens) CpG-island No: 7695
agttttttcgtcggtagcgatggtgttcgtattaatatttattaaattaaattagcggttcgttagttcggtgcgggttgttattttaatgacgggtatcgttattaggtcgtacggcgtattacgatcggtcgtaaatatttgtattgtgatattcgaagttatttgttgcgtgttatagataaaatcgttggttggcgtcgcggcgtaaattaattcgcgtttagtcgggcgttgatcgggcgatagtattttaataattgcgtttttattcgatttagtaatggagtcgagtgttttttttattacgtttgttagatcgttttttttgttgttcggcgaagggttggcgttgcggtcggttttttttatattgagatagttatcgtattattttattttttttagtagtcgtttgtcgattttttcgtttattgcgcgtggtgttagtagatggatcgcgttacgtattttcgttatttttgaaaatattatcgttgcgtcgtagcgtattagtagattagacgtatagttaatcgtcgggtttgtcgttatattagaaaacgtatcgttgttatcgtattgtatattaacgattagttttgaagt

SEQ ID NO: 7696 - DNA, 609 bp, Artificial Sequence
  chemically treated genomic DNA (Homo sapiens) CpG-island No: 7696
acttcaaaactaatcgttaatatacaatacgataacaacgatacgttttctaatataacgacaaacccgacgattaactatacgtctaatctactaatacgctacgacgcaacgataatattttcaaaaataacgaaaatacgtaacgcgatccatctactaacaccacgcgcaataaacgaaaaaatcgacaaacgactactaaaaaaaataaaataatacgataactatctcaatataaaaaaaaccgaccgcaacgccaacccttcgccgaacaacaaaaaaaacgatctaacaaacgtaataaaaaaaacactcgactccattactaaatcgaataaaaacgcaattattaaaatactatcgcccgatcaacgcccgactaaacgcgaattaatttacgccgcgacgccaaccaacgattttatctataacacgcaacaaataacttcgaatatcacaatacaaatatttacgaccgatcgtaatacgccgtacgacctaataacgatacccgtcattaaaataacaacccgcaccgaactaacgaaccgctaatttaatttaataaatattaatacgaacaccatcgctaccgacgaaaaaact

SEQ ID NO: 7697 - DNA, 508 bp, Artificial Sequence
  chemically treated genomic DNA (Homo sapiens) CpG-island No: 7697
cgcgtaggtacgttcgttggcggttggcgtatataacgatcgttagttgttgtaattttgttatattttagaagtggtcgatagtgcgttgaaaattttcgacgaagcgggattatttggcgaattgcgtttgcgttagggttggcgttgtggcgatggtcggtgtagcgttattcgtaattcgttgtattgttatcgtttttggtagtaattgaaaggttagtcggtcgaatttatttggtagttcgatacggtattagtttggtggtagtattgcgtatcggttcgatcgaaagtttgatttaggggttgtattagttcgtttttcgcgtagaaaaacgtatcggtttggtattgttcggtaagggtaatatcggttttcgttggttggaattgttcgttcgtgagtagagtacgttttcggtacgtatcggttttgagtatgtgttggtaggtgtggtggatagtcgtcgtatttgttgagttatgacgggttggacgtagtcgg

SEQ ID NO: 7698 - DNA, 508 bp, Artificial Sequence
  chemically treated genomic DNA (Homo sapiens) CpG-island No: 7698
ccgactacgtccaacccgtcataactcaacaaatacgacgactatccaccacacctaccaacacatactcaaaaccgatacgtaccgaaaacgtactctactcacgaacgaacaattccaaccaacgaaaaccgatattacccttaccgaacaataccaaaccgatacgtttttctacgcgaaaaacgaactaatacaacccctaaatcaaactttcgatcgaaccgatacgcaatactaccaccaaactaataccgtatcgaactaccaaataaattcgaccgactaacctttcaattactaccaaaaacgataacaatacaacgaattacgaataacgctacaccgaccatcgccacaacgccaaccctaacgcaaacgcaattcgccaaataatcccgcttcgtcgaaaattttcaacgcactatcgaccacttctaaaatataacaaaattacaacaactaacgatcgttatatacgccaaccgccaacgaacgtacctacgcg

SEQ ID NO: 7699 - DNA, 508 bp, Artificial Sequence
  chemically treated genomic DNA (Homo sapiens) CpG-island No: 7699
tcggttgcgtttagttcgttatagtttaataggtgcggcggttgtttattatatttgttagtatatatttaaagtcggtacgtgtcgaaagcgtgttttgtttacgggcgaatagttttagttaacgggaatcgatattgtttttatcgaataatattaggtcgatgcgtttttttgcgcggaagacggattgatgtagtttttgaattaggttttcggtcgggtcggtgcgtagtattgttattaggttgatgtcgtatcggattgttaggtaaattcgatcggttggttttttagttgttgttagaagcggtggtaatgtagcgggttacgggtgacgttgtatcgattatcgttatagcgttagttttgacgtaggcgtagttcgttaggtaatttcgtttcgtcgaggatttttagcgtattgtcggttatttttgaggtgtagtaaaattgtagtaattggcgatcgttatgtacgttaatcgttagcgggcgtatttgcgcg

SEQ ID NO: 7700 - DNA, 508 bp, Artificial Sequence
  chemically treated genomic DNA (Homo sapiens) CpG-island No: 7700
cgcgcaaatacgcccgctaacgattaacgtacataacgatcgccaattactacaattttactacacctcaaaaataaccgacaatacgctaaaaatcctcgacgaaacgaaattacctaacgaactacgcctacgtcaaaactaacgctataacgataatcgatacaacgtcacccgtaacccgctacattaccaccgcttctaacaacaactaaaaaaccaaccgatcgaatttacctaacaatccgatacgacatcaacctaataacaatactacgcaccgacccgaccgaaaacctaattcaaaaactacatcaatccgtcttccgcgcaaaaaaacgcatcgacctaatattattcgataaaaacaatatcgattcccgttaactaaaactattcgcccgtaaacaaaacacgctttcgacacgtaccgactttaaatatatactaacaaatataataaacaaccgccgcacctattaaactataacgaactaaacgcaaccga

SEQ ID NO: 7701 - DNA, 567 bp, Artificial Sequence
  chemically treated genomic DNA (Homo sapiens) CpG-island No: 7701
  misc_feature (373)..(373): n is either a, c, g or t
ggtaaaatcgaagaggtaattaaagcgttggagttgggtcgggtttgcggcgtatttattgcggcgtttattaaacgcgcggatagttcgattatttcggcggcggaatttagtattgattattaggtcgattgtatttgggaaatttatttgttgttttgttatagcgtggtgttggagatgattattcgtttcgcgtcgaacgcggaaatcggtaagattaaaaacgattttaagtagttgtcgaatgcgttcggttatttggtacgtatttgggaagaaaaaggtcgttagtttggtgaattggttagttagtggtcgatgatttatatcgttgttgcgggttcgttgcgttcgttgggttataaagaanggtattgtaacgttgatggaatttatttggacgtacggttgcgtgattgagagcggagagtttcgttatggttcgttggagattgtcgaatcgggcgtttcgtttttgtttttgttcggtaatgatgaaagtcgttatattatcgaacgcgttattaattttgttaaatagcgtattgataacgtgatcgttat

SEQ ID NO: 7702 - DNA, 567 bp, Artificial Sequence
  chemically treated genomic DNA (Homo sapiens) CpG-island No: 7702
  misc_feature (195)..(195): n is either a, c, g or t
ataacgatcacgttatcaatacgctatttaacaaaattaataacgcgttcgataatataacgactttcatcattaccgaacaaaaacaaaaacgaaacgcccgattcgacaatctccaacgaaccataacgaaactctccgctctcaatcacgcaaccgtacgtccaaataaattccatcaacgttacaataccnttctttataacccaacgaacgcaacgaacccgcaacaacgatataaatcatcgaccactaactaaccaattcaccaaactaacgacctttttcttcccaaatacgtaccaaataaccgaacgcattcgacaactacttaaaatcgtttttaatcttaccgatttccgcgttcgacgcgaaacgaataatcatctccaacaccacgctataacaaaacaacaaataaatttcccaaatacaatcgacctaataatcaatactaaattccgccgccgaaataatcgaactatccgcgcgtttaataaacgccgcaataaatacgccgcaaacccgacccaactccaacgctttaattacctcttcgattttacc

SEQ ID NO: 7703 - DNA, 567 bp, Artificial Sequence
  chemically treated genomic DNA (Homo sapiens) CpG-island No: 7703
  misc_feature (195)..(195): n is either a, c, g or t
atgacgattacgttgttagtacgttgtttaataaagttaatggcgcgttcggtggtgtggcgatttttattattgtcgagtaggaataggaacggaacgttcggttcgataatttttagcgggttatggcggaatttttcgtttttaattacgtagtcgtgcgtttaggtaaattttattagcgttataatgttnttttttgtaatttagcggacgtagcggattcgtagtaacggtataaattatcggttattggttggttagtttattaagttggcggtttttttttttttaggtgcgtattagatgatcgagcgtattcggtaattgtttgagatcgtttttgattttgtcgattttcgcgttcggcgcgaggcgggtgattatttttagtattacgttgtagtagagtagtaggtgaattttttagatatagtcggtttgataattaatgttaaatttcgtcgtcgaggtaatcgggttattcgcgcgtttggtgaacgtcgtagtgagtgcgtcgtaggttcggtttagttttagcgttttgattattttttcggttttatt

SEQ ID NO: 7704 - DNA, 567 bp, Artificial Sequence
  chemically treated genomic DNA (Homo sapiens) CpG-island No: 7704
  misc_feature (373)..(373): n is either a, c, g or t
aataaaaccgaaaaaataatcaaaacgctaaaactaaaccgaacctacgacgcactcactacgacgttcaccaaacgcgcgaataacccgattacctcgacgacgaaatttaacattaattatcaaaccgactatatctaaaaaattcacctactactctactacaacgtaatactaaaaataatcacccgcctcgcgccgaacgcgaaaatcgacaaaatcaaaaacgatctcaaacaattaccgaatacgctcgatcatctaatacgcacctaaaaaaaaaaaaaccgccaacttaataaactaaccaaccaataaccgataatttataccgttactacgaatccgctacgtccgctaaattacaaaaaanaacattataacgctaataaaatttacctaaacgcacgactacgtaattaaaaacgaaaaattccgccataacccgctaaaaattatcgaaccgaacgttccgttcctattcctactcgacaataataaaaatcgccacaccaccgaacgcgccattaactttattaaacaacgtactaacaacgtaatcgtcat

SEQ ID NO: 7705 - DNA, 634 bp, Artificial Sequence
  chemically treated genomic DNA (Homo sapiens) CpG-island No: 7705
gaagtgagcgggtttcgttttttttttttttcgttttcgttggagtcgtttttgtcgcggttttttcggttgttagtttttcggcgagtcggagttttagtgtcgtatcgttagttttcggtcgcgcggagtcgggatgtattgtttttgttgtgggtttttattatggagattaaacgggtggagattttcggtagcgttttggacgatttttgtaggtatcgcgttattcgattttttttcgttttcgtcgggtttttttagtttcgtcgatttttagaggtttttgggttttttttttcgtttacgtttatgttttcgtttttcgttttcgtcgttgttcgttttttatcgtcgattttgtttttcgacgatatcgttttttttttcgtcgtagtttttttgttttttaaggtttttcgttttttttcgtagaatattcggaatttttttattttttaagttatttaattattttgttttttcgtaggcgtagtcgtttcgtcggagtttgggttttagcgttttgtcgtcgtcgtcgttttttttttttattgttttttttgtttttgtgatttttttacgtcgtgtatttttttttttttgtgttttatttttcgattttgaaggaaga

SEQ ID NO: 7706 - DNA, 634 bp, Artificial Sequence
  chemically treated genomic DNA (Homo sapiens) CpG-island No: 7706
tcttccttcaaaatcgaaaaataaaacacaaaaaaaaaaaaatacacgacgtaaaaaaatcacaaaaacaaaaaaaacaataaaaaaaaaaaacgacgacgacgacaaaacgctaaaacccaaactccgacgaaacgactacgcctacgaaaaaacaaaataattaaataacttaaaaaataaaaaaattccgaatattctacgaaaaaaaacgaaaaaccttaaaaaacaaaaaaactacgacgaaaaaaaaaacgatatcgtcgaaaaacaaaatcgacgataaaaaacgaacaacgacgaaaacgaaaaacgaaaacataaacgtaaacgaaaaaaaaaacccaaaaacctctaaaaatcgacgaaactaaaaaaacccgacgaaaacgaaaaaaaatcgaataacgcgatacctacaaaaatcgtccaaaacgctaccgaaaatctccacccgtttaatctccataataaaaacccacaacaaaaacaatacatcccgactccgcgcgaccgaaaactaacgatacgacactaaaactccgactcgccgaaaaactaacaaccgaaaaaaccgcgacaaaaacgactccaacgaaaacgaaaaaaaaaaaaaacgaaacccgctcacttc

SEQ ID NO: 7707 - DNA, 634 bp, Artificial Sequence
  chemically treated genomic DNA (Homo sapiens) CpG-island No: 7707
tttttttttagaatcggggaatgagatatagggaggagggggtgtacggcgtggaaaagttatagaggtagaaaaaataatgggagagggaggcggcggcggcggtaaaacgttaagatttaggtttcggcgaagcggttacgtttgcgggaaagtaaaatagttgagtaatttaaaaaatgaggaaatttcgggtgttttgcggggaaggacggagggttttgagaaatagggaggttgcggcggaaagaggggcggtgtcgtcggagagtagggtcgacgatggaaagcgagtagcggcgggagcggaaagcgaggatatggacgtgggcggggaagaagatttagaggtttttgggggtcggcgaaattgagaaaattcgacgggggcgaaagggggtcgggtagcgcggtatttgtagagatcgtttaggacgttgtcgggaatttttattcgtttggtttttatgatgaggatttatagtaggaatagtgtatttcggtttcgcgcggtcggggattgacggtacggtattaggatttcggttcgtcggagagttggtagtcgagggagtcgcggtagagacgattttaacggagacgagaaggggaaggggcgggattcgtttatttt

SEQ ID NO: 7708 - DNA, 634 bp, Artificial Sequence
  chemically treated genomic DNA (Homo sapiens) CpG-island No: 7708
aaaataaacgaatcccgccccttccccttctcgtctccgttaaaatcgtctctaccgcgactccctcgactaccaactctccgacgaaccgaaatcctaataccgtaccgtcaatccccgaccgcgcgaaaccgaaatacactattcctactataaatcctcatcataaaaaccaaacgaataaaaattcccgacaacgtcctaaacgatctctacaaataccgcgctacccgaccccctttcgcccccgtcgaattttctcaatttcgccgacccccaaaaacctctaaatcttcttccccgcccacgtccatatcctcgctttccgctcccgccgctactcgctttccatcgtcgaccctactctccgacgacaccgcccctctttccgccgcaacctccctatttctcaaaaccctccgtccttccccgcaaaacacccgaaatttcctcattttttaaattactcaactattttactttcccgcaaacgtaaccgcttcgccgaaacctaaatcttaacgttttaccgccgccgccgcctccctctcccattattttttctacctctataacttttccacgccgtacaccccctcctccctatatctcattccccgattctaaaaaaaaa

SEQ ID NO: 7709 - DNA, 664 bp, Artificial Sequence
  chemically treated genomic DNA (Homo sapiens) CpG-island No: 7709
cgggcgacgcgtattattttttaggtattcggtttcgcgttttattcgtagtagcgtttagcgagaattgcgaaggaggtaggtttcgggtattcgttttcgcgcgtgggcggggtcggttggagggggcggtgttttcgggattgtgagcggggtttttcggggtgtgggtggggttttcggtcgtgggtagggtcggttagggagaggcggggttttcgagaatgggcggggttttcgagaatgggcggggttttcgggagtgcgtttttttcgtatatgcgttttgatagtttaataatggcggcgttcgcggagtcgttgaggaggcggaagattgggtattcggattcggagtttgagtcgtcgttcgcgtcggggcgtggtttcgtaggtttttcggtttatttttatacgggtattttttggttgattcggatcgtgtttttgaaggttttagttttcgtgtattgtgagtgtcgggcgggttcgggatattcgttagtgttattttcgcgtattacgattttcgttttttttcgagattttttcgcgcggtttcgcggtcgcggcgtttttacgtagtttttttttttgttggggttcgggtaaggcggggcgggtagggtaggataaggtttgttggcgatagcgtattcggttt

SEQ ID NO: 7710 - DNA, 664 bp, Artificial Sequence
  chemically treated genomic DNA (Homo sapiens) CpG-island No: 7710
aaaccgaatacgctatcgccaacaaaccttatcctaccctacccgccccgccttacccgaaccccaacaaaaaaaaaaactacgtaaaaacgccgcgaccgcgaaaccgcgcgaaaaaatctcgaaaaaaaacgaaaatcgtaatacgcgaaaataacactaacgaatatcccgaacccgcccgacactcacaatacacgaaaactaaaaccttcaaaaacacgatccgaatcaaccaaaaaatacccgtataaaaataaaccgaaaaacctacgaaaccacgccccgacgcgaacgacgactcaaactccgaatccgaatacccaatcttccgcctcctcaacgactccgcgaacgccgccattattaaactatcaaaacgcatatacgaaaaaaacgcactcccgaaaaccccgcccattctcgaaaaccccgcccattctcgaaaaccccgcctctccctaaccgaccctacccacgaccgaaaaccccacccacaccccgaaaaaccccgctcacaatcccgaaaacaccgccccctccaaccgaccccgcccacgcgcgaaaacgaatacccgaaacctacctccttcgcaattctcgctaaacgctactacgaataaaacgcgaaaccgaatacctaaaaaataatacgcgtcgcccg

SEQ ID NO: 7711 - DNA, 664 bp, Artificial Sequence
  chemically treated genomic DNA (Homo sapiens) CpG-island No: 7711
gggtcgggtgcgttgtcgttagtaagttttgttttgttttgttcgtttcgttttgttcgggttttagtaggaaggagggttgcgtgggggcgtcgcggtcgcgagatcgcgcggaggagtttcgagggagggcgggggtcgtggtgcgcggaggtgatattggcggatgtttcgggttcgttcggtatttatagtatacgaaggttagggtttttaggagtacgattcgggttagttagaaggtgttcgtgtggagatgggtcggagagtttgcggggttacgtttcggcgcgggcggcgatttaggtttcggattcgagtatttagtttttcgtttttttagcgatttcgcgggcgtcgttattgttgggttgttagggcgtatgtgcggggagggcgtattttcggaggtttcgtttattttcggaggtttcgtttattttcggaggtttcgtttttttttggtcggttttgtttacggtcgaaggttttatttatatttcgggaggtttcgtttatagtttcggaggtatcgttttttttagtcggtttcgtttacgcgcgggagcgggtgttcggagtttgtttttttcgtagttttcgttgggcgttgttgcgggtagggcgcggggtcgggtatttgggaggtggtgcgcgtcgttcg

SEQ ID NO: 7712 - DNA, 664 bp, Artificial Sequence
  chemically treated genomic DNA (Homo sapiens) CpG-island No: 7712
cgaacgacgcgcaccacctcccaaatacccgaccccgcgccctacccgcaacaacgcccaacgaaaactacgaaaaaaacaaactccgaacacccgctcccgcgcgtaaacgaaaccgactaaaaaaaacgatacctccgaaactataaacgaaacctcccgaaatataaataaaaccttcgaccgtaaacaaaaccgaccaaaaaaaaacgaaacctccgaaaataaacgaaacctccgaaaataaacgaaacctccgaaaatacgccctccccgcacatacgccctaacaacccaacaataacgacgcccgcgaaatcgctaaaaaaacgaaaaactaaatactcgaatccgaaacctaaatcgccgcccgcgccgaaacgtaaccccgcaaactctccgacccatctccacacgaacaccttctaactaacccgaatcgtactcctaaaaaccctaaccttcgtatactataaataccgaacgaacccgaaacatccgccaatatcacctccgcgcaccacgacccccgccctccctcgaaactcctccgcgcgatctcgcgaccgcgacgcccccacgcaaccctccttcctactaaaacccgaacaaaacgaaacgaacaaaacaaaacaaaacttactaacgacaacgcacccgaccc

SEQ ID NO: 7713 - DNA, 2146 bp, Artificial Sequence
  chemically treated genomic DNA (Homo sapiens) CpG-island No: 7713
tttgggtcgtgattttatgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttacgagagtttgtgtttgggtcgtgatttcgtgttgttatcgtgagtttgtgtttgggtcgtgatttcgtgtttgttagcgtgatgtttgtttgggtggtgatttcgtgttgttatcgtgagtttgtgtttgggtcgtgatttcgtgttgttatcgtgagtttgtgtttgggtcgtgatttcgtgttgttatcgtgagtttgtgtttgggtcgtgattttcgtgttgttatcgtgatgttttgtgttgtggttcgtgattttcgtgttgttatcgtgatgttttgttttgggtggtgatttcgtgttgttatcgtgagtttgtgtttgggtcgtgatttcgtgttgttatcgtgagtttgtgttttgggttcgtgatttcgtgttgttatcgtgagttttgtgtttgggtcgtgatttcgtgttgtttattcgtgagttttgtgttgtgggttcgatgatttttcgtgttgttattcgtgagttttgttttgggggtcgttgatttttcgttgttgttatcgtgagtttgtgtttgggtcgtgatttcgtgttgttatcgtgagtttgtgtttgggtcgtgatttcgtgttgttatcgtgagtttgtttgggtggtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgttttcgtgttgttatcgagagtttgtttgggtcgtgatttcgtgttgttatcgtgagtttgtgtttgggtcgtgatttcgtgttgttatcgagagtttgtgtttgggtcgtgatttcgtgttgtatatcgtgagtttgtgtttgggtcgagatttcgtgttgttatcgtgagtattgtgtttgggtcgtgatttcgtgttgttatcgtgagtttgtagtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttatcgtgattttgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtttgggtcgtgatttcgtgttgttttcgtgagtttgtgtttgggtcgtgatttcgtgttgttatcgtgagtttgtgtttgggtcgtgatttcgtgttgttatcgtgagtttgtttgggtcgtgatttcgtgttgttatcgtgagtttgtgtttgggtcgtgatttcgtgttgttatcgtgagtttgtgtttgggtcgtgatttcgtgttgttaatttcgttgaaggttttttggttttggggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggtcgtgatttcgtgttgttatcgtgagtttgtgtttgggttgtgatttagtgttgttattgtgagtttt

SEQ ID NO: 7714 - DNA, 2146 bp, Artificial Sequence
  chemically treated genomic DNA (Homo sapiens) CpG-island No: 7714
aaaactcacaataacaacactaaatcacaacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgaccccaaaaccaaaaaaccttcaacgaaattaacaacacgaaatcacgacccaaacacaaactcacgataacaacacgaaatcacgacccaaacacaaactcacgataacaacacgaaatcacgacccaaacaaactcacgataacaacacgaaatcacgacccaaacacaaactcacgataacaacacgaaatcacgacccaaacacaaactcacgaaaacaacacgaaatcacgacccaaacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaacaaactcacgataacaacacgaaatcacgacccaaacacaaactcacgataacaacacgaaatcacgacccaaacacaaactcacgataacaacacgaaatcacgacccaaacaaactcacgataacaacacgaaatcacgacccaaacacaaactcacgataacaacacgaaatcacgacccaaacacaaactcacgataacaacacgaaatcacgacccaaacaaaatcacgataacaacacgaaatcacgacccaaacaaactcacgataacaacacgaaatcacgacccaaacacaaactcacgataacaacacgaaatcacgacccaaacacaaactcacgataacaacacgaaatcacgacccaaacacaaactcacgataacaacacgaaatcacgacccaaactacaaactcacgataacaacacgaaatcacgacccaaacacaatactcacgataacaacacgaaatctcgacccaaacacaaactcacgatatacaacacgaaatcacgacccaaacacaaactctcgataacaacacgaaatcacgacccaaacacaaactcacgataacaacacgaaatcacgacccaaacaaactctcgataacaacacgaaaacacgacccaaacacaaactcacgataacaacacgaaatcacgacccaaacacaaactcacgataacaacacgaaatcacgacccaaacacaaactcacgataacaacacgaaatcacgacccaaacacaaactcacgataacaacacgaaatcaccacccaaacaaactcacgataacaacacgaaatcacgacccaaacacaaactcacgataacaacacgaaatcacgacccaaacacaaactcacgataacaacaacgaaaaatcaacgacccccaaaacaaaactcacgaataacaacacgaaaaatcatcgaacccacaacacaaaactcacgaataaacaacacgaaatcacgacccaaacacaaaactcacgataacaacacgaaatcacgaacccaaaacacaaactcacgataacaacacgaaatcacgacccaaacacaaactcacgataacaacacgaaatcaccacccaaaacaaaacatcacgataacaacacgaaaatcacgaaccacaacacaaaacatcacgataacaacacgaaaatcacgacccaaacacaaactcacgataacaacacgaaatcacgacccaaacacaaactcacgataacaacacgaaatcacgacccaaacacaaactcacgataacaacacgaaatcaccacccaaacaaacatcacgctaacaaacacgaaatcacgacccaaacacaaactcacgataacaacacgaaatcacgacccaaacacaaactctcgtaacaacacgaaatcacgacccaaacacaaactcacgataacaacacgaaatcacgacccaaacacaaactcacgataacaacacgaaatcacgacccaaacacaaactcacgataacaacataaaatcacgacccaaa

SEQ ID NO: 7715 - DNA, 2146 bp, Artificial Sequence
  chemically treated genomic DNA (Homo sapiens) CpG-island No: 7715
aagatttatagtgataatattggattataatttagatatagatttacggtgatagtacgggattacgatttagatatagatttacggtgatagtacgggattacgatttagatatagatttacggtgatagtacgggattacgatttagatatagatttacggtgatagtacgggattacgatttagatatagatttacggtgatagtacgggattacgattttaagattaaggaatttttaacggggttgataatacgggattacgatttagatatagatttacggtgatagtacgggattacgatttagatatagatttacggtgataatacgggattacgatttagatagatttacggtgatagtacgggattacgatttagatatagatttacggtgatagtacgggattacgatttagatatagatttacggggatagtacgggattacgatttagatagatttacggtgatagtacgggattacgatttagatatagatttacggtgatagtacgggattacgatttagatatagatttacggtgatagtacgggattacgatttagatatagatttacggtgataatacgggattacgatttagatagatttacggtgatagtacgggattacgatttagatatagatttacggtgatagtacgggattacgatttagatatagatttacggtgatagtacgggattacgatttagatagatttacggtgatagtacgggattacgatttagatatagatttacggtgatagtacgggattacgatttagatatagatttacggtgatagtacgggattacgatttagatagaattacggtgatagtacgggattacgatttagatagatttacggtgatagtacgggattacgatttagatatagatttacggtgatagtacgggattacgatttagatatagatttacggtgatagtacgggattacgatttagatatagatttacggtgatagtacgggattacgatttagattatagatttacggtgatagtacgggattacgatttagatatagtatttacggtgatagtacgggatttcgatttagatatagatttacggtgtatagtacgggattacgatttagatatagattttcggtgatagtacgggattacgatttagatatagatttacggtgatagtacgggattacgatttagatagattttcggtgatagtacgggagtacgatttagatatagatttacggtgatagtacgggattacgatttagatatagatttacggtgatagtacgggattacgatttagatatagatttacggtgatagtacgggattacgatttagatatagatttacggtgatagtacgggattattatttagatagatttacggtgatagtacgggattacgatttagatatagatttacggtgatagtacgggattacgatttagatatagatttacggtgatagtagcggggaattaacgatttttaaaatagaatttacgggtgatagtacggggagttatcgaatttataatatagaatttacgggtgaatagtacgggattacgatttagatatagaatttacggtgatagtacgggattacgaatttagaatatagatttacggtgatagtacgggattacgatttagatatagatttacggtgatagtacgggattattatttagaataagatattacggtgatagtacgggagttacgagttataatataagatattacggtgatagtacgggaattacgatttagatatagatttacggtgatagtacgggattacgatttagatatagatttacggtgatagtacgggattacgatttagatatagatttacggtgatagtacgggattattatttagatagatattacgttgatagatacgggattacgatttagatatagatttacggtgatagtacgggattacgatttagatatagattttcgtgatagtacgggattacgatttagatatagatttacggtgatagtacgggattacgatttagatatagatttacggtgatagtacgggattacgatttagatatagatttacggtgatagtatgggattacgatttaga

SEQ ID NO: 7716 - DNA, 2146 bp, Artificial Sequence
  chemically treated genomic DNA (Homo sapiens) CpG-island No: 7716
tctaaatcgtaatcccatactatcaccgtaaatctatatctaaatcgtaatcccgtactatcaccgtaaatctatatctaaatcgtaatcccgtactatcaccgtaaatctatatctaaatcgtaatcccgtactatcacgaaaatctatatctaaatcgtaatcccgtactatcaccgtaaatctatatctaaatcgtaatcccgtatctatcaacgtaatatctatctaaataataatcccgtactatcaccgtaaatctatatctaaatcgtaatcccgtactatcaccgtaaatctatatctaaatcgtaatcccgtactatcaccgtaaatctatatctaaatcgtaattcccgtactatcaccgtaatatcttatattataactcgtaactcccgtactatcaccgtaatatcttattctaaataataatcccgtactatcaccgtaaatctatatctaaatcgtaatcccgtactatcaccgtaaatctatattctaaattcgtaatcccgtactatcaccgtaaattctatatctaaatcgtaatcccgtactattcacccgtaaattctatattataaattcgataactccccgtactatcacccgtaaattctattttaaaaatcgttaattccccgctactatcaccgtaaatctatatctaaatcgtaatcccgtactatcaccgtaaatctatatctaaatcgtaatcccgtactatcaccgtaaatctatctaaataataatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtactcccgtactatcaccgaaaatctatctaaatcgtaatcccgtactatcaccgtaaatctatatctaaatcgtaatcccgtactatcaccgaaaatctatatctaaatcgtaatcccgtactatacaccgtaaatctatatctaaatcgaaatcccgtactatcaccgtaaatactatatctaaatcgtaatcccgtactatcaccgtaaatctataatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtactatcaccgtaattctatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtattatcaccgtaaatctatatctaaatcgtaatcccgtactatcaccgtaaatctatatctaaatcgtaatcccgtactatcaccgtaaatctatatctaaatcgtaatcccgtactatcaccgtaaatctatctaaatcgtaatcccgtactatccccgtaaatctatatctaaatcgtaatcccgtactatcaccgtaaatctatatctaaatcgtaatcccgtactatcaccgtaaatctatctaaatcgtaatcccgtattatcaccgtaaatctatatctaaatcgtaatcccgtactatcaccgtaaatctatatctaaatcgtaatcccgtattatcaaccccgttaaaaattccttaatcttaaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaatcgtaatcccgtactatcaccgtaaatctatatctaaattataatccaatattatcactataaatctt

SEQ ID NO: 7717 - DNA, 860 bp, Artificial Sequence
  chemically treated genomic DNA (Homo sapiens) CpG-island No: 7717
ttcgggcggtgttggtgttcgtgttgtatttgttggtgtgtgcggtcgggttgggcgggaatacgttggttatttacgtggtgttgcgtttcgttaagatgaagatcgttattaatatttatatttttaatttggtagtggtcgacgttttgtatatgttggggttgttttttttggttacgtagaacgtcgcgtttttttggtttttcggtttcgttttgtgtcgtttggttatgacgttggacggcgttaattagtttattagtgttttttgtttgatagttatgagcgtggatcgttatttggtagtggtgtattcgttgagttcggttcgttggcgtcgttcgcgtgtggttaagttggcgagcgtcgcggtttgggttttgtttttgtgtatgtcgttgtcgtttttggtgttcgcggacgtgtaggagggcggtatttgtaacgttagttggtcggagttcgtggggttgtggggcgtcgtttttattatttatacggtcgtgttgggttttttcgcgtcgttgttggttatttgtttgtgttatttgtttatcgtggtgaaggtgagggcggcgggcgtgcgcgtgggttgcgtgcggcggcgttcggagcggaaggtgacgcgtatggtgttggtggtggtgttggtgtttgcgggatgttggttgtttttttttatcgttaatatcgttaatttggtcgtggcgttgttttaggagttcgttttcgtcggtttttattttttcgtggttatttttttttacgttaatagttgtgttaatttcgttttttacggttttttttttgataattttcgttagagtttttagaaggttttgtgttttcgtaagggt

SEQ ID NO: 7718 - DNA, 860 bp, Artificial Sequence
  chemically treated genomic DNA (Homo sapiens) CpG-island No: 7718
acccttacgaaaacacaaaaccttctaaaaactctaacgaaaattatcaaaaaaaaaaccgtaaaaaacgaaattaacacaactattaacgtaaaaaaaaataaccacgaaaaaataaaaaccgacgaaaacgaactcctaaaacaacgccacgaccaaattaacgatattaacgataaaaaaaaacaaccaacatcccgcaaacaccaacaccaccaccaacaccatacgcgtcaccttccgctccgaacgccgccgcacgcaacccacgcgcacgcccgccgccctcaccttcaccacgataaacaaataacacaaacaaataaccaacaacgacgcgaaaaaacccaacacgaccgtataaataataaaaacgacgccccacaaccccacgaactccgaccaactaacgttacaaataccgccctcctacacgtccgcgaacaccaaaaacgacaacgacatacacaaaaacaaaacccaaaccgcgacgctcgccaacttaaccacacgcgaacgacgccaacgaaccgaactcaacgaatacaccactaccaaataacgatccacgctcataactatcaaacaaaaaacactaataaactaattaacgccgtccaacgtcataaccaaacgacacaaaacgaaaccgaaaaaccaaaaaaacgcgacgttctacgtaaccaaaaaaaacaaccccaacatatacaaaacgtcgaccactaccaaattaaaaatataaatattaataacgatcttcatcttaacgaaacgcaacaccacgtaaataaccaacgtattcccgcccaacccgaccgcacacaccaacaaatacaacacgaacaccaacaccgcccgaa

SEQ ID NO: 7719 - DNA, 860 bp, Artificial Sequence
  chemically treated genomic DNA (Homo sapiens) CpG-island No: 7719
gtttttgcggaggtatagaattttttggaagttttggcggaagttgttagagaggaagtcgtagaggacggggttggtatagttgttggcgtaggagaggatgattacgaagaagtagaggtcggcggaggcgggtttttggggtagcgttacggttaggttgacgatgttgacggtgaagaagggtagttaatatttcgtaaatattagtattattattaatattatgcgcgttatttttcgtttcgagcgtcgtcgtacgtagtttacgcgtacgttcgtcgtttttatttttattacgatgagtaggtagtataggtagatgattagtagcggcgcgaagaagtttagtacggtcgtgtagatgatgaagacggcgttttatagttttacgggtttcggttagttggcgttgtaggtatcgtttttttgtacgttcgcgaatattaggagcggtagcgatatgtatagagataggatttaggtcgcggcgttcgttagtttggttatacgcgggcggcgttagcgggtcgagtttagcgggtgtattattgttaggtagcggtttacgtttatgattgttaggtagaagatattggtgaattggttgacgtcgtttagcgttatgattaggcggtataggacggggtcgaagggttagaaggacgcggcgttttgcgtggttaggaaaggtagttttagtatgtataggacgtcggttattgttaggttgagaatgtagatgttggtgacggtttttattttggcgaagcgtagtattacgtagatgattagcgtgttttcgtttagttcggtcgtatatattagtaggtatagtacgggtattagtatcgttcggg

SEQ ID NO: 7720 - DNA, 860 bp, Artificial Sequence
  chemically treated genomic DNA (Homo sapiens) CpG-island No: 7720
cccgaacgatactaatacccgtactatacctactaatatatacgaccgaactaaacgaaaacacgctaatcatctacgtaatactacgcttcgccaaaataaaaaccgtcaccaacatctacattctcaacctaacaataaccgacgtcctatacatactaaaactacctttcctaaccacgcaaaacgccgcgtccttctaacccttcgaccccgtcctataccgcctaatcataacgctaaacgacgtcaaccaattcaccaatatcttctacctaacaatcataaacgtaaaccgctacctaacaataatacacccgctaaactcgacccgctaacgccgcccgcgtataaccaaactaacgaacgccgcgacctaaatcctatctctatacatatcgctaccgctcctaatattcgcgaacgtacaaaaaaacgatacctacaacgccaactaaccgaaacccgtaaaactataaaacgccgtcttcatcatctacacgaccgtactaaacttcttcgcgccgctactaatcatctacctatactacctactcatcgtaataaaaataaaaacgacgaacgtacgcgtaaactacgtacgacgacgctcgaaacgaaaaataacgcgcataatattaataataatactaatatttacgaaatattaactacccttcttcaccgtcaacatcgtcaacctaaccgtaacgctaccccaaaaacccgcctccgccgacctctacttcttcgtaatcatcctctcctacgccaacaactataccaaccccgtcctctacgacttcctctctaacaacttccgccaaaacttccaaaaaattctatacctccgcaaaaac

SEQ ID NO: 7721 - DNA, 1753 bp, Artificial Sequence
  chemically treated genomic DNA (Homo sapiens) CpG-island No: 7721
atttttgtatatagtcggggtataattaatttttgtatatagtcggcgtttaattaattattgtatatagtcggtatttaattaattatagtatatagtcgtcgtttaattaattatagtatatagtcggtatttaattaatttttgtatatagtcggcgtttaattaattatagtatatagtcggcgtttaattaatttttgtatatagtcggcgtttaattaatttttgtatatagtcggcgtttaataaattattgtatatagtcggcgtttaattaattatagtatatagtcggcgtttaattaattatagtatatagtcggcgtttaattaatttttgtatatagtcggcgtttaattaattcgtgtatatagtcggcgtttaattaattatagtatatagtcgtcgtttaattaattatagtatatagtcggtatttaattaatttttgtatatagtcggcgtttaattaattatagtatatagtcggcgtttaattaatttttgtatatagtcggcgtttaattaatttttgtatatagtcggcgtttaataaattattgtatatagtcggcgtttaattaattatagtatatagtcggcgtttaattaatttttgtatatagtcggcgtttaattaattcgtgtatatagttagcgtttaattaattatagtatatagtcggcgtttaattaattattgtatatagtcggcgtttaattaattcgtgtatatagtcggcgtttaattaatttttgtatatagtcggcgtttaataaattatagtatatagtcggcgtttaattaatttttgtatatagtcggcgtttaacgaatttttgtatatagtcggcgtttaattaatttttgtatatagtcggcgtttaattaatttttgtatatagtcggcgtttaataaattatagtatatagtcggcgtttaattaatttttgtatatagtcggcgtttaattaattcgtgtatatagtcggcgtttaattaattattgtatatagtcggcgtttaattaattatagtatatagtcggcgtttaattaatttttgtatatagtcggcgtttaacgaattcgtgtatatagtcggcgtttaattaatttttgtatatagtcggcgtttaattaatttttgtatatagtcggcgtttaataaattatagtatatagtcggcgtttaattaatttttgtatatagtcggcgtttaattaatttttgtatatagtcggcgtttaattaattattgtatatagtcggcgtttaattaattatagtatatagtcggcgtttaattaatttttgtatatagtcggtgtttaataaattatagtatatagtcggcgtttaattaatttttgtatatagtcggcgtttaattaattatagtatatagtcggcgtttaattaattatagtatatagtcggcgtttaattaatttttgtatatagtcggcgtttaataaattattgtatatagtcggcgtttaattaatttttgtatatagttagcgtttaataaattattgtatatagtcggcgttgaagtttcgcgtgttcgtttattttagttattatttatatgttatgttattagtagtagcgagttgttttcgttttaaggagaaggtcggtttaaaagtcgttcgacgcgaaaatcgaagaaagcgagaaaaaagatcgaaaagatcgaaagatcgaagagttaagaagtcgtaaaaagggaaaagtagag

SEQ ID NO: 7722 - DNA, 1753 bp, Artificial Sequence
  chemically treated genomic DNA (Homo sapiens) CpG-island No: 7722
ctctacttttccctttttacgacttcttaactcttcgatctttcgatcttttcgatcttttttctcgctttcttcgattttcgcgtcgaacgacttttaaaccgaccttctccttaaaacgaaaacaactcgctactactaataacataacatataaataataactaaaataaacgaacacgcgaaacttcaacgccgactatatacaataatttattaaacgctaactatatacaaaaattaattaaacgccgactatatacaataatttattaaacgccgactatatacaaaaattaattaaacgccgactatatactataattaattaaacgccgactatatactataattaattaaacgccgactatatacaaaaattaattaaacgccgactatatactataatttattaaacaccgactatatacaaaaattaattaaacgccgactatatactataattaattaaacgccgactatatacaataattaattaaacgccgactatatacaaaaattaattaaacgccgactatatacaaaaattaattaaacgccgactatatactataatttattaaacgccgactatatacaaaaattaattaaacgccgactatatacaaaaattaattaaacgccgactatatacacgaattcgttaaacgccgactatatacaaaaattaattaaacgccgactatatactataattaattaaacgccgactatatacaataattaattaaacgccgactatatacacgaattaattaaacgccgactatatacaaaaattaattaaacgccgactatatactataatttattaaacgccgactatatacaaaaattaattaaacgccgactatatacaaaaattaattaaacgccgactatatacaaaaattcgttaaacgccgactatatacaaaaattaattaaacgccgactatatactataatttattaaacgccgactatatacaaaaattaattaaacgccgactatatacacgaattaattaaacgccgactatatacaataattaattaaacgccgactatatactataattaattaaacgctaactatatacacgaattaattaaacgccgactatatacaaaaattaattaaacgccgactatatactataattaattaaacgccgactatatacaataatttattaaacgccgactatatacaaaaattaattaaacgccgactatatacaaaaattaattaaacgccgactatatactataattaattaaacgccgactatatacaaaaattaattaaataccgactatatactataattaattaaacgacgactatatactataattaattaaacgccgactatatacacgaattaattaaacgccgactatatacaaaaattaattaaacgccgactatatactataattaattaaacgccgactatatactataattaattaaacgccgactatatacaataatttattaaacgccgactatatacaaaaattaattaaacgccgactatatacaaaaattaattaaacgccgactatatactataattaattaaacgccgactatatacaaaaattaattaaataccgactatatactataattaattaaacgacgactatatactataattaattaaataccgactatatacaataattaattaaacgccgactatatacaaaaattaattataccccgactatatacaaaaat

SEQ ID NO: 7723 - DNA, 1753 bp, Artificial Sequence
  chemically treated genomic DNA (Homo sapiens) CpG-island No: 7723
ttttgtttttttttttttgcggttttttggtttttcggtttttcggttttttcggttttttttttcgtttttttcggttttcgcgtcgggcgatttttgggtcggttttttttttaggacgggggtagttcgttgttgttgatggtatggtatgtgggtgatggttggggtgggcgggtacgcggagttttagcgtcgattgtgtgtagtgatttgttgagcgttgattgtgtgtagggattggttgagcgtcgattgtgtgtagtgatttgttgagcgtcgattgtgtgtagggattggttgagcgtcgattgtgtgttgtgattggttgagcgtcgattgtgtgttgtgattggttgagcgtcgattgtgtgtaggaattgattgagcgtcgattgtgtgttgtgatttgttgagtatcgattgtgtgtagggattggttgagcgtcgattgtgtgttgtgattggttgagcgtcgattgtgtgtagtgattggttgagcgtcgattgtgtgtagggattggttgagcgtcgattgtgtgtagggattgattgagcgtcgattgtgtgttgtgatttgttgagcgtcgattgtgtgtagggattggttgagcgtcgattgtgtgtagggattgattgagcgtcgattgtgtgtacggattcgttgagcgtcgattgtgtgtagggattgattgagcgtcgattgtgtgttgtgattggttgagcgtcgattgtgtgtagtgattggttgagcgtcgattgtgtgtacggattggttgagcgtcgattgtgtgtagggattgattgagcgtcgattgtgtgttgtgatttgttgagcgtcgattgtgtgtagggattggttgagcgtcgattgtgtgtagggattgattgagcgtcgattgtgtgtagggattcgttgagcgtcgattgtgtgtagggattgattgagcgtcgattgtgtgttgtgatttgttgagcgtcgattgtgtgtagggattggttgagcgtcgattgtgtgtacggattggttgagcgtcgattgtgtgtagtgattggttgagcgtcgattgtgtgttgtgattggttgagcgttgattgtgtgtacggattggttgagcgtcgattgtgtgtagggattggttgagcgtcgattgtgtgttgtgattggttgagcgtcgattgtgtgtagtgatttgttgagcgtcgattgtgtgtagggattggttgagcgtcgattgtgtgtagggattgattgagcgtcgattgtgtgttgtgattggttgagcgtcgattgtgtgtagggattggttgagtgtcgattgtgtgttgtgattggttgagcgacgattgtgtgttgtgattggttgagcgtcgattgtgtgtacggattggttgagcgtcgattgtgtgtagggattggttgagcgtcgattgtgtgttgtgattggttgagcgtcgattgtgtgttgtgattggttgagcgtcgattgtgtgtagtgatttgttgagcgtcgattgtgtgtagggattggttgagcgtcgattgtgtgtagggattgattgagcgtcgattgtgtgttgtgattggttgagcgtcgattgtgtgtagggattggttgagtgtcgattgtgtgttgtgattggttgagcgacgattgtgtgttgtgattggttgagtgtcgattgtgtgtagtgattgattgagcgtcgattgtgtgtagggattggttgtgtttcgattgtgtgtagggat

SEQ ID NO: 7724 - DNA, 1753 bp, Artificial Sequence
  chemically treated genomic DNA (Homo sapiens) CpG-island No: 7724
atccctacacacaatcgaaacacaaccaatccctacacacaatcgacgctcaatcaatcactacacacaatcgacactcaaccaatcacaacacacaatcgtcgctcaaccaatcacaacacacaatcgacactcaaccaatccctacacacaatcgacgctcaaccaatcacaacacacaatcgacgctcaatcaatccctacacacaatcgacgctcaaccaatccctacacacaatcgacgctcaacaaatcactacacacaatcgacgctcaaccaatcacaacacacaatcgacgctcaaccaatcacaacacacaatcgacgctcaaccaatccctacacacaatcgacgctcaaccaatccgtacacacaatcgacgctcaaccaatcacaacacacaatcgtcgctcaaccaatcacaacacacaatcgacactcaaccaatccctacacacaatcgacgctcaaccaatcacaacacacaatcgacgctcaatcaatccctacacacaatcgacgctcaaccaatccctacacacaatcgacgctcaacaaatcactacacacaatcgacgctcaaccaatcacaacacacaatcgacgctcaaccaatccctacacacaatcgacgctcaaccaatccgtacacacaatcaacgctcaaccaatcacaacacacaatcgacgctcaaccaatcactacacacaatcgacgctcaaccaatccgtacacacaatcgacgctcaaccaatccctacacacaatcgacgctcaacaaatcacaacacacaatcgacgctcaatcaatccctacacacaatcgacgctcaacgaatccctacacacaatcgacgctcaatcaatccctacacacaatcgacgctcaaccaatccctacacacaatcgacgctcaacaaatcacaacacacaatcgacgctcaatcaatccctacacacaatcgacgctcaaccaatccgtacacacaatcgacgctcaaccaatcactacacacaatcgacgctcaaccaatcacaacacacaatcgacgctcaatcaatccctacacacaatcgacgctcaacgaatccgtacacacaatcgacgctcaatcaatccctacacacaatcgacgctcaaccaatccctacacacaatcgacgctcaacaaatcacaacacacaatcgacgctcaatcaatccctacacacaatcgacgctcaaccaatccctacacacaatcgacgctcaaccaatcactacacacaatcgacgctcaaccaatcacaacacacaatcgacgctcaaccaatccctacacacaatcgatactcaacaaatcacaacacacaatcgacgctcaatcaattcctacacacaatcgacgctcaaccaatcacaacacacaatcgacgctcaaccaatcacaacacacaatcgacgctcaaccaatccctacacacaatcgacgctcaacaaatcactacacacaatcgacgctcaaccaatccctacacacaatcaacgctcaacaaatcactacacacaatcgacgctaaaactccgcgtacccgcccaccccaaccatcacccacataccataccatcaacaacaacgaactacccccgtcctaaaaaaaaaaccgacccaaaaatcgcccgacgcgaaaaccgaaaaaaacgaaaaaaaaaaccgaaaaaaccgaaaaaccgaaaaaccaaaaaaccgcaaaaaaaaaaaaacaaaa

SEQ ID NO: 7725 - DNA, 1061 bp, Artificial Sequence
  chemically treated genomic DNA (Homo sapiens) CpG-island No: 7725
gttttcggtcgggttagaatagggggtaggaggcgcgttttgtgcggtcggtggcggttttaggtgggtgcggtgcgttggtaggaagcggtagtacgattttcgattttgtatttggatttttttagtaacggattagttttttttgtcgatcgggtcggggagatcgcgtggtttagtggttgtagcggttatcggttcgggcgtgggggttttgagggtatcggcgcggtaggttattcgggtttcgcgggtcgtaagttcggagacgcgcgtgtttcgcgttggttgtttgattcggaatggcgtagttttttcgtttttagcgcgttggttgaaaggattcgagttattttcggggacggtcgggtcgaggttatttcgcggggcggttttgggcggggattcggattcgcggttggacgttcgtttcggggggggtaatgtttttttttcgatttcgcggtttttattagggcggtatatttcgtttttttttcgttttcgtaggcgtttagggtttataggttcggagcggttttcgtttttgtcggattatttagggtcgtttcgtcggaggggttttttcgttttcgagttttaggttacgttcggaaggttcggggttttcgcgttcggttacgttattcgttcggcggttttagggatttagcgtcggggttagcgtaggtttcgtttagcgttttcgttttttttagttggtcggttttcgggatcgcgttttcgttcgcgttttttacgttcgtattcgtatgggtagggcggttcggggttttttagtttcgagtcgcggttttttgaagcgcgttatttggacgtgcgttgttcgtagattttggacgagttgggtttgggcgttgcgcggcggaatcgattttgttttggatcgtaggtagtagttgatttcgcgttatcggtttgcgggcgagattttaggcgcgagacgggttgtgtgtgtgtgtgtgtgtgtgagagagagagagagagagagagagagagagagagagagagagagtgtgtgtgtgtgtgtgtgtgtgtgt

SEQ ID NO: 7726 - DNA, 1061 bp, Artificial Sequence
  chemically treated genomic DNA (Homo sapiens) CpG-island No: 7726
acacacacacacacacacacacacactctctctctctctctctctctctctctctctctctctctctctcacacacacacacacacacacaacccgtctcgcgcctaaaatctcgcccgcaaaccgataacgcgaaatcaactactacctacgatccaaaacaaaatcgattccgccgcgcaacgcccaaacccaactcgtccaaaatctacgaacaacgcacgtccaaataacgcgcttcaaaaaaccgcgactcgaaactaaaaaaccccgaaccgccctacccatacgaatacgaacgtaaaaaacgcgaacgaaaacgcgatcccgaaaaccgaccaactaaaaaaaacgaaaacgctaaacgaaacctacgctaaccccgacgctaaatccctaaaaccgccgaacgaataacgtaaccgaacgcgaaaaccccgaaccttccgaacgtaacctaaaactcgaaaacgaaaaaacccctccgacgaaacgaccctaaataatccgacaaaaacgaaaaccgctccgaacctataaaccctaaacgcctacgaaaacgaaaaaaaaacgaaatataccgccctaataaaaaccgcgaaatcgaaaaaaaaacattaccccccccgaaacgaacgtccaaccgcgaatccgaatccccgcccaaaaccgccccgcgaaataacctcgacccgaccgtccccgaaaataactcgaatcctttcaaccaacgcgctaaaaacgaaaaaactacgccattccgaatcaaacaaccaacgcgaaacacgcgcgtctccgaacttacgacccgcgaaacccgaataacctaccgcgccgataccctcaaaacccccacgcccgaaccgataaccgctacaaccactaaaccacgcgatctccccgacccgatcgacaaaaaaaactaatccgttactaaaaaaatccaaatacaaaatcgaaaatcgtactaccgcttcctaccaacgcaccgcacccacctaaaaccgccaccgaccgcacaaaacgcgcctcctaccccctattctaacccgaccgaaaac

SEQ ID NO: 7727 - DNA, 1061 bp, Artificial Sequence
  chemically treated genomic DNA (Homo sapiens) CpG-island No: 7727
atatatatatatatatatatatatatttttttttttttttttttttttttttttttttttttttttttttatatatatatatatatatatagttcgtttcgcgtttgaggtttcgttcgtaggtcggtggcgcggggttagttgttgtttgcggtttaggatagggtcggtttcgtcgcgtagcgtttaggtttagttcgtttagagtttgcggatagcgtacgtttaggtaacgcgttttaaggggtcgcggttcggagttgggggatttcgggtcgttttgtttatacgagtgcgagcgtggagagcgcgggcgggggcgcggtttcgggggtcggttagttggagggggcgggagcgttgggcggggtttgcgttgatttcggcgttgagtttttggggtcgtcgggcggatggcgtggtcggacgcgggggtttcgggtttttcgggcgtgatttagggttcgggggcggggaggttttttcggcggggcggttttgggtggttcggtagaggcggaggtcgtttcgagtttgtgagttttgggcgtttgcggaggcggggagagggcggggtgtgtcgttttggtggggatcgcggggtcggagaggggatattgtttttttcgaggcgaacgtttaatcgcgggttcgggttttcgtttaaggtcgtttcgcgaggtggtttcggttcggtcgttttcgagggtggttcggatttttttaattagcgcgttggaggcgaaggggttgcgttatttcgggttaggtagttaacgcgggatacgcgcgttttcgagtttgcggttcgcgaaattcgggtgatttatcgcgtcggtgtttttaaagtttttacgttcgggtcggtggtcgttgtagttattgagttacgcggttttttcggttcggtcggtagaaggagttggttcgttattagaaaagtttagatgtaaagtcgggggtcgtgttgtcgttttttgttagcgtatcgtatttatttggggtcgttatcgatcgtataggacgcgttttttattttttgttttggttcggtcgagagt

SEQ ID NO: 7728 - DNA, 1061 bp, Artificial Sequence
  chemically treated genomic DNA (Homo sapiens) CpG-island No: 7728
actctcgaccgaaccaaaacaaaaaataaaaaacgcgtcctatacgatcgataacgaccccaaataaatacgatacgctaacaaaaaacgacaacacgacccccgactttacatctaaacttttctaataacgaaccaactccttctaccgaccgaaccgaaaaaaccgcgtaactcaataactacaacgaccaccgacccgaacgtaaaaactttaaaaacaccgacgcgataaatcacccgaatttcgcgaaccgcaaactcgaaaacgcgcgtatcccgcgttaactacctaacccgaaataacgcaaccccttcgcctccaacgcgctaattaaaaaaatccgaaccaccctcgaaaacgaccgaaccgaaaccacctcgcgaaacgaccttaaacgaaaacccgaacccgcgattaaacgttcgcctcgaaaaaaacaatatcccctctccgaccccgcgatccccaccaaaacgacacaccccgccctctccccgcctccgcaaacgcccaaaactcacaaactcgaaacgacctccgcctctaccgaaccacccaaaaccgccccgccgaaaaaacctccccgcccccgaaccctaaatcacgcccgaaaaacccgaaacccccgcgtccgaccacgccatccgcccgacgaccccaaaaactcaacgccgaaatcaacgcaaaccccgcccaacgctcccgccccctccaactaaccgacccccgaaaccgcgcccccgcccgcgctctccacgctcgcactcgtataaacaaaacgacccgaaatcccccaactccgaaccgcgaccccttaaaacgcgttacctaaacgtacgctatccgcaaactctaaacgaactaaacctaaacgctacgcgacgaaaccgaccctatcctaaaccgcaaacaacaactaaccccgcgccaccgacctacgaacgaaacctcaaacgcgaaacgaactatatatatatatatatatataaaaaaaaaaaaaaaaaaaaaaaaaaaaaaaaaaaaaaaaaaaaatatatatatatatatatatatatat

SEQ ID NO: 7729 - DNA, 1059 bp, Artificial Sequence
  chemically treated genomic DNA (Homo sapiens) CpG-island No: 7729
tcgggcggggtaggcgggggcgcggcgagagtcgcggagttttttttatgggtgggggggcgggggcggtcgggtttcgttttcgggggatcggggcgcgtttcgttaatgggtagtcgggcgcggggcggggtcgcggggtcgtcgtttaaagaaatttgttgcgggtttcgtagcgggattcgagtttcggcggcggcggcggcggcggtaggggcgagggtcggggttatcgcgcggcgatttcgggtttcggagcgatcgtagggtagtttcgggcgtcggtttcggtgcgcgttttttgtgcgcgttttttcgcgcgcggtttcgatgttggatatgagcgaggttcgtttttagtcgttttgtagttcgttcggtatcgttagttttatgtcgtacgtggaggattcggattcggacgcgtcgtcgtttttcgtcggtttcgagggtttgggtcgcgcgggggtcgcggtggggggcgttcggggcgattcggcggaggcggcggacgagcgtttttcggtttgtattcgcgacgtcgtgtcgtaggtgtttaagggttacgattggagtttggtgtttatgtcggtgcgcggcggcggcggcggcgcgtttaaagttaagtcgtatgtgaagcggtttatgaacgtatttatggtgtgggcgtaggcggcgcgtcgtaagttggtcgattagtattcgtatttgtataacgtcgagtttagtaagacgttgggtaagttgtggcggtgagtgtcggcgtttcgggggcggggttcgggattttggtcgtttttggtttcggattgcgagcgggggtttggagggcgtagagttcgcggaggtggtggttatacgtaggtttcgggttttgtatttcgggcgggtgttagggcggggttttagtggaaaaatattttttggttagtcggggttcggcgttagttatgggagtcgggattcgcggagggtagcgtttggggtgtgtattttcgtggcgggtgcgttttggagttagtttttttggcggggaatattttgcggagggttatggtt

SEQ ID NO: 7730 - DNA, 1059 bp, Artificial Sequence
  chemically treated genomic DNA (Homo sapiens) CpG-island No: 7730
aaccataaccctccgcaaaatattccccgccaaaaaaactaactccaaaacgcacccgccacgaaaatacacaccccaaacgctaccctccgcgaatcccgactcccataactaacgccgaaccccgactaaccaaaaaatatttttccactaaaaccccgccctaacacccgcccgaaatacaaaacccgaaacctacgtataaccaccacctccgcgaactctacgccctccaaacccccgctcgcaatccgaaaccaaaaacgaccaaaatcccgaaccccgcccccgaaacgccgacactcaccgccacaacttacccaacgtcttactaaactcgacgttatacaaatacgaatactaatcgaccaacttacgacgcgccgcctacgcccacaccataaatacgttcataaaccgcttcacatacgacttaactttaaacgcgccgccgccgccgccgcgcaccgacataaacaccaaactccaatcgtaacccttaaacacctacgacacgacgtcgcgaatacaaaccgaaaaacgctcgtccgccgcctccgccgaatcgccccgaacgccccccaccgcgacccccgcgcgacccaaaccctcgaaaccgacgaaaaacgacgacgcgtccgaatccgaatcctccacgtacgacataaaactaacgataccgaacgaactacaaaacgactaaaaacgaacctcgctcatatccaacatcgaaaccgcgcgcgaaaaaacgcgcacaaaaaacgcgcaccgaaaccgacgcccgaaactaccctacgatcgctccgaaacccgaaatcgccgcgcgataaccccgaccctcgcccctaccgccgccgccgccgccgccgaaactcgaatcccgctacgaaacccgcaacaaatttctttaaacgacgaccccgcgaccccgccccgcgcccgactacccattaacgaaacgcgccccgatcccccgaaaacgaaacccgaccgcccccgcccccccacccataaaaaaaactccgcgactctcgccgcgcccccgcctaccccgcccga

SEQ ID NO: 7731 - DNA, 1059 bp, Artificial Sequence
  chemically treated genomic DNA (Homo sapiens) CpG-island No: 7731
agttatggtttttcgtagggtgtttttcgttaggagaattggttttagagcgtattcgttacgagggtgtatattttaggcgttgtttttcgcggatttcgatttttatagttggcgtcggatttcggttggttagaggatgtttttttattgggatttcgttttgatattcgttcggggtgtagagttcggagtttgcgtgtggttattattttcgcgagttttgcgttttttaggttttcgttcgtagttcgagattaggggcggttaaggtttcgaatttcgttttcggggcgtcggtatttatcgttatagtttgtttagcgttttgttgagttcggcgttgtgtaggtgcgggtattggtcggttagtttgcggcgcgtcgtttgcgtttatattatgaatgcgtttatgggtcgttttatatgcggtttggttttgagcgcgtcgtcgtcgtcgtcgcgtatcggtatgggtattagattttagtcgtagtttttgagtatttgcgatacggcgtcgcggatgtaggtcgggaagcgttcgttcgtcgttttcgtcgggtcgtttcgggcgttttttatcgcgattttcgcgcggtttaggttttcggagtcggcgggagacggcggcgcgttcgagttcgagttttttacgtgcgatatggagttggcggtgtcggacgggttgtagggcggttgggagcgggtttcgtttatgtttagtatcggggtcgcgcgcggaggggcgcgtataggagacgcgtatcggggtcggcgttcggggttgttttgcggtcgtttcgggattcgaggtcgtcgcgcggtggtttcgattttcgtttttgtcgtcgtcgtcgtcgtcgtcgaggttcgggtttcgttgcgggattcgtaataagtttttttaagcggcggtttcgcggtttcgtttcgcgttcggttatttattggcggagcgcgtttcgatttttcggaggcggagttcggtcgttttcgtttttttatttataaagaaagtttcgcggttttcgtcgcgttttcgtttgtttcgttcgg

SEQ ID NO: 7732 - DNA, 1059 bp, Artificial Sequence
  chemically treated genomic DNA (Homo sapiens) CpG-island No: 7732
ccgaacgaaacaaacgaaaacgcgacgaaaaccgcgaaactttctttataaataaaaaaacgaaaacgaccgaactccgcctccgaaaaatcgaaacgcgctccgccaataaataaccgaacgcgaaacgaaaccgcgaaaccgccgcttaaaaaaacttattacgaatcccgcaacgaaacccgaacctcgacgacgacgacgacgacgacaaaaacgaaaatcgaaaccaccgcgcgacgacctcgaatcccgaaacgaccgcaaaacaaccccgaacgccgaccccgatacgcgtctcctatacgcgcccctccgcgcgcgaccccgatactaaacataaacgaaacccgctcccaaccgccctacaacccgtccgacaccgccaactccatatcgcacgtaaaaaactcgaactcgaacgcgccgccgtctcccgccgactccgaaaacctaaaccgcgcgaaaatcgcgataaaaaacgcccgaaacgacccgacgaaaacgacgaacgaacgcttcccgacctacatccgcgacgccgtatcgcaaatactcaaaaactacgactaaaatctaatacccataccgatacgcgacgacgacgacgacgcgctcaaaaccaaaccgcatataaaacgacccataaacgcattcataatataaacgcaaacgacgcgccgcaaactaaccgaccaatacccgcacctacacaacgccgaactcaacaaaacgctaaacaaactataacgataaataccgacgccccgaaaacgaaattcgaaaccttaaccgcccctaatctcgaactacgaacgaaaacctaaaaaacgcaaaactcgcgaaaataataaccacacgcaaactccgaactctacaccccgaacgaatatcaaaacgaaatcccaataaaaaaacatcctctaaccaaccgaaatccgacgccaactataaaaatcgaaatccgcgaaaaacaacgcctaaaatatacaccctcgtaacgaatacgctctaaaaccaattctcctaacgaaaaacaccctacgaaaaaccataact

SEQ ID NO: 7733 - DNA, 663 bp, Artificial Sequence
  chemically treated genomic DNA (Homo sapiens) CpG-island No: 7733
aggtcgggtcggtaggagcgggaaagaggggtcgttaggcgttcggggtttgtagggtcgtagaggttagaaggggtaggtggggtcgtcgggcgtcgcgtgtcgacgtgtttacgtcgtttttttcgtgggtcggcgcgagggtttgtatagtttcgattatttttaggcggtgtttttcgatacggagttggtgaatttggacggcgttttcgatttggtcgcgggtcgttttttttgtacggtgttcggcgtttatttttttagttttaacgtgtatatttggaattataaggagatttatttgtatattatgttgaatcggcggttcgcggtcgtgttttacgcgtagtttagcgagcgtagcgttatgtaggtttagagtttgatgttgttgttggcggcgggcgacgtcgtttgggtgcgtatgttttagcgcgatcgggataacgttatttacggcgagtacggagatttttatattatttttagcggttatttggttaagtcggtcgtcgagttgtagtcgggtgaggggtttcgcggttgagtatcgggcgcgcgcgcgcgtgtgtgtgtgtgtttgtgtgtgtgtgtgtgggggtgggtgtgggtgtgtgtgtgtgggatggattgaagattattgcgagattaacgaagaga

SEQ ID NO: 7734 - DNA, 663 bp, Artificial Sequence
  chemically treated genomic DNA (Homo sapiens) CpG-island No: 7734
tctcttcgttaatctcgcaataatcttcaatccatcccacacacacacacccacacccacccccacacacacacacacaaacacacacacacacgcgcgcgcgcgcccgatactcaaccgcgaaacccctcacccgactacaactcgacgaccgacttaaccaaataaccgctaaaaataatataaaaatctccgtactcgccgtaaataacgttatcccgatcgcgctaaaacatacgcacccaaacgacgtcgcccgccgccaacaacaacatcaaactctaaacctacataacgctacgctcgctaaactacgcgtaaaacacgaccgcgaaccgccgattcaacataatatacaaataaatctccttataattccaaatatacacgttaaaactaaaaaaataaacgccgaacaccgtacaaaaaaaacgacccgcgaccaaatcgaaaacgccgtccaaattcaccaactccgtatcgaaaaacaccgcctaaaaataatcgaaactatacaaaccctcgcgccgacccacgaaaaaaacgacgtaaacacgtcgacacgcgacgcccgacgaccccacctaccccttctaacctctacgaccctacaaaccccgaacgcctaacgacccctctttcccgctcctaccgacccgacct

SEQ ID NO: 7735 - DNA, 663 bp, Artificial Sequence
  chemically treated genomic DNA (Homo sapiens) CpG-island No: 7735
ttttttcgttggtttcgtagtggtttttagtttattttatatatatatatttatatttatttttatatatatatatatagatatatatatatacgcgcgcgcgcgttcggtgtttagtcgcggggttttttattcggttatagttcggcggtcggtttgattaggtggtcgttgaaggtgatgtagaggttttcgtgttcgtcgtagatggcgttgtttcggtcgcgttggaatatgcgtatttagacggcgtcgttcgtcgttagtagtagtattaggttttgggtttgtatgacgttgcgttcgttgggttgcgcgtagagtacggtcgcgggtcgtcggtttagtatgatgtgtaggtaggtttttttgtagttttaggtgtgtacgttgaggttgaggaagtagacgtcgggtatcgtgtagaggaagcggttcgcggttaggtcgaaggcgtcgtttaggtttattagtttcgtgtcgaagggtatcgtttggaagtggtcggagttgtgtaggttttcgcgtcggtttacggagaaggcggcgtaggtacgtcggtacgcggcgttcggcggttttatttgttttttttggtttttgcggttttgtaggtttcgggcgtttggcggtttttttttttcgtttttgtcggttcgattt

SEQ ID NO: 7736 - DNA, 663 bp, Artificial Sequence
  chemically treated genomic DNA (Homo sapiens) CpG-island No: 7736
aaatcgaaccgacaaaaacgaaaaaaaaaaaccgccaaacgcccgaaacctacaaaaccgcaaaaaccaaaaaaaacaaataaaaccgccgaacgccgcgtaccgacgtacctacgccgccttctccgtaaaccgacgcgaaaacctacacaactccgaccacttccaaacgatacccttcgacacgaaactaataaacctaaacgacgccttcgacctaaccgcgaaccgcttcctctacacgatacccgacgtctacttcctcaacctcaacgtacacacctaaaactacaaaaaaacctacctacacatcatactaaaccgacgacccgcgaccgtactctacgcgcaacccaacgaacgcaacgtcatacaaacccaaaacctaatactactactaacgacgaacgacgccgtctaaatacgcatattccaacgcgaccgaaacaacgccatctacgacgaacacgaaaacctctacatcaccttcaacgaccacctaatcaaaccgaccgccgaactataaccgaataaaaaaccccgcgactaaacaccgaacgcgcgcgcgcgtatatatatatatctatatatatatatataaaaataaatataaatatatatatataaaataaactaaaaaccactacgaaaccaacgaaaaaa

SEQ ID NO: 7737 - DNA, 567 bp, Artificial Sequence
  chemically treated genomic DNA (Homo sapiens) CpG-island No: 7737
  misc_feature (112)..(112): n is either a, c, g or t
  misc_feature (169)..(169): n is either a, c, g or t
  misc_feature (249)..(249): n is either a, c, g or t
  misc_feature (256)..(256): n is either a, c, g or t
  misc_feature (261)..(261): n is either a, c, g or t
  misc_feature (288)..(288): n is either a, c, g or t
  misc_feature (418)..(418): n is either a, c, g or t
  misc_feature (464)..(464): n is either a, c, g or t
  misc_feature (509)..(509): n is either a, c, g or t
  misc_feature (519)..(519): n is either a, c, g or t
  misc_feature (532)..(532): n is either a, c, g or t
  misc_feature (541)..(541): n is either a, c, g or t
  misc_feature (546)..(546): n is either a, c, g or t
  misc_feature (549)..(550): n is either a, c, g or t
  misc_feature (559)..(559): n is either a, c, g or t
cggtcgtagaggcgtattatggggaggaatttcgttaacgtgtgggaagtcgttcgttgggtacgcggtgtattagtcggcgtattttgtgtgaggcggttgggcgataggntttcgtgggagtaattatcggggaaatcgttttgggaacgtaatttttcgtttgggngatatgttcgtatgaagaggagatttcgtgttcgatcggttggcgttgcgtcgtattatttacgtgtgtagcgattaggnttggtanagcgnttttacggaaggaatttttttcggttngggtagtagtttcgtatgttacgaagggttttcgttttcgaattgggtgcggtgtgggggtgttatattcgcgtgttggtatgtaaatcgggtgggaaaattttttgtagggaaacgatatcgcggtggnttggtgaaagtggttcgataggtaaagaaggtttttcggttttcgntttggggtgtagtttgtcgtgttaagcgtattggtggggaaaagnaagtaagttngaaataaatttgncgggcgaanggaanttnncgttggatnaggggttg

SEQ ID NO: 7738 - DNA, 567 bp, Artificial Sequence
  chemically treated genomic DNA (Homo sapiens) CpG-island No: 7738
  misc_feature (9)..(9): n is either a, c, g or t
  misc_feature (18)..(19): n is either a, c, g or t
  misc_feature (22)..(22): n is either a, c, g or t
  misc_feature (27)..(27): n is either a, c, g or t
  misc_feature (36)..(36): n is either a, c, g or t
  misc_feature (49)..(49): n is either a, c, g or t
  misc_feature (59)..(59): n is either a, c, g or t
  misc_feature (104)..(104): n is either a, c, g or t
  misc_feature (150)..(150): n is either a, c, g or t
  misc_feature (280)..(280): n is either a, c, g or t
  misc_feature (307)..(307): n is either a, c, g or t
  misc_feature (312)..(312): n is either a, c, g or t
  misc_feature (319)..(319): n is either a, c, g or t
  misc_feature (399)..(399): n is either a, c, g or t
  misc_feature (456)..(456): n is either a, c, g or t
caacccctnatccaacgnnaanttccnttcgcccgncaaatttatttcnaacttacttncttttccccaccaatacgcttaacacgacaaactacaccccaaancgaaaaccgaaaaaccttctttacctatcgaaccactttcaccaanccaccgcgatatcgtttccctacaaaaaattttcccacccgatttacataccaacacgcgaatataacacccccacaccgcacccaattcgaaaacgaaaacccttcgtaacatacgaaactactacccnaaccgaaaaaaattccttccgtaaaancgctntaccaancctaatcgctacacacgtaaataatacgacgcaacgccaaccgatcgaacacgaaatctcctcttcatacgaacatatcncccaaacgaaaaattacgttcccaaaacgatttccccgataattactcccacgaaancctatcgcccaaccgcctcacacaaaatacgccgactaatacaccgcgtacccaacgaacgacttcccacacgttaacgaaattcctccccataatacgcctctacgaccg

SEQ ID NO: 7739 - DNA, 567 bp, Artificial Sequence
  chemically treated genomic DNA (Homo sapiens) CpG-island No: 7739
  misc_feature (9)..(9): n is either a, c, g or t
  misc_feature (18)..(19): n is either a, c, g or t
  misc_feature (22)..(22): n is either a, c, g or t
  misc_feature (27)..(27): n is either a, c, g or t
  misc_feature (36)..(36): n is either a, c, g or t
  misc_feature (49)..(49): n is either a, c, g or t
  misc_feature (59)..(59): n is either a, c, g or t
  misc_feature (104)..(104): n is either a, c, g or t
  misc_feature (150)..(150): n is either a, c, g or t
  misc_feature (280)..(280): n is either a, c, g or t
  misc_feature (307)..(307): n is either a, c, g or t
  misc_feature (312)..(312): n is either a, c, g or t
  misc_feature (319)..(319): n is either a, c, g or t
  misc_feature (399)..(399): n is either a, c, g or t
  misc_feature (456)..(456): n is either a, c, g or t
taatttttnatttaacgnnganttttnttcgttcgntaggtttgttttnaatttgtttntttttttttattagtgcgtttggtacgataagttgtattttaagncgaaagtcggagggttttttttgtttatcgaattatttttattaanttatcgcggtgtcgtttttttgtaaggggtttttttattcggtttgtatgttagtacgcggatgtggtatttttatatcgtatttaattcgaagacgggggtttttcgtgatatgcgagattgttatttngatcgagggaggtttttttcgtaggancgttntgttagntttggtcgttatatacgtgggtggtgcggcgtaacgttagtcggtcggatacggggttttttttttatgcgagtatattntttaagcgaagggttgcgtttttagaacggttttttcggtggttgtttttacgaggntttgtcgtttaatcgttttatataaggtgcgtcgattggtatatcgcgtgtttagcgggcggttttttatacgttggcggagtttttttttatggtgcgtttttacggtcg

SEQ ID NO: 7740 - DNA, 567 bp, Artificial Sequence
  chemically treated genomic DNA (Homo sapiens) CpG-island No: 7740
  misc_feature (112)..(112): n is either a, c, g or t
  misc_feature (169)..(169): n is either a, c, g or t
  misc_feature (249)..(249): n is either a, c, g or t
  misc_feature (256)..(256): n is either a, c, g or t
  misc_feature (261)..(261): n is either a, c, g or t
  misc_feature (288)..(288): n is either a, c, g or t
  misc_feature (418)..(418): n is either a, c, g or t
  misc_feature (464)..(464): n is either a, c, g or t
  misc_feature (509)..(509): n is either a, c, g or t
  misc_feature (519)..(519): n is either a, c, g or t
  misc_feature (532)..(532): n is either a, c, g or t
  misc_feature (541)..(541): n is either a, c, g or t
  misc_feature (546)..(546): n is either a, c, g or t
  misc_feature (549)..(550): n is either a, c, g or t
  misc_feature (559)..(559): n is either a, c, g or t
cgaccgtaaaaacgcaccataaaaaaaaactccgccaacgtataaaaaaccgcccgctaaacacgcgatataccaatcgacgcaccttatataaaacgattaaacgacaaancctcgtaaaaacaaccaccgaaaaaaccgttctaaaaacgcaacccttcgcttaaanaatatactcgcataaaaaaaaaaccccgtatccgaccgactaacgttacgccgcaccacccacgtatataacgaccaaanctaacanaacgntcctacgaaaaaaacctccctcgatcnaaataacaatctcgcatatcacgaaaaacccccgtcttcgaattaaatacgatataaaaataccacatccgcgtactaacatacaaaccgaataaaaaaaccccttacaaaaaaacgacaccgcgataanttaataaaaataattcgataaacaaaaaaaaccctccgactttcgncttaaaatacaacttatcgtaccaaacgcactaataaaaaaaaanaaacaaattnaaaacaaacctancgaacgaanaaaantcnncgttaaatnaaaaatta

SEQ ID NO: 7741 - DNA, 736 bp, Artificial Sequence
  chemically treated genomic DNA (Homo sapiens) CpG-island No: 7741
attgtcgtttcggcggatgttttttcgtttttgcgaatgtagggtgtcgtttatgttacgcgtattgtcgaagattttcgcgatcgtggttagtatgtgttgttgattatggatttttttattcgttacgcgatggtttagcgtgaaattgcgttggcgattggcgaatttttcgttattaaaggttatttatcgtcggtgtttgttaaattatcggtattggtcgagcgtgtcggaaatggtattagcggcggcggttcgattatcgcgttttatatcgtgtttattgaaggcgatgattagtaggattcgattgtcgatttcgcgcgggcgattttcgacggttatattgtgttgtttcgttattggcggaagtcgggtattattcggttatcgatattgaagcgttattagtcgcgtaatgacggtttgattagtgagtaatattacgcgcgagtgcgtatttttaaatagttgttgtttagtttttagcgtaatcgcgatttggttagcgtcggcgcgtatgttaaaggtagcgattcgatttttataaagttatcgttttgtggtcgtagttggagggttatttgtaataaggtatttttgaacgcgcggattgggaagcgtttttttagggttgagcgtattttttttatagtgttataatttagagatacggcgatggtagaatatgtgcgttaggattttaagatcggtaataagagtaagatgcgtt

SEQ ID NO: 7742 - DNA, 736 bp, Artificial Sequence
  chemically treated genomic DNA (Homo sapiens) CpG-island No: 7742
aacgcatcttactcttattaccgatcttaaaatcctaacgcacatattctaccatcgccgtatctctaaattataacactataaaaaaaatacgctcaaccctaaaaaaacgcttcccaatccgcgcgttcaaaaataccttattacaaataaccctccaactacgaccacaaaacgataactttataaaaatcgaatcgctacctttaacatacgcgccgacgctaaccaaatcgcgattacgctaaaaactaaacaacaactatttaaaaatacgcactcgcgcgtaatattactcactaatcaaaccgtcattacgcgactaataacgcttcaatatcgataaccgaataatacccgacttccgccaataacgaaacaacacaatataaccgtcgaaaatcgcccgcgcgaaatcgacaatcgaatcctactaatcatcgccttcaataaacacgatataaaacgcgataatcgaaccgccgccgctaataccatttccgacacgctcgaccaataccgataatttaacaaacaccgacgataaataacctttaataacgaaaaattcgccaatcgccaacgcaatttcacgctaaaccatcgcgtaacgaataaaaaaatccataatcaacaacacatactaaccacgatcgcgaaaatcttcgacaatacgcgtaacataaacgacaccctacattcgcaaaaacgaaaaaacatccgccgaaacgacaat

SEQ ID NO: 7743 - DNA, 736 bp, Artificial Sequence
  chemically treated genomic DNA (Homo sapiens) CpG-island No: 7743
ggcgtattttatttttgttgtcgattttaaggttttagcgtatatgttttgttatcgtcgtatttttgggttatgatattgtggggaagatacgtttagttttggagagacgttttttagttcgcgcgtttaaaaatgttttgttgtaaatagttttttagttgcggttatagggcgatggttttatggagatcggatcgttgtttttggtatacgcgtcgacgttaattagatcgcggttacgttgaaaattgaataatagttgtttgaaggtgcgtattcgcgcgtaatgttgtttattgattaagtcgttattgcgcggttgatgacgttttaatatcgatagtcggatagtgttcggttttcgttagtggcgagatagtataatgtgatcgtcgaggatcgttcgcgcggagtcggtaatcggattttgttggttatcgtttttagtgagtacggtataaaacgcggtaatcgagtcgtcgtcgttaatgttattttcggtacgttcgattagtgtcggtaatttggtaaatatcgacggtggataatttttggtggcggggggttcgttaatcgttagcgtaattttacgttgggttatcgcgtagcgggtgagggagtttataattagtaatatatgttgattacgatcgcgaaaattttcggtaatgcgcgtggtataggcggtattttgtattcgtaggagcggagaaatattcgtcggagcggtaat

SEQ ID NO: 7744 - DNA, 736 bp, Artificial Sequence
  chemically treated genomic DNA (Homo sapiens) CpG-island No: 7744
attaccgctccgacgaatatttctccgctcctacgaatacaaaataccgcctataccacgcgcattaccgaaaattttcgcgatcgtaatcaacatatattactaattataaactccctcacccgctacgcgataacccaacgtaaaattacgctaacgattaacgaaccccccgccaccaaaaattatccaccgtcgatatttaccaaattaccgacactaatcgaacgtaccgaaaataacattaacgacgacgactcgattaccgcgttttataccgtactcactaaaaacgataaccaacaaaatccgattaccgactccgcgcgaacgatcctcgacgatcacattatactatctcgccactaacgaaaaccgaacactatccgactatcgatattaaaacgtcatcaaccgcgcaataacgacttaatcaataaacaacattacgcgcgaatacgcaccttcaaacaactattattcaattttcaacgtaaccgcgatctaattaacgtcgacgcgtataccaaaaacaacgatccgatctccataaaaccatcgccctataaccgcaactaaaaaactatttacaacaaaacatttttaaacgcgcgaactaaaaaacgtctctccaaaactaaacgtatcttccccacaatatcataacccaaaaatacgacgataacaaaacatatacgctaaaaccttaaaatcgacaacaaaaataaaatacgcc

SEQ ID NO: 7745 - DNA, 1244 bp, Artificial Sequence
  chemically treated genomic DNA (Homo sapiens) CpG-island No: 7745
tcgaggtatcgagatcggtatacgtagttattgttagcgtgcgggggatcggcgtggcggttatgattaattgatgcggatggaagttttgttgttggttttttttttataatgttagacgttgatgtacgttaaaacgatgttgttcgtcgataattattagcgttaggtcgttaaattgtatttgtttttggaagatggcgtgtgtatcgataattatttgtatttgatcgttggcgatggttttttgttgtgttagtcgtgttttatttttttgtttatcggcgagttagtttatttcgatatcgagcggtgtaaattagttgcggaagttattggcgtgttgttcggcgagtaattcggttggtgttattaatgttatttgtttgtcgtgggtaatcgtacgtaacgcggcgagggcggcgattagcgttttatcggaatttatatcgttttgtattagacgtattatcggtatatttagcgttatatcgcgttcgattttcgttattacgcgtgtttgtgcgttcgttggtttgaacggtaaggcggcgaggagttattttttagcgtgttattggcgtttagcggttgggtatgaaaacgttgtgtttcggtacgtaaggttaatatgttgaggttgtgcgttagtagtttttttagaattagacgacgttgcgtcggatgttgttcggtttttagatcgttaagttgtagcgtcggtggcgggcggtgtaaagtgcgtaacgttttcggtagcgttattattttttgtgatagtttcggcggtaggagttttttaatggcgtaggtgtcgagtagatttagcgtttggtcggttaatttacgtagcgtggtttgttttacgtttttcgttgttggataaatcggcgtgagcgttttttgtaattttggcgtgttgagatcgttttgtacgcggtatttcgggtggattattttcgtattatatttatcgcgttttgtttcgttataagttagtatacggcggttcgtcgttaggttattttttattgtcgcgttgaaattgaaaaagcgtatggtgaggatgtcggaatcgtcgttgatttggtaggttattattcgtcgatcgtcgaaggagatattgtagtttagtatttcgttttttatcgtggtataaacgttcggtagtagtttttcgatggggtagagatgggtgcgattttcgtagcgtaggggaaggtgtaagagtagattttgtacgg

SEQ ID NO: 7746 - DNA, 1244 bp, Artificial Sequence
  chemically treated genomic DNA (Homo sapiens) CpG-island No: 7746
ccgtacaaaatctactcttacaccttcccctacgctacgaaaatcgcacccatctctaccccatcgaaaaactactaccgaacgtttataccacgataaaaaacgaaatactaaactacaatatctccttcgacgatcgacgaataataacctaccaaatcaacgacgattccgacatcctcaccatacgctttttcaatttcaacgcgacaataaaaaataacctaacgacgaaccgccgtatactaacttataacgaaacaaaacgcgataaatataatacgaaaataatccacccgaaataccgcgtacaaaacgatctcaacacgccaaaattacaaaaaacgctcacgccgatttatccaacaacgaaaaacgtaaaacaaaccacgctacgtaaattaaccgaccaaacgctaaatctactcgacacctacgccattaaaaaactcctaccgccgaaactatcacaaaaaataataacgctaccgaaaacgttacgcactttacaccgcccgccaccgacgctacaacttaacgatctaaaaaccgaacaacatccgacgcaacgtcgtctaattctaaaaaaactactaacgcacaacctcaacatattaaccttacgtaccgaaacacaacgttttcatacccaaccgctaaacgccaataacacgctaaaaaataactcctcgccgccttaccgttcaaaccaacgaacgcacaaacacgcgtaataacgaaaatcgaacgcgatataacgctaaatataccgataatacgtctaatacaaaacgatataaattccgataaaacgctaatcgccgccctcgccgcgttacgtacgattacccacgacaaacaaataacattaataacaccaaccgaattactcgccgaacaacacgccaataacttccgcaactaatttacaccgctcgatatcgaaataaactaactcgccgataaacaaaaaaataaaacacgactaacacaacaaaaaaccatcgccaacgatcaaatacaaataattatcgatacacacgccatcttccaaaaacaaatacaatttaacgacctaacgctaataattatcgacgaacaacatcgttttaacgtacatcaacgtctaacattataaaaaaaaaaccaacaacaaaacttccatccgcatcaattaatcataaccgccacgccgatcccccgcacgctaacaataactacgtataccgatctcgatacctcga

SEQ ID NO: 7747 - DNA, 1244 bp, Artificial Sequence
  chemically treated genomic DNA (Homo sapiens) CpG-island No: 7747
tcgtgtaggatttatttttatatttttttttgcgttacgaagatcgtatttatttttattttatcggagaattattgtcgggcgtttatgttacggtggaaggcgaagtgttgaattgtaatatttttttcggcggtcggcggatgatgatttgttagattagcgacggtttcggtatttttattatgcgtttttttaattttagcgcggtaatgaaaaatagtttggcggcgggtcgtcgtgtattggtttatggcgaagtaaagcgcggtaaatatggtgcggagatgatttattcggaatatcgcgtgtagggcgattttagtacgttagaattataggaaacgtttacgtcggtttatttaataacggaaggcgtaaagtaggttacgttgcgtaaattaatcgattaggcgttggatttgttcgatatttgcgttattgaagaatttttgtcgtcggaattgttataaggaatgatgacgttatcggaagcgttgcgtattttgtatcgttcgttatcgacgttatagtttagcgatttggaaatcgggtagtattcggcgtaacgtcgtttgattttggaagaattgttggcgtataattttagtatgttagttttacgtgtcggagtatagcgtttttatgtttagtcgttgagcgttaatgatacgttgaaaaataatttttcgtcgttttatcgtttaagttaacgggcgtataggtacgcgtagtggcggagatcgagcgcgatatggcgttggatgtgtcgatgatgcgtttggtgtagggcgatgtaggtttcggtaaaacgttggtcgtcgttttcgtcgcgttgcgtgcgattgtttacggtaaataggtagtattgatggtattaatcgaattattcgtcgagtagtacgttaataattttcgtaattggtttgtatcgttcggtatcgaagtgggttggttcgtcggtaagtagaaaggtaaagtacggttggtatagtaggaagttatcgttagcggttaggtgtagatgattgtcggtatatacgttattttttaggaataggtgtagtttaacggtttggcgttggtgattatcgacgaatagtatcgttttggcgtgtattagcgtttggtattgtgggagaaaggttagtagtagggtttttattcgtattagttgattatgatcgttacgtcgatttttcgtacgttggtaatgattgcgtatgtcgatttcgatatttcgg

SEQ ID NO: 7748 - DNA, 1244 bp, Artificial Sequence
  chemically treated genomic DNA (Homo sapiens) CpG-island No: 7748
ccgaaatatcgaaatcgacatacgcaatcattaccaacgtacgaaaaatcgacgtaacgatcataatcaactaatacgaataaaaaccctactactaacctttctcccacaataccaaacgctaatacacgccaaaacgatactattcgtcgataatcaccaacgccaaaccgttaaactacacctattcctaaaaaataacgtatataccgacaatcatctacacctaaccgctaacgataacttcctactataccaaccgtactttacctttctacttaccgacgaaccaacccacttcgataccgaacgatacaaaccaattacgaaaattattaacgtactactcgacgaataattcgattaataccatcaatactacctatttaccgtaaacaatcgcacgcaacgcgacgaaaacgacgaccaacgttttaccgaaacctacatcgccctacaccaaacgcatcatcgacacatccaacgccatatcgcgctcgatctccgccactacgcgtacctatacgcccgttaacttaaacgataaaacgacgaaaaattatttttcaacgtatcattaacgctcaacgactaaacataaaaacgctatactccgacacgtaaaactaacatactaaaattatacgccaacaattcttccaaaatcaaacgacgttacgccgaatactacccgatttccaaatcgctaaactataacgtcgataacgaacgatacaaaatacgcaacgcttccgataacgtcatcattccttataacaattccgacgacaaaaattcttcaataacgcaaatatcgaacaaatccaacgcctaatcgattaatttacgcaacgtaacctactttacgccttccgttattaaataaaccgacgtaaacgtttcctataattctaacgtactaaaatcgccctacacgcgatattccgaataaatcatctccgcaccatatttaccgcgctttacttcgccataaaccaatacacgacgacccgccgccaaactatttttcattaccgcgctaaaattaaaaaaacgcataataaaaataccgaaaccgtcgctaatctaacaaatcatcatccgccgaccgccgaaaaaaatattacaattcaacacttcgccttccaccgtaacataaacgcccgacaataattctccgataaaataaaaataaatacgatcttcgtaacgcaaaaaaaaatataaaaataaatcctacacga

SEQ ID NO: 7749 - DNA, 1059 bp, Artificial Sequence
  chemically treated genomic DNA (Homo sapiens) CpG-island No: 7749
acgtcggttgtcgatgtcgcgcgtcggggtatgttagaggtaggttatggcgacgatgtcggttataatatcggttacgttatcggtattgaagtttatgaagattcgcgttggttatcgcgggatattacgacgttatagttaggtatgttattgatcgtggagtcggggatttatttgttagggtaagggggcgtgcgtatcgaagatgttgtgttggttatttcgtaaggcgtagaagtgttttacgttatgtcgtaaatagtgttgtttacgggagaggtataatggatttatcgttattaaaagcgttgagcgaggtagatgcgatcgttttttcggaataggaagtgcggtagattttgttggaagaagcggatcgtttgtaaaaagaagtgcgagttgatggtttgggatcggtgttgattcgtttgaatgaatcgataggttcgaaggtgatgatttgtgcgtatatggacgaagtgggatttatggtgcgtagtatttttcgcgaaggggcgattgatgtgttgtcggttggtaacgtacgtatggttgttcgttagttgtagtcggtgcgtattattattcgtgaagagtgtaaaattttaggtttgtttgacggcgatcggtaggggaatgacgttagcgttatgcgcgtggatattggtgcgcgtttttatgacgaagtgatgtaggcgggaattcgtttcggcgatcgcgttacgtttgatattattttttaggtttttttttattagcgagtgatggggaaagtttttgatgatcgtttcggttgttatttgttggtgacgtaattgcgcgaattgtacgacgtcgaattatttgcggaagtgtggttggtggtaagttttagcgaagaggtgggattacgcggcgggtaaattgttattcgcgcggtgtcgtcggacgtcgttattgtgtttgatatcgtttgttgggcgaaaaattttgattatggcgcggttaattatcgttagattggtaacgggtcgatgttggtgttaagcgataagtcgttgattgcgtcgttaaaat

SEQ ID NO: 7750 - DNA, 1059 bp, Artificial Sequence
  chemically treated genomic DNA (Homo sapiens) CpG-island No: 7750
attttaacgacgcaatcaacgacttatcgcttaacaccaacatcgacccgttaccaatctaacgataattaaccgcgccataatcaaaatttttcgcccaacaaacgatatcaaacacaataacgacgtccgacgacaccgcgcgaataacaatttacccgccgcgtaatcccacctcttcgctaaaacttaccaccaaccacacttccgcaaataattcgacgtcgtacaattcgcgcaattacgtcaccaacaaataacaaccgaaacgatcatcaaaaactttccccatcactcgctaataaaaaaaaacctaaaaaataatatcaaacgtaacgcgatcgccgaaacgaattcccgcctacatcacttcgtcataaaaacgcgcaccaatatccacgcgcataacgctaacgtcattcccctaccgatcgccgtcaaacaaacctaaaattttacactcttcacgaataataatacgcaccgactacaactaacgaacaaccatacgtacgttaccaaccgacaacacatcaatcgccccttcgcgaaaaatactacgcaccataaatcccacttcgtccatatacgcacaaatcatcaccttcgaacctatcgattcattcaaacgaatcaacaccgatcccaaaccatcaactcgcacttctttttacaaacgatccgcttcttccaacaaaatctaccgcacttcctattccgaaaaaacgatcgcatctacctcgctcaacgcttttaataacgataaatccattatacctctcccgtaaacaacactatttacgacataacgtaaaacacttctacgccttacgaaataaccaacacaacatcttcgatacgcacgcccccttaccctaacaaataaatccccgactccacgatcaataacatacctaactataacgtcgtaatatcccgcgataaccaacgcgaatcttcataaacttcaataccgataacgtaaccgatattataaccgacatcgtcgccataacctacctctaacataccccgacgcgcgacatcgacaaccgacgt

SEQ ID NO: 7751 - DNA, 1059 bp, Artificial Sequence
  chemically treated genomic DNA (Homo sapiens) CpG-island No: 7751
gttttggcggcgtaattagcgatttgtcgtttaatattagtatcggttcgttattaatttggcgatggttagtcgcgttataattaaagtttttcgtttagtaggcggtattaagtataatggcgacgttcggcgatatcgcgcgggtggtagtttgttcgtcgcgtaattttattttttcgttggaatttgttattagttatattttcgtaggtagttcggcgtcgtgtagttcgcgtagttgcgttattagtagatagtaatcgaggcggttattaaaggttttttttattattcgttggtgagggagaatttgaaaagtggtattaaacgtgacgcgatcgtcgggacgaattttcgtttgtattatttcgttataggagcgcgtattaatgtttacgcgtatggcgttgacgttatttttttgtcggtcgtcgttaagtaggtttggaattttgtattttttacgggtggtgatgcgtatcggttgtagttggcgggtagttatgcgtacgttgttaatcggtagtatattaatcgttttttcgcgggagatgttgcgtattataaattttatttcgtttatatgcgtatagattattattttcggatttgtcgatttatttaggcggattagtatcgattttagattattaattcgtatttttttttgtaggcgattcgttttttttagtaggatttgtcgtattttttgtttcgaggaggcgatcgtatttgtttcgtttaacgtttttaatagcgataaatttattatgtttttttcgtgagtaatattgtttacggtatggcgtagagtatttttgcgttttgcggggtaattagtataatattttcgatgcgtacgtttttttgttttggtaaataaattttcggttttacggttagtaatatgtttggttgtagcgtcgtggtgtttcgcggtgattaacgcggatttttatgaattttaatgtcgatagcgtgatcggtgttatgatcgatatcgtcgttataatttgtttttggtatgtttcggcgcgcggtatcgataatcggcgt

SEQ ID NO: 7752 - DNA, 1059 bp, Artificial Sequence
  chemically treated genomic DNA (Homo sapiens) CpG-island No: 7752
acgccgattatcgataccgcgcgccgaaacataccaaaaacaaattataacgacgatatcgatcataacaccgatcacgctatcgacattaaaattcataaaaatccgcgttaatcaccgcgaaacaccacgacgctacaaccaaacatattactaaccgtaaaaccgaaaatttatttaccaaaacaaaaaaacgtacgcatcgaaaatattatactaattaccccgcaaaacgcaaaaatactctacgccataccgtaaacaatattactcacgaaaaaaacataataaatttatcgctattaaaaacgttaaacgaaacaaatacgatcgcctcctcgaaacaaaaaatacgacaaatcctactaaaaaaaacgaatcgcctacaaaaaaaaatacgaattaataatctaaaatcgatactaatccgcctaaataaatcgacaaatccgaaaataataatctatacgcatataaacgaaataaaatttataatacgcaacatctcccgcgaaaaaacgattaatatactaccgattaacaacgtacgcataactacccgccaactacaaccgatacgcatcaccacccgtaaaaaatacaaaattccaaacctacttaacgacgaccgacaaaaaaataacgtcaacgccatacgcgtaaacattaatacgcgctcctataacgaaataatacaaacgaaaattcgtcccgacgatcgcgtcacgtttaataccacttttcaaattctccctcaccaacgaataataaaaaaaacctttaataaccgcctcgattactatctactaataacgcaactacgcgaactacacgacgccgaactacctacgaaaatataactaataacaaattccaacgaaaaaataaaattacgcgacgaacaaactaccacccgcgcgatatcgccgaacgtcgccattatacttaataccgcctactaaacgaaaaactttaattataacgcgactaaccatcgccaaattaataacgaaccgatactaatattaaacgacaaatcgctaattacgccgccaaaac

SEQ ID NO: 7753 - DNA, 602 bp, Artificial Sequence
  chemically treated genomic DNA (Homo sapiens) CpG-island No: 7753
gcgtttcgtggtagggattcgtcgcggtttttatttcgttttatacggtttttattttaagggggtaattgcggattttagagtagggtaggggcgcggagggttgcgtatttcggattcggagtttttttgggtttgtcgatttgttttacgtttagttttgttgttttttgtttcggtttatcgtttatcgggtcgtttcgtcgaagggtcggtttcgcggtgtttcggggtgtcgacgttttaagtttgatatgtgtagtattggcgttatttgtttagcgtttcgtacgttgtcgattcgggttttagggttcgcgcgttttttcggattcgtacgtttttacgtttatttgtgggcgttttggacgtttcggttaggacgtttattttcgcgttttcgggttatttattcgttacggtttttttgtagtcgtttgcgcggcgtatcgtgggtgtagattgagtaggcgttcgttagttgggggtggcggcgtttgtcgggtatcgcgtaggaaggataggtacgaaattaggtcggttgtggatttttgggtattgaagggatttgagtcgttgacgttgagttgtcggattgaaga

SEQ ID NO: 7754 - DNA, 602 bp, Artificial Sequence
  chemically treated genomic DNA (Homo sapiens) CpG-island No: 7754
tcttcaatccgacaactcaacgtcaacgactcaaatcccttcaatacccaaaaatccacaaccgacctaatttcgtacctatccttcctacgcgatacccgacaaacgccgccacccccaactaacgaacgcctactcaatctacacccacgatacgccgcgcaaacgactacaaaaaaaccgtaacgaataaataacccgaaaacgcgaaaataaacgtcctaaccgaaacgtccaaaacgcccacaaataaacgtaaaaacgtacgaatccgaaaaaacgcgcgaaccctaaaacccgaatcgacaacgtacgaaacgctaaacaaataacgccaatactacacatatcaaacttaaaacgtcgacaccccgaaacaccgcgaaaccgacccttcgacgaaacgacccgataaacgataaaccgaaacaaaaaacaacaaaactaaacgtaaaacaaatcgacaaacccaaaaaaactccgaatccgaaatacgcaaccctccgcgcccctaccctactctaaaatccgcaattacccccttaaaataaaaaccgtataaaacgaaataaaaaccgcgacgaatccctaccacgaaacgc

SEQ ID NO: 7755 - DNA, 602 bp, Artificial Sequence
  chemically treated genomic DNA (Homo sapiens) CpG-island No: 7755
tttttagttcggtaatttaacgttaacgatttaagtttttttagtgtttaagagtttatagtcgatttagtttcgtgtttgttttttttgcgcggtgttcggtagacgtcgttatttttagttggcgagcgtttgtttaatttatatttacggtacgtcgcgtagacggttgtagggaggtcgtgacgggtaaatggttcgaggacgcgggagtgaacgttttggtcgaggcgtttaggacgtttataaatggacgtaaaggcgtgcgagttcggaggagcgcgcggattttggggttcggatcggtaacgtgcgggacgttgaatagatggcgttagtgttgtatatgttaggtttgaggcgtcgatatttcgaagtatcgcggagtcggtttttcggcggggcggttcgatggacggtgagtcggagtagagggtagtaggattagacgtgagataagtcgatagatttaaagagatttcggattcgagatgcgtagtttttcgcgtttttgttttgttttggagttcgtagttatttttttgagatgggaatcgtatggaacggagtgggggtcgcggcggatttttgttacgaggcgt

SEQ ID NO: 7756 - DNA, 602 bp, Artificial Sequence
  chemically treated genomic DNA (Homo sapiens) CpG-island No: 7756
acgcctcgtaacaaaaatccgccgcgacccccactccgttccatacgattcccatctcaaaaaaataactacgaactccaaaacaaaacaaaaacgcgaaaaactacgcatctcgaatccgaaatctctttaaatctatcgacttatctcacgtctaatcctactaccctctactccgactcaccgtccatcgaaccgccccgccgaaaaaccgactccgcgatacttcgaaatatcgacgcctcaaacctaacatatacaacactaacgccatctattcaacgtcccgcacgttaccgatccgaaccccaaaatccgcgcgctcctccgaactcgcacgcctttacgtccatttataaacgtcctaaacgcctcgaccaaaacgttcactcccgcgtcctcgaaccatttacccgtcacgacctccctacaaccgtctacgcgacgtaccgtaaatataaattaaacaaacgctcgccaactaaaaataacgacgtctaccgaacaccgcgcaaaaaaaacaaacacgaaactaaatcgactataaactcttaaacactaaaaaaacttaaatcgttaacgttaaattaccgaactaaaaa

SEQ ID NO: 7757 - DNA, 642 bp, Artificial Sequence
  chemically treated genomic DNA (Homo sapiens) CpG-island No: 7757
  misc_feature (613)..(613): n is either a, c, g or t
ggagtcggagtcgttttcggttgcgttttgtttttgaatttcgattttcgtcggttttcgggaaaatcgtagcggggtagcgcgggcgttgtcggaatttgtagttttatttttcgtcgcgttaaatagtcggaaacgggggcggttagaatagagaattatcgaggcgaaggtacgggtggcggcgaggggttaattcgcgtcgggggcggggttggttgtgaggtcgtcggaggtggttgggtgggaggagattcgtttatatatacgaggaggagggttgagttgttgtcgtcgtcgtttttgtcgtcgtcgcgagtgtggagtcgggattggagttgttgtcgcggcgacgtcggggatttttgtcgttagttttcggtttttttgtttcgtcgtttttttttagttagcgttgtttattttttttcggtcgggcgtttttgtttttatttttcgttttttgtttattatatatacggttttttcgattatggattcgggtagtggcggcggcggcggcggcggcggcggcggcgggagtagtagcggtagtagtagtagcgattcggcgtttgattgttgggattaggcggatatggaagttttcggngtcgggggtttttgtgcggcggcgggcgg

SEQ ID NO: 7758 - DNA, 642 bp, Artificial Sequence
  chemically treated genomic DNA (Homo sapiens) CpG-island No: 7758
  misc_feature (30)..(30): n is either a, c, g or t
ccgcccgccgccgcacaaaaacccccgacnccgaaaacttccatatccgcctaatcccaacaatcaaacgccgaatcgctactactactaccgctactactcccgccgccgccgccgccgccgccgccgccgccactacccgaatccataatcgaaaaaaccgtatatataataaacaaaaaacgaaaaataaaaacaaaaacgcccgaccgaaaaaaaataaacaacgctaactaaaaaaaaacgacgaaacaaaaaaaccgaaaactaacgacaaaaatccccgacgtcgccgcgacaacaactccaatcccgactccacactcgcgacgacgacaaaaacgacgacgacaacaactcaaccctcctcctcgtatatataaacgaatctcctcccacccaaccacctccgacgacctcacaaccaaccccgcccccgacgcgaattaacccctcgccgccacccgtaccttcgcctcgataattctctattctaaccgcccccgtttccgactatttaacgcgacgaaaaataaaactacaaattccgacaacgcccgcgctaccccgctacgattttcccgaaaaccgacgaaaatcgaaattcaaaaacaaaacgcaaccgaaaacgactccgactcc

SEQ ID NO: 7759 - DNA, 642 bp, Artificial Sequence
  chemically treated genomic DNA (Homo sapiens) CpG-island No: 7759
  misc_feature (30)..(30): n is either a, c, g or t
tcgttcgtcgtcgtataagggttttcgatntcgggggtttttatgttcgtttggttttagtagttaggcgtcgagtcgttgttgttgttgtcgttgttgttttcgtcgtcgtcgtcgtcgtcgtcgtcgtcgttattgttcggatttatgatcgggggggtcgtgtgtgtggtggatagagagcgagaaatggaggtaggggcgttcggtcggagaggagtgggtaacgttgattgagggaaggcggcggggtagaagggtcgggagttagcgataaagattttcggcgtcgtcgcggtagtagttttagtttcgattttatattcgcgacgacgatagaggcggcggcggtagtagtttaattttttttttcgtgtgtgtgagcggatttttttttatttaattattttcgacggttttatagttaatttcgttttcggcgcggattgatttttcgtcgttattcgtattttcgtttcggtagttttttgttttggtcgttttcgttttcggttatttagcgcggcgggaggtggaattataagtttcggtagcgttcgcgttatttcgttgcggttttttcgggggtcgacgggagtcgaagtttagggatagggcgtaatcggaagcggtttcggtttt

SEQ ID NO: 7760 - DNA, 642 bp, Artificial Sequence
  chemically treated genomic DNA (Homo sapiens) CpG-island No: 7760
  misc_feature (613)..(613): n is either a, c, g or t
aaaaccgaaaccgcttccgattacgccctatccctaaacttcgactcccgtcgacccccgaaaaaaccgcaacgaaataacgcgaacgctaccgaaacttataattccacctcccgccgcgctaaataaccgaaaacgaaaacgaccaaaacaaaaaactaccgaaacgaaaatacgaataacgacgaaaaatcaatccgcgccgaaaacgaaattaactataaaaccgtcgaaaataattaaataaaaaaaaatccgctcacacacacgaaaaaaaaaattaaactactaccgccgccgcctctatcgtcgtcgcgaatataaaatcgaaactaaaactactaccgcgacgacgccgaaaatctttatcgctaactcccgacccttctaccccgccgccttccctcaatcaacgttacccactcctctccgaccgaacgcccctacctccatttctcgctctctatccaccacacacacgacccccccgatcataaatccgaacaataacgacgacgacgacgacgacgacgacgacgaaaacaacaacgacaacaacaacaacgactcgacgcctaactactaaaaccaaacgaacataaaaacccccganatcgaaaacccttatacgacgacgaacga

SEQ ID NO: 7761 - DNA, 636 bp, Artificial Sequence
  chemically treated genomic DNA (Homo sapiens) CpG-island No: 7761
ttttttcgttggacgttgttttattttttagcgtttttgtttaggtcgcggtttaggcgaggttttagaaaatttcggtgttggttaattagttttgagttcgagcgcgtttagtgcgtaacgtggtttttttattggtttatttagtgggtcgcgcgtcgacgtcggggtttcggattgaacggcgcgtttaggtttttgtttttagttagacgtggcgttatcgtttttagttcgtagtttcggcgtagttaatggcggcgtttttcgggcggtaagcgcggtttttcgtcgttagagggcgtcgtcgcgggcgtaatcgagtcgttgtcgtcgtcgttaatcgagggagagttgcgagcgagtatttaggtttcgtcgtcgtcgtcgttatcgttgttcgtttgtcgtcgttcgttttcgtttgttttttgtcgtcggtcggcgcgtcgtttttataggtaggggtaaggggacgtcgtcgggtatgaaggaaacgcgcgcgttcgcgttttcgattttttcgagcgcgtcgtcgtttcgtgttcgcgcgcggaacgttaacggacggcgggcggggcgggggagagggcggaggagttcggggttcgcggaatcgagaggaatttgaaaaga

SEQ ID NO: 7762 - DNA, 636 bp, Artificial Sequence
  chemically treated genomic DNA (Homo sapiens) CpG-island No: 7762
tcttttcaaattcctctcgattccgcgaaccccgaactcctccgccctctcccccgccccgcccgccgtccgttaacgttccgcgcgcgaacacgaaacgacgacgcgctcgaaaaaatcgaaaacgcgaacgcgcgcgtttccttcatacccgacgacgtccccttacccctacctataaaaacgacgcgccgaccgacgacaaaaaacaaacgaaaacgaacgacgacaaacgaacaacgataacgacgacgacgacgaaacctaaatactcgctcgcaactctccctcgattaacgacgacgacaacgactcgattacgcccgcgacgacgccctctaacgacgaaaaaccgcgcttaccgcccgaaaaacgccgccattaactacgccgaaactacgaactaaaaacgataacgccacgtctaactaaaaacaaaaacctaaacgcgccgttcaatccgaaaccccgacgtcgacgcgcgacccactaaataaaccaataaaaaaaccacgttacgcactaaacgcgctcgaactcaaaactaattaaccaacaccgaaattttctaaaacctcgcctaaaccgcgacctaaacaaaaacgctaaaaaataaaacaacgtccaacgaaaaaa

SEQ ID NO: 7763 - DNA, 636 bp, Artificial Sequence
  chemically treated genomic DNA (Homo sapiens) CpG-island No: 7763
tttttttaggtttttttcggtttcgcgggtttcggattttttcgttttttttttcgtttcgttcgtcgttcgttaacgtttcgcgcgcgagtacgaggcggcggcgcgttcgggggggtcgggggcgcgggcgcgcgcgttttttttatgttcggcggcgtttttttatttttatttgtggggacgacgcgtcggtcggcggtagaaggtaggcggaggcgggcggcggtaggcgggtagcggtggcggcggcggcggcggggtttgggtgttcgttcgtagttttttttcggttagcggcggcggtagcggttcggttgcgttcgcggcggcgttttttagcggcgggaggtcgcgtttgtcgttcgggagacgtcgttattggttgcgtcggagttacgggttgggggcggtggcgttacgtttgattgggggtagggatttgggcgcgtcgtttaattcggagtttcggcgtcgacgcgcggtttattgggtgagttaatgggaaggttacgttgcgtattggacgcgttcggatttaagattgattaattagtatcggggttttttggggtttcgtttgggtcgcggtttgagtagaagcgttaggaggtagaatagcgtttagcggggaga

SEQ ID NO: 7764 - DNA, 636 bp, Artificial Sequence
  chemically treated genomic DNA (Homo sapiens) CpG-island No: 7764
tctccccgctaaacgctattctacctcctaacgcttctactcaaaccgcgacccaaacgaaaccccaaaaaaccccgatactaattaatcaatcttaaatccgaacgcgtccaatacgcaacgtaaccttcccattaactcacccaataaaccgcgcgtcgacgccgaaactccgaattaaacgacgcgcccaaatccctacccccaatcaaacgtaacgccaccgcccccaacccgtaactccgacgcaaccaataacgacgtctcccgaacgacaaacgcgacctcccgccgctaaaaaacgccgccgcgaacgcaaccgaaccgctaccgccgccgctaaccgaaaaaaaactacgaacgaacacccaaaccccgccgccgccgccgccaccgctacccgcctaccgccgcccgcctccgcctaccttctaccgccgaccgacgcgtcgtccccacaaataaaaataaaaaaacgccgccgaacataaaaaaaacgcgcgcgcccgcgcccccgacccccccgaacgcgccgccgcctcgtactcgcgcgcgaaacgttaacgaacgacgaacgaaacgaaaaaaaaaacgaaaaaatccgaaacccgcgaaaccgaaaaaaacctaaaaaaa

SEQ ID NO: 7765 - DNA, 503 bp, Artificial Sequence
  chemically treated genomic DNA (Homo sapiens) CpG-island No: 7765
tcgtcgaaagtttgtaacgcggatattttaggatagagaattgttaacgaatcgttgggtttaggttatttttgattttttattgaagggtcgcgttttgtttcgtgaatgcgttagcgtcggtaattagttaggcgacgtttttacgttttgtgttagagaagatcggggattcgttttggtaaagtacgggtaacgcgatatgtattgttgcgttttatcgcggaattgagcgtattttcgtttggcgggtggacgatatcggaaagcgtataaattcgtcgatattcggttgtgttggtcgtagggaagttgtcggtaataggcgtagatggcgacgaatagtggtttgatggtttgttttggatttgatcgattttcgatcgtagggttttttagggcgcgcgtggggtagaagttagtcgcgtaattgaatttgattgatgatatacgtttttggtaggagaagatgtgttttacgttttgatcgtatttaacggtga

SEQ ID NO: 7766 - DNA, 503 bp, Artificial Sequence
  chemically treated genomic DNA (Homo sapiens) CpG-island No: 7766
tcaccgttaaatacgatcaaaacgtaaaacacatcttctcctaccaaaaacgtatatcatcaatcaaattcaattacgcgactaacttctaccccacgcgcgccctaaaaaaccctacgatcgaaaatcgatcaaatccaaaacaaaccatcaaaccactattcgtcgccatctacgcctattaccgacaacttccctacgaccaacacaaccgaatatcgacgaatttatacgctttccgatatcgtccacccgccaaacgaaaatacgctcaattccgcgataaaacgcaacaatacatatcgcgttacccgtactttaccaaaacgaatccccgatcttctctaacacaaaacgtaaaaacgtcgcctaactaattaccgacgctaacgcattcacgaaacaaaacgcgacccttcaataaaaaatcaaaaataacctaaacccaacgattcgttaacaattctctatcctaaaatatccgcgttacaaactttcgacga

SEQ ID NO: 7767 - DNA, 503 bp, Artificial Sequence
  chemically treated genomic DNA (Homo sapiens) CpG-island No: 7767
ttatcgttaaatacggttagggcgtagagtatatttttttttgttagagacgtatattattagttagatttagttgcgcggttaatttttgttttacgcgcgttttaaaaagttttgcggtcggagatcggttaaatttagggtaaattattaaattattgttcgtcgttatttgcgtttgttatcgataatttttttgcggttagtataatcggatgtcggcgaatttatgcgtttttcggtatcgtttattcgttagacgggaatacgtttaatttcgcgataggacgtagtagtgtatatcgcgttgttcgtgttttattaaagcgaattttcgattttttttggtataaggcgtgagaacgtcgtttgattgattgtcgacgttggcgtatttacggggtagaacgcggttttttagtaaaagattagaagtagtttggatttagcggttcgttgatagttttttgttttgggatattcgcgttgtagattttcgacgg

SEQ ID NO: 7768 - DNA, 503 bp, Artificial Sequence
  chemically treated genomic DNA (Homo sapiens) CpG-island No: 7768
ccgtcgaaaatctacaacgcgaatatcccaaaacaaaaaactatcaacgaaccgctaaatccaaactacttctaatcttttactaaaaaaccgcgttctaccccgtaaatacgccaacgtcgacaatcaatcaaacgacgttctcacgccttataccaaaaaaaatcgaaaattcgctttaataaaacacgaacaacgcgatatacactactacgtcctatcgcgaaattaaacgtattcccgtctaacgaataaacgataccgaaaaacgcataaattcgccgacatccgattatactaaccgcaaaaaaattatcgataacaaacgcaaataacgacgaacaataatttaataatttaccctaaatttaaccgatctccgaccgcaaaactttttaaaacgcgcgtaaaacaaaaattaaccgcgcaactaaatctaactaataatatacgtctctaacaaaaaaaaatatactctacgccctaaccgtatttaacgataa

SEQ ID NO: 7769 - DNA, 584 bp, Artificial Sequence
  chemically treated genomic DNA (Homo sapiens) CpG-island No: 7769
gcgtttggattaatttattgtcgtcgttgcgcggcggtatcgtaggacgtggtaacgtggtataggttttttacgcgtattttttttaaggaatacgggttcgagtattcgtttgttaggggtaattagtgtatagtttaatgtcgggttattatgtatcgagtgcgttttgttggtttagttaatgatggcgcgtaacgagttgttttatcggttatgtcggtaggtcgggtgggtataaagtttagaaattgtgtcgatattagttttgaagattgtcgcgttgtttttatacggattttaagagtttagatcgcgtattgagcgtcggtcgtggtgttaggaagtttattttcgattggcggtaattattgtggcggggaaatttacgttgcgattgtaaacgttgtcgtaaattggttagtagatgtttacgttgtatgttatcggcgaagagtcgttgtaatacggcggtaaatgcgcgtttatcgttttggtttgtcgattgataattttaatagttgtcggaaattagtatcgaatagatttgtttgattgtcgaagaagagaatcgaagttgatgg

SEQ ID NO: 7770 - DNA, 584 bp, Artificial Sequence
  chemically treated genomic DNA (Homo sapiens) CpG-island No: 7770
ccatcaacttcgattctcttcttcgacaatcaaacaaatctattcgatactaatttccgacaactattaaaattatcaatcgacaaaccaaaacgataaacgcgcatttaccgccgtattacaacgactcttcgccgataacatacaacgtaaacatctactaaccaatttacgacaacgtttacaatcgcaacgtaaatttccccgccacaataattaccgccaatcgaaaataaacttcctaacaccacgaccgacgctcaatacgcgatctaaactcttaaaatccgtataaaaacaacgcgacaatcttcaaaactaatatcgacacaatttctaaactttatacccacccgacctaccgacataaccgataaaacaactcgttacgcgccatcattaactaaaccaacaaaacgcactcgatacataataacccgacattaaactatacactaattacccctaacaaacgaatactcgaacccgtattccttaaaaaaaatacgcgtaaaaaacctataccacgttaccacgtcctacgataccgccgcgcaacgacgacaataaattaatccaaacgc

SEQ ID NO: 7771 - DNA, 584 bp, Artificial Sequence
  chemically treated genomic DNA (Homo sapiens) CpG-island No: 7771
ttattagtttcggttttttttttcggtaattaggtagatttgttcgatgttggttttcgataattattgagattgttagtcggtaggttaaggcgatgagcgcgtatttgtcgtcgtgttgtagcgatttttcgtcggtgatatatagcgtggatatttgttggttagtttgcgatagcgtttgtagtcgtagcgtggattttttcgttatagtggttatcgttaatcgagaatggattttttggtattacggtcggcgtttagtacgcggtttgaatttttaaaattcgtgtggaaataacgcggtagtttttaaggttgatatcggtatagtttttggattttatgtttattcggtttatcggtatagtcggtgaagtagttcgttacgcgttattattggttgagttagtaagacgtattcggtgtatggtgattcggtattgaattgtgtattgattgtttttgataagcggatattcgggttcgtattttttaaaaaaaatgcgcgtaaggagtttgtgttacgttattacgttttgcggtgtcgtcgcgtagcggcgataataaattgatttaggcgt

SEQ ID NO: 7772 - DNA, 584 bp, Artificial Sequence
  chemically treated genomic DNA (Homo sapiens) CpG-island No: 7772
acgcctaaatcaatttattatcgccgctacgcgacgacaccgcaaaacgtaataacgtaacacaaactccttacgcgcattttttttaaaaaatacgaacccgaatatccgcttatcaaaaacaatcaatacacaattcaataccgaatcaccatacaccgaatacgtcttactaactcaaccaataataacgcgtaacgaactacttcaccgactataccgataaaccgaataaacataaaatccaaaaactataccgatatcaaccttaaaaactaccgcgttatttccacacgaattttaaaaattcaaaccgcgtactaaacgccgaccgtaataccaaaaaatccattctcgattaacgataaccactataacgaaaaaatccacgctacgactacaaacgctatcgcaaactaaccaacaaatatccacgctatatatcaccgacgaaaaatcgctacaacacgacgacaaatacgcgctcatcgccttaacctaccgactaacaatctcaataattatcgaaaaccaacatcgaacaaatctacctaattaccgaaaaaaaaaaccgaaactaataa

SEQ ID NO: 7773 - DNA, 860 bp, Artificial Sequence
  chemically treated genomic DNA (Homo sapiens) CpG-island No: 7773
cgtttggtagcgtggcgtaggtgcgtgaaacggcggttttttgatacgtttcgttaaaacgcgcggtgtggcgattgttatggtggggacgtaattaaagatggttcgttggttggttcgaaagtgttggaatattgatcgattgttcggtgtttttggatggcgatgtcgattttcgttttcgtatttgcgtagttataaaaatcgtttcggcgcggtgaatgagttgggcgtttcgcgatgatcgaataggggttgcgtgaagttagtaatttttcggtaattttttaagtcgcggcgatgaagtgattttcggtagtttagtgatggtggatgggaaggaacgcgtttattgttggtggagatttaggcgttggtcgatattcgatgatggcgaatttacgtcgtgtggtagtggggttggaataaaacgttatgggaattttgttggttgtgttgtatcgttaaggtggttttgaatgggcgattaagatgtgtttgtgaacgtggtcggcggcgtgaaggtgacgaaattagtggcgatttagagttattgttggcgatggtttttatatcggcgaaagaacgttggcgtaggaatttggggtggttggggaatttcgtcggagcggaaaatttcgggcggttacggttaataaagatttttgacggggcgcgggttttcgggaaatatcgcgcggttaggtcgaaaaaggcggggagagttgtgaattttgcgtagtgtgttagttttagtgtaagtgttacgggaatattatagttagcgaacgtttgggtcgtttatgttttacggttggcgacgttagtaaagtgcggataacggtagaatttttacgtta

SEQ ID NO: 7774 - DNA, 860 bp, Artificial Sequence
  chemically treated genomic DNA (Homo sapiens) CpG-island No: 7774
taacgtaaaaattctaccgttatccgcactttactaacgtcgccaaccgtaaaacataaacgacccaaacgttcgctaactataatattcccgtaacacttacactaaaactaacacactacgcaaaattcacaactctccccgcctttttcgacctaaccgcgcgatatttcccgaaaacccgcgccccgtcaaaaatctttattaaccgtaaccgcccgaaattttccgctccgacgaaattccccaaccaccccaaattcctacgccaacgttctttcgccgatataaaaaccatcgccaacaataactctaaatcgccactaatttcgtcaccttcacgccgccgaccacgttcacaaacacatcttaatcgcccattcaaaaccaccttaacgatacaacacaaccaacaaaattcccataacgttttattccaaccccactaccacacgacgtaaattcgccatcatcgaatatcgaccaacgcctaaatctccaccaacaataaacgcgttccttcccatccaccatcactaaactaccgaaaatcacttcatcgccgcgacttaaaaaattaccgaaaaattactaacttcacgcaacccctattcgatcatcgcgaaacgcccaactcattcaccgcgccgaaacgatttttataactacgcaaatacgaaaacgaaaatcgacatcgccatccaaaaacaccgaacaatcgatcaatattccaacactttcgaaccaaccaacgaaccatctttaattacgtccccaccataacaatcgccacaccgcgcgttttaacgaaacgtatcaaaaaaccgccgtttcacgcacctacgccacgctaccaaacg

SEQ ID NO: 7775 - DNA, 860 bp, Artificial Sequence
  chemically treated genomic DNA (Homo sapiens) CpG-island No: 7775
tggcgtaaaaattttatcgttattcgtattttgttgacgtcgttagtcgtgaaatataaacggtttagacgttcgttggttgtaatattttcgtagtatttgtattaaaattgatatattgcgtagggtttatagtttttttcgtttttttcggtttgatcgcgcgatatttttcggagattcgcgtttcgttaagagtttttgttagtcgtggtcgttcgggatttttcgtttcggcggggttttttaattattttaggtttttgcgttagcgttttttcgtcggtgtggaaattatcgttagtagtaattttaagtcgttattggtttcgttatttttacgtcgtcgattacgtttataaatatattttgatcgtttatttaagattattttgacggtgtaatatagttagtaggatttttatgacgttttgttttagttttattgttatacggcgtgggttcgttattatcgagtatcgattagcgtttgaatttttattagtagtggacgcgtttttttttatttattattattgagttatcggaggttattttatcgtcgcgatttaagaaattgtcgaagggttgttgattttacgtagtttttgttcggttatcgcgagacgtttagtttatttatcgcgtcgaagcggtttttatggttgcgtaagtgcgaaaacgggagtcggtatcgttatttaaaagtatcgaatagtcgattagtgttttagtattttcgggttagttagcgaattatttttggttacgtttttattatgataatcgttatatcgcgcgttttggcgaagcgtgttaaaaagtcgtcgttttacgtatttgcgttacgttattaggcg

SEQ ID NO: 7776 - DNA, 860 bp, Artificial Sequence
  chemically treated genomic DNA (Homo sapiens) CpG-island No: 7776
cgcctaataacgtaacgcaaatacgtaaaacgacgactttttaacacgcttcgccaaaacgcgcgatataacgattatcataataaaaacgtaaccaaaaataattcgctaactaacccgaaaatactaaaacactaatcgactattcgatacttttaaataacgataccgactcccgttttcgcacttacgcaaccataaaaaccgcttcgacgcgataaataaactaaacgtctcgcgataaccgaacaaaaactacgtaaaatcaacaacccttcgacaatttcttaaatcgcgacgataaaataacctccgataactcaataataataaataaaaaaaaacgcgtccactactaataaaaattcaaacgctaatcgatactcgataataacgaacccacgccgtataacaataaaactaaaacaaaacgtcataaaaatcctactaactatattacaccgtcaaaataatcttaaataaacgatcaaaatatatttataaacgtaatcgacgacgtaaaaataacgaaaccaataacgacttaaaattactactaacgataatttccacaccgacgaaaaaacgctaacgcaaaaacctaaaataattaaaaaaccccgccgaaacgaaaaatcccgaacgaccacgactaacaaaaactcttaacgaaacgcgaatctccgaaaaatatcgcgcgatcaaaccgaaaaaaacgaaaaaaactataaaccctacgcaatatatcaattttaatacaaatactacgaaaatattacaaccaacgaacgtctaaaccgtttatatttcacgactaacgacgtcaacaaaatacgaataacgataaaatttttacgcca

SEQ ID NO: 7777 - DNA, 1509 bp, Artificial Sequence
  chemically treated genomic DNA (Homo sapiens) CpG-island No: 7777
cgttatcggcgaattaaagtcgacgcggtgcgcggtttcggcggcgaagtgttgttttacgcgcgaatttgatgaagcgaaagttaaagcgatcgaattgttatagtagcggggtttatttgggtgtcgtcgttcgattattcgatggtgattgtcgggaaggtacgttggcgttggaattgttttagtaggacgtttatttcgatcggtatttgtgttagtcggcggcggcggtttggttgttggcgtggcggtgcgattaaataattgatgtcgtaaattaaagtgatcgtcgtagaagcggaaatttcgtttgtttgaaagtagcgttggatgcgggttattcggttgattttcgcgcgtagggttatttgttgaaggcgtagcggtaaaacgtatcggtgcgaaatttttcgtttatgttaggagtatttcgacgatattattatcgttatagcgatgcgatttgtgcggcgatgaaggatttattcgaagatgtgcggcggtggcggaattttttggcgcgttggcgttggcgggaatgaaaaaattatcgttttgtataatattcgcggcgaacggttggcgtatatttttttcgtgttaacgtgaatttttacgatttgcgatacgttttagtacgttgcgtttgggcgaatagcgtgaagcgttgttgtcggtgattatttcggaagaaaagttagtttttttagattttgttaattgtttggcgggcgttcggttattagtttaattatcgttttgtcgatgttaaaaaacgtttgtatttttttcgtgtgcgtttgagtcgcggtttcgaagagcgtaaagaaattttgtagatgttaacgacggcggttatagcgtggttgattttttcgacgacgaaatggtaagttatacgtgcgttatatggtcggcggacgtttatcgtattcgttgcggaacgtttttatagtttcgaattttcggaattatcgggcgcgttgttggtttttttaatacgttgggtacgtattggaatatttttttgttttattacgtagttatggtatcgattacgggcgcgtattggcggcgttcgaatttgcgattatgaatcggatttcgaaattcggttgaatgagttgggttacgatgttacgacgaaattatatattcggcgtttaggttttttttggcgggttaggaaaaatgtttgatacgcgtttcgtttattacggtttattcgcgcgatcgttatttgtgtttcggcgaattttttagaatatatttaattggcgggttagttagtattttgtttaatagtttgcgtatattgtgcggtttacgtagttgttttcggtttttttcggtattattataaatttaaagcgacgtatcgtatgggtagcgcggtagaaatatacgggcgtatcggatcgtaatataaatagaatgcggcgtatttaacggatcgttggcgatatttattataatttattgatgggcgtagttttatttttaaat

SEQ ID NO: 7778 - DNA, 1509 bp, Artificial Sequence
  chemically treated genomic DNA (Homo sapiens) CpG-island No: 7778
atttaaaaataaaactacgcccatcaataaattataataaatatcgccaacgatccgttaaatacgccgcattctatttatattacgatccgatacgcccgtatatttctaccgcgctacccatacgatacgtcgctttaaatttataataataccgaaaaaaaccgaaaacaactacgtaaaccgcacaatatacgcaaactattaaacaaaatactaactaacccgccaattaaatatattctaaaaaattcgccgaaacacaaataacgatcgcgcgaataaaccgtaataaacgaaacgcgtatcaaacatttttcctaacccgccaaaaaaaacctaaacgccgaatatataatttcgtcgtaacatcgtaacccaactcattcaaccgaatttcgaaatccgattcataatcgcaaattcgaacgccgccaatacgcgcccgtaatcgataccataactacgtaataaaacaaaaaaatattccaatacgtacccaacgtattaaaaaaaccaacaacgcgcccgataattccgaaaattcgaaactataaaaacgttccgcaacgaatacgataaacgtccgccgaccatataacgcacgtataacttaccatttcgtcgtcgaaaaaatcaaccacgctataaccgccgtcgttaacatctacaaaatttctttacgctcttcgaaaccgcgactcaaacgcacacgaaaaaaatacaaacgttttttaacatcgacaaaacgataattaaactaataaccgaacgcccgccaaacaattaacaaaatctaaaaaaactaacttttcttccgaaataatcaccgacaacaacgcttcacgctattcgcccaaacgcaacgtactaaaacgtatcgcaaatcgtaaaaattcacgttaacacgaaaaaaatatacgccaaccgttcgccgcgaatattatacaaaacgataattttttcattcccgccaacgccaacgcgccaaaaaattccgccaccgccgcacatcttcgaataaatccttcatcgccgcacaaatcgcatcgctataacgataataatatcgtcgaaatactcctaacataaacgaaaaatttcgcaccgatacgttttaccgctacgccttcaacaaataaccctacgcgcgaaaatcaaccgaataacccgcatccaacgctactttcaaacaaacgaaatttccgcttctacgacgatcactttaatttacgacatcaattatttaatcgcaccgccacgccaacaaccaaaccgccgccgccgactaacacaaataccgatcgaaataaacgtcctactaaaacaattccaacgccaacgtaccttcccgacaatcaccatcgaataatcgaacgacgacacccaaataaaccccgctactataacaattcgatcgctttaactttcgcttcatcaaattcgcgcgtaaaacaacacttcgccgccgaaaccgcgcaccgcgtcgactttaattcgccgataacg

SEQ ID NO: 7779 - DNA, 1509 bp, Artificial Sequence
  chemically treated genomic DNA (Homo sapiens) CpG-island No: 7779
gtttgaaggtaaaattgcgtttattagtggattgtggtagatatcgttaacgattcgttaagtacgtcgtattttatttgtgttgcgattcggtgcgttcgtatgtttttgtcgcgttgtttatgcggtacgtcgttttgaatttatggtgatgtcgggagaaatcgaaggtagttgcgtgagtcgtataatatgcgtaagttgttaagtaaagtgttggttgattcgttaattgagtgtattttggaagattcgtcgaagtataaatgacggtcgcgcgggtaggtcgtgataagcgaagcgcgtattaggtattttttttaattcgttaaaaagaatttgaacgtcgggtgtatggtttcgtcgtggtatcgtagtttagtttatttagtcgggtttcgaaattcggtttatggtcgtaagttcgaacgtcgttagtacgcgttcgtagtcggtgttatggttgcgtagtggaataaagaaatgttttagtacgtatttagcgtgttgaggaagttagtagcgcgttcggtgatttcgggaattcgaagttgtagaggcgtttcgtaacggatgcgatggacgttcgtcgattatatagcgtacgtgtagtttgttatttcgtcgtcggagagattaattacgttgtagtcgtcgtcgttgatatttgtaaaatttttttgcgtttttcgaggtcgcggtttaggcgtatacgagaaagatgtaggcgttttttggtatcggtaaaacggtagttgaattggtgatcgaacgttcgttaagtagttggtagaatttgaggaagttgatttttttttcggaatggttatcggtaataacgttttacgttgttcgtttaggcgtagcgtattgagacgtatcgtaggtcgtggaagtttacgttggtacggaaagaatatgcgttagtcgttcgtcgcgaatgttgtgtagggcgataatttttttattttcgttagcgttagcgcgttagagggtttcgttatcgtcgtatattttcgaataaattttttatcgtcgtatagatcgtatcgttatgacggtgatgatgtcgtcgagatatttttggtataaacggaaggtttcgtatcgatgcgttttatcgttacgtttttagtaaatagttttacgcgcggagattaatcggatgattcgtatttagcgttgtttttaggtaggcggagttttcgtttttacggcgattattttgatttgcggtattagttgtttgatcgtatcgttacgttagtagttagatcgtcgtcgtcgattggtataaatatcggtcgagatgggcgttttgttggagtagttttagcgttagcgtgttttttcggtaattattatcggatggtcgaacggcggtatttaggtgaatttcgttgttgtgatagttcgatcgttttggttttcgttttattaagttcgcgcgtggagtagtatttcgtcgtcgaagtcgcgtatcgcgtcgattttgattcgtcggtggcg

SEQ ID NO: 7780 - DNA, 1509 bp, Artificial Sequence
  chemically treated genomic DNA (Homo sapiens) CpG-island No: 7780
cgccaccgacgaatcaaaatcgacgcgatacgcgacttcgacgacgaaatactactccacgcgcgaacttaataaaacgaaaaccaaaacgatcgaactatcacaacaacgaaattcacctaaataccgccgttcgaccatccgataataattaccgaaaaaacacgctaacgctaaaactactccaacaaaacgcccatctcgaccgatatttataccaatcgacgacgacgatctaactactaacgtaacgatacgatcaaacaactaataccgcaaatcaaaataatcgccgtaaaaacgaaaactccgcctacctaaaaacaacgctaaatacgaatcatccgattaatctccgcgcgtaaaactatttactaaaaacgtaacgataaaacgcatcgatacgaaaccttccgtttataccaaaaatatctcgacgacatcatcaccgtcataacgatacgatctatacgacgataaaaaatttattcgaaaatatacgacgataacgaaaccctctaacgcgctaacgctaacgaaaataaaaaaattatcgccctacacaacattcgcgacgaacgactaacgcatattctttccgtaccaacgtaaacttccacgacctacgatacgtctcaatacgctacgcctaaacgaacaacgtaaaacgttattaccgataaccattccgaaaaaaaaatcaacttcctcaaattctaccaactacttaacgaacgttcgatcaccaattcaactaccgttttaccgataccaaaaaacgcctacatctttctcgtatacgcctaaaccgcgacctcgaaaaacgcaaaaaaattttacaaatatcaacgacgacgactacaacgtaattaatctctccgacgacgaaataacaaactacacgtacgctatataatcgacgaacgtccatcgcatccgttacgaaacgcctctacaacttcgaattcccgaaatcaccgaacgcgctactaacttcctcaacacgctaaatacgtactaaaacatttctttattccactacgcaaccataacaccgactacgaacgcgtactaacgacgttcgaacttacgaccataaaccgaatttcgaaacccgactaaataaactaaactacgataccacgacgaaaccatacacccgacgttcaaattctttttaacgaattaaaaaaaatacctaatacgcgcttcgcttatcacgacctacccgcgcgaccgtcatttatacttcgacgaatcttccaaaatacactcaattaacgaatcaaccaacactttacttaacaacttacgcatattatacgactcacgcaactaccttcgatttctcccgacatcaccataaattcaaaacgacgtaccgcataaacaacgcgacaaaaacatacgaacgcaccgaatcgcaacacaaataaaatacgacgtacttaacgaatcgttaacgatatctaccacaatccactaataaacgcaattttaccttcaaac

SEQ ID NO: 7781 - DNA, 580 bp, Artificial Sequence
  chemically treated genomic DNA (Homo sapiens) CpG-island No: 7781
atttcggtttggtggaagcgtaacgtgagcgtatagttaacgcgttagtattatttatgtagttggaattattattcgatagtgtgtatggtcgcggcgtaaaattttttattatataagtatatcgttgcgttttaattcggtttcggttcgcgattttttgacgaattgttggcgttggtggtatatttattacgttaaacgaaacggaagttagtaaaagtttatcggtattcgtgttgaaattgatgaatatgtagcgtaaggcggcgtaggtattgtatgttttcggtattcgtttttattgatttattttaggtatagtcgaggtagttatgggtttagcgtcgttggtgaaggttagcgcgtatttgaatttcgggtgtaggttgtcgatatttagttgtcggagatatttttatcggtgcgtaaattacggtatagttggagtaaacgtataggtagaggagtatcgatagtttagttgacgttgagatgtcgaattagtaaagggtataatattcgaacgaggcgtgatagtatcgagaaataaataagcgatataggaagttgttgagta

SEQ ID NO: 7782 - DNA, 580 bp, Artificial Sequence
  chemically treated genomic DNA (Homo sapiens) CpG-island No: 7782
tactcaacaacttcctatatcgcttatttatttctcgatactatcacgcctcgttcgaatattataccctttactaattcgacatctcaacgtcaactaaactatcgatactcctctacctatacgtttactccaactataccgtaatttacgcaccgataaaaatatctccgacaactaaatatcgacaacctacacccgaaattcaaatacgcgctaaccttcaccaacgacgctaaacccataactacctcgactatacctaaaataaatcaataaaaacgaataccgaaaacatacaatacctacgccgccttacgctacatattcatcaatttcaacacgaataccgataaacttttactaacttccgtttcgtttaacgtaataaatataccaccaacgccaacaattcgtcaaaaaatcgcgaaccgaaaccgaattaaaacgcaacgatatacttatataataaaaaattttacgccgcgaccatacacactatcgaataataattccaactacataaataatactaacgcgttaactatacgctcacgttacgcttccaccaaaccgaaat

SEQ ID NO: 7783 - DNA, 580 bp, Artificial Sequence
  chemically treated genomic DNA (Homo sapiens) CpG-island No: 7783
tgtttaataattttttgtatcgtttgtttatttttcgatgttgttacgtttcgttcggatgttgtgttttttattggttcggtattttagcgttagttgggttgtcggtgtttttttgtttatgcgtttgttttagttatgtcgtgatttacgtatcggtaaaggtattttcggtagttaggtatcgatagtttgtattcggaatttaggtacgcgttgatttttattagcgacgttgagtttatgattatttcgattgtgtttgaagtgaattagtaaggacggatatcgggggtatgtagtatttgcgtcgttttgcgttgtatgtttattagttttaatacgaatatcggtgagtttttgttggttttcgtttcgtttggcgtaatgaatgtgttattagcgttagtagttcgttaggaagtcgcgagtcggagtcgggttgaagcgtaacgatatgtttatgtgatgggggattttgcgtcgcggttatgtatattgtcgagtggtgattttagttgtatgaataatgttgacgcgttggttatacgtttacgttgcgtttttattaggtcggggt

SEQ ID NO: 7784 - DNA, 580 bp, Artificial Sequence
  chemically treated genomic DNA (Homo sapiens) CpG-island No: 7784
accccgacctaataaaaacgcaacgtaaacgtataaccaacgcgtcaacattattcatacaactaaaatcaccactcgacaatatacataaccgcgacgcaaaatcccccatcacataaacatatcgttacgcttcaacccgactccgactcgcgacttcctaacgaactactaacgctaataacacattcattacgccaaacgaaacgaaaaccaacaaaaactcaccgatattcgtattaaaactaataaacatacaacgcaaaacgacgcaaatactacatacccccgatatccgtccttactaattcacttcaaacacaatcgaaataatcataaactcaacgtcgctaataaaaatcaacgcgtacctaaattccgaatacaaactatcgatacctaactaccgaaaatacctttaccgatacgtaaatcacgacataactaaaacaaacgcataaacaaaaaaacaccgacaacccaactaacgctaaaataccgaaccaataaaaaacacaacatccgaacgaaacgtaacaacatcgaaaaataaacaaacgatacaaaaaattattaaaca

SEQ ID NO: 7785 - DNA, 923 bp, Artificial Sequence
  chemically treated genomic DNA (Homo sapiens) CpG-island No: 7785
  misc_feature (835)..(836): n is either a, c, g or t
  misc_feature (848)..(849): n is either a, c, g or t
  misc_feature (856)..(858): n is either a, c, g or t
  misc_feature (863)..(863): n is either a, c, g or t
  misc_feature (870)..(871): n is either a, c, g or t
  misc_feature (880)..(881): n is either a, c, g or t
  misc_feature (890)..(891): n is either a, c, g or t
  misc_feature (893)..(893): n is either a, c, g or t
  misc_feature (895)..(895): n is either a, c, g or t
  misc_feature (899)..(899): n is either a, c, g or t
  misc_feature (903)..(904): n is either a, c, g or t
  misc_feature (917)..(917): n is either a, c, g or t
gcgtagggattaggattacggttcggagggtttagtggttataattcgggttggtttaattgtcgggtattaatatgtttggacgaaaattgtgggtggtcgatagtggttttggttgcggtttcgtttgtgttttgagttgttaggcgttaattgattttgcgtgacgttgtcgttcgttgtgttttttttttttattcgttttagttcggtttcgttttgcgtgtgtagtattttacggcgtttaggttgtcggtgatggtgatgcggttttttttatattgatacgtgtgtttaagtttgtcgggtttagttgttttgttattcgttcgtcgttgtcgaacggtaacggattttcggtcggttcgtgtgacggtgcgttattattcgtttcggtatttattatcgtaagtaaagttgcgtatttgtttgttattacgttatatattatcgttagttcgtcgcgtggcgtttagttatagcgtatcgcggcgcggtaggtaaatttttcgggtatttcgggtcgtgcgttagttaacggtagatagacggatgtcgttgtttcggttatattcggtgtaattcgtagggtattaggaaaagcggacggtttcgtttcgtcggaaatggtttgcgtcgggttttttttgttcgttgcgtttgcgtggttagtattagtcggaatgacgttaggtattattcgttacgtcggtgatttcgtcgttgaatttacggcggtttcgcggtggaacgtttgtgtgcgttcgaagcggtttattagtcggttagtattcggtacggcggtagcggcgtaggtagtatcgttatgtttttnntcggtatatcgnntttatannnttaantcgagtnnagttattanncggtttttnngntngganttgnntttgtttcgttangataat

SEQ ID NO: 7786 - DNA, 923 bp, Artificial Sequence
  chemically treated genomic DNA (Homo sapiens) CpG-island No: 7786
  misc_feature (7)..(7): n is either a, c, g or t
  misc_feature (20)..(21): n is either a, c, g or t
  misc_feature (25)..(25): n is either a, c, g or t
  misc_feature (29)..(29): n is either a, c, g or t
  misc_feature (31)..(31): n is either a, c, g or t
  misc_feature (33)..(34): n is either a, c, g or t
  misc_feature (43)..(44): n is either a, c, g or t
  misc_feature (53)..(54): n is either a, c, g or t
  misc_feature (61)..(61): n is either a, c, g or t
  misc_feature (66)..(68): n is either a, c, g or t
  misc_feature (75)..(76): n is either a, c, g or t
  misc_feature (88)..(89): n is either a, c, g or t
attatcntaacgaaacaaanncaantccnancnnaaaaaccgnntaataactnnactcganttaannntataaanncgatataccgannaaaaacataacgatactacctacgccgctaccgccgtaccgaatactaaccgactaataaaccgcttcgaacgcacacaaacgttccaccgcgaaaccgccgtaaattcaacgacgaaatcaccgacgtaacgaataatacctaacgtcattccgactaatactaaccacgcaaacgcaacgaacaaaaaaaacccgacgcaaaccatttccgacgaaacgaaaccgtccgcttttcctaataccctacgaattacaccgaatataaccgaaacaacgacatccgtctatctaccgttaactaacgcacgacccgaaatacccgaaaaatttacctaccgcgccgcgatacgctataactaaacgccacgcgacgaactaacgataatatataacgtaataacaaacaaatacgcaactttacttacgataataaataccgaaacgaataataacgcaccgtcacacgaaccgaccgaaaatccgttaccgttcgacaacgacgaacgaataacaaaacaactaaacccgacaaacttaaacacacgtatcaatataaaaaaaaccgcatcaccatcaccgacaacctaaacgccgtaaaatactacacacgcaaaacgaaaccgaactaaaacgaataaaaaaaaaaaacacaacgaacgacaacgtcacgcaaaatcaattaacgcctaacaactcaaaacacaaacgaaaccgcaaccaaaaccactatcgaccacccacaattttcgtccaaacatattaatacccgacaattaaaccaacccgaattataaccactaaaccctccgaaccgtaatcctaatccctacgc

SEQ ID NO: 7787 - DNA, 923 bp, Artificial Sequence
  chemically treated genomic DNA (Homo sapiens) CpG-island No: 7787
  misc_feature (7)..(7): n is either a, c, g or t
  misc_feature (20)..(21): n is either a, c, g or t
  misc_feature (25)..(25): n is either a, c, g or t
  misc_feature (29)..(29): n is either a, c, g or t
  misc_feature (31)..(31): n is either a, c, g or t
  misc_feature (33)..(34): n is either a, c, g or t
  misc_feature (43)..(44): n is either a, c, g or t
  misc_feature (53)..(54): n is either a, c, g or t
  misc_feature (61)..(61): n is either a, c, g or t
  misc_feature (66)..(68): n is either a, c, g or t
  misc_feature (75)..(76): n is either a, c, g or t
  misc_feature (88)..(89): n is either a, c, g or t
gttattntggcgaaataaanntagntttngntnnaggggtcgnntggtggttnngttcggnttggnnntgtgagnncggtgtgtcggnnaagggtatgacggtgttgtttgcgtcgttgtcgtcgtatcgggtattgatcggttggtggatcgtttcgggcgtatatagacgttttatcgcgaagtcgtcgtgaatttagcggcgaaattatcggcgtgacggatggtgtttggcgttatttcggttggtattgattacgtaggcgtagcgggtagaagaagttcggcgtaggttattttcggcgggacggaatcgttcgttttttttgatattttgcgggttatatcgaatatggtcgggataacggtattcgtttgtttgtcgttggttgacgtacgattcggaatattcggagaatttatttgtcgcgtcgcggtgcgttatggttggacgttacgcggcgaattggcggtggtgtatgacgtagtggtaaataggtgcgtagttttatttacgatgataaatatcggggcggatggtggcgtatcgttatacgggtcggtcggaaattcgttatcgttcgatagcgacgggcgggtgatagaatagttaaattcggtaggtttaagtatacgtattagtatgagaaagatcgtattattattatcgatagtttggacgtcgtgaagtgttgtatacgtagggcgaagtcgggttgaagcgggtgggaaaaaggaatatagcggacggtagcgttacgtagagttagttgacgtttggtagtttagggtatagacgaagtcgtagttaggattattatcggttatttataattttcgtttaaatatgttgatattcggtaattggattagttcgaattgtggttattgaatttttcgaatcgtgattttgatttttgcgt

SEQ ID NO: 7788 - DNA, 923 bp, Artificial Sequence
  chemically treated genomic DNA (Homo sapiens) CpG-island No: 7788
  misc_feature (835)..(836): n is either a, c, g or t
  misc_feature (848)..(849): n is either a, c, g or t
  misc_feature (856)..(858): n is either a, c, g or t
  misc_feature (863)..(863): n is either a, c, g or t
  misc_feature (870)..(871): n is either a, c, g or t
  misc_feature (880)..(881): n is either a, c, g or t
  misc_feature (890)..(891): n is either a, c, g or t
  misc_feature (893)..(893): n is either a, c, g or t
  misc_feature (895)..(895): n is either a, c, g or t
  misc_feature (899)..(899): n is either a, c, g or t
  misc_feature (903)..(904): n is either a, c, g or t
  misc_feature (917)..(917): n is either a, c, g or t
acgcaaaaatcaaaatcacgattcgaaaaattcaataaccacaattcgaactaatccaattaccgaatatcaacatatttaaacgaaaattataaataaccgataataatcctaactacgacttcgtctataccctaaactaccaaacgtcaactaactctacgtaacgctaccgtccgctatattcctttttcccacccgcttcaacccgacttcgccctacgtatacaacacttcacgacgtccaaactatcgataataataatacgatctttctcatactaatacgtatacttaaacctaccgaatttaactattctatcacccgcccgtcgctatcgaacgataacgaatttccgaccgacccgtataacgatacgccaccatccgccccgatatttatcatcgtaaataaaactacgcacctatttaccactacgtcatacaccaccgccaattcgccgcgtaacgtccaaccataacgcaccgcgacgcgacaaataaattctccgaatattccgaatcgtacgtcaaccaacgacaaacaaacgaataccgttatcccgaccatattcgatataacccgcaaaatatcaaaaaaaacgaacgattccgtcccgccgaaaataacctacgccgaacttcttctacccgctacgcctacgtaatcaataccaaccgaaataacgccaaacaccatccgtcacgccgataatttcgccgctaaattcacgacgacttcgcgataaaacgtctatatacgcccgaaacgatccaccaaccgatcaatacccgatacgacgacaacgacgcaaacaacaccgtcatacccttnnccgacacaccgnnctcacannnccaanccgaacnnaaccaccanncgacccctnnancnaaanctanntttatttcgccanaataac

SEQ ID NO: 7789 - DNA, 1233 bp, Artificial Sequence
  chemically treated genomic DNA (Homo sapiens) CpG-island No: 7789
taacgtggtgcggttttcgttgaatatagtttgttcgttgttggtaattataaaacggttatcggaaatcgtttggttttatataatgatataattagtaagtttatgttgtgttagtacggattcgatcgttttacgttagcggtacgaatttgaattatcgtatttagtttttcgttaaataattcgttaggcgatcgttatttagagtggcgatattcgcgttaatgttatatgattagtaaaggttattttcgatagcgttattagtaggtcgatattaggcggtcgtgatacgttagtagtttacgttgtgtaattagcgtttgaattcgttatagaagttttttagttgcgcgatatcgcgtatatttgtcggttttcgttaagttgacgataaatttgcgttagcgtcgttgcgtttagcgcgtattgtttttgtttaaattaattagtagtagtgcgttattttcggtagaagttgcggtcgtgatggtgtgacgtatattttttacgcgggtaaatgtagaattattagcgatagcggcgacgttatttcgcgtttttcgttatttttcgttagcgggtttttatcgatatggagtttttatttatcgggatcgttagtttagcgtcggataaagtttttcgtttacggttttaacggttttatatagttcgtatttttattagggtggtttgtcgtcgttatttagttggcggaagtttgatgcgtttgatatcgttaatttgtgttgcggcgatgttggttaagttttatcgatcgttagacgggtagaggcggcgaaatttagtagcgtaacggcgtacgttcgttaatcgttatcgttttatcgtagtagttgtcgaggtggcggtagtgatcgcgtagttagcgatcggtatttgttacggttttatatttgatcgcgcgttattatgtcggttacgttgcggtcgttaatggttataggaaggtttttttcgttatagtcggtagatgtagtatacgttttattcgtttgtaatggtgatttttttacgggttagcgcgtcgtttttcgttttagcgtttgtatatcgcgggttattttcggcgttttattaagtaggacgttagcggtagatcgatcggttgattattaaaatgacgatcgtgtagagaagatgtagtttttcggtcgttttattaattatcgcgtagggtgcgcgtttcgttatatagtaagtaat

SEQ ID NO: 7790 - DNA, 1233 bp, Artificial Sequence
  chemically treated genomic DNA (Homo sapiens) CpG-island No: 7790
attacttactatataacgaaacgcgcaccctacgcgataattaataaaacgaccgaaaaactacatcttctctacacgatcgtcattttaataatcaaccgatcgatctaccgctaacgtcctacttaataaaacgccgaaaataacccgcgatatacaaacgctaaaacgaaaaacgacgcgctaacccgtaaaaaaatcaccattacaaacgaataaaacgtatactacatctaccgactataacgaaaaaaaccttcctataaccattaacgaccgcaacgtaaccgacataataacgcgcgatcaaatataaaaccgtaacaaataccgatcgctaactacgcgatcactaccgccacctcgacaactactacgataaaacgataacgattaacgaacgtacgccgttacgctactaaatttcgccgcctctacccgtctaacgatcgataaaacttaaccaacatcgccgcaacacaaattaacgatatcaaacgcatcaaacttccgccaactaaataacgacgacaaaccaccctaataaaaatacgaactatataaaaccgttaaaaccgtaaacgaaaaactttatccgacgctaaactaacgatcccgataaataaaaactccatatcgataaaaacccgctaacgaaaaataacgaaaaacgcgaaataacgtcgccgctatcgctaataattctacatttacccgcgtaaaaaatatacgtcacaccatcacgaccgcaacttctaccgaaaataacgcactactactaattaatttaaacaaaaacaatacgcgctaaacgcaacgacgctaacgcaaatttatcgtcaacttaacgaaaaccgacaaatatacgcgatatcgcgcaactaaaaaacttctataacgaattcaaacgctaattacacaacgtaaactactaacgtatcacgaccgcctaatatcgacctactaataacgctatcgaaaataacctttactaatcatataacattaacgcgaatatcgccactctaaataacgatcgcctaacgaattatttaacgaaaaactaaatacgataattcaaattcgtaccgctaacgtaaaacgatcgaatccgtactaacacaacataaacttactaattatatcattatataaaaccaaacgatttccgataaccgttttataattaccaacaacgaacaaactatattcaacgaaaaccgcaccacgtta

SEQ ID NO: 7791 - DNA, 1233 bp, Artificial Sequence
  chemically treated genomic DNA (Homo sapiens) CpG-island No: 7791
gttatttattgtgtagcggagcgcgtattttacgcggtgattggtgaagcgatcgaagaattgtattttttttgtacgatcgttattttgataattagtcgatcgatttgtcgttgacgttttgtttggtaaaacgtcgaagatgattcgcgatgtataaacgttaaagcgaaaggcgacgcgttggttcgtgaagggattattattgtagacgggtgaaacgtgtgttgtatttgtcgattgtggcggaaaaaatttttttgtgattattggcgatcgtagcgtaatcggtatggtagcgcgcgattagatgtggggtcgtggtaggtgtcggtcgttaattgcgcggttattatcgttatttcgatagttattacggtgaagcgatggcgattggcgagcgtgcgtcgttgcgttgttggatttcgtcgtttttgttcgtttggcggtcggtgaagtttaattaatatcgtcgtaatataaattggcgatattaaacgtattaaattttcgttaattggatggcggcggtaggttattttggtgaagatgcgggttgtatgaagtcgttaaagtcgtgggcgaagagttttgttcggcgttgggttgacgatttcggtgggtaaagattttatgtcgatgaaaattcgttggcggaaggtaacgaagagcgcgaaatgacgtcgtcgttgtcgttggtgattttgtatttgttcgcgtggaagatgtacgttatattattacggtcgtagtttttatcgaagataacgtattgttgttgattgatttgggtaaaggtaatacgcgttgggcgtaacggcgttggcgtaggtttatcgttagtttggcgaaaatcggtagatgtacgcgatgtcgcgtaattgaaaggtttttatgacggatttaggcgttggttgtatagcgtaagttgttggcgtattacgatcgtttgatgtcggtttgttggtaacgttgtcggaaatggtttttgttggttatgtggtattgacgcggatatcgttattttgggtgacgatcgtttggcgggttgtttaacgaagaattgggtgcggtgatttaggttcgtgtcgttgacgtgaagcggtcgagttcgtattggtatagtatgggtttgttgattgtgttattatgtagggttaggcggttttcggtgatcgttttgtgattattagtaacgggtagattgtatttagcgaaagtcgtattacgttg

SEQ ID NO: 7792 - DNA, 1233 bp, Artificial Sequence
  chemically treated genomic DNA (Homo sapiens) CpG-island No: 7792
caacgtaatacgactttcgctaaatacaatctacccgttactaataatcacaaaacgatcaccgaaaaccgcctaaccctacataataacacaatcaacaaacccatactataccaatacgaactcgaccgcttcacgtcaacgacacgaacctaaatcaccgcacccaattcttcgttaaacaacccgccaaacgatcgtcacccaaaataacgatatccgcgtcaataccacataaccaacaaaaaccatttccgacaacgttaccaacaaaccgacatcaaacgatcgtaatacgccaacaacttacgctatacaaccaacgcctaaatccgtcataaaaacctttcaattacgcgacatcgcgtacatctaccgattttcgccaaactaacgataaacctacgccaacgccgttacgcccaacgcgtattacctttacccaaatcaatcaacaacaatacgttatcttcgataaaaactacgaccgtaataatataacgtacatcttccacgcgaacaaatacaaaatcaccaacgacaacgacgacgtcatttcgcgctcttcgttaccttccgccaacgaattttcatcgacataaaatctttacccaccgaaatcgtcaacccaacgccgaacaaaactcttcgcccacgactttaacgacttcatacaacccgcatcttcaccaaaataacctaccgccgccatccaattaacgaaaatttaatacgtttaatatcgccaatttatattacgacgatattaattaaacttcaccgaccgccaaacgaacaaaaacgacgaaatccaacaacgcaacgacgcacgctcgccaatcgccatcgcttcaccgtaataactatcgaaataacgataataaccgcgcaattaacgaccgacacctaccacgaccccacatctaatcgcgcgctaccataccgattacgctacgatcgccaataatcacaaaaaaattttttccgccacaatcgacaaatacaacacacgtttcacccgtctacaataataatcccttcacgaaccaacgcgtcgcctttcgctttaacgtttatacatcgcgaatcatcttcgacgttttaccaaacaaaacgtcaacgacaaatcgatcgactaattatcaaaataacgatcgtacaaaaaaaatacaattcttcgatcgcttcaccaatcaccgcgtaaaatacgcgctccgctacacaataaataac

SEQ ID NO: 7793 - DNA, 608 bp, Artificial Sequence
  chemically treated genomic DNA (Homo sapiens) CpG-island No: 7793
gaatcgtcgtatagttattcgttgcgaatacgtttttacgttggtttcgtatttcgtattaatgataatttcgtttatgcggtacgttcgattgcgttttcgagttagttggtgttcggtagtagattaatcggacgaaaatatcggttagttcgatgttgtgaatatcgtcgttgatacgtttcgatattttagattaacgattttgttgtcgtcgttttttattttcgggtttgcgtatttagaataatgtcgacgttttttaggttgcgtagtttgtttgtagaatttggtcggtttttatttttggcgtaaattttagtagcgtacgtgtttaacgatattcgttaggttaattgtcgtttttacgtcggagtatcgtcgtcgataatcgttacgcgtttatttttaaatagcgggtcgtcgagtgcgggtagtaggttacgtttttggtgcgatattgattttcgttcggacgtttatgttgcgttattttgtatcggtcgttacgataatgttgcgtgttttagtatcgcgttagaagttatcgtatcgatttggatattattatattatttttaatattatttcggtagttaaagtttgtt

SEQ ID NO: 7794 - DNA, 608 bp, Artificial Sequence
  chemically treated genomic DNA (Homo sapiens) CpG-island No: 7794
aacaaactttaactaccgaaataatattaaaaataatataataatatccaaatcgatacgataacttctaacgcgatactaaaacacgcaacattatcgtaacgaccgatacaaaataacgcaacataaacgtccgaacgaaaatcaatatcgcaccaaaaacgtaacctactacccgcactcgacgacccgctatttaaaaataaacgcgtaacgattatcgacgacgatactccgacgtaaaaacgacaattaacctaacgaatatcgttaaacacgtacgctactaaaatttacgccaaaaataaaaaccgaccaaattctacaaacaaactacgcaacctaaaaaacgtcgacattattctaaatacgcaaacccgaaaataaaaaacgacgacaacaaaatcgttaatctaaaatatcgaaacgtatcaacgacgatattcacaacatcgaactaaccgatattttcgtccgattaatctactaccgaacaccaactaactcgaaaacgcaatcgaacgtaccgcataaacgaaattatcattaatacgaaatacgaaaccaacgtaaaaacgtattcgcaacgaataactatacgacgattc

SEQ ID NO: 7795 - DNA, 608 bp, Artificial Sequence
  chemically treated genomic DNA (Homo sapiens) CpG-island No: 7795
aataggttttagttgtcggagtaatgttggggatggtgtgatggtatttaaatcgatgcgatagtttttggcgcggtattgaaatacgtagtattatcgtggcgatcggtgtaaaatggcgtaatatgaacgttcgggcgaagattagtatcgtattaaaggcgtgatttattgttcgtattcgacggttcgttgtttaaaggtaaacgcgtagcggttatcggcggcggtatttcggcgtggaagcggtaattgatttggcgggtatcgttgagtacgtacgttgttggaatttgcgttagaaatgaaagtcgattaggttttgtaggtaaattgcgtagtttgaaaaacgtcgatattattttgaatgcgtaaattcggaagtgaaaggcgacggtagtaaagtcgttggtttggaatatcgagacgtgttagcggcgatatttataatatcgaattggtcggtattttcgttcgattggtttgttgtcgaatattaattggttcgaaggcgtagtcgaacgtatcgtatgggcgagattattattgatgcgaaatgcgaaattaacgtgaaggcgtgttcgtagcgggtgattgtacgacggttt

SEQ ID NO: 7796 - DNA, 608 bp, Artificial Sequence
  chemically treated genomic DNA (Homo sapiens) CpG-island No: 7796
aaaccgtcgtacaatcacccgctacgaacacgccttcacgttaatttcgcatttcgcatcaataataatctcgcccatacgatacgttcgactacgccttcgaaccaattaatattcgacaacaaaccaatcgaacgaaaataccgaccaattcgatattataaatatcgccgctaacacgtctcgatattccaaaccaacgactttactaccgtcgcctttcacttccgaatttacgcattcaaaataatatcgacgtttttcaaactacgcaatttacctacaaaacctaatcgactttcatttctaacgcaaattccaacaacgtacgtactcaacgatacccgccaaatcaattaccgcttccacgccgaaataccgccgccgataaccgctacgcgtttacctttaaacaacgaaccgtcgaatacgaacaataaatcacgcctttaatacgatactaatcttcgcccgaacgttcatattacgccattttacaccgatcgccacgataatactacgtatttcaataccgcgccaaaaactatcgcatcgatttaaataccatcacaccatccccaacattactccgacaactaaaacctatt

SEQ ID NO: 7797 - DNA, 532 bp, Artificial Sequence
  chemically treated genomic DNA (Homo sapiens) CpG-island No: 7797
tggtatttattacggtttgcggtttagatttattggtagtacgtatataatcgttaatatcggcgagaagtcgttgatattttgacgtacgatttgaaagtgtcgataatgatggtattcggattagtgattttattttagttttatttttataggatgtcgtatcgcgtagcgtttttagtatatgttttttcgacgaaatttaatttggtcggatttttttatcggttcgcgattttagattcgttattgttcgtattttattgtataatgatatagttattttgttcgaaatttttagtttttcgtcggtatagatgttatgataataattcgttttcggagatgtttcgcgacggtaaatattcgtagttagattttattttttaggttagtttacgggtgttcgttaaatttttacgttgtaacgtaggtagaagcgtgtcgtttttagtaataatacgttattgatcgttatagtaattaattttttagtagagaaaaattttgtttttttataggtatttttttg

SEQ ID NO: 7798 - DNA, 532 bp, Artificial Sequence
  chemically treated genomic DNA (Homo sapiens) CpG-island No: 7798
caaaaaaatacctataaaaaaacaaaatttttctctactaaaaaattaattactataacgatcaataacgtattattactaaaaacgacacgcttctacctacgttacaacgtaaaaatttaacgaacacccgtaaactaacctaaaaaataaaatctaactacgaatatttaccgtcgcgaaacatctccgaaaacgaattattatcataacatctataccgacgaaaaactaaaaatttcgaacaaaataactatatcattatacaataaaatacgaacaataacgaatctaaaatcgcgaaccgataaaaaaatccgaccaaattaaatttcgtcgaaaaaacatatactaaaaacgctacgcgatacgacatcctataaaaataaaactaaaataaaatcactaatccgaataccatcattatcgacactttcaaatcgtacgtcaaaatatcaacgacttctcgccgatattaacgattatatacgtactaccaataaatctaaaccgcaaaccgtaataaatacca

SEQ ID NO: 7799 - DNA, 532 bp, Artificial Sequence
  chemically treated genomic DNA (Homo sapiens) CpG-island No: 7799
tagaaggatgtttgtaaaagagtaaggtttttttttgttggaaggttgattgttatggcgattagtagcgtattgttgttgggggcggtacgtttttgtttgcgttatagcgtgaaagtttaacgagtattcgtaagttggtttggaagatgaaatttggttgcgggtatttatcgtcgcgaagtattttcgagggcgggttattgttatggtatttgtatcggcgaagggttggaaatttcggatagggtgattgtgttattgtgtagtgggatgcgaatagtaacggatttgggatcgcgaatcggtaaaagagttcgattagattggatttcgtcgaaggagtatgtgttggaaacgttacgcggtgcgatattttgtgaaggtagggttgggataaagttattaattcggatgttattattatcgatatttttaggtcgtacgttaggatgttagcggtttttcgtcggtgttgacggttatatgcgtgttgttagtaagtttgaatcgtaaatcgtggtgaatgtta

SEQ ID NO: 7800 - DNA, 532 bp, Artificial Sequence
  chemically treated genomic DNA (Homo sapiens) CpG-island No: 7800
taacattcaccacgatttacgattcaaacttactaacaacacgcatataaccgtcaacaccgacgaaaaaccgctaacatcctaacgtacgacctaaaaatatcgataataataacatccgaattaataactttatcccaaccctaccttcacaaaatatcgcaccgcgtaacgtttccaacacatactccttcgacgaaatccaatctaatcgaactcttttaccgattcgcgatcccaaatccgttactattcgcatcccactacacaataacacaatcaccctatccgaaatttccaacccttcgccgatacaaataccataacaataacccgccctcgaaaatacttcgcgacgataaatacccgcaaccaaatttcatcttccaaaccaacttacgaatactcgttaaactttcacgctataacgcaaacaaaaacgtaccgcccccaacaacaatacgctactaatcgccataacaatcaaccttccaacaaaaaaaaaccttactcttttacaaacatccttcta

SEQ ID NO: 7801 - DNA, 516 bp, Artificial Sequence
  chemically treated genomic DNA (Homo sapiens) CpG-island No: 7801
gtagggttcgtttgatcgcggatgtcgggacgttttcgtgtaagtttcgaggggggttgttatttcgaatattcgttagaacgaaagcggtagttagggaagttttcgtaggtgttgtagggatttaagcgtttgagttgagttcgaattcgtatagtaatttcgggaggataaattttagtaattagaatcgggtggcgtcgtttagtaattaggagttaaatgcgcggacgttaggtattggttgtacgtgttacgtgagttagcgtcgttgtttagtgggagattacgtcgaggtacgtgatgcggcgtaatcgttttttggtagagtttttcgcgaaggagttgtggttttgagcgtataggcgaggtatttttggggtttgcgtcgttttttttataaagttttggttttggttggtgcgattaaagaaaggaaacggcgtttgagatttgtttgggttggttatggtgaagtagtgaaacggtgagaattgtgttaatgaggttagttta

SEQ ID NO: 7802 - DNA, 516 bp, Artificial Sequence
  chemically treated genomic DNA (Homo sapiens) CpG-island No: 7802
taaactaacctcattaacacaattctcaccgtttcactacttcaccataaccaacccaaacaaatctcaaacgccgtttcctttctttaatcgcaccaaccaaaaccaaaactttataaaaaaaacgacgcaaaccccaaaaatacctcgcctatacgctcaaaaccacaactccttcgcgaaaaactctaccaaaaaacgattacgccgcatcacgtacctcgacgtaatctcccactaaacaacgacgctaactcacgtaacacgtacaaccaatacctaacgtccgcgcatttaactcctaattactaaacgacgccacccgattctaattactaaaatttatcctcccgaaattactatacgaattcgaactcaactcaaacgcttaaatccctacaacacctacgaaaacttccctaactaccgctttcgttctaacgaatattcgaaataacaacccccctcgaaacttacacgaaaacgtcccgacatccgcgatcaaacgaaccctac

SEQ ID NO: 7803 - DNA, 516 bp, Artificial Sequence
  chemically treated genomic DNA (Homo sapiens) CpG-island No: 7803
tgaattagttttattgatataatttttatcgttttattgttttattatagttagtttagataagttttaagcgtcgttttttttttttggtcgtattagttaaagttaggattttgtaaaaggaacggcgtaaattttaggaatgtttcgtttatgcgtttagagttataattttttcgcgaaaagttttgttaaagggcggttgcgtcgtattacgtgtttcggcgtaattttttattgggtagcggcgttggtttacgtgatacgtgtagttaatgtttggcgttcgcgtatttggtttttggttgttaggcgacgttattcgattttggttgttggagtttattttttcgaggttgttgtgcgagttcggatttagtttaagcgtttggatttttatagtatttgcgagggtttttttggttgtcgttttcgttttggcgaatgttcggggtggtagtttttttcgaggtttgtacgagggcgtttcggtattcgcgattaagcgggttttgt

SEQ ID NO: 7804 - DNA, 516 bp, Artificial Sequence
  chemically treated genomic DNA (Homo sapiens) CpG-island No: 7804
acaaaacccgcttaatcgcgaataccgaaacgccctcgtacaaacctcgaaaaaaactaccaccccgaacattcgccaaaacgaaaacgacaaccaaaaaaaccctcgcaaatactataaaaatccaaacgcttaaactaaatccgaactcgcacaacaacctcgaaaaaataaactccaacaaccaaaatcgaataacgtcgcctaacaaccaaaaaccaaatacgcgaacgccaaacattaactacacgtatcacgtaaaccaacgccgctacccaataaaaaattacgccgaaacacgtaatacgacgcaaccgccctttaacaaaacttttcgcgaaaaaattataactctaaacgcataaacgaaacattcctaaaatttacgccgttccttttacaaaatcctaactttaactaatacgaccaaaaaaaaaaaacgacgcttaaaacttatctaaactaactataataaaacaataaaacgataaaaattatatcaataaaactaattca

SEQ ID NO: 7805 - DNA, 720 bp, Artificial Sequence
  chemically treated genomic DNA (Homo sapiens) CpG-island No: 7805
gtaaaagcggggttatagtgaattttggcgaagggttcgcgtggattaggaattggtgttagaattgtaaaagggtatttgcgttcggatggggaggtgatgcgggggcggggcggggttttgggggcggggcgagttcggaggtgtcgttttggggcggggcggtgatagaaggatggattttggggtgaggattgattttgggggcggggcgagagtgcgaattggagtttgagttgagcggtgacgtaaggacgattttgagggtggagcgaggggaggggatggtttttggaggcggggcggtggtacgaggttagtttttgggggcgggcggtggcgtaagattgattttgggggcggggtgggggcgtgggttgaatttgggggcggggcggtggcgcggaatggattttggggtcggcgcgaggtttgaggtgcgttttgagggcggggcgatgacgtagagcgaattttggggcggggcgagattttttagatgcgtttcggggagtgggcggtgacgcggtgtaggttttggggataggcggtgattttagaattgattttggggataggcgaggcgcggaggcgttttgaaggcgaggcggtgacgtaagagcgatttttggggcggggcgaggcgttggagatgcgttttgcgggcgggatcgaagaaaagagaagaaaattaggttcgatttttttttttattttata

SEQ ID NO: 7806 - DNA, 720 bp, Artificial Sequence
  chemically treated genomic DNA (Homo sapiens) CpG-island No: 7806
tataaaataaaaaaaaaaatcgaacctaattttcttctcttttcttcgatcccgcccgcaaaacgcatctccaacgcctcgccccgccccaaaaatcgctcttacgtcaccgcctcgccttcaaaacgcctccgcgcctcgcctatccccaaaatcaattctaaaatcaccgcctatccccaaaacctacaccgcgtcaccgcccactccccgaaacgcatctaaaaaatctcgccccgccccaaaattcgctctacgtcatcgccccgccctcaaaacgcacctcaaacctcgcgccgaccccaaaatccattccgcgccaccgccccgcccccaaattcaacccacgcccccaccccgcccccaaaatcaatcttacgccaccgcccgcccccaaaaactaacctcgtaccaccgccccgcctccaaaaaccatcccctcccctcgctccaccctcaaaatcgtccttacgtcaccgctcaactcaaactccaattcgcactctcgccccgcccccaaaatcaatcctcaccccaaaatccatccttctatcaccgccccgccccaaaacgacacctccgaactcgccccgcccccaaaaccccgccccgcccccgcatcacctccccatccgaacgcaaatacccttttacaattctaacaccaattcctaatccacgcgaacccttcgccaaaattcactataaccccgcttttac

SEQ ID NO: 7807 - DNA, 720 bp, Artificial Sequence
  chemically treated genomic DNA (Homo sapiens) CpG-island No: 7807
tataaaatgagaggaaaggtcgagtttagtttttttttttttttttcggtttcgttcgtagaacgtatttttaacgtttcgtttcgttttaagaatcgtttttgcgttatcgtttcgtttttaggacgttttcgcgtttcgtttgtttttagggttaattttggggttatcgtttgtttttagaatttgtatcgcgttatcgtttatttttcgggacgtatttagaaggtttcgtttcgttttaggattcgttttgcgttatcgtttcgtttttaggacgtattttaggtttcgcgtcgattttagaatttatttcgcgttatcgtttcgtttttagatttaatttacgtttttatttcgtttttaaggttaattttgcgttatcgttcgtttttaagggttagtttcgtgttatcgtttcgtttttaagagttatttttttttttcgttttatttttagaatcgtttttgcgttatcgtttagtttagattttagttcgtattttcgtttcgtttttaaagttaatttttattttaggatttatttttttgttatcgtttcgttttaaggcggtattttcggattcgtttcgtttttagggtttcgtttcgttttcgtattatttttttattcgggcgtaggtgtttttttgtaattttggtattagtttttggtttacgcgggtttttcgttagaatttattatagtttcgtttttat

SEQ ID NO: 7808 - DNA, 720 bp, Artificial Sequence
  chemically treated genomic DNA (Homo sapiens) CpG-island No: 7808
ataaaaacgaaactataataaattctaacgaaaaacccgcgtaaaccaaaaactaataccaaaattacaaaaaaacacctacgcccgaataaaaaaataatacgaaaacgaaacgaaaccctaaaaacgaaacgaatccgaaaataccgccttaaaacgaaacgataacaaaaaaataaatcctaaaataaaaattaactttaaaaacgaaacgaaaatacgaactaaaatctaaactaaacgataacgcaaaaacgattctaaaaataaaacgaaaaaaaaaaataactcttaaaaacgaaacgataacacgaaactaacccttaaaaacgaacgataacgcaaaattaaccttaaaaacgaaataaaaacgtaaattaaatctaaaaacgaaacgataacgcgaaataaattctaaaatcgacgcgaaacctaaaatacgtcctaaaaacgaaacgataacgcaaaacgaatcctaaaacgaaacgaaaccttctaaatacgtcccgaaaaataaacgataacgcgatacaaattctaaaaacaaacgataaccccaaaattaaccctaaaaacaaacgaaacgcgaaaacgtcctaaaaacgaaacgataacgcaaaaacgattcttaaaacgaaacgaaacgttaaaaatacgttctacgaacgaaaccgaaaaaaaaaaaaaaaaactaaactcgacctttcctctcattttata

SEQ ID NO: 7809 - DNA, 962 bp, Artificial Sequence
  chemically treated genomic DNA (Homo sapiens) CpG-island No: 7809
atttggcgcgtttaggtttatcgcgcgcggcggtacggttaggtcgtcgtcgggtgtttttaggttcgcggggtcgtcgtttttggttcgggtttcgtcgggttcgggcgcgatgagggggttttttttttggtcgtcggatacgttatagatgtcgttttcggcgttttttttcgttatggtttttgcgggttttacggtcgggttggggtcgcggtattttgcggggggttgcggttaggcgcggggtatcggcggtatcggggagggtttcgagggcgcgggtcggtcgggggtcggggggcggtcgggtcgggggacggggcggcgggagagcggcggggtgcgggttataggcggcgtagttagaagtagtttacgaagtatttgaaagtgagtttgaagaattttttgtgtgttaggggttcgggggcgcgcgggcgtcggcggggttcggttaggcgttcgcggtagcggtttcggaggtttttgttcgcggttcgggcggtggcggttgttacggtttttcggtcgattcgaggtttagtttagcggggtacgggcgatatcggcgttcgtagtttgtaagcggcggttggagtagggtttgtggttcgcgttttcggtttcggtcggggttcgcggcggttgttcggtttattcgagatttcggtggcggcggcggcggtttaggcgcgtttcgttttttttttttgggcggcggcggttgtagtcgttttcggggtcgcggcgggtttagcgattcgttatcgcgtttcgattgttttttttttttcggttttcggtcggtagtcgtttaaaaatcgatttcggggtgatgttattatcgttttatttttacggttggtcggtttttttttttttttcgttttgttcgttatagttcgtttattttgtttttgtttttttttcggggaggagtcgtcgttttagcgggaggt

SEQ ID NO: 7810 - DNA, 962 bp, Artificial Sequence
  chemically treated genomic DNA (Homo sapiens) CpG-island No: 7810
acctcccgctaaaacgacgactcctccccgaaaaaaaaacaaaaacaaaataaacgaactataacgaacaaaacgaaaaaaaaaaaaaaaccgaccaaccgtaaaaataaaacgataataacatcaccccgaaatcgatttttaaacgactaccgaccgaaaaccgaaaaaaaaaaaacaatcgaaacgcgataacgaatcgctaaacccgccgcgaccccgaaaacgactacaaccgccgccgcccaaaaaaaaaaaacgaaacgcgcctaaaccgccgccgccgccaccgaaatctcgaataaaccgaacaaccgccgcgaaccccgaccgaaaccgaaaacgcgaaccacaaaccctactccaaccgccgcttacaaactacgaacgccgatatcgcccgtaccccgctaaactaaacctcgaatcgaccgaaaaaccgtaacaaccgccaccgcccgaaccgcgaacaaaaacctccgaaaccgctaccgcgaacgcctaaccgaaccccgccgacgcccgcgcgcccccgaacccctaacacacaaaaaattcttcaaactcactttcaaatacttcgtaaactacttctaactacgccgcctataacccgcaccccgccgctctcccgccgccccgtcccccgacccgaccgccccccgacccccgaccgacccgcgccctcgaaaccctccccgataccgccgataccccgcgcctaaccgcaaccccccgcaaaataccgcgaccccaacccgaccgtaaaacccgcaaaaaccataacgaaaaaaaacgccgaaaacgacatctataacgtatccgacgaccaaaaaaaaaaccccctcatcgcgcccgaacccgacgaaacccgaaccaaaaacgacgaccccgcgaacctaaaaacacccgacgacgacctaaccgtaccgccgcgcgcgataaacctaaacgcgccaaat

SEQ ID NO: 7811 - DNA, 962 bp, Artificial Sequence
  chemically treated genomic DNA (Homo sapiens) CpG-island No: 7811
gtttttcgttggagcggcgattttttttcgggaggagggtagggataaggtgggcggattgtgacgagtagggcgggagggagaggggggtcggttagtcgtgggggtggggcgatagtgatattatttcggagtcggtttttaagcggttgtcggtcgggaatcgggaagagaggaatagtcggaacgcggtggcgagtcgttgagttcgtcgcggtttcgagagcggttgtagtcgtcgtcgtttagaaggagagggcgaggcgcgtttgagtcgtcgtcgtcgttatcggagtttcgggtgagtcgggtagtcgtcgcgggtttcggtcggggtcgggggcgcgggttataggttttgttttagtcgtcgtttgtagattgcgagcgtcgatatcgttcgtgtttcgttaggttgagtttcgggtcggtcgaggagtcgtggtagtcgttatcgttcgagtcgcgggtaagagttttcggaatcgttgtcgcggacgtttggtcgggtttcgtcgacgttcgcgcgttttcgggtttttgatatataggagattttttaggtttatttttaagtgtttcgtggattgtttttgattgcgtcgtttgtgattcgtatttcgtcgttttttcgtcgtttcgtttttcggttcggtcgtttttcggttttcggtcggttcgcgttttcggggtttttttcggtgtcgtcggtgtttcgcgtttgatcgtagtttttcgtagggtgtcgcgattttagttcggtcgtgaggttcgtaggggttatggcgaagaagagcgtcgagaacggtatttgtagcgtgttcggcgattagaagaagggtttttttatcgcgttcgggttcgacggggttcgggttaagggcgacggtttcgcgggtttggggatattcggcggcggtttggtcgtgtcgtcgcgcgcgatagatttggacgcgttagat

SEQ ID NO: 7812 - DNA, 962 bp, Artificial Sequence
  chemically treated genomic DNA (Homo sapiens) CpG-island No: 7812
atctaacgcgtccaaatctatcgcgcgcgacgacacgaccaaaccgccgccgaatatccccaaacccgcgaaaccgtcgcccttaacccgaaccccgtcgaacccgaacgcgataaaaaaacccttcttctaatcgccgaacacgctacaaataccgttctcgacgctcttcttcgccataacccctacgaacctcacgaccgaactaaaatcgcgacaccctacgaaaaactacgatcaaacgcgaaacaccgacgacaccgaaaaaaaccccgaaaacgcgaaccgaccgaaaaccgaaaaacgaccgaaccgaaaaacgaaacgacgaaaaaacgacgaaatacgaatcacaaacgacgcaatcaaaaacaatccacgaaacacttaaaaataaacctaaaaaatctcctatatatcaaaaacccgaaaacgcgcgaacgtcgacgaaacccgaccaaacgtccgcgacaacgattccgaaaactcttacccgcgactcgaacgataacgactaccacgactcctcgaccgacccgaaactcaacctaacgaaacacgaacgatatcgacgctcgcaatctacaaacgacgactaaaacaaaacctataacccgcgcccccgaccccgaccgaaacccgcgacgactacccgactcacccgaaactccgataacgacgacgacgactcaaacgcgcctcgccctctccttctaaacgacgacgactacaaccgctctcgaaaccgcgacgaactcaacgactcgccaccgcgttccgactattcctctcttcccgattcccgaccgacaaccgcttaaaaaccgactccgaaataatatcactatcgccccacccccacgactaaccgacccccctctccctcccgccctactcgtcacaatccgcccaccttatccctaccctcctcccgaaaaaaaatcgccgctccaacgaaaaac

SEQ ID NO: 7813 - DNA, 573 bp, Artificial Sequence
  chemically treated genomic DNA (Homo sapiens) CpG-island No: 7813
gcgatcgatatttgattgtttgtagttattaaacgtcgtatgcgtcgggtaagcgtgataatagttggtttatacgcgtttagtttgtatgtcgcgttttattttataggttagattatcgttgcggttttagacgttcgcgtttaggttatattgcgtatcgttcgttagttttagcgttttttttatcgttttgaaggtggttatcgttagtatcgggttaaaaatttttttttggaatattcgtatattgttttgattaaatagaatcgtcggttcgaggtagtagtcgttttttagtttattttttagtagtttgcgtcgttcgtttgtgagtacgttagcgtttttttttttatcgatattaatgtagttgaggatggtttttagttgttcgtgagaaatttgcgcgtttatttgcgttacgttgtcgagcgggttatcgttacgaatgttttcgatacggcggatggcgcgttttataaagcgttcgtagatagatttttgtattaaagtacgattcggataggtgtaaatttcgttcgtggttaaaggtaaatagtgtaaagtttt

SEQ ID NO: 7814 - DNA, 573 bp, Artificial Sequence
  chemically treated genomic DNA (Homo sapiens) CpG-island No: 7814
aaaactttacactatttacctttaaccacgaacgaaatttacacctatccgaatcgtactttaatacaaaaatctatctacgaacgctttataaaacgcgccatccgccgtatcgaaaacattcgtaacgataacccgctcgacaacgtaacgcaaataaacgcgcaaatttctcacgaacaactaaaaaccatcctcaactacattaatatcgataaaaaaaaaaacgctaacgtactcacaaacgaacgacgcaaactactaaaaaataaactaaaaaacgactactacctcgaaccgacgattctatttaatcaaaacaatatacgaatattccaaaaaaaaatttttaacccgatactaacgataaccaccttcaaaacgataaaaaaaacgctaaaactaacgaacgatacgcaatataacctaaacgcgaacgtctaaaaccgcaacgataatctaacctataaaataaaacgcgacatacaaactaaacgcgtataaaccaactattatcacgcttacccgacgcatacgacgtttaataactacaaacaatcaaatatcgatcgc

SEQ ID NO: 7815 - DNA, 573 bp, Artificial Sequence
  chemically treated genomic DNA (Homo sapiens) CpG-island No: 7815
aaggttttgtattgtttgtttttaattacgggcgaagtttgtatttgttcgagtcgtgttttagtgtaggaatttatttacgaacgttttatggaacgcgttattcgtcgtgtcgaaagtattcgtagcggtaattcgttcgatagcgtgacgtaaatgggcgcgtaggttttttacgggtaattggaaattatttttaattatattgatatcggtaaaaaagagggcgttgacgtgtttataggcgggcggcgtaagttgttggaaggtgaattgaaagacggttattatttcgaatcgacgattttgtttggttagaataatatgcgggtgttttaggaggagatttttggttcggtgttggcggtgattatttttaaaacgatggaagaagcgttggagttggcgaacgatacgtaatatggtttgggcgcgggcgtttggagtcgtaacggtaatttggtttataagatggggcgcggtatataggttgggcgcgtgtggattaattgttattacgtttattcggcgtatgcggcgtttggtggttataaataattaggtatcggtcgt

SEQ ID NO: 7816 - DNA, 573 bp, Artificial Sequence
  chemically treated genomic DNA (Homo sapiens) CpG-island No: 7816
acgaccgatacctaattatttataaccaccaaacgccgcatacgccgaataaacgtaataacaattaatccacacgcgcccaacctatataccgcgccccatcttataaaccaaattaccgttacgactccaaacgcccgcgcccaaaccatattacgtatcgttcgccaactccaacgcttcttccatcgttttaaaaataatcaccgccaacaccgaaccaaaaatctcctcctaaaacacccgcatattattctaaccaaacaaaatcgtcgattcgaaataataaccgtctttcaattcaccttccaacaacttacgccgcccgcctataaacacgtcaacgccctcttttttaccgatatcaatataattaaaaataatttccaattacccgtaaaaaacctacgcgcccatttacgtcacgctatcgaacgaattaccgctacgaatactttcgacacgacgaataacgcgttccataaaacgttcgtaaataaattcctacactaaaacacgactcgaacaaatacaaacttcgcccgtaattaaaaacaaacaatacaaaacctt

SEQ ID NO: 7817 - DNA, 788 bp, Artificial Sequence
  chemically treated genomic DNA (Homo sapiens) CpG-island No: 7817
ttcggttttacgtgtagaaatttcgtcggttcgaggtttcggttttaaaacggttttaagagttaaggtttttatagttcgtttttgagggtggtaaagaggtcgcgggggcggtgtttcgcgagatttaaataagtttacgtgggtaggggcggggtttcgcgaaggcgttacggcgcgttcgtgcgttgttgaggttacgcgtcggtagtatttttgttcgggggtcgtaaagcgcggaaggtcgcggtttcggttttttcggaattttttgttcgtttcgtttcgttttttttttattttcgaatttcgtttttcggttcgcggcgattttaggtaattgttgtggttgtcgtattgttttcgtcgggttgtagttgagcgcggagttcgtggggatcggtgaggtaaggagatagtttcggggtaattttggttttttcgttcgcgcgggtttaagcgtttcgggatttttgggttttttttttttttttttggtttcgttcgggggtggttttcgttagtttacgtttttagtgggtttcgtttggtttttcgcgaagtcgcgttcgggcgttagtattcgttttcgtaaggttgttcgttcgtgttttggtttgtgttttcggttatttttgggcgtgcgtatcgtttttttaggagtttgtattttagtttcgatgttagggcggtcggggtgatttcgggttttttcgtttcgggtttgtatatttttgcggcgtagagttaattttagtttgtttagttcggttttttatttttgtaga

SEQ ID NO: 7818 - DNA, 788 bp, Artificial Sequence
  chemically treated genomic DNA (Homo sapiens) CpG-island No: 7818
tctacaaaaataaaaaaccgaactaaacaaactaaaattaactctacgccgcaaaaatatacaaacccgaaacgaaaaaacccgaaatcaccccgaccgccctaacatcgaaactaaaatacaaactcctaaaaaaacgatacgcacgcccaaaaataaccgaaaacacaaaccaaaacacgaacgaacaaccttacgaaaacgaatactaacgcccgaacgcgacttcgcgaaaaaccaaacgaaacccactaaaaacgtaaactaacgaaaaccacccccgaacgaaaccaaaaaaaaaaaaaaaaaacccaaaaatcccgaaacgcttaaacccgcgcgaacgaaaaaaccaaaattaccccgaaactatctccttacctcaccgatccccacgaactccgcgctcaactacaacccgacgaaaacaatacgacaaccacaacaattacctaaaatcgccgcgaaccgaaaaacgaaattcgaaaataaaaaaaaaacgaaacgaaacgaacaaaaaattccgaaaaaaccgaaaccgcgaccttccgcgctttacgacccccgaacaaaaatactaccgacgcgtaacctcaacaacgcacgaacgcgccgtaacgccttcgcgaaaccccgcccctacccacgtaaacttatttaaatctcgcgaaacaccgcccccgcgacctctttaccaccctcaaaaacgaactataaaaaccttaactcttaaaaccgttttaaaaccgaaacctcgaaccgacgaaatttctacacgtaaaaccgaa

SEQ ID NO: 7819 - DNA, 788 bp, Artificial Sequence
  chemically treated genomic DNA (Homo sapiens) CpG-island No: 7819
tttgtagggatggaggatcgggttagataagttggagttggttttgcgtcgtaggggtgtgtaagttcgagacgggggagttcgaggttatttcggtcgttttggtatcggggttgaagtgtaggtttttggaggagcggtgcgtacgtttaggggtagtcgagaatataagttaaggtacgagcggataattttacggggacgagtattggcgttcggacgcgatttcgcgagaggttaggcggaatttattggaagcgtgagttagcggggattattttcgggcgaaattaaaggagaaagaggggaatttaggggtttcggggcgtttaggttcgcgcggacggggaggttagagttgtttcgaagttatttttttattttatcggtttttacgggtttcgcgtttagttatagttcggcgggagtaatgcggtagttataatagttgtttggggtcgtcgcgggtcggaaagcggggttcggggatgggaagggggcggggcgaagcgagtaaaaagtttcggggaagtcgagatcgcgatttttcgcgttttacggttttcgggtaagggtattgtcggcgcgtgattttagtagcgtacgagcgcgtcgtgacgttttcgcggagtttcgtttttgtttacgtgggtttgtttgggtttcgcgaggtatcgttttcgcggtttttttgttatttttagaggcgagttgtggaagttttgatttttagggtcgttttagaatcggggtttcggatcggcggggtttttgtacgtggaatcgga

SEQ ID NO: 7820 - DNA, 788 bp, Artificial Sequence
  chemically treated genomic DNA (Homo sapiens) CpG-island No: 7820
tccgattccacgtacaaaaaccccgccgatccgaaaccccgattctaaaacgaccctaaaaatcaaaacttccacaactcgcctctaaaaataacaaaaaaaccgcgaaaacgatacctcgcgaaacccaaacaaacccacgtaaacaaaaacgaaactccgcgaaaacgtcacgacgcgctcgtacgctactaaaatcacgcgccgacaatacccttacccgaaaaccgtaaaacgcgaaaaatcgcgatctcgacttccccgaaactttttactcgcttcgccccgcccccttcccatccccgaaccccgctttccgacccgcgacgaccccaaacaactattataactaccgcattactcccgccgaactataactaaacgcgaaacccgtaaaaaccgataaaataaaaaaataacttcgaaacaactctaacctccccgtccgcgcgaacctaaacgccccgaaacccctaaattcccctctttctcctttaatttcgcccgaaaataatccccgctaactcacgcttccaataaattccgcctaacctctcgcgaaatcgcgtccgaacgccaatactcgtccccgtaaaattatccgctcgtaccttaacttatattctcgactacccctaaacgtacgcaccgctcctccaaaaacctacacttcaaccccgataccaaaacgaccgaaataacctcgaactcccccgtctcgaacttacacacccctacgacgcaaaaccaactccaacttatctaacccgatcctccatccctacaaa

SEQ ID NO: 7821 - DNA, 1080 bp, Artificial Sequence
  chemically treated genomic DNA (Homo sapiens) CpG-island No: 7821
ggttttttcgtggacggcggtagtacggttttcggtttgcgttcgtagttgtttaggtttttggtttagggttgggcggcggcgtttttgcggcgggcggttcgtattaggttttgttgtagtacggggtagaggcgttggtagttttcgaggtttaggcgtacggttttcgtttagttttttgttaggtcgttttcgtcgttgtttagtagttcggttatttgatttagtataggtatgagcgttacggtgaggtcggcggcggcgcgttttttttcgagtcgcgtggggtttaggagttaggtgggcgcgggtttcggcgcgaggttgaggtcgtagtttattattaggtcgtatatttttacgttcgcgtcggttagggcgagcgcggcggcggtgagcgcggcggttagggtcgagttatcgttttttagtagtagcgtcgatatttcgagttgcgcgcgcgggtagcggtttaggcgtatagtcggttttagcgttttttgtagcgttagcgttagtttacgtttttcgtagtcgttcgggggagcgcggcgtcggcggttcgcgaagggtgcgcggcggaagtcgtagagtaggcgatcgcgtagcgcggtcggggtttcgtcgtttgtttcggtcgggtcgtcgtcgcgttcgtcgttttcggtttgtcgcgggttcgatacggtatatagtattttggtgtttttcgtttttaggtaggtcgagtttttggtttggtttagtagttcggcgcgcgcgtatacgggtcgtagtcgcgttgggtcgcgggtgtcgggcgtttttttttcgtcggtcgcgtatagttgcggcggttgcgattttttagggtcgcggatgcggcggtgatttttaggtatggcggtttttggcgtgcgaatttttttcgtttaacgttttgtcgtatttattggttttttcgttgtttaaagacgcgcggttgcgtatgggttgtcgagagagcggcgggaggtattatagcgtttttggaggttcggagggagaacggttcggttttagttgtgtagggtagtcggatttatttattttgttgga

SEQ ID NO: 7822 - DNA, 1080 bp, Artificial Sequence
  chemically treated genomic DNA (Homo sapiens) CpG-island No: 7822
tccaacaaaataaataaatccgactaccctacacaactaaaaccgaaccgttctccctccgaacctccaaaaacgctataatacctcccgccgctctctcgacaacccatacgcaaccgcgcgtctttaaacaacgaaaaaaccaataaatacgacaaaacgttaaacgaaaaaaattcgcacgccaaaaaccgccatacctaaaaatcaccgccgcatccgcgaccctaaaaaatcgcaaccgccgcaactatacgcgaccgacgaaaaaaaaacgcccgacacccgcgacccaacgcgactacgacccgtatacgcgcgcgccgaactactaaaccaaaccaaaaactcgacctacctaaaaacgaaaaacaccaaaatactatataccgtatcgaacccgcgacaaaccgaaaacgacgaacgcgacgacgacccgaccgaaacaaacgacgaaaccccgaccgcgctacgcgatcgcctactctacgacttccgccgcgcacccttcgcgaaccgccgacgccgcgctcccccgaacgactacgaaaaacgtaaactaacgctaacgctacaaaaaacgctaaaaccgactatacgcctaaaccgctacccgcgcgcgcaactcgaaatatcgacgctactactaaaaaacgataactcgaccctaaccgccgcgctcaccgccgccgcgctcgccctaaccgacgcgaacgtaaaaatatacgacctaataataaactacgacctcaacctcgcgccgaaacccgcgcccacctaactcctaaaccccacgcgactcgaaaaaaaacgcgccgccgccgacctcaccgtaacgctcatacctatactaaatcaaataaccgaactactaaacaacgacgaaaacgacctaacaaaaaactaaacgaaaaccgtacgcctaaacctcgaaaactaccaacgcctctaccccgtactacaacaaaacctaatacgaaccgcccgccgcaaaaacgccgccgcccaaccctaaaccaaaaacctaaacaactacgaacgcaaaccgaaaaccgtactaccgccgtccacgaaaaaacc

SEQ ID NO: 7823 - DNA, 1080 bp, Artificial Sequence
  chemically treated genomic DNA (Homo sapiens) CpG-island No: 7823
tttagtaagatggatggattcggttattttgtataattgggatcgggtcgtttttttttcgggtttttaggggcgttgtagtgtttttcgtcgttttttcgatagtttatgcgtagtcgcgcgtttttaaataacggaagaattagtggatgcggtagggcgttgggcggaaggggttcgtacgttaagaatcgttatgtttggggattatcgtcgtattcgcggttttgaagaatcgtagtcgtcgtagttgtacgcggtcgacgaggaggaggcgttcggtattcgcgatttaacgcggttacggttcgtgtacgcgcgcgtcgggttgttgagttaggttaagggttcggtttatttggaggcgggaggtattaaggtgttgtgtgtcgtgtcgggttcgcgataggtcgagggcggcgagcgcggcggcggttcggtcggagtaggcggcgaggtttcggtcgcgttgcgcggtcgtttgttttgcgattttcgtcgcgtatttttcgcgggtcgtcggcgtcgcgttttttcgggcggttgcgaggagcgtgagttggcgttggcgttgtaggaggcgttggagtcggttgtgcgtttgggtcgttattcgcgcgcgtagttcgaggtgtcggcgttgttgttggaggacggtggttcggttttggtcgtcgcgtttatcgtcgtcgcgttcgttttggtcgacgcgggcgtggagatgtacgatttggtggtgggttgcggttttagtttcgcgtcggggttcgcgtttatttggtttttggattttacgcggttcgaggaagagcgcgtcgtcgtcggttttatcgtggcgtttatgtttgtgttgaattaggtggtcgggttgttgggtagcggcgagggcggtttgatagagagttgggcggaggtcgtacgtttgggtttcgagggttgttagcgtttttatttcgtgttgtagtagagtttggtgcgggtcgttcgtcgtaggggcgtcgtcgtttagttttgaattagaagtttgagtaattacggacgtaagtcgaggatcgtgttgtcgtcgtttacgaaaagatt

SEQ ID NO: 7824 - DNA, 1080 bp, Artificial Sequence
  chemically treated genomic DNA (Homo sapiens) CpG-island No: 7824
aatcttttcgtaaacgacgacaacacgatcctcgacttacgtccgtaattactcaaacttctaattcaaaactaaacgacgacgcccctacgacgaacgacccgcaccaaactctactacaacacgaaataaaaacgctaacaaccctcgaaacccaaacgtacgacctccgcccaactctctatcaaaccgccctcgccgctacccaacaacccgaccacctaattcaacacaaacataaacgccacgataaaaccgacgacgacgcgctcttcctcgaaccgcgtaaaatccaaaaaccaaataaacgcgaaccccgacgcgaaactaaaaccgcaacccaccaccaaatcgtacatctccacgcccgcgtcgaccaaaacgaacgcgacgacgataaacgcgacgaccaaaaccgaaccaccgtcctccaacaacaacgccgacacctcgaactacgcgcgcgaataacgacccaaacgcacaaccgactccaacgcctcctacaacgccaacgccaactcacgctcctcgcaaccgcccgaaaaaacgcgacgccgacgacccgcgaaaaatacgcgacgaaaatcgcaaaacaaacgaccgcgcaacgcgaccgaaacctcgccgcctactccgaccgaaccgccgccgcgctcgccgccctcgacctatcgcgaacccgacacgacacacaacaccttaatacctcccgcctccaaataaaccgaacccttaacctaactcaacaacccgacgcgcgcgtacacgaaccgtaaccgcgttaaatcgcgaataccgaacgcctcctcctcgtcgaccgcgtacaactacgacgactacgattcttcaaaaccgcgaatacgacgataatccccaaacataacgattcttaacgtacgaaccccttccgcccaacgccctaccgcatccactaattcttccgttatttaaaaacgcgcgactacgcataaactatcgaaaaaacgacgaaaaacactacaacgcccctaaaaacccgaaaaaaaaacgacccgatcccaattatacaaaataaccgaatccatccatcttactaaa

SEQ ID NO: 7825 - DNA, 501 bp, Artificial Sequence
  chemically treated genomic DNA (Homo sapiens) CpG-island No: 7825
ggtaaggttttcggtttattcgtaatcgttagattcgttttattagtgattattttttttatcgtatttgtcgtattattagtagtaagtttaatttttatcgacgggtgtttcgcgcggaagcgatttagaatcggcggtagatggttgtaggtagcggttatcgagtagaagatatgtaattcgttagagagcgacggtttttgttgatcgatggtgtggcgtaattgttgatattgtaatagcgtttgttgggcgaaaacgcgtagtttttcgttcgttttagttagcgttatcgtgcggttatcgcgtataaatagcggttgatcgagatttttttttaggcgttgaatttgtcgtgagagcgtggatgggttaacgtgtatcgttcgcgcgttgcggttaaaatggcggtttttcgttagatgtaggaaggtttttagatcgcgtaaatttatagggatagttttcgatgttgacgttgtaaaaaaagtaatgtga

SEQ ID NO: 7826 - DNA, 501 bp, Artificial Sequence
  chemically treated genomic DNA (Homo sapiens) CpG-island No: 7826
tcacattactttttttacaacgtcaacatcgaaaactatccctataaatttacgcgatctaaaaaccttcctacatctaacgaaaaaccgccattttaaccgcaacgcgcgaacgatacacgttaacccatccacgctctcacgacaaattcaacgcctaaaaaaaaatctcgatcaaccgctatttatacgcgataaccgcacgataacgctaactaaaacgaacgaaaaactacgcgttttcgcccaacaaacgctattacaatatcaacaattacgccacaccatcgatcaacaaaaaccgtcgctctctaacgaattacatatcttctactcgataaccgctacctacaaccatctaccgccgattctaaatcgcttccgcgcgaaacacccgtcgataaaaattaaacttactactaataatacgacaaatacgataaaaaaaataatcactaataaaacgaatctaacgattacgaataaaccgaaaaccttacc

SEQ ID NO: 7827 - DNA, 501 bp, Artificial Sequence
  chemically treated genomic DNA (Homo sapiens) CpG-island No: 7827
ttatattgttttttttgtaacgttaatatcgagggttgtttttgtggatttacgcgatttgaaaatttttttgtatttggcggaaagtcgttattttggtcgtagcgcgcgggcgatgtacgttagtttatttacgtttttacggtagatttagcgtttggaagaagatttcggttagtcgttgtttgtgcgcgataatcgtacggtgacgttgattgaagcgggcgaagagttgcgcgttttcgtttagtaaacgttgttgtagtattagtagttgcgttatattatcgattagtaagggtcgtcgttttttggcgaattatatattttttgttcggtgatcgttgtttatagttatttgtcgtcgattttggatcgttttcgcgcggaatattcgtcggtggagattaaatttattattggtgatgcggtagatgcgatggaaaaggtggttattggtgaagcggatttggcgattgcgggtaaatcggaaattttgtt

SEQ ID NO: 7828 - DNA, 501 bp, Artificial Sequence
  chemically treated genomic DNA (Homo sapiens) CpG-island No: 7828
aacaaaatttccgatttacccgcaatcgccaaatccgcttcaccaataaccaccttttccatcgcatctaccgcatcaccaataataaatttaatctccaccgacgaatattccgcgcgaaaacgatccaaaatcgacgacaaataactataaacaacgatcaccgaacaaaaaatatataattcgccaaaaaacgacgacccttactaatcgataatataacgcaactactaatactacaacaacgtttactaaacgaaaacgcgcaactcttcgcccgcttcaatcaacgtcaccgtacgattatcgcgcacaaacaacgactaaccgaaatcttcttccaaacgctaaatctaccgtaaaaacgtaaataaactaacgtacatcgcccgcgcgctacgaccaaaataacgactttccgccaaatacaaaaaaattttcaaatcgcgtaaatccacaaaaacaaccctcgatattaacgttacaaaaaaaacaatataa

SEQ ID NO: 7829 - DNA, 519 bp, Artificial Sequence
  chemically treated genomic DNA (Homo sapiens) CpG-island No: 7829
  misc_feature (487)..(488): n is either a, c, g or t
tgattgcgtcgtttgtcgcgttggttacggttttttcgtggttggggacgttcggtatagtaggaatcggaatgatattcgtattgattgcgttggtgttttatgttttgttgtcgttggtgcgcggcgtggtagtcggtttgaattagatttcgcgcgatgtgttggaaagcgttagagcgatggggatgagcggggcgtagcgttttttgtatgtttagttatcgttggcgttatcggtatttttgcgtagtttgcgggtggtgatggtgtaaattgtaggtatggcggtgattgcggcgttaatcggcgtaggcggttttggtgcgttgggttttttttacggggttggttaagtacgcgttattgatttagtgttgttgggggtgatttcggtaattgttttggcggtgtttatcgacgcggttgtttcggaatttgggtttaatttcggtatttttgggttttttgggtatagggtggaaanncggtagagtgatttgaatttagttatgttag

SEQ ID NO: 7830 - DNA, 519 bp, Artificial Sequence
  chemically treated genomic DNA (Homo sapiens) CpG-island No: 7830
  misc_feature (32)..(33): n is either a, c, g or t
ctaacataactaaattcaaatcactctaccgnntttccaccctatacccaaaaaacccaaaaataccgaaattaaacccaaattccgaaacaaccgcgtcgataaacaccgccaaaacaattaccgaaatcacccccaacaacactaaatcaataacgcgtacttaaccaaccccgtaaaaaaaacccaacgcaccaaaaccgcctacgccgattaacgccgcaatcaccgccatacctacaatttacaccatcaccacccgcaaactacgcaaaaataccgataacgccaacgataactaaacatacaaaaaacgctacgccccgctcatccccatcgctctaacgctttccaacacatcgcgcgaaatctaattcaaaccgactaccacgccgcgcaccaacgacaacaaaacataaaacaccaacgcaatcaatacgaatatcattccgattcctactataccgaacgtccccaaccacgaaaaaaccgtaaccaacgcgacaaacgacgcaatca

SEQ ID NO: 7831 - DNA, 519 bp, Artificial Sequence
  chemically treated genomic DNA (Homo sapiens) CpG-island No: 7831
  misc_feature (32)..(33): n is either a, c, g or t
ttgatatggttaaatttaagttattttatcgnntttttattttgtgtttaaaaggtttaagggtgtcggagttaagtttaaatttcgaaatagtcgcgtcggtaagtatcgttagaataattatcgggattatttttagtaatattaaattaatggcgcgtgtttagttagtttcgtgggaaaaatttagcgtattaaaatcgtttgcgtcgattaacgtcgtaattatcgttatatttatagtttgtattattattattcgtaggttgcgtagaaatatcggtaacgttagcggtaattgaatatgtaggaaacgttgcgtttcgtttatttttatcgttttggcgttttttagtatatcgcgcgggatttggtttaaatcgattattacgtcgcgtattagcggtagtaaggtatagagtattagcgtaattagtgcgggtgttatttcggtttttgttatgtcgagcgtttttagttacggaaaggtcgtaattagcgcggtaagcggcgtaatta

SEQ ID NO: 7832 - DNA, 519 bp, Artificial Sequence
  chemically treated genomic DNA (Homo sapiens) CpG-island No: 7832
  misc_feature (487)..(488): n is either a, c, g or t
taattacgccgcttaccgcgctaattacgacctttccgtaactaaaaacgctcgacataacaaaaaccgaaataacacccgcactaattacgctaatactctataccttactaccgctaatacgcgacgtaataatcgatttaaaccaaatcccgcgcgatatactaaaaaacgccaaaacgataaaaataaacgaaacgcaacgtttcctacatattcaattaccgctaacgttaccgatatttctacgcaacctacgaataataataatacaaactataaatataacgataattacgacgttaatcgacgcaaacgattttaatacgctaaatttttcccacgaaactaactaaacacgcgccattaatttaatattactaaaaataatcccgataattattctaacgatacttaccgacgcgactatttcgaaatttaaacttaactccgacacccttaaaccttttaaacacaaaataaaaanncgataaaataacttaaatttaaccatatcaa

SEQ ID NO: 7833 - DNA, 706 bp, Artificial Sequence
  chemically treated genomic DNA (Homo sapiens) CpG-island No: 7833
acgtatttattggtgattttgatatagttgttgacgattagagagcgtacgttatgggattagttcgtgaacgttggtgtaatcggcgttgtaagaaacgtgtttattttttagattagattaggtcgggttggagataattttgcgcggttgtgtttgaatatcgcggaagcggattttttcgttttttttatttagcgttagatgcgtatggttacgatcggtaaattcgtttagggtagtttaggtttttacggttatttgatcgttggttttcggtgttagtgttaggattatttttgtcgtattaattgcggtgtttagtatcggttggtttttcgtcggatttttcgttttggtgtagttgagtttacgtagtagatttatttcgttttgggtgttttaggtaatttttttatcgttattatcgattttttttattagcgggtcgatagaggtaaagcgttcgtaagtcgtcggataatcgcgttttacgattataatgtgtggcgcggttttatacgtgggattaggtcgtattcgttttttttttagttttttatatttagcggttgcgttagtttagcggtagagttatgttggataggtagcgtgacgatgtcggtttttttatttagatggtttaacgttaatatatttcggagaaattttttcgcgatggttttgtagattttttagtcgtttt

SEQ ID NO: 7834 - DNA, 706 bp, Artificial Sequence
  chemically treated genomic DNA (Homo sapiens) CpG-island No: 7834
aaaacgactaaaaaatctacaaaaccatcgcgaaaaaatttctccgaaatatattaacgttaaaccatctaaataaaaaaaccgacatcgtcacgctacctatccaacataactctaccgctaaactaacgcaaccgctaaatataaaaaactaaaaaaaaaacgaatacgacctaatcccacgtataaaaccgcgccacacattataatcgtaaaacgcgattatccgacgacttacgaacgctttacctctatcgacccgctaataaaaaaaatcgataataacgataaaaaaattacctaaaacacccaaaacgaaataaatctactacgtaaactcaactacaccaaaacgaaaaatccgacgaaaaaccaaccgatactaaacaccgcaattaatacgacaaaaataatcctaacactaacaccgaaaaccaacgatcaaataaccgtaaaaacctaaactaccctaaacgaatttaccgatcgtaaccatacgcatctaacgctaaataaaaaaaacgaaaaaatccgcttccgcgatattcaaacacaaccgcgcaaaattatctccaacccgacctaatctaatctaaaaaataaacacgtttcttacaacgccgattacaccaacgttcacgaactaatcccataacgtacgctctctaatcgtcaacaactatatcaaaatcaccaataaatacgt

SEQ ID NO: 7835 - DNA, 706 bp, Artificial Sequence
  chemically treated genomic DNA (Homo sapiens) CpG-island No: 7835
aaagcgattgggaaatttataaagttatcgcgaagaaattttttcgaagtgtgttggcgttgggttatttgggtaaagaaatcgatatcgttacgttgtttatttagtatgattttgtcgttgaattggcgtagtcgttggatgtgaaagattggaaaaaaggcgagtgcgatttgattttacgtgtaaaatcgcgttatatattatggtcgtagagcgcgattattcggcgatttacgaacgttttatttttatcggttcgttgatggagaaaatcggtaatggcggtaaagggattgtttggaatatttagagcgagatggatttgttgcgtaagtttaattatattaaagcggaaggttcggcgaaaggttagtcgatgttgaatatcgtaattgatgcggtagagatgattttgatattggtatcggaaattaacggttaggtagtcgtgaaagtttgggttgttttgagcgaatttatcggtcgtgattatacgtatttggcgttgaataaagaagacgagaagattcgttttcgcgatatttaggtatagtcgcgtaaaattatttttagttcgatttggtttggtttggaagatgaatacgttttttataacgtcggttatattaacgtttacgagttgattttatggcgtacgttttttggtcgttagtaattgtattaggattattagtggatgcgt

SEQ ID NO: 7836 - DNA, 706 bp, Artificial Sequence
  chemically treated genomic DNA (Homo sapiens) CpG-island No: 7836
acgcatccactaataatcctaatacaattactaacgaccaaaaaacgtacgccataaaatcaactcgtaaacgttaatataaccgacgttataaaaaacgtattcatcttccaaaccaaaccaaatcgaactaaaaataattttacgcgactatacctaaatatcgcgaaaacgaatcttctcgtcttctttattcaacgccaaatacgtataatcacgaccgataaattcgctcaaaacaacccaaactttcacgactacctaaccgttaatttccgataccaatatcaaaatcatctctaccgcatcaattacgatattcaacatcgactaacctttcgccgaaccttccgctttaatataattaaacttacgcaacaaatccatctcgctctaaatattccaaacaatccctttaccgccattaccgattttctccatcaacgaaccgataaaaataaaacgttcgtaaatcgccgaataatcgcgctctacgaccataatatataacgcgattttacacgtaaaatcaaatcgcactcgccttttttccaatctttcacatccaacgactacgccaattcaacgacaaaatcatactaaataaacaacgtaacgatatcgatttctttacccaaataacccaacgccaacacacttcgaaaaaatttcttcgcgataactttataaatttcccaatcgcttt

SEQ ID NO: 7837 - DNA, 579 bp, Artificial Sequence
  chemically treated genomic DNA (Homo sapiens) CpG-island No: 7837
gagtcgcgggcgttgtaattgttggtacgcgtcgttgaaggtagtttgcgagatgttttaagtttgatcgattaggcgattgttagcggtgacggttaggttttaatttaggcggttagtgcgatgttgggtacgtttgacgacgattaggcgttgtcgttggttgaagcgatggtcgaggttaacggcgagcgcgtaatggcgttgattaatgaagtcgttgttcgtggtatcgagtgggaagcgttgttggtggaaatgttcggtttgttgtatcgtattgcgatggtataattttcgtttgttgtatttggtaacgatatggtcgttatcgagttgcggatgcgtgaattggcgcgtattatatcgtcgacggatatttagttttattattagacgttgttgattggtcgtaaagaattatcgtatgcgtcggatcgtcgtatgggcgttgagatgacgttgttgcgcgcgttggtattttattcgcgtatgtcgttgtttgagttagaagtgttacgatagttttttgtattcgtcgcgttaacggtagtaatgacgttaatttaggtgtcgtcg

SEQ ID NO: 7838 - DNA, 579 bp, Artificial Sequence
  chemically treated genomic DNA (Homo sapiens) CpG-island No: 7838
cgacgacacctaaattaacgtcattactaccgttaacgcgacgaatacaaaaaactatcgtaacacttctaactcaaacaacgacatacgcgaataaaataccaacgcgcgcaacaacgtcatctcaacgcccatacgacgatccgacgcatacgataattctttacgaccaatcaacaacgtctaataataaaactaaatatccgtcgacgatataatacgcgccaattcacgcatccgcaactcgataacgaccatatcgttaccaaatacaacaaacgaaaattataccatcgcaatacgatacaacaaaccgaacatttccaccaacaacgcttcccactcgataccacgaacaacgacttcattaatcaacgccattacgcgctcgccgttaacctcgaccatcgcttcaaccaacgacaacgcctaatcgtcgtcaaacgtacccaacatcgcactaaccgcctaaattaaaacctaaccgtcaccgctaacaatcgcctaatcgatcaaacttaaaacatctcgcaaactaccttcaacgacgcgtaccaacaattacaacgcccgcgactc

SEQ ID NO: 7839 - DNA, 579 bp, Artificial Sequence
  chemically treated genomic DNA (Homo sapiens) CpG-island No: 7839
cggcggtatttgggttggcgttattattgtcgttggcgcgacgggtgtaaaggattgtcgtggtatttttggtttaggtagcggtatacgcggatggaatgttagcgcgcgtagtagcgttattttaacgtttatgcgacggttcggcgtatacggtaattttttgcgattaattaatagcgtttgatagtaaagttgaatattcgtcggcggtatggtgcgcgttagtttacgtattcgtagttcgatggcggttatgtcgttgttaagtgtagtaggcgaaagttgtattatcgtaatacgatgtaataggtcgagtatttttattagtaacgttttttattcgatattacgggtagcggttttattaattagcgttattacgcgttcgtcgttggtttcgattatcgttttaattagcgatagcgtttgatcgtcgttaagcgtatttagtatcgtattgatcgtttgggttgaaatttggtcgttatcgttggtaatcgtttggtcggttagatttaaggtatttcgtaggttgtttttagcggcgcgtgttagtaattgtagcgttcgcggttt

SEQ ID NO: 7840 - DNA, 579 bp, Artificial Sequence
  chemically treated genomic DNA (Homo sapiens) CpG-island No: 7840
aaaccgcgaacgctacaattactaacacgcgccgctaaaaacaacctacgaaataccttaaatctaaccgaccaaacgattaccaacgataacgaccaaatttcaacccaaacgatcaatacgatactaaatacgcttaacgacgatcaaacgctatcgctaattaaaacgataatcgaaaccaacgacgaacgcgtaataacgctaattaataaaaccgctacccgtaatatcgaataaaaaacgttactaataaaaatactcgacctattacatcgtattacgataatacaactttcgcctactacacttaacaacgacataaccgccatcgaactacgaatacgtaaactaacgcgcaccataccgccgacgaatattcaactttactatcaaacgctattaattaatcgcaaaaaattaccgtatacgccgaaccgtcgcataaacgttaaaataacgctactacgcgcgctaacattccatccgcgtataccgctacctaaaccaaaaataccacgacaatcctttacacccgtcgcgccaacgacaataataacgccaacccaaataccgccg

SEQ ID NO: 7841 - DNA, 673 bp, Artificial Sequence
  chemically treated genomic DNA (Homo sapiens) CpG-island No: 7841
gtttttcgttacgttagttgttaaacgtagaaatagcggtaaaagcggcgaattaggtttcgattttatgtgtcgatttttcggtaatggcggaaagtttttcgttattgacggtatttagtttttgtatgcgtttttgttttagtaaagttatgaattggttattttaaatcgggttgagcggatgtagcgttttttgatttttaataaattttttagcggcgttaattattcgttgttgacgtaattcgcgtttattggcgggtaaatttttttcgttttttaatagacggtcgcgtatatgggtatcggttttcgttagttcgggtatcggcggttgatgggaaagtttatcggaatttaggaatagtacgcgtttattgagagtgttggtgaaacgtttaatggttttatttaatatgcgggtacgttggaaatcgggtagcggcgtggcgatatcgttgatgaatataggtagaattggtattttatttagtttatcgagtaggaattttagcggttgggcgaattcgtggtttatttgtatatagtaagaaacggtaagatcgatttcgttttttatgacggtatgcgtataggttttcgttagttttataggtacgggtagtttttttgtcgtattgtcgaaattattaattgtcgtcgttttaat

SEQ ID NO: 7842 - DNA, 673 bp, Artificial Sequence
  chemically treated genomic DNA (Homo sapiens) CpG-island No: 7842
attaaaacgacgacaattaataatttcgacaatacgacaaaaaaactacccgtacctataaaactaacgaaaacctatacgcataccgtcataaaaaacgaaatcgatcttaccgtttcttactatatacaaataaaccacgaattcgcccaaccgctaaaattcctactcgataaactaaataaaataccaattctacctatattcatcaacgatatcgccacgccgctacccgatttccaacgtacccgcatattaaataaaaccattaaacgtttcaccaacactctcaataaacgcgtactattcctaaattccgataaactttcccatcaaccgccgatacccgaactaacgaaaaccgatacccatatacgcgaccgtctattaaaaaacgaaaaaaatttacccgccaataaacgcgaattacgtcaacaacgaataattaacgccgctaaaaaatttattaaaaatcaaaaaacgctacatccgctcaacccgatttaaaataaccaattcataactttactaaaacaaaaacgcatacaaaaactaaataccgtcaataacgaaaaactttccgccattaccgaaaaatcgacacataaaatcgaaacctaattcgccgcttttaccgctatttctacgtttaacaactaacgtaacgaaaaac

SEQ ID NO: 7843 - DNA, 673 bp, Artificial Sequence
  chemically treated genomic DNA (Homo sapiens) CpG-island No: 7843
gttggagcgacggtaattggtgatttcggtagtgcggtaggagagttgttcgtgtttgtggagttggcggaggtttgtgcgtatgtcgttatgaagagcgggatcgattttgtcgttttttattgtatgtaggtggattacgggttcgtttagtcgttggagtttttgttcggtgggttggataaggtgttagttttgtttgtgtttattaacggtgtcgttacgtcgttgttcggtttttagcgtattcgtatgttgggtgaagttattggacgttttattagtatttttaataaacgcgtgttgtttttgggtttcggtgggtttttttattagtcgtcggtgttcgaattggcgaaagtcgatgtttatatgcgcgatcgtttgttggggagcgggaaagatttattcgttagtgagcgcgaattgcgttagtaacgggtgattagcgtcgttgagaagtttgttgaggattagagaacgttgtattcgtttaattcgatttgggataattagtttatgattttgttggagtagggacgtatataggaattggatgtcgttagtaacgaagagtttttcgttattgtcggaaagtcgatatatgaaatcgaaatttggttcgtcgtttttgtcgttatttttgcgtttggtaattggcgtagcgaagggt

SEQ ID NO: 7844 - DNA, 673 bp, Artificial Sequence
  chemically treated genomic DNA (Homo sapiens) CpG-island No: 7844
acccttcgctacgccaattaccaaacgcaaaaataacgacaaaaacgacgaaccaaatttcgatttcatatatcgactttccgacaataacgaaaaactcttcgttactaacgacatccaattcctatatacgtccctactccaacaaaatcataaactaattatcccaaatcgaattaaacgaatacaacgttctctaatcctcaacaaacttctcaacgacgctaatcacccgttactaacgcaattcgcgctcactaacgaataaatctttcccgctccccaacaaacgatcgcgcatataaacatcgactttcgccaattcgaacaccgacgactaataaaaaaacccaccgaaacccaaaaacaacacgcgtttattaaaaatactaataaaacgtccaataacttcacccaacatacgaatacgctaaaaaccgaacaacgacgtaacgacaccgttaataaacacaaacaaaactaacaccttatccaacccaccgaacaaaaactccaacgactaaacgaacccgtaatccacctacatacaataaaaaacgacaaaatcgatcccgctcttcataacgacatacgcacaaacctccgccaactccacaaacacgaacaactctcctaccgcactaccgaaatcaccaattaccgtcgctccaac

SEQ ID NO: 7845 - DNA, 693 bp, Artificial Sequence
  chemically treated genomic DNA (Homo sapiens) CpG-island No: 7845
ggaataggaattttagcggttcggtagtgtcgttaacgacgtaggcgattaggttagaaattagtagatttttaattttatggcgatttttcgggcgcgcgtagtgatatatagttaacgttgtatttggtagatcgtcgagaaacgtaggtattttattttgcgaaaggaaacgcgtggcgtttttagaaaaatcgtgagtggtcgggtaatttaattgcgtttggaagatggttagtgcgtcgttgacggtttgatcgtagattttttgcgtgtcgtttgcgtcggtaaagcgaattaatgttattagaatgtgatgtagattaaacggtaatagtagacgtttatcggtattaaatagtatcggttcgaaattattcgcgttgtttattatatggtttaagtcgttaatatttatggcgaaaatcggttagattaatggaattattaggtcgataaggtttattattagcgaggagataattggtacgaagcgcgtatcgtcgaagaatgttagcgtattcggtaggcggatattatggaaacgtttatgtagtatttagacgataatatcggcgattatcgtatcgaggatttcggtatcgatcgattggattttaagaatgttttggatgttattggtttttagaatcgcggtattcgtggttggtagaatgtttttattggttaatt

SEQ ID NO: 7846 - DNA, 693 bp, Artificial Sequence
  chemically treated genomic DNA (Homo sapiens) CpG-island No: 7846
aattaaccaataaaaacattctaccaaccacgaataccgcgattctaaaaaccaataacatccaaaacattcttaaaatccaatcgatcgataccgaaatcctcgatacgataatcgccgatattatcgtctaaatactacataaacgtttccataatatccgcctaccgaatacgctaacattcttcgacgatacgcgcttcgtaccaattatctcctcgctaataataaaccttatcgacctaataattccattaatctaaccgattttcgccataaatattaacgacttaaaccatataataaacaacgcgaataatttcgaaccgatactatttaataccgataaacgtctactattaccgtttaatctacatcacattctaataacattaattcgctttaccgacgcaaacgacacgcaaaaaatctacgatcaaaccgtcaacgacgcactaaccatcttccaaacgcaattaaattacccgaccactcacgatttttctaaaaacgccacgcgtttcctttcgcaaaataaaatacctacgtttctcgacgatctaccaaatacaacgttaactatatatcactacgcgcgcccgaaaaatcgccataaaattaaaaatctactaatttctaacctaatcgcctacgtcgttaacgacactaccgaaccgctaaaattcctattcc

SEQ ID NO: 7847 - DNA, 693 bp, Artificial Sequence
  chemically treated genomic DNA (Homo sapiens) CpG-island No: 7847
ggttgattaataaaggtattttgttaattacggatgtcgcggttttgaaagttaataatatttagagtatttttgggatttagtcgatcgatatcgggattttcggtgcggtgatcgtcggtattatcgtttggatgttgtatgagcgtttttataatattcgtttgtcggatgcgttggtatttttcggcggtacgcgtttcgtattaattattttttcgttggtgatgggttttgtcggtttggtgattttattagtttggtcgattttcgttatgggtattagcggtttgggttatatgataaatagcgcgggtgatttcggatcgatgttgtttggtatcggtgaacgtttgttgttgtcgtttggtttgtattatattttggtggtattaattcgttttatcgacgtaggcggtacgtaggaagtttgcggttaaatcgttagcggcgtattgattattttttaggcgtaattgagttgttcgattatttacggtttttttgaaagcgttacgcgttttttttcgtaaggtaaaatgtttgcgtttttcggcggtttgttaggtgtagcgttagttatgtattattgcgcgcgttcggaaaatcgttataaaattaaaggtttgttgatttttggtttgatcgtttgcgtcgttggcggtattatcgaatcgttggaatttttgtttt

SEQ ID NO: 7848 - DNA, 693 bp, Artificial Sequence
  chemically treated genomic DNA (Homo sapiens) CpG-island No: 7848
aaaacaaaaattccaacgattcgataataccgccaacgacgcaaacgatcaaaccaaaaatcaacaaacctttaattttataacgattttccgaacgcgcgcaataatacataactaacgctacacctaacaaaccgccgaaaaacgcaaacattttaccttacgaaaaaaaacgcgtaacgctttcaaaaaaaccgtaaataatcgaacaactcaattacgcctaaaaaataatcaatacgccgctaacgatttaaccgcaaacttcctacgtaccgcctacgtcgataaaacgaattaataccaccaaaatataatacaaaccaaacgacaacaacaaacgttcaccgataccaaacaacatcgatccgaaatcacccgcgctatttatcatataacccaaaccgctaatacccataacgaaaatcgaccaaactaataaaatcaccaaaccgacaaaacccatcaccaacgaaaaaataattaatacgaaacgcgtaccgccgaaaaataccaacgcatccgacaaacgaatattataaaaacgctcatacaacatccaaacgataataccgacgatcaccgcaccgaaaatcccgatatcgatcgactaaatcccaaaaatactctaaatattattaactttcaaaaccgcgacatccgtaattaacaaaatacctttattaatcaacc

SEQ ID NO: 7849 - DNA, 659 bp, Artificial Sequence
  chemically treated genomic DNA (Homo sapiens) CpG-island No: 7849
  misc_feature (428)..(428): n is either a, c, g or t
gtaggtcggggcgattattatgttgatcgtgcgtttggggtcggtgatttcgtttatgattggcggtttattgttggcgatcggtggcgtagtttggaattacgggttggcggcggcgggtacgtttattattttgttatcgttgttaagtttttcggcgttgttatcgttatcgtagtcgcgtgagtattcgttgaaattattattggtaggatttcgttttttgtttgttagttcgttggtgggcgggattgcgttgttgggtggtttattgacgatggcgagcgcggtgcgggtattgtattcggcgttggttgataattggtagatgttagcggtatagattggttttttttacgcggcgatttcgttcggcgcggttattggtgcgttaattagcgggaagttggtatatagtgcgcgattanggttattgatgttgttttttacgttgggatcgtttttcgttattggtttgtttggtttgatgtcgatgtggattttaggcgtggtttgtttggcgttgttcggttggttgagtgcggttagttcgttgttgtaatatataatgttgtaaacgtaagattcgggaagcgatgttagggcggattaacgggttgtggacggggtaaaagtgacggcgatgttattgggtcggg

SEQ ID NO: 7850 - DNA, 659 bp, Artificial Sequence
  chemically treated genomic DNA (Homo sapiens) CpG-island No: 7850
  misc_feature (232)..(232): n is either a, c, g or t
cccgacccaataacatcgccgtcacttttaccccgtccacaacccgttaatccgccctaacatcgcttcccgaatcttacgtttacaacattatatattacaacaacgaactaaccgcactcaaccaaccgaacaacgccaaacaaaccacgcctaaaatccacatcgacatcaaaccaaacaaaccaataacgaaaaacgatcccaacgtaaaaaacaacatcaataaccntaatcgcgcactatataccaacttcccgctaattaacgcaccaataaccgcgccgaacgaaatcgccgcgtaaaaaaaaccaatctataccgctaacatctaccaattatcaaccaacgccgaatacaatacccgcaccgcgctcgccatcgtcaataaaccacccaacaacgcaatcccgcccaccaacgaactaacaaacaaaaaacgaaatcctaccaataataatttcaacgaatactcacgcgactacgataacgataacaacgccgaaaaacttaacaacgataacaaaataataaacgtacccgccgccgccaacccgtaattccaaactacgccaccgatcgccaacaataaaccgccaatcataaacgaaatcaccgaccccaaacgcacgatcaacataataatcgccccgacctac

SEQ ID NO: 7851 - DNA, 659 bp, Artificial Sequence
  chemically treated genomic DNA (Homo sapiens) CpG-island No: 7851
  misc_feature (232)..(232): n is either a, c, g or t
ttcggtttaatggtatcgtcgttatttttgtttcgtttataattcgttaattcgttttaatatcgtttttcgggttttgcgtttgtagtattgtgtattgtagtaacgagttgatcgtatttaattagtcgaatagcgttagataaattacgtttaaaatttatatcggtattaggttaaatagattaatggcgaggaacgattttagcgtggagagtagtattaataattntggtcgcgtattatgtgttagtttttcgttggttaacgtattaatagtcgcgtcgagcgggatcgtcgcgtagagaaaattaatttgtgtcgttgatatttgttagttgttagttagcgtcggatatagtattcgtatcgcgttcgttatcgttaataaattatttagtagcgtaatttcgtttattagcgggttggtaagtagaaaacgaaattttgttagtaatgattttaacggatgtttacgcggttgcggtggcggtggtaacgtcggaaggtttaataacggtagtaaggtaataaacgtgttcgtcgtcgttagttcgtagttttaggttacgttatcggtcgttagtaataaatcgttaattatgggcgaaattatcgattttagacgtacggttaatatggtgatcgtttcggtttgt

SEQ ID NO: 7852 - DNA, 659 bp, Artificial Sequence
  chemically treated genomic DNA (Homo sapiens) CpG-island No: 7852
  misc_feature (428)..(428): n is either a, c, g or t
acaaaccgaaacgatcaccatattaaccgtacgtctaaaatcgataatttcgcccataattaacgatttattactaacgaccgataacgtaacctaaaactacgaactaacgacgacgaacacgtttattaccttactaccgttattaaaccttccgacgttaccaccgccaccgcaaccgcgtaaacatccgttaaaatcattactaacaaaatttcgttttctacttaccaacccgctaataaacgaaattacgctactaaataatttattaacgataacgaacgcgatacgaatactatatccgacgctaactaacaactaacaaatatcaacgacacaaattaattttctctacgcgacgatcccgctcgacgcgactattaatacgttaaccaacgaaaaactaacacataatacgcgaccanaattattaatactactctccacgctaaaatcgttcctcgccattaatctatttaacctaataccgatataaattttaaacgtaatttatctaacgctattcgactaattaaatacgatcaactcgttactacaatacacaatactacaaacgcaaaacccgaaaaacgatattaaaacgaattaacgaattataaacgaaacaaaaataacgacgataccattaaaccgaa

SEQ ID NO: 7853 - DNA, 641 bp, Artificial Sequence
  chemically treated genomic DNA (Homo sapiens) CpG-island No: 7853
ttgcgtaaattcgcgattggttataagtcggatagcggaggcgaagtgttgttgatgaacggcgacgacgcgcgttcggtgcgtgtttcggagattagtgtgttggtgcgtagtcggtaggaggtcgattaggtgcgcgatgttttaacgttgttggaaatttttttcgtttatttttcgaatcgcgatagtgttttagaaattttggacgcgtaggaaatgttatggtggttgtaggcggtgatgacgttcgaacgtgagaatattttgcgtagtgcgttggtaacgttaatgatggggttgaaagtattggatatcgaaacgttgaatattgacgaatatgcgtgggattgtggtattcgaagtagttcgatggttatcggtaaatttggcgtaaacgtggcgttatgtcgatgttgcgggcgttgatgtcggcgcgtaaattgtcgtgtagttggaaggtgaacggatgttggtacgtttcgggcgtagtcgtttttcgttgtttattttgttagcggcggatttttcgaatttcgatgattggtagagtgaagtcgaatttattttgtcgtaggtaacgatgaagcgtttgattgaagcgatttagttttttatggcgtattaggacgttcgttatt

SEQ ID NO: 7854 - DNA, 641 bp, Artificial Sequence
  chemically treated genomic DNA (Homo sapiens) CpG-island No: 7854
aataacgaacgtcctaatacgccataaaaaactaaatcgcttcaatcaaacgcttcatcgttacctacgacaaaataaattcgacttcactctaccaatcatcgaaattcgaaaaatccgccgctaacaaaataaacaacgaaaaacgactacgcccgaaacgtaccaacatccgttcaccttccaactacacgacaatttacgcgccgacatcaacgcccgcaacatcgacataacgccacgtttacgccaaatttaccgataaccatcgaactacttcgaataccacaatcccacgcatattcgtcaatattcaacgtttcgatatccaatactttcaaccccatcattaacgttaccaacgcactacgcaaaatattctcacgttcgaacgtcatcaccgcctacaaccaccataacatttcctacgcgtccaaaatttctaaaacactatcgcgattcgaaaaataaacgaaaaaaatttccaacaacgttaaaacatcgcgcacctaatcgacctcctaccgactacgcaccaacacactaatctccgaaacacgcaccgaacgcgcgtcgtcgccgttcatcaacaacacttcgcctccgctatccgacttataaccaatcgcgaatttacgcaa

SEQ ID NO: 7855 - DNA, 641 bp, Artificial Sequence
  chemically treated genomic DNA (Homo sapiens) CpG-island No: 7855
aatagcgaacgttttgatgcgttatagaaaattgggtcgttttaattagacgttttatcgttgtttgcggtagggtaaattcgattttattttgttagttatcgaggttcgggaaattcgtcgttggtagggtagatagcgaaaaacggttacgttcggagcgtattagtattcgtttattttttagttgtacggtaatttacgcgtcgatattagcgttcgtagtatcggtataacgttacgtttgcgttagatttgtcgataattatcgaattgtttcgagtattatagttttacgtatgttcgttagtgtttagcgtttcgatatttagtgtttttagttttattattgacgttattagcgtattacgtagggtgtttttacgttcgggcgttattatcgtttgtaattattatagtattttttgcgcgtttagagtttttaaaatattgtcgcggttcgaaaggtaaacggaagggatttttagtaacgttaaggtatcgcgtatttggtcggttttttgtcggttgcgtattagtatattgattttcgaagtacgtatcggacgcgcgtcgtcgtcgtttattagtaatatttcgttttcgttgttcggtttgtagttagtcgcggatttgcgtag

SEQ ID NO: 7856 - DNA, 641 bp, Artificial Sequence
  chemically treated genomic DNA (Homo sapiens) CpG-island No: 7856
ctacgcaaatccgcgactaactacaaaccgaacaacgaaaacgaaatattactaataaacgacgacgacgcgcgtccgatacgtacttcgaaaatcaatatactaatacgcaaccgacaaaaaaccgaccaaatacgcgataccttaacgttactaaaaatcccttccgtttacctttcgaaccgcgacaatattttaaaaactctaaacgcgcaaaaaatactataataattacaaacgataataacgcccgaacgtaaaaacaccctacgtaatacgctaataacgtcaataataaaactaaaaacactaaatatcgaaacgctaaacactaacgaacatacgtaaaactataatactcgaaacaattcgataattatcgacaaatctaacgcaaacgtaacgttataccgatactacgaacgctaatatcgacgcgtaaattaccgtacaactaaaaaataaacgaatactaatacgctccgaacgtaaccgtttttcgctatctaccctaccaacgacgaatttcccgaacctcgataactaacaaaataaaatcgaatttaccctaccgcaaacaacgataaaacgtctaattaaaacgacccaattttctataacgcatcaaaacgttcgctatt

SEQ ID NO: 7857 - DNA, 564 bp, Artificial Sequence
  chemically treated genomic DNA (Homo sapiens) CpG-island No: 7857
ggtcgaaaaatgttggattgtggtgaaggcgttggtcgatgtcgatagtcgggagttttcgttagttatatcgcgcgtttttgtcgcggtttggggcgagcgagaaattcgcgatatgtacgggttgatttcggttggtttgtcggattagcgtcgtttggtgttgttcgatgattggtcggaagatatgtattcgttgcgtaaagatgcgatggattatcgattgcgttttgaatcgacgattgatttcgaaacgtattcgtttattaatgagggtaatagcgatgcgcgggtgatttttgtcggttcgttgtatattattttcgatgaatcgggttattttcgtttgtttgtggatggcgagtaaattgtcgatgttgattatcgtttgttttatgtttatcgcggtatggagaaattggtagaaacgcggatgggttataacgaagtgatttttttatcggatcgcgtgtgttggatttgcgggtttgtttatagtgtggtttatattaattcggttgtaaatgttttggggattgagtgtttaaagagttttatattcgt

SEQ ID NO: 7858 - DNA, 564 bp, Artificial Sequence
  chemically treated genomic DNA (Homo sapiens) CpG-island No: 7858
acgaatataaaactctttaaacactcaatccccaaaacatttacaaccgaattaatataaaccacactataaacaaacccgcaaatccaacacacgcgatccgataaaaaaatcacttcgttataacccatccgcgtttctaccaatttctccataccgcgataaacataaaacaaacgataatcaacatcgacaatttactcgccatccacaaacaaacgaaaataacccgattcatcgaaaataatatacaacgaaccgacaaaaatcacccgcgcatcgctattaccctcattaataaacgaatacgtttcgaaatcaatcgtcgattcaaaacgcaatcgataatccatcgcatctttacgcaacgaatacatatcttccgaccaatcatcgaacaacaccaaacgacgctaatccgacaaaccaaccgaaatcaacccgtacatatcgcgaatttctcgctcgccccaaaccgcgacaaaaacgcgcgatataactaacgaaaactcccgactatcgacatcgaccaacgccttcaccacaatccaacatttttcgacc

SEQ ID NO: 7859 - DNA, 564 bp, Artificial Sequence
  chemically treated genomic DNA (Homo sapiens) CpG-island No: 7859
gcgaatataaggttttttgggtatttaatttttagggtatttataatcgaattggtataggttatattgtgggtaaattcgtaaatttaatatacgcggttcgataagaaggttatttcgttgtagtttattcgcgtttttgttagtttttttatgtcgcgatggatataaaataggcggtaattagtatcgataatttgttcgttatttataaataagcggaagtgattcggtttatcggaggtgatatgtagcgggtcgatagggattattcgcgtatcgttgttgtttttattgataaacggatacgtttcggaattagtcgtcggtttagggcgtagtcgataatttatcgtatttttgcgtagcggatgtatatttttcggttagttatcgggtaatattaggcgacgttgattcggtaggttaatcggaattagttcgtatatatcgcgaatttttcgttcgttttagatcgcggtagggacgcgcggtgtgattgacggaaattttcgattgtcggtatcgattagcgtttttattataatttagtatttttcggtt

SEQ ID NO: 7860 - DNA, 564 bp, Artificial Sequence
  chemically treated genomic DNA (Homo sapiens) CpG-island No: 7860
aaccgaaaaatactaaattataataaaaacgctaatcgataccgacaatcgaaaatttccgtcaatcacaccgcgcgtccctaccgcgatctaaaacgaacgaaaaattcgcgatatatacgaactaattccgattaacctaccgaatcaacgtcgcctaatattacccgataactaaccgaaaaatatacatccgctacgcaaaaatacgataaattatcgactacgccctaaaccgacgactaattccgaaacgtatccgtttatcaataaaaacaacaacgatacgcgaataatccctatcgacccgctacatatcacctccgataaaccgaatcacttccgcttatttataaataacgaacaaattatcgatactaattaccgcctattttatatccatcgcgacataaaaaaactaacaaaaacgcgaataaactacaacgaaataaccttcttatcgaaccgcgtatattaaatttacgaatttacccacaatataacctataccaattcgattataaataccctaaaaattaaatacccaaaaaaccttatattcgc

SEQ ID NO: 7861 - DNA, 570 bp, Artificial Sequence
  chemically treated genomic DNA (Homo sapiens) CpG-island No: 7861
gcggcgtggcgtaattgattatcgtcgggtagatcgttacgtttaattcgtcggattttttatggttcggtagtggatcgttgttgtttttgttaacgtcggttattatcgcggtgttgacgtttattttgttttggttgttgattcgtaaaacggcgttggggatgtttatcgaagtcgttggtattaatattcgggcggtaaaaaatgtcggggtaaatacgcgaattatcgttatgtttatttatgtgttgagcgggttgtgtgcggcgattgcgggtattatcgtggcggcggatattcgcggtgtcgatgttaataacgttgggttatggttggagttggacgttattttcgcggtggtgattggcggcggatcgttgatgggcgggcgttttaatttgttattttcggtggtgggggcgttgattatttaggggatgaatatcggaattttgttttcgggtttttcgttagagatgaattaggtggtgaaagcggtggtggtgttttgcgtgttgattgtttagtcgtaacgttttattagtttgattaaaggagtacgtagtt

SEQ ID NO: 7862 - DNA, 570 bp, Artificial Sequence
  chemically treated genomic DNA (Homo sapiens) CpG-island No: 7862
aactacgtactcctttaatcaaactaataaaacgttacgactaaacaatcaacacgcaaaacaccaccaccgctttcaccacctaattcatctctaacgaaaaacccgaaaacaaaattccgatattcatcccctaaataatcaacgcccccaccaccgaaaataacaaattaaaacgcccgcccatcaacgatccgccgccaatcaccaccgcgaaaataacgtccaactccaaccataacccaacgttattaacatcgacaccgcgaatatccgccgccacgataatacccgcaatcgccgcacacaacccgctcaacacataaataaacataacgataattcgcgtatttaccccgacattttttaccgcccgaatattaataccaacgacttcgataaacatccccaacgccgttttacgaatcaacaaccaaaacaaaataaacgtcaacaccgcgataataaccgacgttaacaaaaacaacaacgatccactaccgaaccataaaaaatccgacgaattaaacgtaacgatctacccgacgataatcaattacgccacgccgc

SEQ ID NO: 7863 - DNA, 570 bp, Artificial Sequence
  chemically treated genomic DNA (Homo sapiens) CpG-island No: 7863
ggttacgtatttttttaattagattgataaagcgttgcgattgaataattagtacgtaaagtattattatcgtttttattatttggtttatttttggcggaaagttcgaaagtaaaatttcggtgtttattttttgaataattagcgtttttattatcgaaagtagtaggttaaagcgttcgtttattagcgattcgtcgttaattattatcgcgagaatggcgtttagttttagttataatttagcgttgttggtatcggtatcgcgaatattcgtcgttacgataatgttcgtaatcgtcgtatatagttcgtttaatatataagtgagtatgacgatgattcgcgtgtttatttcggtattttttgtcgttcgaatgttgatattaacggtttcgataaatatttttagcgtcgttttgcgggttaatagttagaataggataagcgttagtatcgcgataatgatcggcgttggtaggaataatagcgatttattgtcgaattatgagagattcggcgagttaaacgtgacgatttgttcggcggtgattagttgcgttacgtcgt

SEQ ID NO: 7864 - DNA, 570 bp, Artificial Sequence
  chemically treated genomic DNA (Homo sapiens) CpG-island No: 7864
acgacgtaacgcaactaatcaccgccgaacaaatcgtcacgtttaactcgccgaatctctcataattcgacaataaatcgctattattcctaccaacgccgatcattatcgcgatactaacgcttatcctattctaactattaacccgcaaaacgacgctaaaaatatttatcgaaaccgttaatatcaacattcgaacgacaaaaaataccgaaataaacacgcgaatcatcgtcatactcacttatatattaaacgaactatatacgacgattacgaacattatcgtaacgacgaatattcgcgataccgataccaacaacgctaaattataactaaaactaaacgccattctcgcgataataattaacgacgaatcgctaataaacgaacgctttaacctactactttcgataataaaaacgctaattattcaaaaaataaacaccgaaattttactttcgaactttccgccaaaaataaaccaaataataaaaacgataataatactttacgtactaattattcaatcgcaacgctttatcaatctaattaaaaaaatacgtaacc

SEQ ID NO: 7865 - DNA, 687 bp, Artificial Sequence
  chemically treated genomic DNA (Homo sapiens) CpG-island No: 7865
gttattggatattttcgggttaaatgaagtcgggtaatcgtatttgtaaaaaatgtttaattagtagttggtacgcgtttcggcggtattggcggtgttggattatacgtaattgaaatcgattttcgatgaagaggttcgtgaggcgattttggcggtggggtaatcggtgtcgttgtacgtgttggttaataagttcgattaataggatcgtaatagtgacgacgtcgattaggtgcgggtattgattttcgggacgttgatgaaaggttgtattacgttatagtagatattttcggtgtcgtcgatgtggggttatttggcgaatcgggcgcgttatgagttagttaataacggtaagttattatcgttagagtaataacgttgggtggaagattttgtttatgtcgcgtttggtaggcgttggcgttatgtcgatttggcggatttcgaatatattcgttatgttgtcgattagttgtgggaagattcgttgttcgtttagttaatttaggcgttgttttatgtcgtttacgttaacgtttcgttgtatgttttgcgatttgtcgcgtataaattgttgaattacgcgtagtaggcgcgggaatatttggattttcgtgcgtacgggttaaacgtcgtttgtgaataattgcggtaaaatatttattagatcgaaaaagttgt

SEQ ID NO: 7866 - DNA, 687 bp, Artificial Sequence
  chemically treated genomic DNA (Homo sapiens) CpG-island No: 7866
acaactttttcgatctaataaatattttaccgcaattattcacaaacgacgtttaacccgtacgcacgaaaatccaaatattcccgcgcctactacgcgtaattcaacaatttatacgcgacaaatcgcaaaacatacaacgaaacgttaacgtaaacgacataaaacaacgcctaaattaactaaacgaacaacgaatcttcccacaactaatcgacaacataacgaatatattcgaaatccgccaaatcgacataacgccaacgcctaccaaacgcgacataaacaaaatcttccacccaacgttattactctaacgataataacttaccgttattaactaactcataacgcgcccgattcgccaaataaccccacatcgacgacaccgaaaatatctactataacgtaatacaacctttcatcaacgtcccgaaaatcaatacccgcacctaatcgacgtcgtcactattacgatcctattaatcgaacttattaaccaacacgtacaacgacaccgattaccccaccgccaaaatcgcctcacgaacctcttcatcgaaaatcgatttcaattacgtataatccaacaccgccaataccgccgaaacgcgtaccaactactaattaaacattttttacaaatacgattacccgacttcatttaacccgaaaatatccaataac

SEQ ID NO: 7867 - DNA, 687 bp, Artificial Sequence
  chemically treated genomic DNA (Homo sapiens) CpG-island No: 7867
gtaattttttcgatttggtggatattttgtcgtaattgtttataagcgacgtttaattcgtgcgtacgaaaatttaggtattttcgcgtttgttgcgcgtaatttaatagtttatgcgcggtagatcgtagagtatataacgaggcgttagcgtaagcggtatgaagtaacgtttgaattggttgggcgaatagcgaatttttttataattgatcggtagtatgacgaatatgttcgaggttcgttagatcggtatgacgttagcgtttgttaagcgcggtatgggtaaaattttttatttagcgttgttgttttggcggtggtaatttatcgttgttggttaatttatagcgcgttcgattcgttaggtagttttatatcgacgatatcggaaatatttgttgtggcgtaatatagttttttattagcgtttcggaaattagtgttcgtatttggtcggcgtcgttattgttacgattttgttgatcgaatttattgattagtacgtatagcggtatcgattgttttatcgttaaaatcgttttacggatttttttatcggagatcgattttagttgcgtataatttagtatcgttagtatcgtcgaggcgcgtgttagttgttggttaagtattttttgtagatgcggttgttcggttttatttggttcgggggtatttagtaat

SEQ ID NO: 7868 - DNA, 687 bp, Artificial Sequence
  chemically treated genomic DNA (Homo sapiens) CpG-island No: 7868
attactaaatacccccgaaccaaataaaaccgaacaaccgcatctacaaaaaatacttaaccaacaactaacacgcgcctcgacgatactaacgatactaaattatacgcaactaaaatcgatctccgataaaaaaatccgtaaaacgattttaacgataaaacaatcgataccgctatacgtactaatcaataaattcgatcaacaaaatcgtaacaataacgacgccgaccaaatacgaacactaatttccgaaacgctaataaaaaactatattacgccacaacaaatatttccgatatcgtcgatataaaactacctaacgaatcgaacgcgctataaattaaccaacaacgataaattaccaccgccaaaacaacaacgctaaataaaaaattttacccataccgcgcttaacaaacgctaacgtcataccgatctaacgaacctcgaacatattcgtcatactaccgatcaattataaaaaaattcgctattcgcccaaccaattcaaacgttacttcataccgcttacgctaacgcctcgttatatactctacgatctaccgcgcataaactattaaattacgcgcaacaaacgcgaaaatacctaaattttcgtacgcacgaattaaacgtcgcttataaacaattacgacaaaatatccaccaaatcgaaaaaattac

SEQ ID NO: 7869 - DNA, 537 bp, Artificial Sequence
  chemically treated genomic DNA (Homo sapiens) CpG-island No: 7869
  misc_feature (485)..(485): n is either a, c, g or t
tttcgcgaggaaatcgcgagaatgtagtatatttaggttgtgtaaagtgagtagagtttgattgcgacgaagcgttagagcgcggaatagcggcggatttttagttttattgtatattagcgtattatttgcgcgtgggtttttgttggagtcgataaagatcgggatatcgttgcgtattgcgggtagtaacgttggcggatgtagtatttttgtattaaaagttgttatttttgtcgtttcggtaaaacgcgatttattaatgcgttttgttgcggaattacgttggatcgggggttaatgttcggatttgtttaaattatcgagaggttaagtttttatagtgttataattgtttcgtatttttttgattttttgtttaaattcgggtataattttaagggtcggcggatattttgaacgcggataggcgttttttacggacgtttttattttcgtttttttttcgataataattaattttntatagtaatagtataaatatacgaagaaaataatagagtaacggagaatagt

SEQ ID NO: 7870 - DNA, 537 bp, Artificial Sequence
  chemically treated genomic DNA (Homo sapiens) CpG-island No: 7870
  misc_feature (53)..(53): n is either a, c, g or t
actattctccgttactctattattttcttcgtatatttatactattactatanaaaattaattattatcgaaaaaaaaacgaaaataaaaacgtccgtaaaaaacgcctatccgcgttcaaaatatccgccgacccttaaaattatacccgaatttaaacaaaaaatcaaaaaaatacgaaacaattataacactataaaaacttaacctctcgataatttaaacaaatccgaacattaacccccgatccaacgtaattccgcaacaaaacgcattaataaatcgcgttttaccgaaacgacaaaaataacaacttttaatacaaaaatactacatccgccaacgttactacccgcaatacgcaacgatatcccgatctttatcgactccaacaaaaacccacgcgcaaataatacgctaatatacaataaaactaaaaatccgccgctattccgcgctctaacgcttcgtcgcaatcaaactctactcactttacacaacctaaatatactacattctcgcgatttcctcgcgaaa

SEQ ID NO: 7871 - DNA, 537 bp, Artificial Sequence
  chemically treated genomic DNA (Homo sapiens) CpG-island No: 7871
  misc_feature (53)..(53): n is either a, c, g or t
gttgtttttcgttgttttgttgtttttttcgtgtgtttgtgttgttgttatanagagttgattgttgtcgaggggagggcggagatgagggcgttcgtgaagagcgtttgttcgcgtttagggtgttcgtcggtttttagggttgtattcgggtttgggtaaaaagttaaaagggtgcggagtagttatgatattgtgggagtttaatttttcggtaatttggataagttcgggtattgattttcgatttagcgtagtttcgtagtaaaacgtattgatgaatcgcgttttgtcgaagcggtagagatggtaatttttggtgtaaaagtattgtattcgttaacgttgttattcgtagtacgtagcgatatttcggtttttgtcggttttagtaaagatttacgcgtaggtggtacgttggtgtgtaataaaattgaaaattcgtcgttgtttcgcgttttggcgtttcgtcgtaattagattttgtttattttgtatagtttgaatatgttgtattttcgcggttttttcgcggaa

SEQ ID NO: 7872 - DNA, 537 bp, Artificial Sequence
  chemically treated genomic DNA (Homo sapiens) CpG-island No: 7872
  misc_feature (485)..(485): n is either a, c, g or t
ttccgcgaaaaaaccgcgaaaatacaacatattcaaactatacaaaataaacaaaatctaattacgacgaaacgccaaaacgcgaaacaacgacgaattttcaattttattacacaccaacgtaccacctacgcgtaaatctttactaaaaccgacaaaaaccgaaatatcgctacgtactacgaataacaacgttaacgaatacaatacttttacaccaaaaattaccatctctaccgcttcgacaaaacgcgattcatcaatacgttttactacgaaactacgctaaatcgaaaatcaatacccgaacttatccaaattaccgaaaaattaaactcccacaatatcataactactccgcacccttttaactttttacccaaacccgaatacaaccctaaaaaccgacgaacaccctaaacgcgaacaaacgctcttcacgaacgccctcatctccgccctcccctcgacaacaatcaactctntataacaacaacacaaacacacgaaaaaaacaacaaaacaacgaaaaacaac

SEQ ID NO: 7873 - DNA, 798 bp, Artificial Sequence
  chemically treated genomic DNA (Homo sapiens) CpG-island No: 7873
gtcgcggattagtagcgtttcggtagtcgcgatattgtttttgcggttaatgttttttagtagatcgtttttggtaatatcggtggtagagaagatgacgttatcgttgcgcgttatatcgtttaggcgtaatattttatcggtttcgatgtttatcgttttgtagcgtgttagtttttgttcgttaatgcgacgatttttttcgttgtcgtttttgacgttatgacgcgttagtagacgatcgtttatgtcgttatttaatgcgcggattatcgtcgtagaaattacgtttttcggcgcgttattaatatcgtatagtacgttaatttcgttgtttggtatataggtgagaattgaggtcgtaacgtcgtcgttcggaatagtaaatacgcgtacgtcgagttgttgtattttagcgataacggtatcgtggcgtggtttagttagaatcgttatcgttagttcgtttaacggtttgtcgagcgtcgtcgttatattgcgtaggttattcgttagcggtaggtttagattaatggtgtttttggttttcggttcgataattagtttttttatatatatattcggcgtattgaggaagtagtttttatcgtttattgttagtatcgttagcgcgttagtttggtttatcgtcgttatgcgcgtgtttttaatcggattaatagtaatatttatcgcgtcgtcgcgattagtatcgatttttttattaatgtagagtatcggtgtttcgtcgattttatttttattaatgacgatggtgtcgttaatgttgatttggtt

SEQ ID NO: 7874 - DNA, 798 bp, Artificial Sequence
  chemically treated genomic DNA (Homo sapiens) CpG-island No: 7874
aaccaaatcaacattaacgacaccatcgtcattaataaaaataaaatcgacgaaacaccgatactctacattaataaaaaaatcgatactaatcgcgacgacgcgataaatattactattaatccgattaaaaacacgcgcataacgacgataaaccaaactaacgcgctaacgatactaacaataaacgataaaaactacttcctcaatacgccgaatatatatataaaaaaactaattatcgaaccgaaaaccaaaaacaccattaatctaaacctaccgctaacgaataacctacgcaatataacgacgacgctcgacaaaccgttaaacgaactaacgataacgattctaactaaaccacgccacgataccgttatcgctaaaatacaacaactcgacgtacgcgtatttactattccgaacgacgacgttacgacctcaattctcacctatataccaaacaacgaaattaacgtactatacgatattaataacgcgccgaaaaacgtaatttctacgacgataatccgcgcattaaataacgacataaacgatcgtctactaacgcgtcataacgtcaaaaacgacaacgaaaaaaatcgtcgcattaacgaacaaaaactaacacgctacaaaacgataaacatcgaaaccgataaaatattacgcctaaacgatataacgcgcaacgataacgtcatcttctctaccaccgatattaccaaaaacgatctactaaaaaacattaaccgcaaaaacaatatcgcgactaccgaaacgctactaatccgcgac

SEQ ID NO: 7875 - DNA, 798 bp, Artificial Sequence
  chemically treated genomic DNA (Homo sapiens) CpG-island No: 7875
aattaggttaatattgacggtattatcgttattggtgaaggtgaaatcgacgaagtatcgatgttttatattggtgaaaaagtcggtattggtcgcggcgacgcggtagatattgttgttgattcgattgaaggtacgcgtatgacggcgatgggttaggttaacgcgttggcggtgttggtagtaggcgataaaggttgtttttttaatgcgtcggatatgtatatggagaagttgattgtcgggtcgggagttaaaggtattattgatttgaatttgtcgttggcggataatttgcgtaatgtagcggcggcgttcggtaaatcgttgagcgaattgacggtaacgattttggttaaattacgttacgatgtcgttatcgttgaaatgtagtaattcggcgtacgcgtatttgttatttcggacggcgacgttgcggttttaatttttatttgtatgttagatagcgaagttgacgtgttgtacggtattggtggcgcgtcggaaggcgtagtttttgcggcggtgattcgcgtattagatggcgatatgaacggtcgtttgttggcgcgttatgacgttaaaggcgataacgaagagaatcgtcgtattggcgagtaggagttggtacgttgtaaagcgatgggtatcgaagtcggtaaagtattgcgtttgggcgatatggcgcgtagcgataacgttattttttttgttatcggtattattaaaggcgatttgttggaaggtattagtcgtaaaggtaatatcgcgattatcgaaacgttgttgattcgcggt

SEQ ID NO: 7876 - DNA, 798 bp, Artificial Sequence
  chemically treated genomic DNA (Homo sapiens) CpG-island No: 7876
accgcgaatcaacaacgtttcgataatcgcgatattacctttacgactaataccttccaacaaatcgcctttaataataccgataacaaaaaaaataacgttatcgctacgcgccatatcgcccaaacgcaatactttaccgacttcgatacccatcgctttacaacgtaccaactcctactcgccaatacgacgattctcttcgttatcgcctttaacgtcataacgcgccaacaaacgaccgttcatatcgccatctaatacgcgaatcaccgccgcaaaaactacgccttccgacgcgccaccaataccgtacaacacgtcaacttcgctatctaacatacaaataaaaattaaaaccgcaacgtcgccgtccgaaataacaaatacgcgtacgccgaattactacatttcaacgataacgacatcgtaacgtaatttaaccaaaatcgttaccgtcaattcgctcaacgatttaccgaacgccgccgctacattacgcaaattatccgccaacgacaaattcaaatcaataatacctttaactcccgacccgacaatcaacttctccatatacatatccgacgcattaaaaaaacaacctttatcgcctactaccaacaccgccaacgcgttaacctaacccatcgccgtcatacgcgtaccttcaatcgaatcaacaacaatatctaccgcgtcgccgcgaccaataccgactttttcaccaatataaaacatcgatacttcgtcgatttcaccttcaccaataacgataataccgtcaatattaacctaatt

SEQ ID NO: 7877 - DNA, 792 bp, Artificial Sequence
  chemically treated genomic DNA (Homo sapiens) CpG-island No: 7877
  misc_feature (569)..(569): n is either a, c, g or t
ggagtaatcggtatcgtaaattcgatattcgttttttttagtagtaggtggatagttagtacgtcggacggcgttttcgttatcgagattacgtaggcggtaatggagttttgcggtgtttcggtaattatttggtaggtatcgagtatttcgcgcgtttcggcgtttggttgttagttgcgcggtagaagcggacgtttggagtttagttcgcggattaggaacgtttgtttgtcggtttttgattagttttcgtagtcgtcgatatcgaggtagcgggttagttcgtttagcgtttcggtatgacgcgtgtttttttgacggatattaatacggattagcggtacgtcgaaatattttacgcggcgtagggtgtcgagtagatcgtcgttggcgataatatttatgttatacgtttgaagtgattggtagtaagcgtagagcggtttttatagtttttcgttttgtgttagtaggttttttggttttggtagtttttcgttttttaggcgcgtttttagttatgtttgtgtcgttattaggcgagaacgtaggtttttattagatancgatacggttttgcggtattttttttgttaattagcgttagtagtttaagtgtcgcgtttatttttcgacgtttcgaaattcggatttgatattttttcggtttattcgggggttttatcggttgttatcggatttgggggtgtttcgggtgttttcggttgttttcggttcggttttttaattatagggcgataatttcgggggttgggtcggttttttcgt

SEQ ID NO: 7878 - DNA, 792 bp, Artificial Sequence
  chemically treated genomic DNA (Homo sapiens) CpG-island No: 7878
  misc_feature (224)..(224): n is either a, c, g or t
acgaaaaaaccgacccaacccccgaaattatcgccctataattaaaaaaccgaaccgaaaacaaccgaaaacacccgaaacacccccaaatccgataacaaccgataaaacccccgaataaaccgaaaaaatatcaaatccgaatttcgaaacgtcgaaaaataaacgcgacacttaaactactaacgctaattaacaaaaaaaataccgcaaaaccgtatcgntatctaataaaaacctacgttctcgcctaataacgacacaaacataactaaaaacgcgcctaaaaaacgaaaaactaccaaaaccaaaaaacctactaacacaaaacgaaaaactataaaaaccgctctacgcttactaccaatcacttcaaacgtataacataaatattatcgccaacgacgatctactcgacaccctacgccgcgtaaaatatttcgacgtaccgctaatccgtattaatatccgtcaaaaaaacacgcgtcataccgaaacgctaaacgaactaacccgctacctcgatatcgacgactacgaaaactaatcaaaaaccgacaaacaaacgttcctaatccgcgaactaaactccaaacgtccgcttctaccgcgcaactaacaaccaaacgccgaaacgcgcgaaatactcgatacctaccaaataattaccgaaacaccgcaaaactccattaccgcctacgtaatctcgataacgaaaacgccgtccgacgtactaactatccacctactactaaaaaaaacgaatatcgaatttacgataccgattactcc

SEQ ID NO: 7879 - DNA, 792 bp, Artificial Sequence
  chemically treated genomic DNA (Homo sapiens) CpG-island No: 7879
  misc_feature (224)..(224): n is either a, c, g or t
gcgggagaatcggtttaattttcggaattgtcgttttataattggaaggtcggatcggaggtaatcgaaggtattcgaaatatttttaagttcggtaatagtcggtggaattttcggatgggtcggaaagatattaggttcgggtttcggaacgtcggagggtgaacgcgatatttgaattgttggcgttgattgataaagaaggtgtcgtagaatcgtatcgntatttgatgaaaatttgcgttttcgtttgatggcgatataggtatggttggaagcgcgtttgaaaggcgaagaattgttaaaattagaaggtttgttgatataaaacgaagaattgtgggaatcgttttacgtttgttattagttattttaggcgtgtggtatgggtattatcgttaacggcgatttgttcgatattttgcgtcgcgtgaaatgtttcggcgtatcgttggttcgtattgatattcgttaggagagtacgcgttatatcgaagcgttgggcgagttgattcgttatttcggtatcggcgattacgaaagttggttagaggtcgataaataggcgtttttgattcgcgaattgaattttaaacgttcgtttttgtcgcgtaattggtaattaagcgtcgaaacgcgcgaagtgttcgatatttgttaggtgattgtcgaagtatcgtaaggttttattgtcgtttacgtgatttcgatggcgaaaacgtcgttcgacgtattggttgtttatttgttgttgaaagaagcgggtatcgggtttgcgatgtcggttgtttt

SEQ ID NO: 7880 - DNA, 792 bp, Artificial Sequence
  chemically treated genomic DNA (Homo sapiens) CpG-island No: 7880
  misc_feature (569)..(569): n is either a, c, g or t
aaaacaaccgacatcgcaaacccgatacccgcttctttcaacaacaaataaacaaccaatacgtcgaacgacgttttcgccatcgaaatcacgtaaacgacaataaaaccttacgatacttcgacaatcacctaacaaatatcgaacacttcgcgcgtttcgacgcttaattaccaattacgcgacaaaaacgaacgtttaaaattcaattcgcgaatcaaaaacgcctatttatcgacctctaaccaactttcgtaatcgccgataccgaaataacgaatcaactcgcccaacgcttcgatataacgcgtactctcctaacgaatatcaatacgaaccaacgatacgccgaaacatttcacgcgacgcaaaatatcgaacaaatcgccgttaacgataatacccataccacacgcctaaaataactaataacaaacgtaaaacgattcccacaattcttcgttttatatcaacaaaccttctaattttaacaattcttcgcctttcaaacgcgcttccaaccatacctatatcgccatcaaacgaaaacgcaaattttcatcaaatancgatacgattctacgacaccttctttatcaatcaacgccaacaattcaaatatcgcgttcaccctccgacgttccgaaacccgaacctaatatctttccgacccatccgaaaattccaccgactattaccgaacttaaaaatatttcgaataccttcgattacctccgatccgaccttccaattataaaacgacaattccgaaaattaaaccgattctcccgc

SEQ ID NO: 7881 - DNA, 936 bp, Artificial Sequence
  chemically treated genomic DNA (Homo sapiens) CpG-island No: 7881
ggacgtacgttaacgtcgagattcgcgtcgcgtttgttttaaatcgtattatttcggtataggcgattatcgcgtcgttattagtataaaatttcggacgcgcgtagaatatttcgtcgcggcgtttttttattattttagttagtttcgttcgtaacgtacggttagtatttacgtcgttcgttatgattagtcgtttaaagttcgtttgatttagcgttcgtttgtatttaattattagcgtatcgattatcgtatttttaaaggcgcgggcgatattagtacgcgtttggtcgtcggtgtcgttgttatagaatggtatttgtcgcgaaggtttttaggtcggagaagttgaaatttagtttcggacggtcggttatcggacgcgggaagataaagcgttcggtagtattttgaagtcgtatttacgatagtaacggttcgttaggataatttagttttagtagtttcgcgtttttattaaacgttttttcggcggtattatcgatagattcgtcgagtagttcgtattgattaatgttagttacgttgattaattgcgtatgatcgtcggaaataagtagcgtaataaacggaaatttcggcgggttattttttagtatcggcgttaatagatgtttttttatatggtgtatagggatcgtcggaacgttttaggtaaacgttagagaacgttttacggtcgcgttaattagtagcgcgtcgattaatttagggtttgcggtataggttatagtattaatgttttttgtcgttaaattagatttttttagcgtcgtttggattaacggtacggttttacgtatatgatcgcgggaggttagtttaggtacgacgtcgtcgtagttagcgtgtaattttatttgattatataattggttggttaataaattttttttatcgtcgtaaatggcg

SEQ ID NO: 7882 - DNA, 936 bp, Artificial Sequence
  chemically treated genomic DNA (Homo sapiens) CpG-island No: 7882
cgccatttacgacgataaaaaaaatttattaaccaaccaattatataatcaaataaaattacacgctaactacgacgacgtcgtacctaaactaacctcccgcgatcatatacgtaaaaccgtaccgttaatccaaacgacgctaaaaaaatctaatttaacgacaaaaaacattaatactataacctataccgcaaaccctaaattaatcgacgcgctactaattaacgcgaccgtaaaacgttctctaacgtttacctaaaacgttccgacgatccctatacaccatataaaaaaacatctattaacgccgatactaaaaaataacccgccgaaatttccgtttattacgctacttatttccgacgatcatacgcaattaatcaacgtaactaacattaatcaatacgaactactcgacgaatctatcgataataccgccgaaaaaacgtttaataaaaacgcgaaactactaaaactaaattatcctaacgaaccgttactatcgtaaatacgacttcaaaatactaccgaacgctttatcttcccgcgtccgataaccgaccgtccgaaactaaatttcaacttctccgacctaaaaaccttcgcgacaaataccattctataacaacgacaccgacgaccaaacgcgtactaatatcgcccgcgcctttaaaaatacgataatcgatacgctaataattaaatacaaacgaacgctaaatcaaacgaactttaaacgactaatcataacgaacgacgtaaatactaaccgtacgttacgaacgaaactaactaaaataataaaaaaacgccgcgacgaaatattctacgcgcgtccgaaattttatactaataacgacgcgataatcgcctataccgaaataatacgatttaaaacaaacgcgacgcgaatctcgacgttaacgtacgtcc

SEQ ID NO: 7883 - DNA, 936 bp, Artificial Sequence
  chemically treated genomic DNA (Homo sapiens) CpG-island No: 7883
cgttatttacgacgatgaaaaaggtttgttagttaattaattgtatagttaggtgaaattgtacgttgattacggcggcgtcgtgtttgaattggtttttcgcgattatgtgcgtaaaatcgtatcgttgatttaggcggcgttaaaggagtttggtttaacggtaaaagatattgatgttgtggtttatatcgtaggttttggattagtcggcgcgttattggttggcgcgatcgtggggcgttttttggcgtttgtttgggacgtttcggcgatttttgtatattatatggaagggtatttgttagcgtcgatgttggaagataattcgtcggaattttcgtttgttgcgttgtttgttttcggcggttatacgtagttaattagcgtgattggtattggttagtacgagttgttcggcgagtttatcgatgatgtcgtcggggaagcgtttgataaaagcgcgaagttgttggggttggattattttggcgggtcgttattgtcgtaaatgcggttttagggtattgtcgggcgttttgttttttcgcgttcgatgatcgatcgttcggggttggattttagttttttcggtttgaaaattttcgcggtaaatattattttgtgataacggtatcgacgattagacgcgtgttgatatcgttcgcgtttttgaagatgcggtggtcgatacgttgatgattaagtgtaagcgggcgttggattagacgggttttaagcgattggttatggcgggcggcgtgagtgttaatcgtacgttacgggcgaagttggttgaaatgatgaaaaaacgtcgcggcgaagtgttttacgcgcgttcggaattttgtattgataacggcgcgatgatcgtttatgtcggaatggtgcggtttaaagtaggcgcgacgcggatttcggcgttagcgtgcgttt

SEQ ID NO: 7884 - DNA, 936 bp, Artificial Sequence
  chemically treated genomic DNA (Homo sapiens) CpG-island No: 7884
aaacgcacgctaacgccgaaatccgcgtcgcgcctactttaaaccgcaccattccgacataaacgatcatcgcgccgttatcaatacaaaattccgaacgcgcgtaaaacacttcgccgcgacgttttttcatcatttcaaccaacttcgcccgtaacgtacgattaacactcacgccgcccgccataaccaatcgcttaaaacccgtctaatccaacgcccgcttacacttaatcatcaacgtatcgaccaccgcatcttcaaaaacgcgaacgatatcaacacgcgtctaatcgtcgataccgttatcacaaaataatatttaccgcgaaaattttcaaaccgaaaaaactaaaatccaaccccgaacgatcgatcatcgaacgcgaaaaaacaaaacgcccgacaataccctaaaaccgcatttacgacaataacgacccgccaaaataatccaaccccaacaacttcgcgcttttatcaaacgcttccccgacgacatcatcgataaactcgccgaacaactcgtactaaccaataccaatcacgctaattaactacgtataaccgccgaaaacaaacaacgcaacaaacgaaaattccgacgaattatcttccaacatcgacgctaacaaatacccttccatataatatacaaaaatcgccgaaacgtcccaaacaaacgccaaaaaacgccccacgatcgcgccaaccaataacgcgccgactaatccaaaacctacgatataaaccacaacatcaatatcttttaccgttaaaccaaactcctttaacgccgcctaaatcaacgatacgattttacgcacataatcgcgaaaaaccaattcaaacacgacgccgccgtaatcaacgtacaatttcacctaactatacaattaattaactaacaaacctttttcatcgtcgtaaataacg

SEQ ID NO: 7885 - DNA, 571 bp, Artificial Sequence
  chemically treated genomic DNA (Homo sapiens) CpG-island No: 7885
cgcgtcgtattcggcgttgttgttaaattttagtgtcgtaataatgtcggatgcgatgtttgcgtattttattcgatttatagtgatttaaacgatgtttaatcgtaggtcggataaggcgttcgcgtcgtattcggtattgttgttaaattttagtgtcgtaataatgtcggatgcgatatttgcgtattttattcgatcgatagtgatttaaacgatgtttaattgtaggtcggataaggcgtttacgtcgtattcggtaatcggtgtacgatgtttgatgcgttacgttttattaggtttataaaattaatcgttttttagtaatattttttttagttattggcgtagttcgacgggcgcggtttttaggttgttagatttacgcgtaatcgtcgcgatgtttgcgtcgagtttattttttaatttacgttggtttatttcgtcgcgtaatagtttttcgataatacgtacgcgagtttttaacgtttcgcgtttatttggcgttagtattaggtttaataacggtaaatggagatcgttttggtaggtatttttaagtaggtcgata

SEQ ID NO: 7886 - DNA, 571 bp, Artificial Sequence
  chemically treated genomic DNA (Homo sapiens) CpG-island No: 7886
tatcgacctacttaaaaatacctaccaaaacgatctccatttaccgttattaaacctaatactaacgccaaataaacgcgaaacgttaaaaactcgcgtacgtattatcgaaaaactattacgcgacgaaataaaccaacgtaaattaaaaaataaactcgacgcaaacatcgcgacgattacgcgtaaatctaacaacctaaaaaccgcgcccgtcgaactacgccaataactaaaaaaaatattactaaaaaacgattaattttataaacctaataaaacgtaacgcatcaaacatcgtacaccgattaccgaatacgacgtaaacgccttatccgacctacaattaaacatcgtttaaatcactatcgatcgaataaaatacgcaaatatcgcatccgacattattacgacactaaaatttaacaacaataccgaatacgacgcgaacgccttatccgacctacgattaaacatcgtttaaatcactataaatcgaataaaatacgcaaacatcgcatccgacattattacgacactaaaatttaacaacaacgccgaatacgacgcg

SEQ ID NO: 7887 - DNA, 571 bp, Artificial Sequence
  chemically treated genomic DNA (Homo sapiens) CpG-island No: 7887
tgtcgatttgtttaagaatgtttattaaaacgatttttatttatcgttgttaaatttgatgttgacgttagatgagcgcgaagcgttggggattcgcgtgcgtattgtcgaagagttgttgcgcggcgaaatgagttagcgtgagttaaaaaatgaattcggcgtaggtatcgcgacgattacgcgtggatttaatagtttgaaagtcgcgttcgtcgagttgcgttagtggttggaagaggtgttgttgaaaagcgattgattttgtaggtttgataagacgtggcgtattaggtatcgtgtatcgattgtcggatgcggcgtgaacgttttattcggtttatagttgggtatcgtttgagttattgtcggtcggataagatgcgtaagtatcgtattcgatattattgcggtattggagtttggtaatagtgtcggatgcggcgcgagcgttttattcggtttacggttgggtatcgtttgagttattgtaggtcggataagatgcgtaagtatcgtattcgatattattgcggtattggagtttggtaatagcgtcggatgcggcgcg

SEQ ID NO: 7888 - DNA, 571 bp, Artificial Sequence
  chemically treated genomic DNA (Homo sapiens) CpG-island No: 7888
cgcgccgcatccgacgctattaccaaactccaataccgcaataatatcgaatacgatacttacgcatcttatccgacctacaataactcaaacgatacccaaccgtaaaccgaataaaacgctcgcgccgcatccgacactattaccaaactccaataccgcaataatatcgaatacgatacttacgcatcttatccgaccgacaataactcaaacgatacccaactataaaccgaataaaacgttcacgccgcatccgacaatcgatacacgatacctaatacgccacgtcttatcaaacctacaaaatcaatcgcttttcaacaacacctcttccaaccactaacgcaactcgacgaacgcgactttcaaactattaaatccacgcgtaatcgtcgcgatacctacgccgaattcattttttaactcacgctaactcatttcgccgcgcaacaactcttcgacaatacgcacgcgaatccccaacgcttcgcgctcatctaacgtcaacatcaaatttaacaacgataaataaaaatcgttttaataaacattcttaaacaaatcgaca

SEQ ID NO: 7889 - DNA, 509 bp, Artificial Sequence
  chemically treated genomic DNA (Homo sapiens) CpG-island No: 7889
tttgttttggattttggagttggttaggttggtatggattatatgcggtagtacgaatagggcgattattaacgttggcgtatagatgatgtaggtatgaagtagtaggaacgttagcggcgtagttaggaagattagtcgtggaatgttcgataagaagtggaatatggcgttgacgtaatatagtcgttgagtaaattttagttttttatcggtgagcgggttatcgagacggaagatttgtattatttcgcgcgtttagcgaatacgttgatcgatatgcgtcgatagattttcggtcgttagtttttgcgtttgtggaatacgtatatacgcggaggtatagttacgacggtgtaatcgtagagaagtatgcgtatttttagttacggtttcgatagtaatgtcgttaattttatttagcggtttacgacgaattatcgtataggaatcgtagaagaaagtggcggattatatatcgatagaatttttgtattagattatagaat

SEQ ID NO: 7890 - DNA, 509 bp, Artificial Sequence
  chemically treated genomic DNA (Homo sapiens) CpG-island No: 7890
attctataatctaatacaaaaattctatcgatatataatccgccactttcttctacgattcctatacgataattcgtcgtaaaccgctaaataaaattaacgacattactatcgaaaccgtaactaaaaatacgcatacttctctacgattacaccgtcgtaactatacctccgcgtatatacgtattccacaaacgcaaaaactaacgaccgaaaatctatcgacgcatatcgatcaacgtattcgctaaacgcgcgaaataatacaaatcttccgtctcgataacccgctcaccgataaaaaactaaaatttactcaacgactatattacgtcaacgccatattccacttcttatcgaacattccacgactaatcttcctaactacgccgctaacgttcctactacttcatacctacatcatctatacgccaacgttaataatcgccctattcgtactaccgcatataatccataccaacctaaccaactccaaaatccaaaacaaa

SEQ ID NO: 7891 - DNA, 509 bp, Artificial Sequence
  chemically treated genomic DNA (Homo sapiens) CpG-island No: 7891
gttttatggtttggtgtagaagttttatcgatatgtagttcgttatttttttttgcggtttttgtgcggtgattcgtcgtaagtcgttggatgaaattggcggtattgttgtcgaaatcgtgattgaagatgcgtatatttttttgcggttgtatcgtcgtggttatattttcgcgtatatgcgtattttatagacgtaggggttggcgatcgaaagtttgtcggcgtatatcggttagcgtattcgttgggcgcgcgggatggtataaatttttcgtttcgataattcgtttatcggtaaagggttgaagtttgtttagcggttatgttacgttaacgttatgttttattttttgtcgggtattttacggttgatttttttgattgcgtcgttggcgtttttgttgttttatgtttatattatttatgcgttagcgttgatgatcgttttattcgtgttgtcgtatatgatttatgttagtttgattaattttaagatttagggtaaa

SEQ ID NO: 7892 - DNA, 509 bp, Artificial Sequence
  chemically treated genomic DNA (Homo sapiens) CpG-island No: 7892
tttaccctaaatcttaaaattaatcaaactaacataaatcatatacgacaacacgaataaaacgatcatcaacgctaacgcataaataatataaacataaaacaacaaaaacgccaacgacgcaatcaaaaaaatcaaccgtaaaatacccgacaaaaaataaaacataacgttaacgtaacataaccgctaaacaaacttcaaccctttaccgataaacgaattatcgaaacgaaaaatttataccatcccgcgcgcccaacgaatacgctaaccgatatacgccgacaaactttcgatcgccaacccctacgtctataaaatacgcatatacgcgaaaatataaccacgacgatacaaccgcaaaaaaatatacgcatcttcaatcacgatttcgacaacaataccgccaatttcatccaacgacttacgacgaatcaccgcacaaaaaccgcaaaaaaaaataacgaactacatatcgataaaacttctacaccaaaccataaaac

SEQ ID NO: 7893 - DNA, 532 bp, Artificial Sequence
  chemically treated genomic DNA (Homo sapiens) CpG-island No: 7893
  misc_feature (406)..(406): n is either a, c, g or t
tggcggcgttatttaaagttttttttttttaaggcgcgtttttcgcggtcggtagggggcgtcgcggtcgtttgggttcgtcggatgttaataagtttggcggtttcgttttttgtcggaagtggttgcggcgggggcggggtttacgagttgggtcgggcggtcgtgcgggagttatggcggtttcggaggcggcggcggcggcggggttcgcggttttggcggcgggtgttcgggtcgtttcggcggttacgataggagtcgtcgtcgtcgtttcgggttcgtgggtgttttcgggatttcgattgagggtgtagcggtcgcgggtcgcgggggcgacgtagtaagtcgtttgtttcgcgtcggtcggcgtggaattgatttacgcgtttgtgaacgagttttntcgggttttgcggattatatttgttgttcggtgcggttgtggaaattttgttaaagatcgcgtttaatggttaatagagtacgttttgttatttacgcggttcggtggggtttttttataaatcgg

SEQ ID NO: 7894 - DNA, 532 bp, Artificial Sequence
  chemically treated genomic DNA (Homo sapiens) CpG-island No: 7894
  misc_feature (127)..(127): n is either a, c, g or t
ccgatttataaaaaaaccccaccgaaccgcgtaaataacaaaacgtactctattaaccattaaacgcgatctttaacaaaatttccacaaccgcaccgaacaacaaatataatccgcaaaacccganaaaactcgttcacaaacgcgtaaatcaattccacgccgaccgacgcgaaacaaacgacttactacgtcgcccccgcgacccgcgaccgctacaccctcaatcgaaatcccgaaaacacccacgaacccgaaacgacgacgacgactcctatcgtaaccgccgaaacgacccgaacacccgccgccaaaaccgcgaaccccgccgccgccgccgcctccgaaaccgccataactcccgcacgaccgcccgacccaactcgtaaaccccgcccccgccgcaaccacttccgacaaaaaacgaaaccgccaaacttattaacatccgacgaacccaaacgaccgcgacgccccctaccgaccgcgaaaaacgcgccttaaaaaaaaaaaactttaaataacgccgcca

SEQ ID NO: 7895 - DNA, 532 bp, Artificial Sequence
  chemically treated genomic DNA (Homo sapiens) CpG-island No: 7895
  misc_feature (127)..(127): n is either a, c, g or t
tcggtttgtgaaaagattttatcgggtcgcgtggataataaagcgtgttttattagttattggacgcggtttttgatagaatttttataatcgtatcgggtaatagatgtggttcgtaaggttcggnaaagttcgtttataaacgcgtggattagttttacgtcggtcggcgcgggataagcggtttgttgcgtcgttttcgcggttcgcggtcgttgtatttttagtcggggtttcgggggtatttacgggttcgaggcggcggcggcggtttttgtcgtggtcgtcgggacggttcgggtattcgtcgttagagtcgcggatttcgtcgtcgtcgtcgttttcgaggtcgttatggttttcgtacggtcgttcggtttagttcgtaggtttcgttttcgtcgtagttattttcggtagggggcgaggtcgttaggtttgttagtattcggcgggtttaggcggtcgcggcgttttttgtcggtcgcggagggcgcgttttggagggagaggattttaggtgacgtcgtta

SEQ ID NO: 7896 - DNA, 532 bp, Artificial Sequence
  chemically treated genomic DNA (Homo sapiens) CpG-island No: 7896
  misc_feature (406)..(406): n is either a, c, g or t
taacgacgtcacctaaaatcctctccctccaaaacgcgccctccgcgaccgacaaaaaacgccgcgaccgcctaaacccgccgaatactaacaaacctaacgacctcgccccctaccgaaaataactacgacgaaaacgaaacctacgaactaaaccgaacgaccgtacgaaaaccataacgacctcgaaaacgacgacgacgacgaaatccgcgactctaacgacgaatacccgaaccgtcccgacgaccacgacaaaaaccgccgccgccgcctcgaacccgtaaatacccccgaaaccccgactaaaaatacaacgaccgcgaaccgcgaaaacgacgcaacaaaccgcttatcccgcgccgaccgacgtaaaactaatccacgcgtttataaacgaactttnccgaaccttacgaaccacatctattacccgatacgattataaaaattctatcaaaaaccgcgtccaataactaataaaacacgctttattatccacgcgacccgataaaatcttttcacaaaccga

SEQ ID NO: 7897 - DNA, 514 bp, Artificial Sequence
  chemically treated genomic DNA (Homo sapiens) CpG-island No: 7897
tcgtcgttatcgtgggcgagttggatattatttacgttttatttttttgttgacgatattgatattacgcggcgtacgttttttcggaggaaattattagcgtattaaacgcggtttgaggattataggtgttattaaatagcgggtattgatgcggtttatatttgttcgttaatattttattataacgcgcgcgcgggttatcgtagatttgttgcggtgtcgggcggaaatgtgtttcggtatcgaatcgttgataattcggcgttaggtgtacgttagaagatttaattacgtttaagtcgcgttattcgttgtcgtcgttgatatagaatatatcggtaatcgtttgttgcgttagtaggttatcggtattcggtattattcgacgatattgattttttattttgttgtgggtcgttattttttgttgtattagtatgattacgttttgtagtagattaagggttcgaatttagtaattattagcggacgatgaaaatcgttggcgata

SEQ ID NO: 7898 - DNA, 514 bp, Artificial Sequence
  chemically treated genomic DNA (Homo sapiens) CpG-island No: 7898
tatcgccaacgattttcatcgtccgctaataattactaaattcgaacccttaatctactacaaaacgtaatcatactaatacaacaaaaaataacgacccacaacaaaataaaaaatcaatatcgtcgaataataccgaataccgataacctactaacgcaacaaacgattaccgatatattctatatcaacgacgacaacgaataacgcgacttaaacgtaattaaatcttctaacgtacacctaacgccgaattatcaacgattcgataccgaaacacatttccgcccgacaccgcaacaaatctacgataacccgcgcgcgcgttataataaaatattaacgaacaaatataaaccgcatcaatacccgctatttaataacacctataatcctcaaaccgcgtttaatacgctaataatttcctccgaaaaaacgtacgccgcgtaatatcaatatcgtcaacaaaaaaataaaacgtaaataatatccaactcgcccacgataacgacga

SEQ ID NO: 7899 - DNA, 514 bp, Artificial Sequence
  chemically treated genomic DNA (Homo sapiens) CpG-island No: 7899
tatcgttagcgatttttatcgttcgttggtggttgttggattcgaatttttgatttattataaggcgtggttatgttggtgtagtagaaaatagcggtttatagtaaggtagagaattagtatcgtcgagtggtatcggatgtcggtaatttgttggcgtaataggcgattgtcgatgtgttttgtgttaacggcgatagcgaatggcgcggtttaggcgtgattgaattttttggcgtgtatttgacgtcggattattaacgattcgatgtcgaagtatattttcgttcggtatcgtagtaggtttgcgatgattcgcgcgcgcgttgtggtgaggtattaacgggtaaatgtaagtcgtattaatgttcgttgtttggtaatatttgtaatttttaaatcgcgtttggtgcgttgatggtttttttcgaaggagcgtgcgtcgcgtggtattagtatcgttagtaggagagtgaagcgtgaataatatttaattcgtttacggtagcggcgg

SEQ ID NO: 7900 - DNA, 514 bp, Artificial Sequence
  chemically treated genomic DNA (Homo sapiens) CpG-island No: 7900
ccgccgctaccgtaaacgaattaaatattattcacgcttcactctcctactaacgatactaataccacgcgacgcacgctccttcgaaaaaaaccatcaacgcaccaaacgcgatttaaaaattacaaatattaccaaacaacgaacattaatacgacttacatttacccgttaatacctcaccacaacgcgcgcgcgaatcatcgcaaacctactacgataccgaacgaaaatatacttcgacatcgaatcgttaataatccgacgtcaaatacacgccaaaaaattcaatcacgcctaaaccgcgccattcgctatcgccgttaacacaaaacacatcgacaatcgcctattacgccaacaaattaccgacatccgataccactcgacgatactaattctctaccttactataaaccgctattttctactacaccaacataaccacgccttataataaatcaaaaattcgaatccaacaaccaccaacgaacgataaaaatcgctaacgata

SEQ ID NO: 7901 - DNA, 578 bp, Artificial Sequence
  chemically treated genomic DNA (Homo sapiens) CpG-island No: 7901
gcggttgcgtggtgcgttttgttaataaaaaatcgtttttggcgatgacgtcgattttaatcgtatttttattatgatttgttggtcggaagatgtcgcgtcgttgattatttgggggttgatagtgacgcgcggtttatataaagagcggtagaatttgggtatttatcgttagtagttgattggtaaaaataaattgattatgcgttggttgtcgtatcgcggcggcgcgttggattattaggagtggtgtgcggcgtattcgggcgaacgtttttcggtttttgtggcgttgggtgtcgatttcgttacgattttcggtgtagttattttcgtttcggatacgtttttagagtatgcgtttgtcggattgttacgtggtattaagatcgaagtggtgaagtgtatttttaatgattttgaagtgttcgttagtgcggagattgtgttggaagggtatatcgaataaggcgaaattgcgtcggaagggtcgtatggcgattatatcggttattataatgaagtcgatagtttttcggtatttatcgtgacgtatattatttagcgtgaagatgcga

SEQ ID NO: 7902 - DNA, 578 bp, Artificial Sequence
  chemically treated genomic DNA (Homo sapiens) CpG-island No: 7902
tcgcatcttcacgctaaataatatacgtcacgataaataccgaaaaactatcgacttcattataataaccgatataatcgccatacgacccttccgacgcaatttcgccttattcgatatacccttccaacacaatctccgcactaacgaacacttcaaaatcattaaaaatacacttcaccacttcgatcttaataccacgtaacaatccgacaaacgcatactctaaaaacgtatccgaaacgaaaataactacaccgaaaatcgtaacgaaatcgacacccaacgccacaaaaaccgaaaaacgttcgcccgaatacgccgcacaccactcctaataatccaacgcgccgccgcgatacgacaaccaacgcataatcaatttatttttaccaatcaactactaacgataaatacccaaattctaccgctctttatataaaccgcgcgtcactatcaacccccaaataatcaacgacgcgacatcttccgaccaacaaatcataataaaaatacgattaaaatcgacgtcatcgccaaaaacgattttttattaacaaaacgcaccacgcaaccgc

SEQ ID NO: 7903 - DNA, 578 bp, Artificial Sequence
  chemically treated genomic DNA (Homo sapiens) CpG-island No: 7903
tcgtatttttacgttgggtaatatgcgttacggtaaatatcgggaaattatcgattttattatagtaatcggtgtggtcgttatacggttttttcggcgtagtttcgttttgttcgatatatttttttagtataattttcgtattggcgggtattttaagattattggagatatattttattatttcggttttggtgttacgtagtaattcggtaaacgtatattttgaaagcgtattcggaacgggagtgattgtatcgagaatcgtggcgggatcggtatttagcgttatagaaatcgggaaacgttcgttcggatgcgtcgtatattatttttgataatttagcgcgtcgtcgcgatgcgatagttagcgtataattagtttgtttttattaattagttgttggcgataaatgtttagattttgtcgttttttatgtgggtcgcgcgttattgttagtttttaggtaattagcggcgcggtatttttcggttagtaggttataatgggaatgcgattgagatcgacgttatcgttagagacgattttttgttggtagggcgtattacgtagtcgt

SEQ ID NO: 7904 - DNA, 578 bp, Artificial Sequence
  chemically treated genomic DNA (Homo sapiens) CpG-island No: 7904
acgactacgtaatacgccctaccaacaaaaaatcgtctctaacgataacgtcgatctcaatcgcattcccattataacctactaaccgaaaaataccgcgccgctaattacctaaaaactaacaataacgcgcgacccacataaaaaacgacaaaatctaaacatttatcgccaacaactaattaataaaaacaaactaattatacgctaactatcgcatcgcgacgacgcgctaaattatcaaaaataatatacgacgcatccgaacgaacgtttcccgatttctataacgctaaataccgatcccgccacgattctcgatacaatcactcccgttccgaatacgctttcaaaatatacgtttaccgaattactacgtaacaccaaaaccgaaataataaaatatatctccaataatcttaaaatacccgccaatacgaaaattatactaaaaaaatatatcgaacaaaacgaaactacgccgaaaaaaccgtataacgaccacaccgattactataataaaatcgataatttcccgatatttaccgtaacgcatattacccaacgtaaaaatacga

SEQ ID NO: 7905 - DNA, 867 bp, Artificial Sequence
  chemically treated genomic DNA (Homo sapiens) CpG-island No: 7905
  misc_feature (850)..(850): n is either a, c, g or t
agcgacgcgttagttttagattcggcgtggaggttttatattagattaggttagtatatggcgtatacgttaggttacggttgatcgtttgtttaatgttcgtatgagtacggaagaagtttttattggtacgttcgtcggtaataaattcgttgttatacgggtcgtaatcggaggtgattagattcgtcgtattagtatcggtacgggtaattagtagggttggaacgttcgttacgttagttgttagacgcgtcgcgattagtttttgaatagttttttgagttggtattaaaattttgtcgtttatgtgatcgtatttttttattgacgttagttgattttcgaagtgaattgtcgttgtatcggttttaattatcgtttttattagtttaaaggtatttaggatatcgttaaaatcggttttcgtatcggtaacgatcggtaggaagtaatcgatatagcgcggatcgttcggtttaatgttcgcggattattggatttgatcggtacgacggaaggtgttgttgattcgttttattatagttggtatcgagtttgtcggatagagcgattgattcggatatatgttggtcgttaggttagcgttcgtcgttatttgttatttcgatagatagattgttttaatattcgttttcgtttgttgtagcgtttgatcgttagttagtgcgtcgaggttgttgatgtagttttttttcgatttatcgtgtagtagacgttatattttcgttgcgtttagttgcgttagcgtgtatttaggattgattgaatcgcgtaattttattatatttttcgtattgtatgggcgtagtaatgtttttttaacgtnggttgagtttatttttt

SEQ ID NO: 7906 - DNA, 867 bp, Artificial Sequence
  chemically treated genomic DNA (Homo sapiens) CpG-island No: 7906
  misc_feature (18)..(18): n is either a, c, g or t
aaaaaataaactcaaccnacgttaaaaaaacattactacgcccatacaatacgaaaaatataataaaattacgcgattcaatcaatcctaaatacacgctaacgcaactaaacgcaacgaaaatataacgtctactacacgataaatcgaaaaaaaactacatcaacaacctcgacgcactaactaacgatcaaacgctacaacaaacgaaaacgaatattaaaacaatctatctatcgaaataacaaataacgacgaacgctaacctaacgaccaacatatatccgaatcaatcgctctatccgacaaactcgataccaactataataaaacgaatcaacaacaccttccgtcgtaccgatcaaatccaataatccgcgaacattaaaccgaacgatccgcgctatatcgattacttcctaccgatcgttaccgatacgaaaaccgattttaacgatatcctaaatacctttaaactaataaaaacgataattaaaaccgatacaacgacaattcacttcgaaaatcaactaacgtcaataaaaaaatacgatcacataaacgacaaaattttaataccaactcaaaaaactattcaaaaactaatcgcgacgcgtctaacaactaacgtaacgaacgttccaaccctactaattacccgtaccgatactaatacgacgaatctaatcacctccgattacgacccgtataacaacgaatttattaccgacgaacgtaccaataaaaacttcttccgtactcatacgaacattaaacaaacgatcaaccgtaacctaacgtatacgccatatactaacctaatctaatataaaacctccacgccgaatctaaaactaacgcgtcgct

SEQ ID NO: 7907 - DNA, 867 bp, Artificial Sequence
  chemically treated genomic DNA (Homo sapiens) CpG-island No: 7907
  misc_feature (18)..(18): n is either a, c, g or t
aaagagtggatttaattngcgttgggaaggtattattgcgtttatatagtgcggaagatgtggtgaaattacgcggtttagttaattttgaatgtacgttggcgtaattgggcgtagcgaaaatgtggcgtttgttgtacggtgagtcgaaaaaaggttatattaatagtttcggcgtattgattggcggttaggcgttgtaataggcgaaagcgggtattgaagtagtttatttgtcgggatggtaggtagcggcggacgttaatttggcggttagtatgtattcggattagtcgttttattcggtaaattcggtgttagttgtggtggagcggattaataatatttttcgtcgtgtcgattagatttaatggttcgcgggtattgagtcgggcgattcgcgttatgtcgattattttttgtcgatcgttgtcgatgcggaagtcggttttggcggtgttttgaatgtttttgaattgatgaaagcgatgattgaagtcggtgtagcggtagtttatttcgaagattagttggcgttagtgaagaaatgcggttatatgggcggtaaagttttagtgttaatttaggaagttatttagaaattggtcgcggcgcgtttggtagttgacgtgacgggcgttttaattttgttggttgttcgtatcgatgttgatgcggcggatttgattattttcgattgcgattcgtatgatagcgaatttattatcggcgagcgtattagtgaaggtttttttcgtatttatgcgggtattgagtaagcgattagtcgtggtttggcgtatgcgttatatgttgatttggtttggtgtgaaatttttacgtcggatttggaattggcgcgtcgtt

SEQ ID NO: 7908 - DNA, 867 bp, Artificial Sequence
  chemically treated genomic DNA (Homo sapiens) CpG-island No: 7908
  misc_feature (850)..(850): n is either a, c, g or t
aacgacgcgccaattccaaatccgacgtaaaaatttcacaccaaaccaaatcaacatataacgcatacgccaaaccacgactaatcgcttactcaatacccgcataaatacgaaaaaaaccttcactaatacgctcgccgataataaattcgctatcatacgaatcgcaatcgaaaataatcaaatccgccgcatcaacatcgatacgaacaaccaacaaaattaaaacgcccgtcacgtcaactaccaaacgcgccgcgaccaatttctaaataacttcctaaattaacactaaaactttaccgcccatataaccgcatttcttcactaacgccaactaatcttcgaaataaactaccgctacaccgacttcaatcatcgctttcatcaattcaaaaacattcaaaacaccgccaaaaccgacttccgcatcgacaacgatcgacaaaaaataatcgacataacgcgaatcgcccgactcaatacccgcgaaccattaaatctaatcgacacgacgaaaaatattattaatccgctccaccacaactaacaccgaatttaccgaataaaacgactaatccgaatacatactaaccgccaaattaacgtccgccgctacctaccatcccgacaaataaactacttcaatacccgctttcgcctattacaacgcctaaccgccaatcaatacgccgaaactattaatataaccttttttcgactcaccgtacaacaaacgccacattttcgctacgcccaattacgccaacgtacattcaaaattaactaaaccgcgtaatttcaccacatcttccgcactatataaacgcaataataccttcccaacgcnaattaaatccactcttt

SEQ ID NO: 7909 - DNA, 920 bp, Artificial Sequence
  chemically treated genomic DNA (Homo sapiens) CpG-island No: 7909
tattgtcgggttggggttgggcggggaaggttggattattatgattattattacgttaatcggtgaaggggtaattagcgcgcgtacgtttgttcgtttgcgtcgttgtgtattagtcgatgcgtttcgtattgtttaaggagtaatagatgcgtacgacgaataatggtttattttacgtttgtaaacggcggtaacgttgtgtaattagacgttcgtcgcgacggaattttcgttgtggttgggggtggatttgggtatttgcgatgtggtgtcgatgttgtcgatcgcgacggttagttagtggcggtatgtttcgattgggtcgatgtggttcgcgacggtatcgtttgggattttttcggcgttgttattattgttcgtcgttatttcgatacgttcgagtagtaattcggtcgtcgttttagttatgcggcgattttattttttttaggtacggattcgcgtatttttattaacgtgttggaatttgtcggattggaagtgagttatgtgttggatgagttaatcgtagttgcggatttgttgtaattggataacgtcggtgtagtggatatcggcggcggtattatcggtattgttatcgtgaaaaagggtaaggtgacgtattcggcggatgaagttatcggcggatattatatttttttgattttcgtcggaaatcgtcgtatttcgttggaagaggcggagtagtataagcgcggttacggtgaagagatttggtttgcggtgaaatcggtgtacgaaaaaatggcggatattgtcgttcggtatattgaagggtagggtattattgatttatggttggcgggcggtttttgtatgtaatcgggcgtggcggaattgtttcgtaaataattttcggcgttataggtgtatttatcgtagtatagtttgtt

SEQ ID NO: 7910 - DNA, 920 bp, Artificial Sequence
  chemically treated genomic DNA (Homo sapiens) CpG-island No: 7910
aacaaactatactacgataaatacacctataacgccgaaaattatttacgaaacaattccgccacgcccgattacatacaaaaaccgcccgccaaccataaatcaataataccctacccttcaatataccgaacgacaatatccgccattttttcgtacaccgatttcaccgcaaaccaaatctcttcaccgtaaccgcgcttatactactccgcctcttccaacgaaatacgacgatttccgacgaaaatcaaaaaaatataatatccgccgataacttcatccgccgaatacgtcaccttaccctttttcacgataacaataccgataataccgccgccgatatccactacaccgacgttatccaattacaacaaatccgcaactacgattaactcatccaacacataactcacttccaatccgacaaattccaacacgttaataaaaatacgcgaatccgtacctaaaaaaaataaaatcgccgcataactaaaacgacgaccgaattactactcgaacgtatcgaaataacgacgaacaataataacaacgccgaaaaaatcccaaacgataccgtcgcgaaccacatcgacccaatcgaaacataccgccactaactaaccgtcgcgatcgacaacatcgacaccacatcgcaaatacccaaatccacccccaaccacaacgaaaattccgtcgcgacgaacgtctaattacacaacgttaccgccgtttacaaacgtaaaataaaccattattcgtcgtacgcatctattactccttaaacaatacgaaacgcatcgactaatacacaacgacgcaaacgaacaaacgtacgcgcgctaattaccccttcaccgattaacgtaataataatcataataatccaaccttccccgcccaaccccaacccgacaata

SEQ ID NO: 7911 - DNA, 920 bp, Artificial Sequence
  chemically treated genomic DNA (Homo sapiens) CpG-island No: 7911
aataaattgtgttgcggtaaatgtatttgtaacgtcgggaattgtttgcgaaatagtttcgttacgttcggttgtatataagagtcgttcgttagttataaattagtaatgttttgttttttaatatgtcgggcgataatgttcgttattttttcgtatatcggttttatcgtaggttaaatttttttatcgtgatcgcgtttgtattgtttcgttttttttagcgaaatacggcgattttcggcgagagttagagagatgtgatgttcgtcggtggttttattcgtcgagtacgttattttgtttttttttacgatggtaatgtcggtagtgtcgtcgtcgatatttattatatcggcgttgtttagttgtagtagattcgtaattgcggttggtttatttagtatatggtttatttttagttcggtagattttagtacgttgatggaaatacgcgggttcgtatttggaggaaatgaagtcgtcgtatggttaaaacgacgatcgaattgttgttcgagcgtgtcgagatggcgacgaataatggtgatagcgtcgaagaaattttagacgatgtcgtcgcgaattatatcggtttagtcgaggtatatcgttattggttgatcgtcgcggtcgataatatcgatattatatcgtaggtgtttagatttatttttagttatagcggagatttcgtcgcggcgggcgtttggttatatagcgttgtcgtcgtttgtagacgtggggtgagttattgttcgtcgtgcgtatttgttattttttaaataatgcgaaacgtatcgattaatatatagcgacgtagacggataaacgtacgcgcgttggttatttttttatcggttggcgtggtgatggttatggtggtttagtttttttcgtttagttttagttcggtaatg

SEQ ID NO: 7912 - DNA, 920 bp, Artificial Sequence
  chemically treated genomic DNA (Homo sapiens) CpG-island No: 7912
cattaccgaactaaaactaaacgaaaaaaactaaaccaccataaccatcaccacgccaaccgataaaaaaataaccaacgcgcgtacgtttatccgtctacgtcgctatatattaatcgatacgtttcgcattatttaaaaaataacaaatacgcacgacgaacaataactcaccccacgtctacaaacgacgacaacgctatataaccaaacgcccgccgcgacgaaatctccgctataactaaaaataaatctaaacacctacgatataatatcgatattatcgaccgcgacgatcaaccaataacgatatacctcgactaaaccgatataattcgcgacgacatcgtctaaaatttcttcgacgctatcaccattattcgtcgccatctcgacacgctcgaacaacaattcgatcgtcgttttaaccatacgacgacttcatttcctccaaatacgaacccgcgtatttccatcaacgtactaaaatctaccgaactaaaaataaaccatatactaaataaaccaaccgcaattacgaatctactacaactaaacaacgccgatataataaatatcgacgacgacactaccgacattaccatcgtaaaaaaaaacaaaataacgtactcgacgaataaaaccaccgacgaacatcacatctctctaactctcgccgaaaatcgccgtatttcgctaaaaaaaacgaaacaatacaaacgcgatcacgataaaaaaatttaacctacgataaaaccgatatacgaaaaaataacgaacattatcgcccgacatattaaaaaacaaaacattactaatttataactaacgaacgactcttatatacaaccgaacgtaacgaaactatttcgcaaacaattcccgacgttacaaatacatttaccgcaacacaatttatt

SEQ ID NO: 7913 - DNA, 510 bp, Artificial Sequence
  chemically treated genomic DNA (Homo sapiens) CpG-island No: 7913
agcgggttttcgtagtaatatttcgatttttttcgtttttaaatataatttttatttattataatttaaatttattcgtattttgttatgtcggaaatttttttttatattttcgtaatgttgttatcgatagtttcgtattaatgcgcgttgtttgatgcgcgtcggtagtagcgataatttttttttgcggattaattattcggttgttatcgcgataatggtagtcgttgttatcgttgtcgacgcgattgtatttcgttatatacgtttgatttttaatcgcgcgggtcgttagtaatgtttgttagtgtagagagcgcggagtaggttagttggcgacgtatagggcgaggttataatcgttgagattgcgcgattatataggaaaacgtaagtcgtagtatattagcggtaaaatacgttagtcgcgttattttataattattcgcgtattgttcgttttataatgtagatgtttatttgttatgcggaatagatgacgtttat

SEQ ID NO: 7914 - DNA, 510 bp, Artificial Sequence
  chemically treated genomic DNA (Homo sapiens) CpG-island No: 7914
ataaacgtcatctattccgcataacaaataaacatctacattataaaacgaacaatacgcgaataattataaaataacgcgactaacgtattttaccgctaatatactacgacttacgttttcctatataatcgcgcaatctcaacgattataacctcgccctatacgtcgccaactaacctactccgcgctctctacactaacaaacattactaacgacccgcgcgattaaaaatcaaacgtatataacgaaatacaatcgcgtcgacaacgataacaacgactaccattatcgcgataacaaccgaataattaatccgcaaaaaaaaattatcgctactaccgacgcgcatcaaacaacgcgcattaatacgaaactatcgataacaacattacgaaaatataaaaaaaaatttccgacataacaaaatacgaataaatttaaattataataaataaaaattatatttaaaaacgaaaaaaatcgaaatattactacgaaaacccgct

SEQ ID NO: 7915 - DNA, 510 bp, Artificial Sequence
  chemically treated genomic DNA (Homo sapiens) CpG-island No: 7915
ataagcgttatttgtttcgtatggtagatgagtatttatattataaagcgggtaatgcgcgagtgattgtggaatggcgcggttggcgtattttgtcgttggtgtgttacgatttacgtttttttgtgtggtcgcgtaattttaacgattatgatttcgttttgtacgtcgttaattggtttgtttcgcgttttttgtattggtaggtattgttgacggttcgcgcgattgagaattaggcgtatgtggcgggatgtaatcgcgtcggtagcgatggtaacggttgttattatcgcggtgatagtcgggtgattaattcgtaaggagagattatcgttattgtcgacgcgtattaggtaacgcgtattgatgcggagttgtcgatggtagtattgcgggaatatagagaaaagttttcggtatggtaggatgcggatgagtttaggttgtggtgagtgggggttgtgtttaaggacggggagagtcggggtattattacgaaagttcgtt

SEQ ID NO: 7916 - DNA, 510 bp, Artificial Sequence
  chemically treated genomic DNA (Homo sapiens) CpG-island No: 7916
aacgaactttcgtaataataccccgactctccccgtccttaaacacaacccccactcaccacaacctaaactcatccgcatcctaccataccgaaaacttttctctatattcccgcaatactaccatcgacaactccgcatcaatacgcgttacctaatacgcgtcgacaataacgataatctctccttacgaattaatcacccgactatcaccgcgataataacaaccgttaccatcgctaccgacgcgattacatcccgccacatacgcctaattctcaatcgcgcgaaccgtcaacaatacctaccaatacaaaaaacgcgaaacaaaccaattaacgacgtacaaaacgaaatcataatcgttaaaattacgcgaccacacaaaaaaacgtaaatcgtaacacaccaacgacaaaatacgccaaccgcgccattccacaatcactcgcgcattacccgctttataatataaatactcatctaccatacgaaacaaataacgcttat

SEQ ID NO: 7917 - DNA, 526 bp, Artificial Sequence
  chemically treated genomic DNA (Homo sapiens) CpG-island No: 7917
tgggtatggtgggtggtatggtcgtcgtttgtcggtttgtttttggcgcgtatttcgcgtgggcgtattattcgttagttcgtgttgggtacgttgattatttcgtttatttttacgttgttatggttttcggtgttcggtaatagcgcgttgtatgaaattatttacggcggcgcggtatttgtcgaggaagcgatggtttattcggagcgcggtttttatagtttgttggcgtagtattcggcgtttatttttagcgttttcgtcgttattattattggtttgttgttttatgtgatttcggcggatttcggggcgttggtgttggggaattttatttcgtagtttaaagatattaatagcgacgttttcggttggttgcgcgttttttggtcggtggcgattggtttgttgacgttcggtatgttgatgattaacgggatattcgcgttgtaaaatattacggtgattatggggttgtcgtttagttttgtgatttttttcgtgatggcggggttgtataaat

SEQ ID NO: 7918 - DNA, 526 bp, Artificial Sequence
  chemically treated genomic DNA (Homo sapiens) CpG-island No: 7918
atttatacaaccccgccatcacgaaaaaaatcacaaaactaaacgacaaccccataatcaccgtaatattttacaacgcgaatatcccgttaatcatcaacataccgaacgtcaacaaaccaatcgccaccgaccaaaaaacgcgcaaccaaccgaaaacgtcgctattaatatctttaaactacgaaataaaattccccaacaccaacgccccgaaatccgccgaaatcacataaaacaacaaaccaataataataacgacgaaaacgctaaaaataaacgccgaatactacgccaacaaactataaaaaccgcgctccgaataaaccatcgcttcctcgacaaataccgcgccgccgtaaataatttcatacaacgcgctattaccgaacaccgaaaaccataacaacgtaaaaataaacgaaataatcaacgtacccaacacgaactaacgaataatacgcccacgcgaaatacgcgccaaaaacaaaccgacaaacgacgaccataccacccaccataccca

SEQ ID NO: 7919 - DNA, 526 bp, Artificial Sequence
  chemically treated genomic DNA (Homo sapiens) CpG-island No: 7919
atttatataatttcgttattacgaagaagattataaagttgaacggtagttttataattatcgtggtgttttgtagcgcggatatttcgttagttattagtatgtcgagcgttagtaggttaatcgttatcgattagaagacgcgtagttagtcgggggcgtcgttgttgatatttttaagttgcgaggtgaaattttttagtattagcgtttcggagttcgtcgaggttatataaaatagtaggttagtaatggtggcgacggaggcgttaaaggtaaacgtcggatattgcgttagtaggttgtagaagtcgcgtttcggatggattatcgttttttcggtaaatgtcgcgtcgtcgtggatgattttatatagcgcgttattgtcgaatatcgagagttataatagcgtgaaggtaaacggaataattaacgtgtttagtacgaattggcgaatggtacgtttacgcgagatacgcgttaggaataagtcgataaacggcgattatgttatttattatgttta

SEQ ID NO: 7920 - DNA, 526 bp, Artificial Sequence
  chemically treated genomic DNA (Homo sapiens) CpG-island No: 7920
taaacataataaataacataatcgccgtttatcgacttattcctaacgcgtatctcgcgtaaacgtaccattcgccaattcgtactaaacacgttaattattccgtttaccttcacgctattataactctcgatattcgacaataacgcgctatataaaatcatccacgacgacgcgacatttaccgaaaaaacgataatccatccgaaacgcgacttctacaacctactaacgcaatatccgacgtttacctttaacgcctccgtcgccaccattactaacctactattttatataacctcgacgaactccgaaacgctaatactaaaaaatttcacctcgcaacttaaaaatatcaacaacgacgcccccgactaactacgcgtcttctaatcgataacgattaacctactaacgctcgacatactaataactaacgaaatatccgcgctacaaaacaccacgataattataaaactaccgttcaactttataatcttcttcgtaataacgaaattatataaat

SEQ ID NO: 7921 - DNA, 526 bp, Artificial Sequence
  chemically treated genomic DNA (Homo sapiens) CpG-island No: 7921
aataaacggacgttcgtgcggtcgggattacggtttggggggaatttcgtatcggtaagggtttttatttttagtaagttttgtttcgtcgttagtcgcgggttagatatttgaaaacggtgacgggtagaggttttattattaaacgataggttcgcgtaatgatgcgttagttttattagttcgtcgaaattgattttttaggcgtttatcgtattattttatcggaaaaatttagttcggggttaagcgtggcgggtaatgttaacgagttcgattttaggttcgttatcggttatgcgtagtaatttgcggtatattaggcgttggggcgatggttatcggaagtattaatgtcgtcgaatggcgcggtattggtagtatcggtaagcggtttgttttagttaataattttcgttcgcgtttttagtaatagttgatcgaatttttttcgttcgggggaaattagatcgtaagagagttcgaagcgagtgttattcgttattcgaatcgttttatcgaaagt

SEQ ID NO: 7922 - DNA, 526 bp, Artificial Sequence
  chemically treated genomic DNA (Homo sapiens) CpG-island No: 7922
actttcgataaaacgattcgaataacgaataacactcgcttcgaactctcttacgatctaatttcccccgaacgaaaaaaattcgatcaactattactaaaaacgcgaacgaaaattattaactaaaacaaaccgcttaccgatactaccaataccgcgccattcgacgacattaatacttccgataaccatcgccccaacgcctaatataccgcaaattactacgcataaccgataacgaacctaaaatcgaactcgttaacattacccgccacgcttaaccccgaactaaatttttccgataaaataatacgataaacgcctaaaaaatcaatttcgacgaactaataaaactaacgcatcattacgcgaacctatcgtttaataataaaacctctacccgtcaccgttttcaaatatctaacccgcgactaacgacgaaacaaaacttactaaaaataaaaacccttaccgatacgaaattccccccaaaccgtaatcccgaccgcacgaacgtccgtttatt

SEQ ID NO: 7923 - DNA, 526 bp, Artificial Sequence
  chemically treated genomic DNA (Homo sapiens) CpG-island No: 7923
attttcgatgaagcgattcgaatggcgaataatattcgtttcggatttttttgcggtttggtttttttcgagcgggaaaagttcgattaattgttgttggaggcgcgggcggggattgttaattggaataaatcgtttatcggtgttgttagtatcgcgttattcggcggtattggtgttttcggtaattatcgttttagcgtttggtatgtcgtagattattgcgtatggtcgatggcgagtttggagtcggattcgttaatattgttcgttacgtttaatttcgggttggattttttcgatgaggtggtgcgatgaacgtttgggaagttaatttcgacgggttggtagggttgacgtattattacgcgggtttgtcgtttggtaatgaagtttttattcgttatcgtttttaggtgtttaattcgcgattggcggcgaagtagggtttattgaaaatgaaagtttttgtcgatgcgggattttttttaggtcgtgatttcggtcgtacgaacgttcgtttatt

SEQ ID NO: 7924 - DNA, 526 bp, Artificial Sequence
  chemically treated genomic DNA (Homo sapiens) CpG-island No: 7924
aataaacgaacgttcgtacgaccgaaatcacgacctaaaaaaaatcccgcatcgacaaaaactttcattttcaataaaccctacttcgccgccaatcgcgaattaaacacctaaaaacgataacgaataaaaacttcattaccaaacgacaaacccgcgtaataatacgtcaaccctaccaacccgtcgaaattaacttcccaaacgttcatcgcaccacctcatcgaaaaaatccaacccgaaattaaacgtaacgaacaatattaacgaatccgactccaaactcgccatcgaccatacgcaataatctacgacataccaaacgctaaaacgataattaccgaaaacaccaataccgccgaataacgcgatactaacaacaccgataaacgatttattccaattaacaatccccgcccgcgcctccaacaacaattaatcgaacttttcccgctcgaaaaaaaccaaaccgcaaaaaaatccgaaacgaatattattcgccattcgaatcgcttcatcgaaaat

SEQ ID NO: 7925 - DNA, 529 bp, Artificial Sequence
  chemically treated genomic DNA (Homo sapiens) CpG-island No: 7925
aatcggtgcgttcgggtcgttttgataggttattatacgtttttgttgcgtttcgattagaacgtcgtaattagtatcgtagaaacggtacggcgttttattttatttgatggttttttgttgattaataacggcgcgggtaacgttcggtacgttgagatcggtagtcgtcgtagcggtcgtaacggcgttagtttttataaagttacgacgattgagttttatggtgtttttttattttgttttttttgttggtgataaattagcgatatcgttagtacgttttttacgttgcgtattgatttaatggtattggattagcgtttcgttgttttttgtttttattattataattaattgatcgttcggcgcgtcgttgatagtaattttatagtcgggaaaggcgtttagttgggtgttgatgtttgaaattcgttcgtttttggtttgtacgattaggttgtaaatttgttagttagtgtgtatggagatatttcgtagttatggttgatatcggatagttggttgt

SEQ ID NO: 7926 - DNA, 529 bp, Artificial Sequence
  chemically treated genomic DNA (Homo sapiens) CpG-island No: 7926
acaaccaactatccgatatcaaccataactacgaaatatctccatacacactaactaacaaatttacaacctaatcgtacaaaccaaaaacgaacgaatttcaaacatcaacacccaactaaacgcctttcccgactataaaattactatcaacgacgcgccgaacgatcaattaattataataataaaaacaaaaaacaacgaaacgctaatccaataccattaaatcaatacgcaacgtaaaaaacgtactaacgatatcgctaatttatcaccaacaaaaaaaacaaaataaaaaaacaccataaaactcaatcgtcgtaactttataaaaactaacgccgttacgaccgctacgacgactaccgatctcaacgtaccgaacgttacccgcgccgttattaatcaacaaaaaaccatcaaataaaataaaacgccgtaccgtttctacgatactaattacgacgttctaatcgaaacgcaacaaaaacgtataataacctatcaaaacgacccgaacgcaccgatt

SEQ ID NO: 7927 - DNA, 529 bp, Artificial Sequence
  chemically treated genomic DNA (Homo sapiens) CpG-island No: 7927
gtagttagttgttcggtattagttataattgcggagtatttttatgtatattaattggtaagtttgtagtttggtcgtgtaggttaaaagcgaacgaattttagatattagtatttaattgaacgtttttttcggttgtgaagttgttgttagcgacgcgtcgagcggttagttgattgtggtggtggaagtagaagatagcgaaacgttgatttaatattattgagttagtacgtaacgtagagggcgtgttggcggtgtcgttggtttattattagtaggaagagtaaggtgaggaaatattatgaaatttagtcgtcgtagttttatgaaagttaacgtcgttgcggtcgttgcggcggttgtcggttttagcgtgtcgggcgttgttcgcgtcgttgttggttagtaggaagttattaaatgggataaagcgtcgtgtcgtttttgcggtattggttgcggcgttttggtcggaacgtagtagggacgtgtggtggtttgttagggcgattcggacgtatcggtt

SEQ ID NO: 7928 - DNA, 529 bp, Artificial Sequence
  chemically treated genomic DNA (Homo sapiens) CpG-island No: 7928
aaccgatacgtccgaatcgccctaacaaaccaccacacgtccctactacgttccgaccaaaacgccgcaaccaataccgcaaaaacgacacgacgctttatcccatttaataacttcctactaaccaacaacgacgcgaacaacgcccgacacgctaaaaccgacaaccgccgcaacgaccgcaacgacgttaactttcataaaactacgacgactaaatttcataatatttcctcaccttactcttcctactaataataaaccaacgacaccgccaacacgccctctacgttacgtactaactcaataatattaaatcaacgtttcgctatcttctacttccaccaccacaatcaactaaccgctcgacgcgtcgctaacaacaacttcacaaccgaaaaaaacgttcaattaaatactaatatctaaaattcgttcgcttttaacctacacgaccaaactacaaacttaccaattaatatacataaaaatactccgcaattataactaataccgaacaactaactac

SEQ ID NO: 7929 - DNA, 802 bp, Artificial Sequence
  chemically treated genomic DNA (Homo sapiens) CpG-island No: 7929
ttcgttgggtttttgttagtattttataattaattataaatttacgtacggtggcggagcgtagtagaggcggatataaagtgcgcgtgtagttgttagtgttgatttttttcgttattaaatggcgcgtcgtgttagtttatagagtaggggaaggagtattggacgaggttgttataacgattggttagtttttttaacgttagacgttagatcgttgcgttgggcgtcggttaaatcggtgattcgtaaaatcgtgggttttgggtagtagtagcgtttcgaataagttaggcgtatatatttataatttcggcgttggcgtaggtaatagcgtgttggacgtggttaatgtttttagtaaagtttgcggtaaatcggttaattattattttgtatcgcgtcgcgagggcgatttttcggtttattgggcggacgttagtaaagtcgatcgtgaattgaattggcgcgtaacgcgtatattcgatgaaatggcgtaggatatttggtattggtagttacgttatttatagggatatttcgattaaggaacgattatgacgtaatttaatttcgttgattatttatatcgtcgttataattcgtttatcgggtaatggattttggttttatcgtatcgcgttaagcgtttttggtagggggcgtaggaaacgttagttaaataggtgttatttgcgtacgatttagattgttttttttgcgtaggtaatgtgcgggtgataggcgataaaaatttcgattatatcgggatttacgtttttattaatgattttgcggtttt

SEQ ID NO: 7930 - DNA, 802 bp, Artificial Sequence
  chemically treated genomic DNA (Homo sapiens) CpG-island No: 7930
aaaaccgcaaaatcattaataaaaacgtaaatcccgatataatcgaaatttttatcgcctatcacccgcacattacctacgcaaaaaaaacaatctaaatcgtacgcaaataacacctatttaactaacgtttcctacgccccctaccaaaaacgcttaacgcgatacgataaaaccaaaatccattacccgataaacgaattataacgacgatataaataatcaacgaaattaaattacgtcataatcgttccttaatcgaaatatccctataaataacgtaactaccaataccaaatatcctacgccatttcatcgaatatacgcgttacgcgccaattcaattcacgatcgactttactaacgtccgcccaataaaccgaaaaatcgccctcgcgacgcgatacaaaataataattaaccgatttaccgcaaactttactaaaaacattaaccacgtccaacacgctattacctacgccaacgccgaaattataaatatatacgcctaacttattcgaaacgctactactacccaaaacccacgattttacgaatcaccgatttaaccgacgcccaacgcaacgatctaacgtctaacgttaaaaaaactaaccaatcgttataacaacctcgtccaatactccttcccctactctataaactaacacgacgcgccatttaataacgaaaaaaatcaacactaacaactacacgcgcactttatatccgcctctactacgctccgccaccgtacgtaaatttataattaattataaaatactaacaaaaacccaacgaa

SEQ ID NO: 7931 - DNA, 802 bp, Artificial Sequence
  chemically treated genomic DNA (Homo sapiens) CpG-island No: 7931
agagtcgtaaagttattagtgaaaacgtaagtttcggtgtaatcggggtttttatcgtttgttattcgtatattatttgcgtagaggaagtaatttggatcgtgcgtaggtaatatttgtttggttggcgttttttgcgttttttgttaggggcgtttagcgcggtgcggtgaaattagaatttattgttcggtgagcgggttgtagcggcgatgtggatgattaacgggattaaattgcgttatggtcgttttttaatcgggatatttttgtggatggcgtgattgttagtgttaggtgttttgcgttattttatcgagtgtgcgcgttacgcgttagtttagtttacggtcggttttgttggcgttcgtttagtaggtcggaaggtcgttttcgcgacgcggtgtaaaatgataattaatcggtttgtcgtaggttttgttgaaggtattaattacgtttagtacgttgttgtttacgttagcgtcgaggttgtagatgtgtacgtttggtttgttcgaaacgttattgttgtttaaagtttacggttttacggattatcgatttgatcgacgtttagcgtagcgatttggcgtttggcgttgaaaaagttgattagtcgttatgataatttcgtttagtgtttttttttttattttatgggttggtacggcgcgttatttaatggcgaagagaattaatattggtagttgtacgcgtattttgtattcgtttttgttgcgtttcgttatcgtacgtaaatttatggttggttatgaaatgttggtagagatttagcgag

SEQ ID NO: 7932 - DNA, 802 bp, Artificial Sequence
  chemically treated genomic DNA (Homo sapiens) CpG-island No: 7932
ctcgctaaatctctaccaacatttcataaccaaccataaatttacgtacgataacgaaacgcaacaaaaacgaatacaaaatacgcgtacaactaccaatattaattctcttcgccattaaataacgcgccgtaccaacccataaaataaaaaaaaaaacactaaacgaaattatcataacgactaatcaactttttcaacgccaaacgccaaatcgctacgctaaacgtcgatcaaatcgataatccgtaaaaccgtaaactttaaacaacaataacgtttcgaacaaaccaaacgtacacatctacaacctcgacgctaacgtaaacaacaacgtactaaacgtaattaataccttcaacaaaacctacgacaaaccgattaattatcattttacaccgcgtcgcgaaaacgaccttccgacctactaaacgaacgccaacaaaaccgaccgtaaactaaactaacgcgtaacgcgcacactcgataaaataacgcaaaacacctaacactaacaatcacgccatccacaaaaatatcccgattaaaaaacgaccataacgcaatttaatcccgttaatcatccacatcgccgctacaacccgctcaccgaacaataaattctaatttcaccgcaccgcgctaaacgcccctaacaaaaaacgcaaaaaacgccaaccaaacaaatattacctacgcacgatccaaattacttcctctacgcaaataatatacgaataacaaacgataaaaaccccgattacaccgaaacttacgttttcactaataactttacgactct

SEQ ID NO: 7933 - DNA, 659 bp, Artificial Sequence
  chemically treated genomic DNA (Homo sapiens) CpG-island No: 7933
cggttcgattcgatcgtattcggcgtttgttttcgttcggcgttttcggttagttatgggtttttggagtcgtagtttttcggcgttgttgttgttgttgtaggtatttcggattttttgatttgcgagggacgtattcgggtcgtaagtttcgcgttttagttttgcgtttttttttttttcgtcgttatcgtttttttttttttaagaaagttcgggttttgaggagcggagcggtttggaagtttcgcgcgtttcggattttttagtgatgggagtggggggtgggtggtgaggggcgagcgcggtttttttgttttttttagcgtagatcgaggcgggggcgtttggtcgcggagttcgcggggtgggttcgcgcgggcggtgggggcgtgaagcggggtgtagggggtggggtgtggagaaggggtgttttggtgtaagtcgagggggagttaggagtcgtggggacgattttcgagggaaggagaggggtattcgtagaaataaaggtattatgttatgttaagaaaggtcgtaaataggagtgagggtttcggggataagaaagtgaggtcggaggaggtgggagcgtttttcgttttgaggagtggtgtattttcggtttaaggaaagtggggtattggagaataaagata

SEQ ID NO: 7934 - DNA, 659 bp, Artificial Sequence
  chemically treated genomic DNA (Homo sapiens) CpG-island No: 7934
tatctttattctccaataccccactttccttaaaccgaaaatacaccactcctcaaaacgaaaaacgctcccacctcctccgacctcactttcttatccccgaaaccctcactcctatttacgacctttcttaacataacataatacctttatttctacgaatacccctctccttccctcgaaaatcgtccccacgactcctaactccccctcgacttacaccaaaacaccccttctccacaccccaccccctacaccccgcttcacgcccccaccgcccgcgcgaacccaccccgcgaactccgcgaccaaacgcccccgcctcgatctacgctaaaaaaaacaaaaaaaccgcgctcgcccctcaccacccaccccccactcccatcactaaaaaatccgaaacgcgcgaaacttccaaaccgctccgctcctcaaaacccgaactttcttaaaaaaaaaaaaacgataacgacgaaaaaaaaaaaaacgcaaaactaaaacgcgaaacttacgacccgaatacgtccctcgcaaatcaaaaaatccgaaatacctacaacaacaacaacaacgccgaaaaactacgactccaaaaacccataactaaccgaaaacgccgaacgaaaacaaacgccgaatacgatcgaatcgaaccg

SEQ ID NO: 7935 - DNA, 659 bp, Artificial Sequence
  chemically treated genomic DNA (Homo sapiens) CpG-island No: 7935
tgtttttattttttagtattttattttttttagatcgggaatgtattattttttagagcgaggggcgtttttatttttttcgattttatttttttattttcgggatttttatttttatttacgattttttttggtatggtatggtgtttttatttttacggatgtttttttttttttttcgaagatcgtttttacgatttttggttttttttcgatttgtattagggtattttttttttatattttattttttatatttcgttttacgtttttatcgttcgcgcgagtttatttcgcggatttcgcggttagacgttttcgtttcggtttgcgttggagggggtaggaaagtcgcgttcgttttttattatttattttttatttttattattggggggttcggagcgcgcgaggtttttaggtcgtttcgttttttaggattcgaatttttttggaagaagggaagcggtgacgacgggagaggaaggggcgtagggttggggcgcggagtttgcggttcgaatgcgtttttcgtaagttaggggattcggggtatttgtagtagtagtagtagcgtcgagaggttgcggttttaagggtttatggttggtcggggacgtcgagcgagggtaggcgtcgggtgcggtcgggtcgggtcg

SEQ ID NO: 7936 - DNA, 659 bp, Artificial Sequence
  chemically treated genomic DNA (Homo sapiens) CpG-island No: 7936
cgacccgacccgaccgcacccgacgcctaccctcgctcgacgtccccgaccaaccataaacccttaaaaccgcaacctctcgacgctactactactactacaaataccccgaatcccctaacttacgaaaaacgcattcgaaccgcaaactccgcgccccaaccctacgccccttcctctcccgtcgtcaccgcttcccttcttccaaaaaaattcgaatcctaaaaaacgaaacgacctaaaaacctcgcgcgctccgaaccccccaataataaaaataaaaaataaataataaaaaacgaacgcgactttcctaccccctccaacgcaaaccgaaacgaaaacgtctaaccgcgaaatccgcgaaataaactcgcgcgaacgataaaaacgtaaaacgaaatataaaaaataaaatataaaaaaaaaataccctaatacaaatcgaaaaaaaaccaaaaatcgtaaaaacgatcttcgaaaaaaaaaaaaaaacatccgtaaaaataaaaacaccataccataccaaaaaaaatcgtaaataaaaataaaaatcccgaaaataaaaaaataaaatcgaaaaaaataaaaacgcccctcgctctaaaaaataatacattcccgatctaaaaaaaataaaatactaaaaaataaaaaca

SEQ ID NO: 7937 - DNA, 535 bp, Artificial Sequence
  chemically treated genomic DNA (Homo sapiens) CpG-island No: 7937
gttcgaacgtcgttgttagttgtgttattttgtcgtttttgtttttttcggtaaggtttagttttagtatggcgtttatttcgtaattttgaatatgtagtacggtacgcgtattagagagtttcgttagtaggcgtattttcggcgcgtaaaatagcgttggtattacgttaataatgcgattcggtttttagcgacgttgcgttattagcggaaagaaattgttgacggtaaaattgtttagatgtaataggcgttttagggtgttcggttgttttggtatatatagcgggtagcgttatatcgtggcggtttttttttttcgtttgtagcgttaggcggaatagttttcgtttatttgttattgcgggtagtaaggcggtgcggtaatgattcgtattttatgattttgtgtcgttagttattttattatttcgtcggtgtatttgtcgatgtcggttaatttcggcgagtagttaatgtcgtagattagtatttttataattcgggtatttcggtacgttttttagcgaga

SEQ ID NO: 7938 - DNA, 535 bp, Artificial Sequence
  chemically treated genomic DNA (Homo sapiens) CpG-island No: 7938
tctcgctaaaaaacgtaccgaaatacccgaattataaaaatactaatctacgacattaactactcgccgaaattaaccgacatcgacaaatacaccgacgaaataataaaataactaacgacacaaaatcataaaatacgaatcattaccgcaccgccttactacccgcaataacaaataaacgaaaactattccgcctaacgctacaaacgaaaaaaaaaaaccgccacgatataacgctacccgctatatataccaaaacaaccgaacaccctaaaacgcctattacatctaaacaattttaccgtcaacaatttctttccgctaataacgcaacgtcgctaaaaaccgaatcgcattattaacgtaataccaacgctattttacgcgccgaaaatacgcctactaacgaaactctctaatacgcgtaccgtactacatattcaaaattacgaaataaacgccatactaaaactaaaccttaccgaaaaaaacaaaaacgacaaaataacacaactaacaacgacgttcgaac

SEQ ID NO: 7939 - DNA, 535 bp, Artificial Sequence
  chemically treated genomic DNA (Homo sapiens) CpG-island No: 7939
tttcgttgagaagcgtatcggagtattcggattatgaaaatattggtttacggtattaattattcgtcggagttaatcggtatcggtaaatatatcggcgagatggtggaatggttggcggtataaggttatgaggtgcgggttattatcgtatcgttttattattcgtaatggtaggtgggcgagaattatttcgtttggcgttataaacgagaagagggggtcgttacggtgtggcgttgttcgttgtatgtgttaaaatagtcgagtattttgaaacgtttgttgtatttgggtagttttgtcgttagtagttttttttcgttgatggcgtaacgtcgttggaagtcggatcgtattattggcgtggtgttaacgttgttttgcgcgtcgggaatgcgtttgttggcgaaattttttggtgcgcgtatcgtgttgtatatttaggattacgaagtggacgttatgttggggttgggttttgtcggaaaaggtaaaggcggtaaagtggtatagttggtaacggcgttcgaat

SEQ ID NO: 7940 - DNA, 535 bp, Artificial Sequence
  chemically treated genomic DNA (Homo sapiens) CpG-island No: 7940
attcgaacgccgttaccaactataccactttaccgcctttaccttttccgacaaaacccaaccccaacataacgtccacttcgtaatcctaaatatacaacacgatacgcgcaccaaaaaatttcgccaacaaacgcattcccgacgcgcaaaacaacgttaacaccacgccaataatacgatccgacttccaacgacgttacgccatcaacgaaaaaaaactactaacgacaaaactacccaaatacaacaaacgtttcaaaatactcgactattttaacacatacaacgaacaacgccacaccgtaacgaccccctcttctcgtttataacgccaaacgaaataattctcgcccacctaccattacgaataataaaacgatacgataataacccgcacctcataaccttataccgccaaccattccaccatctcgccgatatatttaccgataccgattaactccgacgaataattaataccgtaaaccaatattttcataatccgaatactccgatacgcttctcaacgaaa

SEQ ID NO: 7941 - DNA, 688 bp, Artificial Sequence
  chemically treated genomic DNA (Homo sapiens) CpG-island No: 7941
ttgtattttttttagttcgattcgtttttttttgaacgttttgtttgcgtttagatttattttttttacgtttagtttttcgttgatatttatttttttgattattatttttttatcgtatttcgggggcgttgtgttgtcgttgtattgtcgcgttgtacggttgatatcgcgagttcggtatcgttatatttagcgtttcgtgcgggcgtttaaggttatagatcgttcgttagtggtcgaaggcgcgttgttagtttatcgttgtttgcgaattattttttttgtagtattttcgtttttaggttgcggtgaaaacgttttagcgtttttttgcgtttgcggatgataggtcggagtgttttattcggatatttaggcgtattagttatagttttagcgtcgtttaggtgttcggtggtgtcgttttacggtgagtcgttatttatggttattcggttcggtaggtcgttacgtttaaatatcgttgattagttgttgttgtttcggtttcgcgtcgtttatcggtatatgtgcgttacggttattagggataaaatcgggagtggtcgtttacgtagggtgagcggatggtagcgtagttttgaaatttttttggagaatattaggggcggtttgttttattttttttttgtaagagcggtatcgtttgattttaatcgttgtt

SEQ ID NO: 7942 - DNA, 688 bp, Artificial Sequence
  chemically treated genomic DNA (Homo sapiens) CpG-island No: 7942
aacaacgattaaaatcaaacgataccgctcttacaaaaaaaaaataaaacaaaccgcccctaatattctccaaaaaaatttcaaaactacgctaccatccgctcaccctacgtaaacgaccactcccgattttatccctaataaccgtaacgcacatataccgataaacgacgcgaaaccgaaacaacaacaactaatcaacgatatttaaacgtaacgacctaccgaaccgaataaccataaataacgactcaccgtaaaacgacaccaccgaacacctaaacgacgctaaaactataactaatacgcctaaatatccgaataaaacactccgacctatcatccgcaaacgcaaaaaaacgctaaaacgttttcaccgcaacctaaaaacgaaaatactacaaaaaaaataattcgcaaacaacgataaactaacaacgcgccttcgaccactaacgaacgatctataaccttaaacgcccgcacgaaacgctaaatataacgataccgaactcgcgatatcaaccgtacaacgcgacaatacaacgacaacacaacgcccccgaaatacgataaaaaaataataatcaaaaaaataaatatcaacgaaaaactaaacgtaaaaaaaataaatctaaacgcaaacaaaacgttcaaaaaaaaacgaatcgaactaaaaaaaatacaa

SEQ ID NO: 7943 - DNA, 688 bp, Artificial Sequence
  chemically treated genomic DNA (Homo sapiens) CpG-island No: 7943
agtagcgattaaggttaagcgatatcgtttttatagaggagaggtagggtaaatcgtttttaatgttttttaaagagattttaaggttacgttgttattcgtttattttgcgtggacgattattttcgattttatttttgatgatcgtggcgtatatgtatcgatgaacggcgcgagatcgggatagtagtagttggttagcgatgtttgagcgtaacggtttgtcggatcggatgattatggataacggtttatcgtggggcgatattatcggatatttgaacggcgttggagttgtggttgatgcgtttgggtattcgggtggggtatttcggtttattattcgtagacgtaggggaacgttggagcgtttttatcgtagtttgaaggcggaagtgttgtagggaaaatggttcgtagatagcggtgaattggtagcgcgttttcgattattggcggacggtttataattttgaacgttcgtacgaggcgttggatatggcggtatcgggttcgcggtattagtcgtatagcgcggtagtatagcggtaatataacgttttcggaatacgatgaaggggtgatggttaggaaagtggatattagcggaaagttgagcgtgaaaggggtaagtttgagcgtaggtaaggcgtttaggggagaacgggtcgggttgaaggagatgtag

SEQ ID NO: 7944 - DNA, 688 bp, Artificial Sequence
  chemically treated genomic DNA (Homo sapiens) CpG-island No: 7944
ctacatctccttcaacccgacccgttctcccctaaacgccttacctacgctcaaacttacccctttcacgctcaactttccgctaatatccactttcctaaccatcaccccttcatcgtattccgaaaacgttatattaccgctatactaccgcgctatacgactaataccgcgaacccgataccgccatatccaacgcctcgtacgaacgttcaaaattataaaccgtccgccaataatcgaaaacgcgctaccaattcaccgctatctacgaaccattttccctacaacacttccgccttcaaactacgataaaaacgctccaacgttcccctacgtctacgaataataaaccgaaataccccacccgaatacccaaacgcatcaaccacaactccaacgccgttcaaatatccgataatatcgccccacgataaaccgttatccataatcatccgatccgacaaaccgttacgctcaaacatcgctaaccaactactactatcccgatctcgcgccgttcatcgatacatatacgccacgatcatcaaaaataaaatcgaaaataatcgtccacgcaaaataaacgaataacaacgtaaccttaaaatctctttaaaaaacattaaaaacgatttaccctacctctcctctataaaaacgatatcgcttaaccttaatcgctact

SEQ ID NO: 7945 - DNA, 682 bp, Artificial Sequence
  chemically treated genomic DNA (Homo sapiens) CpG-island No: 7945
gacgtcgtcgttgaagatttgttggtagaagtgagttagtcgaagcgcgattttagcgaagaagagattatcgttcgtatgatgatttcgatggttaacgaagtggtgcgttgtttggaggaaggtattatcgttatttcggcggaagcggatatggcgttggtttacggtttgggttttttttcgttttacggcggcgcgtttcgttggttggatattttcggtagcgtaaaatatttcgatatggtatagtaatattagtatttcggttcgttgtatgaagtgtcggaaggtttgcgtaataaagcgcgttataacgaatcgtattatttttcggttgagttagttcgttcggttggcgatttgaaaacggtttaaggagttataatggaataggttgttattgtcgatgtaattcgtatttcgatgggtcgttcgaagggcggtgtttttcgtaacgtgcgtgtagaagattttttcgtttatttaatgcgtagtttgttggcgcgtaattcggcgttggaagcggcggttttcgacgatatttattggggttgtgtgtagtagacgttggagtagggttttaatatcgttcgtaacgcggcgttgttggtagaagtattatattttgtttcggcggttatcgttaatcgtttgtgtggtttatttatgtaggtattgt

SEQ ID NO: 7946 - DNA, 682 bp, Artificial Sequence
  chemically treated genomic DNA (Homo sapiens) CpG-island No: 7946
acaatacctacataaataaaccacacaaacgattaacgataaccgccgaaacaaaatataatacttctaccaacaacgccgcgttacgaacgatattaaaaccctactccaacgtctactacacacaaccccaataaatatcgtcgaaaaccgccgcttccaacgccgaattacgcgccaacaaactacgcattaaataaacgaaaaaatcttctacacgcacgttacgaaaaacaccgcccttcgaacgacccatcgaaatacgaattacatcgacaataacaacctattccattataactccttaaaccgttttcaaatcgccaaccgaacgaactaactcaaccgaaaaataatacgattcgttataacgcgctttattacgcaaaccttccgacacttcatacaacgaaccgaaatactaatattactataccatatcgaaatattttacgctaccgaaaatatccaaccaacgaaacgcgccgccgtaaaacgaaaaaaaacccaaaccgtaaaccaacgccatatccgcttccgccgaaataacgataataccttcctccaaacaacgcaccacttcgttaaccatcgaaatcatcatacgaacgataatctcttcttcgctaaaatcgcgcttcgactaactcacttctaccaacaaatcttcaacgacgacgtc

SEQ ID NO: 7947 - DNA, 682 bp, Artificial Sequence
  chemically treated genomic DNA (Homo sapiens) CpG-island No: 7947
gtagtgtttgtatggatgaattatataagcgattaacggtaatcgtcgggatagagtgtggtatttttgttagtagcgtcgcgttacgggcgatattaaaattttgttttagcgtttgttgtatataattttagtaaatatcgtcgagggtcgtcgtttttagcgtcgggttacgcgttagtaggttacgtattaaatgagcggagagattttttgtacgtacgttacgaaaagtatcgtttttcgaacggtttatcggggtgcgaattgtatcgataatgataatttgttttattgtgattttttaagtcgtttttaggtcgttaatcggacgggttggtttaatcggaggatagtacggttcgttatgacgcgttttattacgtagatttttcggtattttatatagcgggtcgaggtgttgatattgttgtgttatatcgaggtattttgcgttatcgagggtgtttagttagcggaacgcgtcgtcgtggaacggagggaagtttaggtcgtagattagcgttatattcgttttcgtcggagtggcgataatgtttttttttagatagcgtattatttcgttgattatcgggattattatgcgggcgataatttttttttcgttgaaatcgcgtttcggttggtttatttttgttagtaggtttttaacggcggcgtt

SEQ ID NO: 7948 - DNA, 682 bp, Artificial Sequence
  chemically treated genomic DNA (Homo sapiens) CpG-island No: 7948
aacgccgccgttaaaaacctactaacaaaaataaaccaaccgaaacgcgatttcaacgaaaaaaaaattatcgcccgcataataatcccgataatcaacgaaataatacgctatctaaaaaaaaacattatcgccactccgacgaaaacgaatataacgctaatctacgacctaaacttccctccgttccacgacgacgcgttccgctaactaaacaccctcgataacgcaaaatacctcgatataacacaacaatatcaacacctcgacccgctatataaaataccgaaaaatctacgtaataaaacgcgtcataacgaaccgtactatcctccgattaaaccaacccgtccgattaacgacctaaaaacgacttaaaaaatcacaataaaacaaattatcattatcgatacaattcgcaccccgataaaccgttcgaaaaacgatacttttcgtaacgtacgtacaaaaaatctctccgctcatttaatacgtaacctactaacgcgtaacccgacgctaaaaacgacgaccctcgacgatatttactaaaattatatacaacaaacgctaaaacaaaattttaatatcgcccgtaacgcgacgctactaacaaaaataccacactctatcccgacgattaccgttaatcgcttatataattcatccatacaaacactac

SEQ ID NO: 7949 - DNA, 687 bp, Artificial Sequence
  chemically treated genomic DNA (Homo sapiens) CpG-island No: 7949
tatttagtattattaagtaatgtatcgaatagggaatcgcgatcgtcggaaagtgtcgttatcgtcgtagttacgtatcgcgggcgatgacgttagaatttttagatcgttttgtcgcgtatttgttttgtttattaggaattcgagggcgcgatacgtttaataagaatggtcggttatcgtcgtataagtaatttcgtaaagggtaaagataagaatgcgtattcgacgaacgattgatgtcgtataatcgtgtttcgtcgtagtattatcgttaacggtaaaaatcgagcgttcgaaggcggttttgcggttgatgaatataaatagcgtaaataatataattatgattagcgcggatatcggtatatcgagaaattcgttcgtttagttagtttagtatttcgtttttattaatcggtattggtagtgcgttcgtttataaatagttttatttcgcgtagggcgttttatagttttagtgtggtaatcgaaatttggtattattaaattacgtttgcgtacgttatttcggtttatgcgtttttattagtcgcgtttaatttagtaatattagtaggtacgttatcgttattcggaatttttaaattgtagttaataaatgttaggtatatcggagataaaagttattatcggtttaacgttgatattaatttttatcggatg

SEQ ID NO: 7950 - DNA, 687 bp, Artificial Sequence
  chemically treated genomic DNA (Homo sapiens) CpG-island No: 7950
catccgataaaaattaatatcaacgttaaaccgataataacttttatctccgatatacctaacatttattaactacaatttaaaaattccgaataacgataacgtacctactaatattactaaattaaacgcgactaataaaaacgcataaaccgaaataacgtacgcaaacgtaatttaataataccaaatttcgattaccacactaaaactataaaacgccctacgcgaaataaaactatttataaacgaacgcactaccaataccgattaataaaaacgaaatactaaactaactaaacgaacgaatttctcgatataccgatatccgcgctaatcataattatattatttacgctatttatattcatcaaccgcaaaaccgccttcgaacgctcgatttttaccgttaacgataatactacgacgaaacacgattatacgacatcaatcgttcgtcgaatacgcattcttatctttaccctttacgaaattacttatacgacgataaccgaccattcttattaaacgtatcgcgccctcgaattcctaataaacaaaacaaatacgcgacaaaacgatctaaaaattctaacgtcatcgcccgcgatacgtaactacgacgataacgacactttccgacgatcgcgattccctattcgatacattacttaataatactaaata

SEQ ID NO: 7951 - DNA, 687 bp, Artificial Sequence
  chemically treated genomic DNA (Homo sapiens) CpG-island No: 7951
tattcggtgagaattgatgttagcgttgggtcgatggtggtttttgttttcggtgtgtttggtatttgttgattgtaatttgaagatttcgagtggcggtggcgtgtttgttggtgttgttggattaggcgcgattgatgggaacgtatggatcggggtgacgtgcgtaggcgtgatttaatgatattaagtttcggttgttatattggggttgtggagcgttttgcgcggaatggggttgtttatagacgaacgtattgttagtgtcgattgatgaaaacgaggtgttggattggttgggcggacgaatttttcggtgtgtcggtattcgcgttgattatgattgtgttgtttgcgttgtttgtgtttattagtcgtaaaatcgttttcgggcgttcggtttttgtcgttggcggtaatgttacggcggggtacgattgtgcggtattaatcgttcgtcgggtgcgtatttttatttttattttttacgggattatttatgcggcggtgatcggttatttttgttgagcgtgtcgcgttttcgggtttttggtaagtaagataggtgcgcgataaaacggtttggagattttgacgttatcgttcgcggtgcgtggttacggcggtagcggtatttttcggcggtcgcggttttttgttcggtatattgtttggtgatgttgggtg

SEQ ID NO: 7952 - DNA, 687 bp, Artificial Sequence
  chemically treated genomic DNA (Homo sapiens) CpG-island No: 7952
cacccaacatcaccaaacaatataccgaacaaaaaaccgcgaccgccgaaaaataccgctaccgccgtaaccacgcaccgcgaacgataacgtcaaaatctccaaaccgttttatcgcgcacctatcttacttaccaaaaacccgaaaacgcgacacgctcaacaaaaataaccgatcaccgccgcataaataatcccgtaaaaaataaaaataaaaatacgcacccgacgaacgattaataccgcacaatcgtaccccgccgtaacattaccgccaacgacaaaaaccgaacgcccgaaaacgattttacgactaataaacacaaacaacgcaaacaacacaatcataatcaacgcgaataccgacacaccgaaaaattcgtccgcccaaccaatccaacacctcgttttcatcaatcgacactaacaatacgttcgtctataaacaaccccattccgcgcaaaacgctccacaaccccaatataacaaccgaaacttaatatcattaaatcacgcctacgcacgtcaccccgatccatacgttcccatcaatcgcgcctaatccaacaacaccaacaaacacgccaccgccactcgaaatcttcaaattacaatcaacaaataccaaacacaccgaaaacaaaaaccaccatcgacccaacgctaacatcaattctcaccgaata

SEQ ID NO: 7953 - DNA, 559 bp, Artificial Sequence
  chemically treated genomic DNA (Homo sapiens) CpG-island No: 7953
ttttgtttgtattaggcgacgaattggttcggttgacggtaggaatgggcgtttttggcggcgggtaatgttgttatgttcggtatcgatttgagttatggtgtggatttcgtttttttgaaacgttagtagttattgacggcggaattcgtttaggtttttttgggtgcggaagttcgttatgttggtcgggaacgcggcgcgtagttcgtttgaatagtttgttgaatatttgcgttatttgttcgatcggcgcgtatttttggtattgttttggtaggttatgggttatgcggtttatttgttcgcggatcgtggttacgtatttgttttgtaagagattttatcggattattttataggtttagttagtgttgttgaagtttagatttggtttgatagcgcgttgtttattttcggcgttacgttgtattgttagtttgttttacggcgttacgtaggttttcgggatttaggatgttggtttgttagaagtggtgtttgttagtttagttatatagcgcgtagatgttttggtgcgattaggtatgtttatttg

SEQ ID NO: 7954 - DNA, 559 bp, Artificial Sequence
  chemically treated genomic DNA (Homo sapiens) CpG-island No: 7954
caaataaacatacctaatcgcaccaaaacatctacgcgctatataactaaactaacaaacaccacttctaacaaaccaacatcctaaatcccgaaaacctacgtaacgccgtaaaacaaactaacaatacaacgtaacgccgaaaataaacaacgcgctatcaaaccaaatctaaacttcaacaacactaactaaacctataaaataatccgataaaatctcttacaaaacaaatacgtaaccacgatccgcgaacaaataaaccgcataacccataacctaccaaaacaataccaaaaatacgcgccgatcgaacaaataacgcaaatattcaacaaactattcaaacgaactacgcgccgcgttcccgaccaacataacgaacttccgcacccaaaaaaacctaaacgaattccgccgtcaataactactaacgtttcaaaaaaacgaaatccacaccataactcaaatcgataccgaacataacaacattacccgccgccaaaaacgcccattcctaccgtcaaccgaaccaattcgtcgcctaatacaaacaaaa

SEQ ID NO: 7955 - DNA, 559 bp, Artificial Sequence
  chemically treated genomic DNA (Homo sapiens) CpG-island No: 7955
tagatagatatatttggtcgtattaggatatttgcgcgttgtatgattgggttagtaaatattatttttggtagattaatattttgagtttcgaaagtttgcgtaacgtcgtgggataagttgataatgtagcgtaacgtcggaggtgagtagcgcgttgttaagttagatttggattttaataatattgattgggtttatggggtgattcgatgaaattttttgtagagtagatgcgtaattacgattcgcgagtagatgagtcgtatggtttataatttgttagagtagtattaggagtgcgcgtcggtcgagtaggtggcgtaggtatttaataagttgtttaaacgagttgcgcgtcgcgttttcggttagtatggcgaattttcgtatttaggaagatttgaacgaatttcgtcgttagtggttgttggcgttttaggagaacgggatttatattatggtttaggtcgatgtcgggtatagtagtattgttcgtcgttaggagcgtttatttttgtcgttagtcgggttagttcgtcgtttggtgtaagtagag

SEQ ID NO: 7956 - DNA, 559 bp, Artificial Sequence
  chemically treated genomic DNA (Homo sapiens) CpG-island No: 7956
ctctacttacaccaaacgacgaactaacccgactaacgacaaaaataaacgctcctaacgacgaacaatactactatacccgacatcgacctaaaccataatataaatcccgttctcctaaaacgccaacaaccactaacgacgaaattcgttcaaatcttcctaaatacgaaaattcgccatactaaccgaaaacgcgacgcgcaactcgtttaaacaacttattaaatacctacgccacctactcgaccgacgcgcactcctaatactactctaacaaattataaaccatacgactcatctactcgcgaatcgtaattacgcatctactctacaaaaaatttcatcgaatcaccccataaacccaatcaatattattaaaatccaaatctaacttaacaacgcgctactcacctccgacgttacgctacattatcaacttatcccacgacgttacgcaaactttcgaaactcaaaatattaatctaccaaaaataatatttactaacccaatcatacaacgcgcaaatatcctaatacgaccaaatatatctatcta

SEQ ID NO: 7957 - DNA, 509 bp, Artificial Sequence
  chemically treated genomic DNA (Homo sapiens) CpG-island No: 7957
gttcgtacgatttagcgtcgtcgtggtttttttttagcgttttttgttttagcgattattatgttttcgggttcgagtagttagggtcgcggttatcgtttttttcgtattttaggtcgagaatttataacgcggcgtgtttttcgcgcgatttcgtcgttacgttacgtttttttttcgtttttcggaagtgcgcgggttggagcggaagcgtacgtttgttaggattagcggtggtggtttcgcgatggtaggcggcggcggggtcggcggcggttttttggagaatgttaatttttttatttattagcgttttggggagcggtttgtgacggtaggcgaggaggacgagtaggttttcgatagtatcgacgtacgcgagattttcgatattcgtcgttgttgggcgcgggcgggtttcgggggtttgcggtggggggagtagtgatatcgagtagttggtggagtcgtattttagtagggcgtttttggtagagggttttaagtgg

SEQ ID NO: 7958 - DNA, 509 bp, Artificial Sequence
  chemically treated genomic DNA (Homo sapiens) CpG-island No: 7958
ccacttaaaaccctctaccaaaaacgccctactaaaatacgactccaccaactactcgatatcactactccccccaccgcaaacccccgaaacccgcccgcgcccaacaacgacgaatatcgaaaatctcgcgtacgtcgatactatcgaaaacctactcgtcctcctcgcctaccgtcacaaaccgctccccaaaacgctaataaataaaaaaattaacattctccaaaaaaccgccgccgaccccgccgccgcctaccatcgcgaaaccaccaccgctaatcctaacaaacgtacgcttccgctccaacccgcgcacttccgaaaaacgaaaaaaaaacgtaacgtaacgacgaaatcgcgcgaaaaacacgccgcgttataaattctcgacctaaaatacgaaaaaaacgataaccgcgaccctaactactcgaacccgaaaacataataatcgctaaaacaaaaaacgctaaaaaaaaaccacgacgacgctaaatcgtacgaac

SEQ ID NO: 7959 - DNA, 509 bp, Artificial Sequence
  chemically treated genomic DNA (Homo sapiens) CpG-island No: 7959
ttatttagaattttttgttaggaacgttttgttgggatgcggttttattagttgttcgatattattgttttttttatcgtaagttttcggaattcgttcgcgtttagtagcggcggatatcgaagatttcgcgtgcgtcgatgttgtcgggaatttgttcgtttttttcgtttgtcgttataggtcgttttttagagcgttggtagatgagggggttggtattttttaggaggtcgtcgtcgatttcgtcgtcgtttattatcgcggaattattatcgttgattttagtaggcgtgcgttttcgttttaattcgcgtattttcggagaacgggaagggggcgtggcgtggcgacggagtcgcgcgagggatacgtcgcgttgtgggttttcggtttgaggtgcgagagaagcggtgatcgcggttttggttgttcggattcgggaatatgatggtcgttggagtagaaggcgttgagaagggattacggcggcgttgggtcgtgcgagt

SEQ ID NO: 7960 - DNA, 509 bp, Artificial Sequence
  chemically treated genomic DNA (Homo sapiens) CpG-island No: 7960
actcgcacgacccaacgccgccgtaatcccttctcaacgccttctactccaacgaccatcatattcccgaatccgaacaaccaaaaccgcgatcaccgcttctctcgcacctcaaaccgaaaacccacaacgcgacgtatccctcgcgcgactccgtcgccacgccacgcccccttcccgttctccgaaaatacgcgaattaaaacgaaaacgcacgcctactaaaatcaacgataataattccgcgataataaacgacgacgaaatcgacgacgacctcctaaaaaataccaaccccctcatctaccaacgctctaaaaaacgacctataacgacaaacgaaaaaaacgaacaaattcccgacaacatcgacgcacgcgaaatcttcgatatccgccgctactaaacgcgaacgaattccgaaaacttacgataaaaaaaacaataatatcgaacaactaataaaaccgcatcccaacaaaacgttcctaacaaaaaattctaaataa

SEQ ID NO: 7961 - DNA, 708 bp, Artificial Sequence
  chemically treated genomic DNA (Homo sapiens) CpG-island No: 7961
gtagcgtggatcgggggcgggagcgggggcgggtggaggtttaaataggcggttttggagttagagtttagtgcgggttgagaaggcggtggttgtagtagtagcggcggcggaaattttaaagttcgagttcggattacgagtgcgtggttttttaattcggattttagttttgagcgtgtttgtgtgcgagtgggtgagtgttttggcggagcggggtcggggcggttgtagatggatgcgttaggttcggaggggtttcgggtgagggcgtcgcgatttgggggttgggggagggttgcggcgggatttcggtcggagtatttcgtttgatttcgggttgggtaggtgcgtttcgggtttcgtttttttcgcggtttatacggttattcgggtttttgattttttagacggtttcggacgcgatgattttgaacggcggcggtagcggagcgggcgggagtcgcggtgggggttaggagcgcgagcgtcgtcggggtagtatattttggggtttcgtttcgtcgttgtatcgtcgtagtatgtcggtggacgagcgcgatttgtaggcggcgttgatttcgggtgttttgacggcggtcgcggtcgggacggggatttagggttttaggttggattggttcgaggatttcgaggattcgtttagtttagggggtagcgatttagacgagagcgtttataaggtgt

SEQ ID NO: 7962 - DNA, 708 bp, Artificial Sequence
  chemically treated genomic DNA (Homo sapiens) CpG-island No: 7962
acaccttataaacgctctcgtctaaatcgctaccccctaaactaaacgaatcctcgaaatcctcgaaccaatccaacctaaaaccctaaatccccgtcccgaccgcgaccgccgtcaaaacacccgaaatcaacgccgcctacaaatcgcgctcgtccaccgacatactacgacgatacaacgacgaaacgaaaccccaaaatatactaccccgacgacgctcgcgctcctaacccccaccgcgactcccgcccgctccgctaccgccgccgttcaaaatcatcgcgtccgaaaccgtctaaaaaatcaaaaacccgaataaccgtataaaccgcgaaaaaaacgaaacccgaaacgcacctacccaacccgaaatcaaacgaaatactccgaccgaaatcccgccgcaaccctcccccaacccccaaatcgcgacgccctcacccgaaacccctccgaacctaacgcatccatctacaaccgccccgaccccgctccgccaaaacactcacccactcgcacacaaacacgctcaaaactaaaatccgaattaaaaaaccacgcactcgtaatccgaactcgaactttaaaatttccgccgccgctactactacaaccaccgccttctcaacccgcactaaactctaactccaaaaccgcctatttaaacctccacccgcccccgctcccgcccccgatccacgctac

SEQ ID NO: 7963 - DNA, 708 bp, Artificial Sequence
  chemically treated genomic DNA (Homo sapiens) CpG-island No: 7963
gtattttgtaaacgttttcgtttgagtcgttgttttttgagttgagcgagttttcggagttttcgggttagtttagtttgggattttgggttttcgtttcggtcgcggtcgtcgttagggtattcggggttagcgtcgtttgtaggtcgcgttcgtttatcggtatgttgcggcggtgtagcggcggggcggggttttagggtgtgttgtttcgacggcgttcgcgtttttggtttttatcgcggttttcgttcgtttcgttgtcgtcgtcgtttagggttatcgcgttcgggatcgtttaggggattaggaattcgagtggtcgtgtaagtcgcgagggaggcgggattcggggcgtatttgtttaattcggagttaggcgggatgtttcggtcgaggtttcgtcgtagtttttttttagtttttaggtcgcggcgtttttattcgggattttttcggatttggcgtatttatttgtagtcgtttcgatttcgtttcgttaggatatttatttattcgtatatagatacgtttaggattaggattcggattaggaggttacgtattcgtagttcggattcggattttagggttttcgtcgtcgttgttgttgtagttatcgtttttttagttcgtattgggttttggttttagagtcgtttatttaagtttttattcgttttcgttttcgttttcggtttacgttgt

SEQ ID NO: 7964 - DNA, 708 bp, Artificial Sequence
  chemically treated genomic DNA (Homo sapiens) CpG-island No: 7964
acaacgtaaaccgaaaacgaaaacgaaaacgaataaaaacttaaataaacgactctaaaaccaaaacccaatacgaactaaaaaaacgataactacaacaacaacgacgacgaaaaccctaaaatccgaatccgaactacgaatacgtaacctcctaatccgaatcctaatcctaaacgtatctatatacgaataaataaatatcctaacgaaacgaaatcgaaacgactacaaataaatacgccaaatccgaaaaaatcccgaataaaaacgccgcgacctaaaaactaaaaaaaaactacgacgaaacctcgaccgaaacatcccgcctaactccgaattaaacaaatacgccccgaatcccgcctccctcgcgacttacacgaccactcgaattcctaatcccctaaacgatcccgaacgcgataaccctaaacgacgacgacaacgaaacgaacgaaaaccgcgataaaaaccaaaaacgcgaacgccgtcgaaacaacacaccctaaaaccccgccccgccgctacaccgccgcaacataccgataaacgaacgcgacctacaaacgacgctaaccccgaataccctaacgacgaccgcgaccgaaacgaaaacccaaaatcccaaactaaactaacccgaaaactccgaaaactcgctcaactcaaaaaacaacgactcaaacgaaaacgtttacaaaatac

SEQ ID NO: 7965 - DNA, 1427 bp, Artificial Sequence
  chemically treated genomic DNA (Homo sapiens) CpG-island No: 7965
ggttcgggttcgagttttattcgcggtgtttcgttggtcgatacgcgttatcgcggcgagttttaggaaaagcgttttttcgcgagtatcggttcgcggtatttggtttcgtattttgaatttcgagtaggaagtgagacggcgtttatttagtttcgggagtcgtagtagtcgcgtcgtcgttcggaatcggtttgggtcgtcgcggtttcgcgtaataagtgattcgcgcgcgtttcgggttagtcgatttacgattttcgagcggtcgtcgcggtaggcgttttggaagcgtgtttggcgtttttcgtggggtcggtttttgaagttcgtgtatttaatttgtaaggtaagacggttcgaaattaggagttaaattcgcggcgtcgttcgcgcgttcgtttttttagcgtagcgtcgataagggtaagtagaggttgcgggcgatggtcgtttcggcgagattgttttttcgcgggcgtatcgatcgggattttcggggatcgtgtcgtttaaattttttttcgttcgggtttattcggggcgcgttgcggttttttagtcgttcgttcgtttgttttattttatattcgcggtttagttttttaaaaaatttttcgttttcgaatttgtttttttggtcgggtacgacgcgcggtattttttcgttttgaggtcgcgtcggtcggtcgcgttcggggtttgcgcgggtattcgttggttggtttcgcgttgatcgattgatcgtttattcgcggcgttcggacgttcgtttttttttgttttaggcgttcgttcgcgtgggttttcgtttcggggagtttgaggcgtcgtcgttcgttcgagtttaatttacgtcgtcgtcgtcgtcgtcgtcgttttagtcgttgtttgtcgttcgcgtagttttagcgtttatcgttttcggtcgtcgtcgtcgtcgtcgtcgttatttttttttatcgtttatttcgttttcgtcggttttatttttttttttcgcgcgttcgttcgtttttaatttcggtaaataagacgtattatttataatttcgcggtttacgtcgcgtatgcgttattcgttcgttggcggagcggtttggttgtggcgtttcggggtttttttcgtattagggtttttttttttttgttcgttcgcggttattcggcgtggagttgtcgttgggggattcgtttggtttttagtagacgggagtagttagcgtaggttttttttatcgttttttttcggttatttggaatttttgggttttttaggtgcgcggagtaattttagattgttatttgaacgcgaggaaatttaagtttttggggatttttcgtttttaaatcgatcggtaggggtgtaggttttgtacgttgaagattgaggtggaaacggattaaagaatttaatcgagttatgg

SEQ ID NO: 7966 - DNA, 1427 bp, Artificial Sequence
  chemically treated genomic DNA (Homo sapiens) CpG-island No: 7966
ccataactcgattaaattctttaatccgtttccacctcaatcttcaacgtacaaaacctacacccctaccgatcgatttaaaaacgaaaaatccccaaaaacttaaatttcctcgcgttcaaataacaatctaaaattactccgcgcacctaaaaaacccaaaaattccaaataaccgaaaaaaaacgataaaaaaaacctacgctaactactcccgtctactaaaaaccaaacgaatcccccaacgacaactccacgccgaataaccgcgaacgaacaaaaaaaaaaaaaccctaatacgaaaaaaaccccgaaacgccacaaccaaaccgctccgccaacgaacgaataacgcatacgcgacgtaaaccgcgaaattataaataatacgtcttatttaccgaaattaaaaacgaacgaacgcgcgaaaaaaaaaaataaaaccgacgaaaacgaaataaacgataaaaaaaaataacgacgacgacgacgacgacgaccgaaaacgataaacgctaaaactacgcgaacgacaaacaacgactaaaacgacgacgacgacgacgacgacgtaaattaaactcgaacgaacgacgacgcctcaaactccccgaaacgaaaacccacgcgaacgaacgcctaaaacaaaaaaaaacgaacgtccgaacgccgcgaataaacgatcaatcgatcaacgcgaaaccaaccaacgaatacccgcgcaaaccccgaacgcgaccgaccgacgcgacctcaaaacgaaaaaataccgcgcgtcgtacccgaccaaaaaaacaaattcgaaaacgaaaaattttttaaaaaactaaaccgcgaatataaaataaaacaaacgaacgaacgactaaaaaaccgcaacgcgccccgaataaacccgaacgaaaaaaaatttaaacgacacgatccccgaaaatcccgatcgatacgcccgcgaaaaaacaatctcgccgaaacgaccatcgcccgcaacctctacttacccttatcgacgctacgctaaaaaaacgaacgcgcgaacgacgccgcgaatttaactcctaatttcgaaccgtcttaccttacaaattaaatacacgaacttcaaaaaccgaccccacgaaaaacgccaaacacgcttccaaaacgcctaccgcgacgaccgctcgaaaatcgtaaatcgactaacccgaaacgcgcgcgaatcacttattacgcgaaaccgcgacgacccaaaccgattccgaacgacgacgcgactactacgactcccgaaactaaataaacgccgtctcacttcctactcgaaattcaaaatacgaaaccaaataccgcgaaccgatactcgcgaaaaaacgcttttcctaaaactcgccgcgataacgcgtatcgaccaacgaaacaccgcgaataaaactcgaacccgaacc

SEQ ID NO: 7967 - DNA, 1427 bp, Artificial Sequence
  chemically treated genomic DNA (Homo sapiens) CpG-island No: 7967
ttatgattcggttggattttttggttcgtttttattttagtttttaacgtgtagagtttatatttttgtcggtcggtttagggacgaaaagtttttaaggatttaggttttttcgcgtttaagtgataatttggggttatttcgcgtatttggggaatttagaagttttagatgatcgaggaagggcggtagaaaaggtttgcgttggttattttcgtttgttaaaggttaggcggattttttaacgatagttttacgtcgagtggtcgcgggcgagtagggggaaaagggttttgatgcggaaggagtttcggggcgttatagttaggtcgtttcgttagcgggcgggtggcgtatgcgcggcgtgggtcgcggagttgtgaatggtgcgttttgtttgtcggagttggaggcgggcgggcgcgcgaggaggaggggtggggtcggcgggggcggggtgggcggtgagaggaagtggcggcggcggcggcggcggcggtcgggggcggtgagcgttggggttgcgcgggcggtaggtaacggttgaggcggcggcggcggcggcggcggcgtgggttgggttcgagcgggcggcggcgttttagatttttcggaacgggagtttacgcgggcgggcgtttgaaataaagggaagcgggcgttcgggcgtcgcgggtgggcggttagtcggttagcgcggagttagttagcgggtgttcgcgtaagtttcgagcgcggtcggtcggcgcggttttagggcgggaagatgtcgcgcgtcgtgttcgattagagaagtaagttcgagaacgaggagttttttaggaagttgagtcgcgagtgtgaggtgaggtaggcgggcgggcggttaggaggtcgtagcgcgtttcgagtgggttcgggcggagaaaagtttgggcggtacggttttcgggagtttcggtcggtgcgttcgcggaggggtaatttcgtcggggcggttatcgttcgtagtttttgtttgtttttatcggcgttgcgttgggagggcgggcgcgcgggcggcgtcgcggatttggtttttgatttcgggtcgttttgttttgtagattaagtatacgggttttagggatcggttttacgaggaacgttaggtacgtttttagaacgtttgtcgcgacggtcgttcggaaatcgtaagtcggttggttcggggcgcgcgcgggttatttgttgcgcggggtcgcggcggtttaggtcggtttcggacggcggcgcggttgttgcggttttcggaattgagtgggcgtcgttttattttttattcgggatttaaaatgcgaaattagatgtcgcgggtcggtattcgcggggagacgttttttttggggttcgtcgcggtggcgcgtgtcggttaacggagtatcgcgagtggagttcgaattcgagtt

SEQ ID NO: 7968 - DNA, 1427 bp, Artificial Sequence
  chemically treated genomic DNA (Homo sapiens) CpG-island No: 7968
aactcgaattcgaactccactcgcgatactccgttaaccgacacgcgccaccgcgacgaaccccaaaaaaaacgtctccccgcgaataccgacccgcgacatctaatttcgcattttaaatcccgaataaaaaataaaacgacgcccactcaattccgaaaaccgcaacaaccgcgccgccgtccgaaaccgacctaaaccgccgcgaccccgcgcaacaaataacccgcgcgcgccccgaaccaaccgacttacgatttccgaacgaccgtcgcgacaaacgttctaaaaacgtacctaacgttcctcgtaaaaccgatccctaaaacccgtatacttaatctacaaaacaaaacgacccgaaatcaaaaaccaaatccgcgacgccgcccgcgcgcccgccctcccaacgcaacgccgataaaaacaaacaaaaactacgaacgataaccgccccgacgaaattacccctccgcgaacgcaccgaccgaaactcccgaaaaccgtaccgcccaaacttttctccgcccgaacccactcgaaacgcgctacgacctcctaaccgcccgcccgcctacctcacctcacactcgcgactcaacttcctaaaaaactcctcgttctcgaacttacttctctaatcgaacacgacgcgcgacatcttcccgccctaaaaccgcgccgaccgaccgcgctcgaaacttacgcgaacacccgctaactaactccgcgctaaccgactaaccgcccacccgcgacgcccgaacgcccgcttccctttatttcaaacgcccgcccgcgtaaactcccgttccgaaaaatctaaaacgccgccgcccgctcgaacccaacccacgccgccgccgccgccgccgccgcctcaaccgttacctaccgcccgcgcaaccccaacgctcaccgcccccgaccgccgccgccgccgccgccgccacttcctctcaccgcccaccccgcccccgccgaccccacccctcctcctcgcgcgcccgcccgcctccaactccgacaaacaaaacgcaccattcacaactccgcgacccacgccgcgcatacgccacccgcccgctaacgaaacgacctaactataacgccccgaaactccttccgcatcaaaacccttttccccctactcgcccgcgaccactcgacgtaaaactatcgttaaaaaatccgcctaacctttaacaaacgaaaataaccaacgcaaaccttttctaccgcccttcctcgatcatctaaaacttctaaattccccaaatacgcgaaataaccccaaattatcacttaaacgcgaaaaaacctaaatccttaaaaacttttcgtccctaaaccgaccgacaaaaatataaactctacacgttaaaaactaaaataaaaacgaaccaaaaaatccaaccgaatcataa

SEQ ID NO: 7969 - DNA, 697 bp, Artificial Sequence
  chemically treated genomic DNA (Homo sapiens) CpG-island No: 7969
gtatacgtacgcgtatagacgttgtttggattttgttttgggtttcgtttttttattgcggattttggattgaaacgattttttcgcggtcgtcgtcgttatttggtgttcgtaggtgtttgtaggagttttggggttagttggtttcgatgtacgttagtacgcgggaacggtataagtggttgcgttttagcgaggattgtttgtatttgaacgtgtacgcgtcggcgcgcgcgttcggggatttttagttgttagtgagtgttaggtttttcgcgttcgcggttttatcgtcgtttatcgtttcgtttagatttcggtttttttcgtttaggtgatggtttggttttcgggaggcgtttttatcgtgggcgttgttttttcgtacgagggttttgatttggtcgttcgcgagaaagtggtgttggtgtttttgtagtataggttcggtattttcggttttttgaggtggcggggtcggtattttttgggatcgtagttgtggttagagcggcggggattgggtgggaagggaggggcggggtttggggcggggatggggggggtggggtcgcgaggcgggggcggtgtttggcgttcggtggaaggggcgggcgttttatattatttggatggggcgagttaattttaaagaacggggtgtggtcgtaggattaggttttagaggggttaagtt

SEQ ID NO: 7970 - DNA, 697 bp, Artificial Sequence
  chemically treated genomic DNA (Homo sapiens) CpG-island No: 7970
aacttaacccctctaaaacctaatcctacgaccacaccccgttctttaaaattaactcgccccatccaaataatataaaacgcccgccccttccaccgaacgccaaacaccgcccccgcctcgcgaccccaccccccccatccccgccccaaaccccgcccctcccttcccacccaatccccgccgctctaaccacaactacgatcccaaaaaataccgaccccgccacctcaaaaaaccgaaaataccgaacctatactacaaaaacaccaacaccactttctcgcgaacgaccaaatcaaaaccctcgtacgaaaaaacaacgcccacgataaaaacgcctcccgaaaaccaaaccatcacctaaacgaaaaaaaccgaaatctaaacgaaacgataaacgacgataaaaccgcgaacgcgaaaaacctaacactcactaacaactaaaaatccccgaacgcgcgcgccgacgcgtacacgttcaaatacaaacaatcctcgctaaaacgcaaccacttataccgttcccgcgtactaacgtacatcgaaaccaactaaccccaaaactcctacaaacacctacgaacaccaaataacgacgacgaccgcgaaaaaatcgtttcaatccaaaatccgcaataaaaaaacgaaacccaaaacaaaatccaaacaacgtctatacgcgtacgtatac

SEQ ID NO: 7971 - DNA, 697 bp, Artificial Sequence
  chemically treated genomic DNA (Homo sapiens) CpG-island No: 7971
agtttggtttttttaagatttagttttgcgattatatttcgttttttggagttagttcgttttatttagatggtatggagcgttcgttttttttatcgagcgttaggtatcgttttcgtttcgcggttttattttttttattttcgttttaggtttcgtttttttttttttatttagttttcgtcgttttggttatagttgcggttttaaagggtatcggtttcgttattttaggaagtcgaagatgtcgagtttgtgttgtagaaatattagtattattttttcgcgggcggttaagttagagttttcgtacgaagaagtagcgtttacgatgaaggcgtttttcgggaattagattattatttggacgaagaaggtcgggatttgagcggggcggtgggcggcggtgggatcgcgggcgcgggagatttggtatttattggtagttggggattttcgggcgcgcgcgtcggcgcgtatacgtttaggtatagatagttttcgttgaagcgtagttatttgtatcgttttcgcgtgttgacgtatatcgaggttagttggttttaggatttttgtaggtatttgcgggtattaggtagcggcggcggtcgcggggagatcgttttaatttagggttcgtagtgagaagacggaatttaaagtaaaatttaggtagcgtttgtgcgcgtgcgtgtgt

SEQ ID NO: 7972 - DNA, 697 bp, Artificial Sequence
  chemically treated genomic DNA (Homo sapiens) CpG-island No: 7972
acacacgcacgcgcacaaacgctacctaaattttactttaaattccgtcttctcactacgaaccctaaattaaaacgatctccccgcgaccgccgccgctacctaatacccgcaaatacctacaaaaatcctaaaaccaactaacctcgatatacgtcaacacgcgaaaacgatacaaataactacgcttcaacgaaaactatctatacctaaacgtatacgcgccgacgcgcgcgcccgaaaatccccaactaccaataaataccaaatctcccgcgcccgcgatcccaccgccgcccaccgccccgctcaaatcccgaccttcttcgtccaaataataatctaattcccgaaaaacgccttcatcgtaaacgctacttcttcgtacgaaaactctaacttaaccgcccgcgaaaaaataatactaatatttctacaacacaaactcgacatcttcgacttcctaaaataacgaaaccgataccctttaaaaccgcaactataaccaaaacgacgaaaactaaataaaaaaaaaaaaacgaaacctaaaacgaaaataaaaaaaataaaaccgcgaaacgaaaacgatacctaacgctcgataaaaaaaacgaacgctccataccatctaaataaaacgaactaactccaaaaaacgaaatataatcgcaaaactaaatcttaaaaaaaccaaact

SEQ ID NO: 7973 - DNA, 854 bp, Artificial Sequence
  chemically treated genomic DNA (Homo sapiens) CpG-island No: 7973
atgaaggtcggatgacgagtagttcgatttaaagtttgaggaaagcgggtagcgagtcgtagacgtttagtatgtaggcgtagtcgtcgttcgatttggagatggtggtgtttagtttcgcgtagtagagcgcgtttacgatggagaagacgtcgtacgcgggttatattattagcgttagtttcggcgagtttgtttttttaagtacgttcgtgggcgttacgaagatgttcgagtcgatgatggcgtttacgatgatggttacgtcgttgagtagcgtgatgtttcgttgtagggttacgttttcgttttcgtttgtcggcgtcgcgtcgttcgcgcgtttggaggttagtattttttttcgcgttttttgttttttttcggttatcggggtcgttagcgttcgtcgtttcgggttcgtattcgttatgttttgtttatcggtcgggtttgggatattcgagagtcgtagtcgagcgaggattgtgcgcgtcgttcgtcgttcgtagttgcgttaagaatttcgttcgcgtcgtattttaggtttcggttcgttggtttcgtttatcgttcgcggttttttttcgtatcgtggttcggtcgcggttattagtttcgttttttcgatttagttcggagtacgtgcgtttttcggtttagtatggtaggcgatttttaggttcgcgtggttttcgaaggttttcgtttttatgcgttatggagatttcggtttcgcgatttattttttcggcgttcgcgttattttatttcgttttttcgggtgcgtttgggcggggtttggtagttagggcgagtttttttatttattggttcgtagtttttcgttaagtttg

SEQ ID NO: 7974 - DNA, 854 bp, Artificial Sequence
  chemically treated genomic DNA (Homo sapiens) CpG-island No: 7974
caaacttaacgaaaaactacgaaccaataaataaaaaaactcgccctaactaccaaaccccgcccaaacgcacccgaaaaaacgaaataaaataacgcgaacgccgaaaaaataaatcgcgaaaccgaaatctccataacgcataaaaacgaaaaccttcgaaaaccacgcgaacctaaaaatcgcctaccatactaaaccgaaaaacgcacgtactccgaactaaatcgaaaaaacgaaactaataaccgcgaccgaaccacgatacgaaaaaaaaccgcgaacgataaacgaaaccaacgaaccgaaacctaaaatacgacgcgaacgaaattcttaacgcaactacgaacgacgaacgacgcgcacaatcctcgctcgactacgactctcgaatatcccaaacccgaccgataaacaaaacataacgaatacgaacccgaaacgacgaacgctaacgaccccgataaccgaaaaaaaacaaaaaacgcgaaaaaaaatactaacctccaaacgcgcgaacgacgcgacgccgacaaacgaaaacgaaaacgtaaccctacaacgaaacatcacgctactcaacgacgtaaccatcatcgtaaacgccatcatcgactcgaacatcttcgtaacgcccacgaacgtacttaaaaaaacaaactcgccgaaactaacgctaataatataacccgcgtacgacgtcttctccatcgtaaacgcgctctactacgcgaaactaaacaccaccatctccaaatcgaacgacgactacgcctacatactaaacgtctacgactcgctacccgctttcctcaaactttaaatcgaactactcgtcatccgaccttcat

SEQ ID NO: 7975 - DNA, 854 bp, Artificial Sequence
  chemically treated genomic DNA (Homo sapiens) CpG-island No: 7975
taggtttgacgagaggttgcgggttagtgggtgaaggggttcgttttgattgttaggtttcgtttaggcgtattcgggaggacggggtgggatgacgcgggcgtcgggggggtaggtcgcgaggtcggggtttttatggcgtatgaggacgggggttttcgaggattacgcgggtttgggaatcgtttgttatgttaggtcggaggacgtacgtgtttcgagttgggtcgagggggcggggttgatagtcgcggtcgggttacggtgcggggaggagtcgcggacggtgggcggggttaacgggtcggggtttaaaatgcggcgcgggcggggtttttgacgtagttgcgggcggcgagcggcgcgtataattttcgttcggttgcggttttcgggtgttttaggttcggtcggtaagtagagtatggcgggtgcgggttcgaagcggcgggcgttagcggtttcggtggtcgaggagaagtaagaggcgcgggagaagatgttggtttttaagcgcgcggacggcgcggcgtcggtaggcgagggcgagggcgtgattttgtagcggaatattacgttatttaacggcgtggttattatcgtgggcgttattatcggttcgggtattttcgtgacgtttacgggcgtgtttaaggaggtaggttcgtcggggttggcgttggtgatgtggttcgcgtgcggcgttttttttatcgtgggcgcgttttgttacgcggagttgggtattattatttttaaatcgggcggcgattacgtttatatgttggacgtttacggttcgttgttcgttttttttaagttttggatcgagttgttcgttattcggtttttat

SEQ ID NO: 7976 - DNA, 854 bp, Artificial Sequence
  chemically treated genomic DNA (Homo sapiens) CpG-island No: 7976
ataaaaaccgaataacgaacaactcgatccaaaacttaaaaaaaacgaacaacgaaccgtaaacgtccaacatataaacgtaatcgccgcccgatttaaaaataataatacccaactccgcgtaacaaaacgcgcccacgataaaaaaaacgccgcacgcgaaccacatcaccaacgccaaccccgacgaacctacctccttaaacacgcccgtaaacgtcacgaaaatacccgaaccgataataacgcccacgataataaccacgccgttaaataacgtaatattccgctacaaaatcacgccctcgccctcgcctaccgacgccgcgccgtccgcgcgcttaaaaaccaacatcttctcccgcgcctcttacttctcctcgaccaccgaaaccgctaacgcccgccgcttcgaacccgcacccgccatactctacttaccgaccgaacctaaaacacccgaaaaccgcaaccgaacgaaaattatacgcgccgctcgccgcccgcaactacgtcaaaaaccccgcccgcgccgcattttaaaccccgacccgttaaccccgcccaccgtccgcgactcctccccgcaccgtaacccgaccgcgactatcaaccccgccccctcgacccaactcgaaacacgtacgtcctccgacctaacataacaaacgattcccaaacccgcgtaatcctcgaaaacccccgtcctcatacgccataaaaaccccgacctcgcgacctacccccccgacgcccgcgtcatcccaccccgtcctcccgaatacgcctaaacgaaacctaacaatcaaaacgaaccccttcacccactaacccgcaacctctcgtcaaaccta

SEQ ID NO: 7977 - DNA, 648 bp, Artificial Sequence
  chemically treated genomic DNA (Homo sapiens) CpG-island No: 7977
  misc_feature (597)..(597): n is either a, c, g or t
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtatatnttttttgaagagattattagttaagttgtgtgtgttgcgtttttttgatag

SEQ ID NO: 7978 - DNA, 648 bp, Artificial Sequence
  chemically treated genomic DNA (Homo sapiens) CpG-island No: 7978
  misc_feature (52)..(52): n is either a, c, g or t
ctatcaaaaaaacgcaacacacacaacttaactaataatctcttcaaaaaanatatacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 7979 - DNA, 648 bp, Artificial Sequence
  chemically treated genomic DNA (Homo sapiens) CpG-island No: 7979
  misc_feature (52)..(52): n is either a, c, g or t
ttgttagaaagacgtagtatatatagtttgattggtggtttttttagagaanatatgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 7980 - DNA, 648 bp, Artificial Sequence
  chemically treated genomic DNA (Homo sapiens) CpG-island No: 7980
  misc_feature (597)..(597): n is either a, c, g or t
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacatatnttctctaaaaaaaccaccaatcaaactatatatactacgtctttctaacaa

SEQ ID NO: 7981 - DNA, 596 bp, Artificial Sequence
  chemically treated genomic DNA (Homo sapiens) CpG-island No: 7981
aagcgtcgtattttttcgtattttttttcgggattttttttttttgttttgtttcgtttcggtatcggtaacgttcgtttgtgattggatgtcggtcggtcgtgaggcggtggaaggggttgcggtggttatggtgataggaggcggggcgtcgcgttttttcggtagttatcgaggttcggatttgcggcgtcggcggcgcgcgtagagggttaggcgggcgtagaggtcggatcgacgcgtggcggtagagggtatttaaggtcggatttggcgcgtaggcgttgattcgatttggtagtgagttggtcgcggttttggttgagaggttttaatttcgtcgggcggtcgcgttttgtatgcgagttgggtcgcgggcggggttggagtttattcggggcgattgcgatggacgttttagaaggagagagttttgcgttgtttttgtgagtagtttttttagggcgtaggcgatttggggtcggaggtagcgggcgttcgtttcggggtttgattttataaaataggtgtttttaggggtcgggtcgggtcgggtcgggtagggtgggggtcgttaaggcgtcgttttagtttta

SEQ ID NO: 7982 - DNA, 596 bp, Artificial Sequence
  chemically treated genomic DNA (Homo sapiens) CpG-island No: 7982
taaaactaaaacgacgccttaacgacccccaccctacccgacccgacccgacccgacccctaaaaacacctattttataaaatcaaaccccgaaacgaacgcccgctacctccgaccccaaatcgcctacgccctaaaaaaactactcacaaaaacaacgcaaaactctctccttctaaaacgtccatcgcaatcgccccgaataaactccaaccccgcccgcgacccaactcgcatacaaaacgcgaccgcccgacgaaattaaaacctctcaaccaaaaccgcgaccaactcactaccaaatcgaatcaacgcctacgcgccaaatccgaccttaaataccctctaccgccacgcgtcgatccgacctctacgcccgcctaaccctctacgcgcgccgccgacgccgcaaatccgaacctcgataactaccgaaaaaacgcgacgccccgcctcctatcaccataaccaccgcaaccccttccaccgcctcacgaccgaccgacatccaatcacaaacgaacgttaccgataccgaaacgaaacaaaacaaaaaaaaaaaatcccgaaaaaaaatacgaaaaaatacgacgctt

SEQ ID NO: 7983 - DNA, 596 bp, Artificial Sequence
  chemically treated genomic DNA (Homo sapiens) CpG-island No: 7983
tggagttgggacggcgttttggcggtttttattttgttcggttcggttcggttcggtttttaaggatatttgttttatagggttaggtttcggggcgaacgttcgttgttttcggttttaagtcgtttgcgttttggaggagttatttataaagatagcgtaaagttttttttttttaaggcgtttatcgtagtcgtttcgagtaggttttaatttcgttcgcggtttaattcgtatgtagggcgcggtcgttcggcggggttaaggttttttagttaaggtcgcggttagtttattgttaggtcgggttagcgtttgcgcgttaggttcggttttggatattttttgtcgttacgcgtcggttcggtttttacgttcgtttggttttttgcgcgcgtcgtcgacgtcgtaggttcgggtttcggtgattgtcggaggggcgcggcgtttcgttttttgttattatggttatcgtaattttttttatcgttttacggtcggtcggtatttaattataggcgagcgttatcgatgtcggggcggggtaagatagggagaggaagtttcggaagggagtgcggagggatgcggcgttt

SEQ ID NO: 7984 - DNA, 596 bp, Artificial Sequence
  chemically treated genomic DNA (Homo sapiens) CpG-island No: 7984
aaacgccgcatccctccgcactcccttccgaaacttcctctccctatcttaccccgccccgacatcgataacgctcgcctataattaaataccgaccgaccgtaaaacgataaaaaaaattacgataaccataataacaaaaaacgaaacgccgcgcccctccgacaatcaccgaaacccgaacctacgacgtcgacgacgcgcgcaaaaaaccaaacgaacgtaaaaaccgaaccgacgcgtaacgacaaaaaatatccaaaaccgaacctaacgcgcaaacgctaacccgacctaacaataaactaaccgcgaccttaactaaaaaaccttaaccccgccgaacgaccgcgccctacatacgaattaaaccgcgaacgaaattaaaacctactcgaaacgactacgataaacgccttaaaaaaaaaaaactttacgctatctttataaataactcctccaaaacgcaaacgacttaaaaccgaaaacaacgaacgttcgccccgaaacctaaccctataaaacaaatatccttaaaaaccgaaccgaaccgaaccgaacaaaataaaaaccgccaaaacgccgtcccaactcca

SEQ ID NO: 7985 - DNA, 657 bp, Artificial Sequence
  chemically treated genomic DNA (Homo sapiens) CpG-island No: 7985
gttagtcgacgttagttcgataagtagttttcgttagttaagttagatcgttagttagtttacgttagttcgtcgttcgtttagttaagttagttatacgattaatttattttagtaagttcgtttcgttagttaattcgagtagtcgattacgttagtttatttttttttttcgtagtttaatttaacggttaatttatttacgttagtaaggttattcgtttagttaaatttatttaacgattatattacgtcgatttttcgtttttttatttagatttacgtagacggtaacgttaggttagtaagtacgtttgttttatgtaagcgtacgtagtcgattaacgttagtttcgattttcgttttcgtcgtagttaaggttaggcggtcgacgcgagtcgtcgagaggcgcgatttcggagttaagtttagttagtttattaatgttaagttcgacggggggtacgtcgtattataggtaggattcgtagttagggttacggtagggtatagtttcgtcgatttgaggaaggtcgcgggggaatgtttatttaggggcgggtgtgcgtaatttattcgaagtaggagttaggggaaggaaggtgtcgagatatcgcggtaaggtaagaacggaggattgagtaggagtgagagga

SEQ ID NO: 7986 - DNA, 657 bp, Artificial Sequence
  chemically treated genomic DNA (Homo sapiens) CpG-island No: 7986
tcctctcactcctactcaatcctccgttcttaccttaccgcgatatctcgacaccttccttcccctaactcctacttcgaataaattacgcacacccgcccctaaataaacattcccccgcgaccttcctcaaatcgacgaaactataccctaccgtaaccctaactacgaatcctacctataatacgacgtaccccccgtcgaacttaacattaataaactaactaaacttaactccgaaatcgcgcctctcgacgactcgcgtcgaccgcctaaccttaactacgacgaaaacgaaaatcgaaactaacgttaatcgactacgtacgcttacataaaacaaacgtacttactaacctaacgttaccgtctacgtaaatctaaataaaaaaacgaaaaatcgacgtaatataatcgttaaataaatttaactaaacgaataaccttactaacgtaaataaattaaccgttaaattaaactacgaaaaaaaaaaataaactaacgtaatcgactactcgaattaactaacgaaacgaacttactaaaataaattaatcgtataactaacttaactaaacgaacgacgaactaacgtaaactaactaacgatctaacttaactaacgaaaactacttatcgaactaacgtcgactaac

SEQ ID NO: 7987 - DNA, 657 bp, Artificial Sequence
  chemically treated genomic DNA (Homo sapiens) CpG-island No: 7987
tttttttatttttgtttaatttttcgtttttgttttatcgcgatatttcggtatttttttttttttggtttttgtttcgggtaaattgcgtatattcgtttttgagtagatattttttcgcgattttttttaaatcggcggaattgtgttttgtcgtgattttggttgcggattttgtttataatgcggcgtatttttcgtcgagtttgatattggtggattggttgggtttaatttcgggatcgcgtttttcgacgattcgcgtcgatcgtttggttttaattgcggcgaaagcgggggtcgaagttgacgttggtcgattgcgtgcgtttatatggggtagacgtgtttgttgatttgacgttgtcgtttgcgtgggtttaaatgggggaacggaagatcgacgtgatgtggtcgttgggtgggtttaattgggcgaatggttttgttgacgtgagtgggttggtcgttgggttaaattgcgggaagggggggtgagttgacgtggtcgattgttcgggttaattggcggaacgagtttgttgaggtgagttggtcgtgtggttggtttaattgggcgaacggcgggttgacgtgagttggttggcggtttggtttaattggcggaagttgtttgtcgagttgacgtcggttgat

SEQ ID NO: 7988 - DNA, 657 bp, Artificial Sequence
  chemically treated genomic DNA (Homo sapiens) CpG-island No: 7988
atcaaccgacgtcaactcgacaaacaacttccgccaattaaaccaaaccgccaaccaactcacgtcaacccgccgttcgcccaattaaaccaaccacacgaccaactcacctcaacaaactcgttccgccaattaacccgaacaatcgaccacgtcaactcacccccccttcccgcaatttaacccaacgaccaacccactcacgtcaacaaaaccattcgcccaattaaacccacccaacgaccacatcacgtcgatcttccgttcccccatttaaacccacgcaaacgacaacgtcaaatcaacaaacacgtctaccccatataaacgcacgcaatcgaccaacgtcaacttcgacccccgctttcgccgcaattaaaaccaaacgatcgacgcgaatcgtcgaaaaacgcgatcccgaaattaaacccaaccaatccaccaatatcaaactcgacgaaaaatacgccgcattataaacaaaatccgcaaccaaaatcacgacaaaacacaattccgccgatttaaaaaaaatcgcgaaaaaatatctactcaaaaacgaatatacgcaatttacccgaaacaaaaaccaaaaaaaaaaaaataccgaaatatcgcgataaaacaaaaacgaaaaattaaacaaaaataaaaaaa

SEQ ID NO: 7989 - DNA, 677 bp, Artificial Sequence
  chemically treated genomic DNA (Homo sapiens) CpG-island No: 7989
gtttatcgcgttaaagttggttgaaatttatagcgaagcgggtttgtcggacggcgtatttaacgtgttgtcgggcgtgggcgcggagatcgggtaatatttgatcgagtattcgggtattgttaaagtgttatttatcggcggtgtcgttagcggtaaaaaagtgatggttaattcggcggttttttttttgaaagaagtgattatggaattgggcggtaaattatcgttgatcgttttcgatgatgcggatttcgatttcgtcgtcgatatcgttatgatggtaaatttttttagtttcggttaggtgtgtattaatggtattcgcgttttcgtttcggcgaaatgtaaagtcgtatttgagtagaaaattttggcgcgcgttgagcgtattcgcgcgggcgacgttttcgattcgtaaattaatttcggttcgttggttagtttttcgtatcgcgataacgtgttgcgttatatcgttaaaggtaaagaggaaggcgcgcgcgtattgtgcggcggcgatgtattgaaaggcgatggtttcgataacggcgtatgggttgtatcgatagtgtttatcgattgtagcgacgatatgattatcgtgcgtgaagagattttcgggtagtgatgtttttttgagttaagatcggaagagaagtattcgcgcgttaaga

SEQ ID NO: 7990 - DNA, 677 bp, Artificial Sequence
  chemically treated genomic DNA (Homo sapiens) CpG-island No: 7990
tcttaacgcgcgaatacttctcttccgatcttaactcaaaaaaacatcactacccgaaaatctcttcacgcacgataatcatatcgtcgctacaatcgataaacactatcgatacaacccatacgccgttatcgaaaccatcgcctttcaatacatcgccgccgcacaatacgcgcgcgccttcctctttacctttaacgatataacgcaacacgttatcgcgatacgaaaaactaaccaacgaaccgaaattaatttacgaatcgaaaacgtcgcccgcgcgaatacgctcaacgcgcgccaaaattttctactcaaatacgactttacatttcgccgaaacgaaaacgcgaataccattaatacacacctaaccgaaactaaaaaaatttaccatcataacgatatcgacgacgaaatcgaaatccgcatcatcgaaaacgatcaacgataatttaccgcccaattccataatcacttctttcaaaaaaaaaaccgccgaattaaccatcacttttttaccgctaacgacaccgccgataaataacactttaacaatacccgaatactcgatcaaatattacccgatctccgcgcccacgcccgacaacacgttaaatacgccgtccgacaaacccgcttcgctataaatttcaaccaactttaacgcgataaac

SEQ ID NO: 7991 - DNA, 677 bp, Artificial Sequence
  chemically treated genomic DNA (Homo sapiens) CpG-island No: 7991
ttttagcgcgcgaatatttttttttcgattttagtttagaaggatattattgttcgaagatttttttacgtacgatggttatatcgtcgttgtaatcggtgaatattgtcggtgtaatttatgcgtcgttatcgaagttatcgttttttagtatatcgtcgtcgtatagtacgcgcgcgtttttttttttgtttttggcgatatagcgtagtacgttatcgcgatgcgggaagttgattagcgggtcgaagttagtttgcggatcgaaaacgtcgttcgcgcgaatgcgtttaacgcgcgttagaattttttgtttaaatgcggttttgtatttcgtcggaacgaagacgcgggtgttattggtatatatttgatcggagttgaagaagtttgttattatggcgatatcggcggcgagatcgagattcgtattatcgaaaacgattagcggtgatttatcgtttagttttatggttattttttttagggaagaggtcgtcgagttagttattatttttttgtcgttggcgatatcgtcggtaaatgatattttggtaatgttcggatgttcggttagatattgttcggttttcgcgtttacgttcggtaatacgttaaatacgtcgttcggtaggttcgtttcgttgtaaattttagttagttttaacgcggtaagt

SEQ ID NO: 7992 - DNA, 677 bp, Artificial Sequence
  chemically treated genomic DNA (Homo sapiens) CpG-island No: 7992
acttaccgcgttaaaactaactaaaatttacaacgaaacgaacctaccgaacgacgtatttaacgtattaccgaacgtaaacgcgaaaaccgaacaatatctaaccgaacatccgaacattaccaaaatatcatttaccgacgatatcgccaacgacaaaaaaataataactaactcgacgacctcttccctaaaaaaaataaccataaaactaaacgataaatcaccgctaatcgttttcgataatacgaatctcgatctcgccgccgatatcgccataataacaaacttcttcaactccgatcaaatatataccaataacacccgcgtcttcgttccgacgaaatacaaaaccgcatttaaacaaaaaattctaacgcgcgttaaacgcattcgcgcgaacgacgttttcgatccgcaaactaacttcgacccgctaatcaacttcccgcatcgcgataacgtactacgctatatcgccaaaaacaaaaaaaaaaacgcgcgcgtactatacgacgacgatatactaaaaaacgataacttcgataacgacgcataaattacaccgacaatattcaccgattacaacgacgatataaccatcgtacgtaaaaaaatcttcgaacaataatatccttctaaactaaaatcgaaaaaaaaatattcgcgcgctaaaa

SEQ ID NO: 7993 - DNA, 865 bp, Artificial Sequence
  chemically treated genomic DNA (Homo sapiens) CpG-island No: 7993
tttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtagaagaagttcggtagtaggttattttcggcgggacggaatcgttcgttttttttgatattttgtcgggttatatcgaatatggtcgggataacggtattcgtttgtttgtcgtgtggttgacgtacgattcggaatattcggagaatttatttgtcgcgtcgttggtgcgttatggttggacgttacgcgtcgaattggcggtggtgtatgattgtagtggttaataggtgagtatattttatttacgatgataaatatcggggtcggatggtggcgtatcgttataaggatcggtcggaaattcgttatcgttacgataattgtcggtcggttgatacgaatagttaaattcggtaggcgtaagtaatacgtattacgatgaagaaaggtagtattattattatcgatagtcgtaggtttttcgtgaaatgtagtatataatagagttagaagttagggttgaagcggat

SEQ ID NO: 7994 - DNA, 865 bp, Artificial Sequence
  chemically treated genomic DNA (Homo sapiens) CpG-island No: 7994
atccgcttcaaccctaacttctaactctattatatactacatttcacgaaaaacctacgactatcgataataataatactacctttcttcatcgtaatacgtattacttacgcctaccgaatttaactattcgtatcaaccgaccgacaattatcgtaacgataacgaatttccgaccgatccttataacgatacgccaccatccgaccccgatatttatcatcgtaaataaaatatactcacctattaaccactacaatcatacaccaccgccaattcgacgcgtaacgtccaaccataacgcaccaacgacgcgacaaataaattctccgaatattccgaatcgtacgtcaaccacacgacaaacaaacgaataccgttatcccgaccatattcgatataacccgacaaaatatcaaaaaaaacgaacgattccgtcccgccgaaaataacctactaccgaacttcttctacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaa

SEQ ID NO: 7995 - DNA, 865 bp, Artificial Sequence
  chemically treated genomic DNA (Homo sapiens) CpG-island No: 7995
attcgttttagttttggtttttggttttgttgtgtgttgtattttacgggggatttacggttgtcggtgatggtgatgttgtttttttttatcgtgatacgtgttgtttacgtttgtcgggtttagttgttcgtgttagtcgatcgatagttgtcgtaacggtaacggattttcggtcggtttttgtgacggtgcgttattattcggtttcggtatttattatcgtaagtaaagtgtgtttatttgttggttattatagttatatattatcgttagttcgacgcgtggcgtttagttatagcgtattagcggcgcggtaggtaaatttttcgggtatttcgggtcgtgcgttagttatacggtagatagacggatgtcgttgtttcggttatattcggtgtaattcggtagggtattaggaaaagcggacggtttcgtttcgtcggaaatggtttgttgtcgggttttttttgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaatagg

SEQ ID NO: 7996 - DNA, 865 bp, Artificial Sequence
  chemically treated genomic DNA (Homo sapiens) CpG-island No: 7996
cctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacaaaaaaaacccgacaacaaaccatttccgacgaaacgaaaccgtccgcttttcctaataccctaccgaattacaccgaatataaccgaaacaacgacatccgtctatctaccgtataactaacgcacgacccgaaatacccgaaaaatttacctaccgcgccgctaatacgctataactaaacgccacgcgtcgaactaacgataatatataactataataaccaacaaataaacacactttacttacgataataaataccgaaaccgaataataacgcaccgtcacaaaaaccgaccgaaaatccgttaccgttacgacaactatcgatcgactaacacgaacaactaaacccgacaaacgtaaacaacacgtatcacgataaaaaaaaacaacatcaccatcaccgacaaccgtaaatcccccgtaaaatacaacacacaacaaaaccaaaaaccaaaactaaaacgaat

SEQ ID NO: 7997 - DNA, 868 bp, Artificial Sequence
  chemically treated genomic DNA (Homo sapiens) CpG-island No: 7997
ttttcgcgggtgtcgtttattatttcggtggattttagtttttaggtttcgttttacggggattggggggaggggggaggcgtcgcgcgtattaggcgttgatagtatatcgatttttttttcggtgcgtataggttaatatttatatatatttttatatattcgtatatattttcgtggaaattgaggtaggtaggcggcggattaggtttcgtcgtttgacggttagcggttgggatggaattcggattgttagacgtttttcgttttataggtattttttagtcgttgaggttcggttcggtttttatcgtcggagttttataaagaaagtttttcggttcgagttttttacgtatttatcggcgtcgacgttcgcggcgattggggtttttattttttttagttttttgcgggggtcggttttggggtcggtttgggcgtcggtagcggcgattgttttatatttatcgggttcgggtcgcgttcgtttcgagttaacggtttcgttagttaggcgcgcgcgttagtttcgggcgttatgttttcgtcgtgttgttcgtcgtcgaggcgatttttattgttttttagtcgcgcgcgttttcgcgggtttatatacgaatcgcgtacgcgcgcgttcgtcgcgttttttttttttttcgcgcgtttttgtttcgtttttttggagttggtcgttgtttttagtgtttcgtttattttcgtcgggttcgttcgatttcgcgggtgagcgcgtggttttcggttgggtatcgtcgtttgtttttttgtagattatttcggattcgattttttcgttatttttttatattgtttttttcgttttttttattacgtggggtttaggaag

SEQ ID NO: 7998 - DNA, 868 bp, Artificial Sequence
  chemically treated genomic DNA (Homo sapiens) CpG-island No: 7998
cttcctaaaccccacgtaataaaaaaaacgaaaaaaacaatataaaaaaataacgaaaaaatcgaatccgaaataatctacaaaaaaacaaacgacgatacccaaccgaaaaccacgcgctcacccgcgaaatcgaacgaacccgacgaaaataaacgaaacactaaaaacaacgaccaactccaaaaaaacgaaacaaaaacgcgcgaaaaaaaaaaaaaacgcgacgaacgcgcgcgtacgcgattcgtatataaacccgcgaaaacgcgcgcgactaaaaaacaataaaaatcgcctcgacgacgaacaacacgacgaaaacataacgcccgaaactaacgcgcgcgcctaactaacgaaaccgttaactcgaaacgaacgcgacccgaacccgataaatataaaacaatcgccgctaccgacgcccaaaccgaccccaaaaccgacccccgcaaaaaactaaaaaaaataaaaaccccaatcgccgcgaacgtcgacgccgataaatacgtaaaaaactcgaaccgaaaaactttctttataaaactccgacgataaaaaccgaaccgaacctcaacgactaaaaaatacctataaaacgaaaaacgtctaacaatccgaattccatcccaaccgctaaccgtcaaacgacgaaacctaatccgccgcctacctacctcaatttccacgaaaatatatacgaatatataaaaatatatataaatattaacctatacgcaccgaaaaaaaaatcgatatactatcaacgcctaatacgcgcgacgcctcccccctccccccaatccccgtaaaacgaaacctaaaaactaaaatccaccgaaataataaacgacacccgcgaaaa

SEQ ID NO: 7999 - DNA, 868 bp, Artificial Sequence
  chemically treated genomic DNA (Homo sapiens) CpG-island No: 7999
ttttttaggttttacgtggtgggggaagcgaaaggggtagtgtggggaagtggcggaggggtcgggttcggggtggtttgtagagaggtaggcggcggtgtttagtcgggaattacgcgtttattcgcggagtcggacgggttcggcgggggtgggcgagatattgggaatagcggttagttttagaggggcgaggtaggggcgcgcggggagggaggggggcgcggcgaacgcgcgcgtgcgcggttcgtgtgtgggttcgcgggggcgcgcgcggttggggggtagtgagggtcgtttcggcggcgagtagtacggcgggaatatggcgttcggaattggcgcgcgcgtttagttggcgggatcgttagttcgaggcggacgcggttcggattcggtggatgtggagtagtcgtcgttgtcggcgtttaagtcgattttagggtcgattttcgtaaggagttgaaggaggtgggagttttagtcgtcgcgggcgtcggcgtcggtgagtgcgtgaggggttcgggtcgggagattttttttgtgaaatttcggcggtgggagtcgggtcgggttttagcggttgaggagtgtttgtgaggcggaaggcgtttggtagttcgggttttattttagtcgttagtcgttaggcggcgggatttggttcgtcgtttgtttgttttagtttttacgggagtgtgtgcgggtgtgtgagggtgtgtatgggtgttggtttgtgcgtatcggagggggggtcggtatattgttagcgtttaatgcgcgcggcgttttttttttttttttagttttcgtggggcggaatttggggattggagtttatcggagtagtaggcggtattcgcgggga

SEQ ID NO: 8000 - DNA, 868 bp, Artificial Sequence
  chemically treated genomic DNA (Homo sapiens) CpG-island No: 8000
tccccgcgaataccgcctactactccgataaactccaatccccaaattccgccccacgaaaactaaaaaaaaaaaaaaaacgccgcgcgcattaaacgctaacaatataccgaccccccctccgatacgcacaaaccaacacccatacacaccctcacacacccgcacacactcccgtaaaaactaaaacaaacaaacgacgaaccaaatcccgccgcctaacgactaacgactaaaataaaacccgaactaccaaacgccttccgcctcacaaacactcctcaaccgctaaaacccgacccgactcccaccgccgaaatttcacaaaaaaaatctcccgacccgaacccctcacgcactcaccgacgccgacgcccgcgacgactaaaactcccacctccttcaactccttacgaaaatcgaccctaaaatcgacttaaacgccgacaacgacgactactccacatccaccgaatccgaaccgcgtccgcctcgaactaacgatcccgccaactaaacgcgcgcgccaattccgaacgccatattcccgccgtactactcgccgccgaaacgaccctcactaccccccaaccgcgcgcgcccccgcgaacccacacacgaaccgcgcacgcgcgcgttcgccgcgcccccctccctccccgcgcgcccctacctcgcccctctaaaactaaccgctattcccaatatctcgcccacccccgccgaacccgtccgactccgcgaataaacgcgtaattcccgactaaacaccgccgcctacctctctacaaaccaccccgaacccgacccctccgccacttccccacactacccctttcgcttcccccaccacgtaaaacctaaaaaa

SEQ ID NO: 8001 - DNA, 722 bp, Artificial Sequence
  chemically treated genomic DNA (Homo sapiens) CpG-island No: 8001
ggtataggttagcgtacggtgttttcgattagtttcggtttggtttcgttttttaatttcgatgtagtgaaaacggtcggacgtgtttttgtttatgaagcggtagatgatggtttgaatatgatttgggtatcgatggtcgatgtttcgcgcgattcgcgttggggacgtgttttcgaaggttttggcgaagatacgtattttattttaataatgggtaaaattatggtggaagcgatgtagggtaaaagttcggtagatcgttattcggtgatgattagcgttaaatattttgtcgtatacggcgcggtagaaggcggtaaagagtataatatcgtcgatatgagttcgtagcgtttgtttaatgattatatgtcgtcgtataaagcggggttggacgtaggtagcggcgcggtgatggtggcgttgaattcgttgaacggtacgttagttattttcgatttttggttgttgaaagatgttttgcgcgattagtggggttttaaaggtattatcgttttcgattacggtgtaattaaagagttgattaaatatggtacggcggtagattcggaagatgcggtgcgcgtggcgttgaaattcggaattaatatgagtatgagcgacgagtattattcgaagtatttgtttgggtggattaaattcggtaaagtgacgatggtagagttggacgatgttgttcggtatgtattgaacgttaa

SEQ ID NO: 8002 - DNA, 722 bp, Artificial Sequence
  chemically treated genomic DNA (Homo sapiens) CpG-island No: 8002
ttaacgttcaatacataccgaacaacatcgtccaactctaccatcgtcactttaccgaatttaatccacccaaacaaatacttcgaataatactcgtcgctcatactcatattaattccgaatttcaacgccacgcgcaccgcatcttccgaatctaccgccgtaccatatttaatcaactctttaattacaccgtaatcgaaaacgataatacctttaaaaccccactaatcgcgcaaaacatctttcaacaaccaaaaatcgaaaataactaacgtaccgttcaacgaattcaacgccaccatcaccgcgccgctacctacgtccaaccccgctttatacgacgacatataatcattaaacaaacgctacgaactcatatcgacgatattatactctttaccgccttctaccgcgccgtatacgacaaaatatttaacgctaatcatcaccgaataacgatctaccgaacttttaccctacatcgcttccaccataattttacccattattaaaataaaatacgtatcttcgccaaaaccttcgaaaacacgtccccaacgcgaatcgcgcgaaacatcgaccatcgatacccaaatcatattcaaaccatcatctaccgcttcataaacaaaaacacgtccgaccgttttcactacatcgaaattaaaaaacgaaaccaaaccgaaactaatcgaaaacaccgtacgctaacctatacc

SEQ ID NO: 8003 - DNA, 722 bp, Artificial Sequence
  chemically treated genomic DNA (Homo sapiens) CpG-island No: 8003
ttaacgtttagtatatgtcgggtagtatcgtttagttttgttatcgttattttgtcggatttaatttatttaggtagatatttcgagtagtattcgtcgtttatgtttatgttgatttcggattttagcgttacgcgtatcgtatttttcgggtttgtcgtcgtgttatgtttaattagttttttgattgtatcgtgatcggaaacggtgatgtttttaaagttttattggtcgcgtagaatattttttagtagttaggaatcggaggtggttggcgtgtcgtttagcgagtttagcgttattattatcgcgtcgttgtttgcgtttagtttcgttttgtacggcggtatataattattaaataggcgttgcggatttatatcgacggtgttgtattttttatcgttttttatcgcgtcgtatgcggtaaagtgtttgacgttggttattatcgagtagcgatttgtcgggtttttattttgtatcgtttttattatggttttatttattgttgaggtgagatacgtattttcgttaaaattttcggaagtacgtttttagcgcggatcgcgcgagatatcgattatcggtgtttaggttatatttaggttattatttgtcgttttataagtagagatacgttcgatcgtttttattgtatcgaggttaaaagacgaggttagatcgaggttaatcgggaatatcgtgcgttgatttgtgtt

SEQ ID NO: 8004 - DNA, 722 bp, Artificial Sequence
  chemically treated genomic DNA (Homo sapiens) CpG-island No: 8004
aacacaaatcaacgcacgatattcccgattaacctcgatctaacctcgtcttttaacctcgatacaataaaaacgatcgaacgtatctctacttataaaacgacaaataataacctaaatataacctaaacaccgataatcgatatctcgcgcgatccgcgctaaaaacgtacttccgaaaattttaacgaaaatacgtatctcacctcaacaataaataaaaccataataaaaacgatacaaaataaaaacccgacaaatcgctactcgataataaccaacgtcaaacactttaccgcatacgacgcgataaaaaacgataaaaaatacaacaccgtcgatataaatccgcaacgcctatttaataattatataccgccgtacaaaacgaaactaaacgcaaacaacgacgcgataataataacgctaaactcgctaaacgacacgccaaccacctccgattcctaactactaaaaaatattctacgcgaccaataaaactttaaaaacatcaccgtttccgatcacgatacaatcaaaaaactaattaaacataacacgacgacaaacccgaaaaatacgatacgcgtaacgctaaaatccgaaatcaacataaacataaacgacgaatactactcgaaatatctacctaaataaattaaatccgacaaaataacgataacaaaactaaacgatactacccgacatatactaaacgttaa

SEQ ID NO: 8005 - DNA, 763 bp, Artificial Sequence
  chemically treated genomic DNA (Homo sapiens) CpG-island No: 8005
gaacggttgcggcgtttatattttagtcgcgttgcggtattaatgttagacgcgtatcgttggtattatcgcgtttgtcgttattacggaaggtagaagtagatgtttaggttatcgatattagtttattaatagatagattagaattcgtaatcgcgaattttagatcgataatgttttgttcggtcgggttgtagatcggttgcggtagcggattttgttagattagattttttttcggtattttcggttcgatgtagcgagatttcggttttatatttttgtgcgttagtttgaattaggtacgggtaaaggtttcgttgaacgtttgcggatcgttgaggaaacgacgagagattttttcgaatttaggattaaaacgtagcgttaggtcggttattagtattgtcggtttacgttttttcgacggattaaacggattcgggataattttcggtgcgtttatcgtttcgaattggattgcgttagtcgggttgcgggtttgtatttatttatatttgaataggttttcgaagaaatagttgttttattgggttcgcgtttgggtttcgattattttagaatcgagttatggatttggttaacgtcgttgcgtaattgtcggttaatttaatttgttttttattcgtgtatttcggatcgggttttttgatgtgatcgacgcggtttttacggtttgtttcgcgatagtttcggtttcgtttttatttttaggtggtattgttcgtcgacgggtgcgcga

SEQ ID NO: 8006 - DNA, 763 bp, Artificial Sequence
  chemically treated genomic DNA (Homo sapiens) CpG-island No: 8006
tcgcgcacccgtcgacgaacaataccacctaaaaataaaaacgaaaccgaaactatcgcgaaacaaaccgtaaaaaccgcgtcgatcacatcaaaaaacccgatccgaaatacacgaataaaaaacaaattaaattaaccgacaattacgcaacgacgttaaccaaatccataactcgattctaaaataatcgaaacccaaacgcgaacccaataaaacaactatttcttcgaaaacctattcaaatataaataaatacaaacccgcaacccgactaacgcaatccaattcgaaacgataaacgcaccgaaaattatcccgaatccgtttaatccgtcgaaaaaacgtaaaccgacaatactaataaccgacctaacgctacgttttaatcctaaattcgaaaaaatctctcgtcgtttcctcaacgatccgcaaacgttcaacgaaacctttacccgtacctaattcaaactaacgcacaaaaatataaaaccgaaatctcgctacatcgaaccgaaaataccgaaaaaaaatctaatctaacaaaatccgctaccgcaaccgatctacaacccgaccgaacaaaacattatcgatctaaaattcgcgattacgaattctaatctatctattaataaactaatatcgataacctaaacatctacttctaccttccgtaataacgacaaacgcgataataccaacgatacgcgtctaacattaataccgcaacgcgactaaaatataaacgccgcaaccgttc

SEQ ID NO: 8007 - DNA, 763 bp, Artificial Sequence
  chemically treated genomic DNA (Homo sapiens) CpG-island No: 8007
tcgcgtattcgtcggcgagtaatgttatttggaaatggaagcggaatcggggttatcgcggggtaaatcgtgaaaatcgcgtcggttatattaagaggttcgattcgaagtgtacggatgaagaataggttaagttggtcgataattacgtagcggcgttggttaaatttataattcggttttggaatagtcgggatttagacgcggatttagtggagtaattattttttcgagaatttgtttaagtatgagtgggtatagattcgtagttcggttggcgtaatttagttcgaagcggtagacgtatcggaaattatttcggattcgtttgattcgtcgaagaaacgtaaatcgataatgttggtgatcgatttgacgttgcgttttgattttgagttcgagaagatttttcgtcgtttttttaacgattcgtaggcgtttaacgaagtttttgttcgtgtttggtttaaattgacgtatagggatatggggtcgaaatttcgttatatcgggtcggaagtgtcgaaagaagatttgatttggtaagattcgttgtcgtagtcgatttataattcgatcgagtaggatattatcgatttgaaattcgcgattgcggattttggtttgtttgttagtgagttggtatcggtggtttgggtatttgtttttatttttcgtggtggcgataaacgcggtggtgttaacggtgcgcgtttggtattaatgtcgtagcgcgattgggatgtgaacgtcgtagtcgttt

SEQ ID NO: 8008 - DNA, 763 bp, Artificial Sequence
  chemically treated genomic DNA (Homo sapiens) CpG-island No: 8008
aaacgactacgacgttcacatcccaatcgcgctacgacattaataccaaacgcgcaccgttaacaccaccgcgtttatcgccaccacgaaaaataaaaacaaatacccaaaccaccgataccaactcactaacaaacaaaccaaaatccgcaatcgcgaatttcaaatcgataatatcctactcgatcgaattataaatcgactacgacaacgaatcttaccaaatcaaatcttctttcgacacttccgacccgatataacgaaatttcgaccccatatccctatacgtcaatttaaaccaaacacgaacaaaaacttcgttaaacgcctacgaatcgttaaaaaaacgacgaaaaatcttctcgaactcaaaatcaaaacgcaacgtcaaatcgatcaccaacattatcgatttacgtttcttcgacgaatcaaacgaatccgaaataatttccgatacgtctaccgcttcgaactaaattacgccaaccgaactacgaatctatacccactcatacttaaacaaattctcgaaaaaataattactccactaaatccgcgtctaaatcccgactattccaaaaccgaattataaatttaaccaacgccgctacgtaattatcgaccaacttaacctattcttcatccgtacacttcgaatcgaacctcttaatataaccgacgcgattttcacgatttaccccgcgataaccccgattccgcttccatttccaaataacattactcgccgacgaatacgcga

SEQ ID NO: 8009 - DNA, 540 bp, Artificial Sequence
  chemically treated genomic DNA (Homo sapiens) CpG-island No: 8009
cgttcgcgtgggtttttattttgtattacgaatattttcgatattgattttttttttatgttcgtattcgtttttttttttgcgtggcgttttcggttcggtttttattttttttttttgtggttttttcgggcggcgtttttgcgttttttcggattatcgtttcgttgcggttttcgtttttttttttttttttcgttttgcgcgtcgtttcgggttttttttttatttcggttttttttttttttttggcgtttattttttcgttcgcgtggttcgttatgtttttcgcgggtttttattttcgtttttatttttgcggtttttttttttcgttgtagtgtattcgtgtttttttttatttgtttttttcgtttttgtggtttatacggtgtttttttcgggtgtgatttattatataatttttatttttcgtcgtttcgttttttttcggttgggttgcgtcgtcgcggtcgtcgcgtttcggtcgtttttcgtcgtcggttttttttttttttttttttgttgttcgtttttcgt

SEQ ID NO: 8010 - DNA, 540 bp, Artificial Sequence
  chemically treated genomic DNA (Homo sapiens) CpG-island No: 8010
acgaaaaacgaacaacaaaaaaaaaaaaaaaaaaaaccgacgacgaaaaacgaccgaaacgcgacgaccgcgacgacgcaacccaaccgaaaaaaaacgaaacgacgaaaaataaaaattatataataaatcacacccgaaaaaaacaccgtataaaccacaaaaacgaaaaaaacaaataaaaaaaaacacgaatacactacaacgaaaaaaaaaaaccgcaaaaataaaaacgaaaataaaaacccgcgaaaaacataacgaaccacgcgaacgaaaaaataaacgccaaaaaaaaaaaaaaaaccgaaataaaaaaaaaacccgaaacgacgcgcaaaacgaaaaaaaaaaaaaaaaacgaaaaccgcaacgaaacgataatccgaaaaaacgcaaaaacgccgcccgaaaaaaccacaaaaaaaaaaaataaaaaccgaaccgaaaacgccacgcaaaaaaaaaaacgaatacgaacataaaaaaaaaatcaatatcgaaaatattcgtaatacaaaataaaaacccacgcgaacg

SEQ ID NO: 8011 - DNA, 540 bp, Artificial Sequence
  chemically treated genomic DNA (Homo sapiens) CpG-island No: 8011
gcgggaggcggatagtagggagggggggggggagggtcggcggcggggggcggtcggggcgcggcggtcgcggcgacgtagtttagtcgggggggagcggggcggcgggagataaaaattatataataaattatattcggggggggtatcgtgtagattataggagcggagggagtagataagggaggatacgggtgtattatagcggggagagaaagtcgtaggggtgaaggcgaaggtgggggttcgcggggggtataacgagttacgcggacgagaaggtagacgttaggggggagagagaggtcgaggtggagggagaattcgaggcggcgcgtaaggcgagagagaggggggggggcgggggtcgtagcggggcggtggttcgaagggacgtaagggcgtcgttcgggggggttatagggaaggaggatagaggtcgagtcggggacgttacgtagaggagggggcgggtgcgaatatggagagggagttagtatcgggaatattcgtggtgtagggtaggaatttacgcgggcg

SEQ ID NO: 8012 - DNA, 540 bp, Artificial Sequence
  chemically treated genomic DNA (Homo sapiens) CpG-island No: 8012
cgcccgcgtaaattcctaccctacaccacgaatattcccgatactaactccctctccatattcgcacccgccccctcctctacgtaacgtccccgactcgacctctatcctccttccctataacccccccgaacgacgcccttacgtcccttcgaaccaccgccccgctacgacccccgcccccccccctctctctcgccttacgcgccgcctcgaattctccctccacctcgacctctctctcccccctaacgtctaccttctcgtccgcgtaactcgttataccccccgcgaacccccaccttcgccttcacccctacgactttctctccccgctataatacacccgtatcctcccttatctactccctccgctcctataatctacacgataccccccccgaatataatttattatataatttttatctcccgccgccccgctcccccccgactaaactacgtcgccgcgaccgccgcgccccgaccgccccccgccgccgaccctccccccccccctccctactatccgcctcccgc

SEQ ID NO: 8013 - DNA, 666 bp, Artificial Sequence
  chemically treated genomic DNA (Homo sapiens) CpG-island No: 8013
tggtttgacgtaatacggtcgcggtttttaattagtgtaaagcgaatatgcgtattattatagtcgttaaagttaattttcggcgagatataaattttcgtttcgttaaggagttttttggtaaagttttagcgattttatggtcgtatatggtttcgggattttcgtttagatatatatggaagttttcggtattttaattatttagttcgttttatgtagttttgttaattaatatattacggcggcgtttgtattgttcggtaatgtcgcgtacgtattgttgatcgttttttagcgtcgtaatcgtcgttatttgtaacggcgtaaaggtgtcgtaatcgtgatagtttttaatacgagttagggcgttgattagcgttttgttgttaattataaagtcgatacgttagttcgttatgttgtagtttttcgatagcgtaaagaattcgattgttatatcgcgtgtattcggtatttgtataattgacggcgttttttagttatcgtagacgatatcggtataggttaggttatggattattagtatatcgtagcgtttcgttagcgttattattttttcgaagaattttagttttacgtattgcgcggttgggtttgacgggaagtcgaggattattattttcggtttcggataatttttat

SEQ ID NO: 8014 - DNA, 666 bp, Artificial Sequence
  chemically treated genomic DNA (Homo sapiens) CpG-island No: 8014
ataaaaattatccgaaaccgaaaataataatcctcgacttcccgtcaaacccaaccgcgcaatacgtaaaactaaaattcttcgaaaaaataataacgctaacgaaacgctacgatatactaataatccataacctaacctataccgatatcgtctacgataactaaaaaacgccgtcaattatacaaataccgaatacacgcgatataacaatcgaattctttacgctatcgaaaaactacaacataacgaactaacgtatcgactttataattaacaacaaaacgctaatcaacgccctaactcgtattaaaaactatcacgattacgacacctttacgccgttacaaataacgacgattacgacgctaaaaaacgatcaacaatacgtacgcgacattaccgaacaatacaaacgccgccgtaatatattaattaacaaaactacataaaacgaactaaataattaaaataccgaaaacttccatatatatctaaacgaaaatcccgaaaccatatacgaccataaaatcgctaaaactttaccaaaaaactccttaacgaaacgaaaatttatatctcgccgaaaattaactttaacgactataataatacgcatattcgctttacactaattaaaaaccgcgaccgtattacgtcaaacca

SEQ ID NO: 8015 - DNA, 666 bp, Artificial Sequence
  chemically treated genomic DNA (Homo sapiens) CpG-island No: 8015
gtgaaagttattcgaaatcgaagatgatgattttcggtttttcgttaaatttaatcgcgtaatgcgtggaattggagtttttcgaaaaagtagtggcgttggcgaaacgttacgatgtgttggtggtttatgatttggtttatgtcgatatcgtttacgatggttggaaagcgtcgttaattatgtaggtatcgggtgtacgcgatgtggtagtcgagttttttacgttgtcgaaaagttataatatggcgggttggcgtatcggttttatggttggtaataaaacgttggttagcgttttggttcgtattaaaagttattacgattacggtatttttacgtcgttgtaggtggcggcgattgcggcgttggagggcgattaatagtgcgtgcgcgatattgtcgaatagtataaacgtcgtcgtgatgtattggttaatagggttgtatgaagcgggttggatggttgaaatgtcgaaggtttttatgtatgtttgggcgaaaatttcggaattatatgcggttatgggatcgttggaattttgttaagaagttttttaacgaagcgaaggtttgtgtttcgtcggggattggttttggcgattatggtgatacgtatgttcgttttgtattgattgaaaatcgcgatcgtattgcgttaggtta

SEQ ID NO: 8016 - DNA, 666 bp, Artificial Sequence
  chemically treated genomic DNA (Homo sapiens) CpG-island No: 8016
taacctaacgcaatacgatcgcgattttcaatcaatacaaaacgaacatacgtatcaccataatcgccaaaaccaatccccgacgaaacacaaaccttcgcttcgttaaaaaacttcttaacaaaattccaacgatcccataaccgcatataattccgaaattttcgcccaaacatacataaaaaccttcgacatttcaaccatccaacccgcttcatacaaccctattaaccaatacatcacgacgacgtttatactattcgacaatatcgcgcacgcactattaatcgccctccaacgccgcaatcgccgccacctacaacgacgtaaaaataccgtaatcgtaataacttttaatacgaaccaaaacgctaaccaacgttttattaccaaccataaaaccgatacgccaacccgccatattataacttttcgacaacgtaaaaaactcgactaccacatcgcgtacacccgatacctacataattaacgacgctttccaaccatcgtaaacgatatcgacataaaccaaatcataaaccaccaacacatcgtaacgtttcgccaacgccactactttttcgaaaaactccaattccacgcattacgcgattaaatttaacgaaaaaccgaaaatcatcatcttcgatttcgaataactttcac

SEQ ID NO: 8017 - DNA, 926 bp, Artificial Sequence
  chemically treated genomic DNA (Homo sapiens) CpG-island No: 8017
tataggggcgttcgttgattgatatcgttattgacgttttagaagtgattttggtattggtatcggaaattaacggttatgttgtagttaaagcgtggtaggcgttgggcgagattatcgggcgcgaatatatttatttggcgttgtataaagaggacgagaagattcgttttcgcgatatttaggcgtagtcgcgtaaaattatttttagttttatttggttcggtttggaaagcgattacgttttttataacgcgggatatattaacgtttatgagttaatttcgtggcgtacgttgtcgggacgttagtagttttattaggattattcgtggatgcgtgtttttggtgaaagtttggtggtttatcgttcgtttatcgatattcgtagcgttagtgagatgcgttagtatatcgtttaagacgggtttttcgagaaatatgtagtttaattttttgacgtcgtattagaaatggggtatttatttaatttatagtgaaaatttgttaatgttgacgttttttcgcggtggatcgattgtttggattagcgaaatagatgttcgagaattgattattgtcgataacgattgggtggaagtatttaacgttaacggcgcgttgattgttcgcgcggtggttagttaacgtgtatcgtcgggtatgattatgatgtattacgtttaggaacgtattatgaatatttttggttcggaagtaattggtatgcgcggcggtatttataattcggttattcgcgtttgttcgaaattaacgtatatgattggcggttacgcgtagttggtttggggttttaattattacggtatcgtcggatcgaatcgcgatgagtttattatgattcgtaagatgaagaacgttaattggttggatgatgaaggtcgcgattaggtataggaggcgaa

SEQ ID NO: 8018 - DNA, 926 bp, Artificial Sequence
  chemically treated genomic DNA (Homo sapiens) CpG-island No: 8018
ttcgcctcctatacctaatcgcgaccttcatcatccaaccaattaacgttcttcatcttacgaatcataataaactcatcgcgattcgatccgacgataccgtaataattaaaaccccaaaccaactacgcgtaaccgccaatcatatacgttaatttcgaacaaacgcgaataaccgaattataaataccgccgcgcataccaattacttccgaaccaaaaatattcataatacgttcctaaacgtaatacatcataatcatacccgacgatacacgttaactaaccaccgcgcgaacaatcaacgcgccgttaacgttaaatacttccacccaatcgttatcgacaataatcaattctcgaacatctatttcgctaatccaaacaatcgatccaccgcgaaaaaacgtcaacattaacaaattttcactataaattaaataaataccccatttctaatacgacgtcaaaaaattaaactacatatttctcgaaaaacccgtcttaaacgatatactaacgcatctcactaacgctacgaatatcgataaacgaacgataaaccaccaaactttcaccaaaaacacgcatccacgaataatcctaataaaactactaacgtcccgacaacgtacgccacgaaattaactcataaacgttaatatatcccgcgttataaaaaacgtaatcgctttccaaaccgaaccaaataaaactaaaaataattttacgcgactacgcctaaatatcgcgaaaacgaatcttctcgtcctctttatacaacgccaaataaatatattcgcgcccgataatctcgcccaacgcctaccacgctttaactacaacataaccgttaatttccgataccaataccaaaatcacttctaaaacgtcaataacgatatcaatcaacgaacgcccctata

SEQ ID NO: 8019 - DNA, 926 bp, Artificial Sequence
  chemically treated genomic DNA (Homo sapiens) CpG-island No: 8019
ttcgttttttgtatttgatcgcgatttttattatttagttagttaacgttttttattttgcggattatgatgaatttatcgcggttcgattcgacggtgtcgtagtagttaaagttttaggttagttgcgcgtaatcgttaattatatgcgttggtttcgggtaaacgcgggtaatcgagttatgaatgtcgtcgcgtatgttagttattttcgaattaggaatatttataatgcgtttttgggcgtgatatattatggttatgttcggcggtatacgttggttgattatcgcgcgggtagttagcgcgtcgttggcgttgaatatttttatttagtcgttatcgataatggttagttttcgggtatttgtttcgttgatttagataatcggtttatcgcgagagagcgttagtattagtaggtttttattgtaggttgagtgaatgttttatttttggtgcggcgttaggaagttaagttgtatgtttttcgggaagttcgttttggacggtatattggcgtattttattgacgttacgggtgtcgataggcgggcgataagttattaggtttttattaaaagtacgtatttacggatgattttgatagagttgttggcgtttcgatagcgtgcgttacggaattaatttatgaacgttggtgtatttcgcgttataggagacgtgatcgttttttagatcggattaggtggggttggagataattttacgcggttgcgtttgaatatcgcgaaagcgaattttttcgttttttttgtgtagcgttagatgggtatgttcgcgttcggtgatttcgtttagcgtttgttacgttttgattgtaatatgatcgttggttttcggtgttagtgttagaattatttttgaagcgttaatggcggtgttaattagcggacgtttttgtg

SEQ ID NO: 8020 - DNA, 926 bp, Artificial Sequence
  chemically treated genomic DNA (Homo sapiens) CpG-island No: 8020
cacaaaaacgtccgctaattaacaccgccattaacgcttcaaaaataattctaacactaacaccgaaaaccaacgatcatattacaatcaaaacgtaacaaacgctaaacgaaatcaccgaacgcgaacatacccatctaacgctacacaaaaaaaacgaaaaaattcgctttcgcgatattcaaacgcaaccgcgtaaaattatctccaaccccacctaatccgatctaaaaaacgatcacgtctcctataacgcgaaatacaccaacgttcataaattaattccgtaacgcacgctatcgaaacgccaacaactctatcaaaatcatccgtaaatacgtacttttaataaaaacctaataacttatcgcccgcctatcgacacccgtaacgtcaataaaatacgccaatataccgtccaaaacgaacttcccgaaaaacatacaacttaacttcctaacgccgcaccaaaaataaaacattcactcaacctacaataaaaacctactaatactaacgctctctcgcgataaaccgattatctaaatcaacgaaacaaatacccgaaaactaaccattatcgataacgactaaataaaaatattcaacgccaacgacgcgctaactacccgcgcgataatcaaccaacgtataccgccgaacataaccataatatatcacgcccaaaaacgcattataaatattcctaattcgaaaataactaacatacgcgacgacattcataactcgattacccgcgtttacccgaaaccaacgcatataattaacgattacgcgcaactaacctaaaactttaactactacgacaccgtcgaatcgaaccgcgataaattcatcataatccgcaaaataaaaaacgttaactaactaaataataaaaatcgcgatcaaatacaaaaaacgaa

SEQ ID NO: 8021 - DNA, 512 bp, Artificial Sequence
  chemically treated genomic DNA (Homo sapiens) CpG-island No: 8021
aaagtcgttggcggaaattggttggcgggtaatggtgttgttatatggcggagcggattgtgttagtttcgtcgattttttcgtttgtaaggtttgcgtattaatcggttcgttttttattagtatttgttgtatcgtgattttacgcgtatcgtttaataggacgatatcggtttgtttgtcgggtgttagtaagtcgaggtgatttagattaaagtggcgcgtcgtcgattagttggcgacgcgatatgttatatgtagcggtatattgtgttgttcgattaggcggcgaattaaggtatcgatgtgttttttatgggcgattttttacgggttacggttatcggtatagagtatgtattgcgggttgttaaattcgttgattaacggtgttagcgcgttgagattgcgggtagcggatttttcgcggattattaacgatatgtcgagttgtaattttcggcgttttttttttagttgataattttcgtggtagtttttaatattcgtag

SEQ ID NO: 8022 - DNA, 512 bp, Artificial Sequence
  chemically treated genomic DNA (Homo sapiens) CpG-island No: 8022
ctacgaatattaaaaactaccacgaaaattatcaactaaaaaaaaaacgccgaaaattacaactcgacatatcgttaataatccgcgaaaaatccgctacccgcaatctcaacgcgctaacaccgttaatcaacgaatttaacaacccgcaatacatactctataccgataaccgtaacccgtaaaaaatcgcccataaaaaacacatcgataccttaattcgccgcctaatcgaacaacacaatataccgctacatataacatatcgcgtcgccaactaatcgacgacgcgccactttaatctaaatcacctcgacttactaacacccgacaaacaaaccgatatcgtcctattaaacgatacgcgtaaaatcacgatacaacaaatactaataaaaaacgaaccgattaatacgcaaaccttacaaacgaaaaaatcgacgaaactaacacaatccgctccgccatataacaacaccattacccgccaaccaatttccgccaacgacttt

SEQ ID NO: 8023 - DNA, 512 bp, Artificial Sequence
  chemically treated genomic DNA (Homo sapiens) CpG-island No: 8023
ttgcgggtattgaaaattgttacgaaagttattagttggaagaaggacgtcggaaattataattcggtatgtcgttgatgattcgcgaagggttcgttgttcgtaattttaacgcgttggtatcgttgattaacgaatttaatagttcgtaatgtatgttttgtatcgatgatcgtaattcgtgggagatcgtttatgaaggatatatcgatgttttaattcgtcgtttgatcgaataatataatgtgtcgttgtatgtggtatatcgcgtcgttagttggtcgacggcgcgttattttggtttgaattatttcggtttattggtattcggtaagtaggtcgatatcgttttgttgagcgatgcgcgtaaggttacggtgtagtaggtattggtgaaaggcgagtcgattgatgcgtaaattttataggcggaagagtcggcgagattggtataattcgtttcgttatatggtaatattattgttcgttagttagttttcgttagcgatttt

SEQ ID NO: 8024 - DNA, 512 bp, Artificial Sequence
  chemically treated genomic DNA (Homo sapiens) CpG-island No: 8024
aaaatcgctaacgaaaactaactaacgaacaataatattaccatataacgaaacgaattataccaatctcgccgactcttccgcctataaaatttacgcatcaatcgactcgcctttcaccaatacctactacaccgtaaccttacgcgcatcgctcaacaaaacgatatcgacctacttaccgaataccaataaaccgaaataattcaaaccaaaataacgcgccgtcgaccaactaacgacgcgatataccacatacaacgacacattatattattcgatcaaacgacgaattaaaacatcgatatatccttcataaacgatctcccacgaattacgatcatcgatacaaaacatacattacgaactattaaattcgttaatcaacgataccaacgcgttaaaattacgaacaacgaacccttcgcgaatcatcaacgacataccgaattataatttccgacgtccttcttccaactaataactttcgtaacaattttcaatacccgcaa

SEQ ID NO: 8025 - DNA, 538 bp, Artificial Sequence
  chemically treated genomic DNA (Homo sapiens) CpG-island No: 8025
cgatcgttacgatcgtagatgatcgttattattatcgcgttagggttagtttttgttattcgtagtgtttcggtaaacgcgtcgtcggagttgacgttatagaatattttttttcgtatcggtagttcgcgtatggtgtttttcgtatcgcgttgatgaatatttagtattttatttattagagaagcgttgaaaattttcggtagatatttcgtaggttagcggcgaatgtcgggaatgttgttggtttttttcggttgtagggcgataatggttatcggtttggattgttcgcgtataaagcgtgagacgtcggtgatagtggcggtcgtttttatgttggagataaaatgagtgatgcgttcggcggtttgttggtagattttcggtttagtggtggtgtaatgcgtataagggtaatcgggattattgaattggtcgagtagattttttcggtacgattcggtatttttaggttagattgagcgtatattttatggtttggatattgggggaaagaattaagttcggagtaaaa

SEQ ID NO: 8026 - DNA, 538 bp, Artificial Sequence
  chemically treated genomic DNA (Homo sapiens) CpG-island No: 8026
ttttactccgaacttaattctttcccccaatatccaaaccataaaatatacgctcaatctaacctaaaaataccgaatcgtaccgaaaaaatctactcgaccaattcaataatcccgattacccttatacgcattacaccaccactaaaccgaaaatctaccaacaaaccgccgaacgcatcactcattttatctccaacataaaaacgaccgccactatcaccgacgtctcacgctttatacgcgaacaatccaaaccgataaccattatcgccctacaaccgaaaaaaaccaacaacattcccgacattcgccgctaacctacgaaatatctaccgaaaattttcaacgcttctctaataaataaaatactaaatattcatcaacgcgatacgaaaaacaccatacgcgaactaccgatacgaaaaaaaatattctataacgtcaactccgacgacgcgtttaccgaaacactacgaataacaaaaactaaccctaacgcgataataataacgatcatctacgatcgtaacgatcg

SEQ ID NO: 8027 - DNA, 538 bp, Artificial Sequence
  chemically treated genomic DNA (Homo sapiens) CpG-island No: 8027
ttttgtttcgaatttaatttttttttttaatgtttaggttatggaatgtgcgtttaatttggtttggagatgtcgaatcgtgtcgaagaaatttgttcgattagtttaataatttcgattatttttatgcgtattatattattattgggtcggaaatttgttagtaaatcgtcgggcgtattatttattttgtttttagtatggggacgatcgttattattatcggcgttttacgttttatgcgcgaataatttaaatcggtgattattgtcgttttgtaatcggaagaggttagtagtattttcggtattcgtcgttggtttacggaatatttgtcggggatttttaacgtttttttggtggatgaggtgttggatatttattagcgcgatgcggaaaatattatgcgcgaattgtcggtgcgggaaggaatattttgtggcgttagtttcggcggcgcgtttgtcggagtattgcgggtggtaaaagttaattttgacgcggtggtggtggcgattatttgcgatcgtggcgatcg

SEQ ID NO: 8028 - DNA, 538 bp, Artificial Sequence
  chemically treated genomic DNA (Homo sapiens) CpG-island No: 8028
cgatcgccacgatcgcaaataatcgccaccaccaccgcgtcaaaattaacttttaccacccgcaatactccgacaaacgcgccgccgaaactaacgccacaaaatattccttcccgcaccgacaattcgcgcataatattttccgcatcgcgctaataaatatccaacacctcatccaccaaaaaaacgttaaaaatccccgacaaatattccgtaaaccaacgacgaataccgaaaatactactaacctcttccgattacaaaacgacaataatcaccgatttaaattattcgcgcataaaacgtaaaacgccgataataataacgatcgtccccatactaaaaacaaaataaataatacgcccgacgatttactaacaaatttccgacccaataataatataatacgcataaaaataatcgaaattattaaactaatcgaacaaatttcttcgacacgattcgacatctccaaaccaaattaaacgcacattccataacctaaacattaaaaaaaaaaattaaattcgaaacaaaa

SEQ ID NO: 8029 - DNA, 762 bp, Artificial Sequence
  chemically treated genomic DNA (Homo sapiens) CpG-island No: 8029
acggtacgcggtatagtttcggtttggtttttagcgttagtttgtagcggtaagtgggtttttggcgtagtagttgcgaaattttattgttgggatcgtttagattgttaaacgttagcgttttggtcgggtaagttttaacgtacgcgggtaatttatcggtttgtaaattggttttacggtagaaatcgtatttgttcgtcgttttcgtgatcggatggataaagcgtacgcggtacggataggcggcgatgtagtattgataatcgacgtagagattcggattaatatcgataattttattggtagtatcgcgaaaagacgtatcggtcgggtagacgttaacgtacggcgtatgatcgtagtgttggtaagatttacggaagaagcgatattttatattaggaaattcgttttgcggttcgttacgaataatcgttaggcgcgagacgtttttcggtattttgtttatttttcgataagtatttatataggcggtatagtcgatgtataacgattcgttatgtattatgtcgtaacgtattttattgatatttaacgttttcgttattacgcgttttgcggtgtcgttgacggttgttagtacgtcgacgtcggtgagaaattggcgacgagattaggttatggttgttttttaagtaacggaatagacgtcgggttaaagttcggattggtgcgttgatcgttgtggtaatcgacgtaaattttaattcgttttttgttatttaacgtttgtatcgt

SEQ ID NO: 8030 - DNA, 762 bp, Artificial Sequence
  chemically treated genomic DNA (Homo sapiens) CpG-island No: 8030
acgatacaaacgttaaataacaaaaaacgaattaaaatttacgtcgattaccacaacgatcaacgcaccaatccgaactttaacccgacgtctattccgttacttaaaaaacaaccataacctaatctcgtcgccaatttctcaccgacgtcgacgtactaacaaccgtcaacgacaccgcaaaacgcgtaataacgaaaacgttaaatatcaataaaatacgttacgacataatacataacgaatcgttatacatcgactataccgcctatataaatacttatcgaaaaataaacaaaataccgaaaaacgtctcgcgcctaacgattattcgtaacgaaccgcaaaacgaatttcctaatataaaatatcgcttcttccgtaaatcttaccaacactacgatcatacgccgtacgttaacgtctacccgaccgatacgtcttttcgcgatactaccaataaaattatcgatattaatccgaatctctacgtcgattatcaatactacatcgccgcctatccgtaccgcgtacgctttatccatccgatcacgaaaacgacgaacaaatacgatttctaccgtaaaaccaatttacaaaccgataaattacccgcgtacgttaaaacttacccgaccaaaacgctaacgtttaacaatctaaacgatcccaacaataaaatttcgcaactactacgccaaaaacccacttaccgctacaaactaacgctaaaaaccaaaccgaaactataccgcgtaccgt

SEQ ID NO: 8031 - DNA, 762 bp, Artificial Sequence
  chemically treated genomic DNA (Homo sapiens) CpG-island No: 8031
acgatgtagacgttaagtgataaaggacggattaagatttgcgtcgattgttatagcgattagcgtattaattcgaattttaattcggcgtttgtttcgttgtttaaggagtagttatgatttggtttcgtcgttagttttttatcggcgtcggcgtgttggtagtcgttagcggtatcgtagggcgcgtggtggcgaaaacgttgaatattaatggggtgcgttacggtatggtgtatgacgagtcgttatgtatcggttgtatcgtttgtatggatgtttgtcgggaagtgaataaggtgtcggaaggcgtttcgcgtttgacgattattcgtagcgagtcgtagggcgaattttttgatgtgaaatatcgtttttttcgtaagttttgttagtattgcgattatgcgtcgtgcgttgacgtttgttcgatcggtgcgttttttcgcgatgttgttagtgggattgtcgatgttaattcggatttttgcgtcggttgttagtattgtatcgtcgtttgttcgtatcgcgtgcgttttatttattcggttacgaagacggcggataaatgcgatttttgtcgtaagattaatttgtaggtcggtaagttgttcgcgtgcgttgaagtttgttcgattaaggcgttgacgtttggtaatttggacgattttaatagtgagatttcgtaattgttgcgttagaagtttatttatcgttataagttggcgttgggaattaaatcgaagttgtatcgcgtatcgt

SEQ ID NO: 8032 - DNA, 762 bp, Artificial Sequence
  chemically treated genomic DNA (Homo sapiens) CpG-island No: 8032
acgatacgcgatacaacttcgatttaattcccaacgccaacttataacgataaataaacttctaacgcaacaattacgaaatctcactattaaaatcgtccaaattaccaaacgtcaacgccttaatcgaacaaacttcaacgcacgcgaacaacttaccgacctacaaattaatcttacgacaaaaatcgcatttatccgccgtcttcgtaaccgaataaataaaacgcacgcgatacgaacaaacgacgatacaatactaacaaccgacgcaaaaatccgaattaacatcgacaatcccactaacaacatcgcgaaaaaacgcaccgatcgaacaaacgtcaacgcacgacgcataatcgcaatactaacaaaacttacgaaaaaaacgatatttcacatcaaaaaattcgccctacgactcgctacgaataatcgtcaaacgcgaaacgccttccgacaccttattcacttcccgacaaacatccatacaaacgatacaaccgatacataacgactcgtcatacaccataccgtaacgcaccccattaatattcaacgttttcgccaccacgcgccctacgataccgctaacgactaccaacacgccgacgccgataaaaaactaacgacgaaaccaaatcataactactccttaaacaacgaaacaaacgccgaattaaaattcgaattaatacgctaatcgctataacaatcgacgcaaatcttaatccgtcctttatcacttaacgtctacatcgt

SEQ ID NO: 8033 - DNA, 538 bp, Artificial Sequence
  chemically treated genomic DNA (Homo sapiens) CpG-island No: 8033
tggttgtcgggtagagttttggtgggtttttcgcgttgtatgtcggattgtattggtttgaacgttttggttgtgtattaagttagttaggatcgtattggtggtcgtatcggggcgggtagtaagagggcgtgttatttgaaaagttaaaagttggtgatagttagcgtcgaaggtttgcgtattgtgttggaagcgggttttcgcgagtcgatgattatgcgggttaattaggcgttgtatgcgtaattatattttataaaagaatttattttttggcgttaggttgacggcggatatgatgcgttttgttggcgcggtggtttgatgtaggggttaatcgatttttggtaattatttttttatgataggagtcgatatatggtatttagtaattttttcgatgattcgtagggagcgtgcgatatattgcgtaatgcgtaggggtaatttagtttgtggtcgtaataatgcgttttatcggtaggttgggatatagtgtgttagacgaagttataggcgttttgttagtagtggt

SEQ ID NO: 8034 - DNA, 538 bp, Artificial Sequence
  chemically treated genomic DNA (Homo sapiens) CpG-island No: 8034
accactactaacaaaacgcctataacttcgtctaacacactatatcccaacctaccgataaaacgcattattacgaccacaaactaaattacccctacgcattacgcaatatatcgcacgctccctacgaatcatcgaaaaaattactaaataccatatatcgactcctatcataaaaaaataattaccaaaaatcgattaacccctacatcaaaccaccgcgccaacaaaacgcatcatatccgccgtcaacctaacgccaaaaaataaattcttttataaaatataattacgcatacaacgcctaattaacccgcataatcatcgactcgcgaaaacccgcttccaacacaatacgcaaaccttcgacgctaactatcaccaacttttaacttttcaaataacacgccctcttactacccgccccgatacgaccaccaatacgatcctaactaacttaatacacaaccaaaacgttcaaaccaatacaatccgacatacaacgcgaaaaacccaccaaaactctacccgacaacca

SEQ ID NO: 8035 - DNA, 538 bp, Artificial Sequence
  chemically treated genomic DNA (Homo sapiens) CpG-island No: 8035
gttattgttggtaggacgtttgtgatttcgtttgatatattatgttttagtttgtcggtaagacgtattgttgcggttatagattgaattgtttttgcgtattgcgtaatatgtcgtacgttttttgcggattatcgaagggattattgaatgttatatgtcgatttttgttatggaaaagtggttgttagaggtcgattagtttttgtattaagttatcgcgttaataaagcgtattatgttcgtcgttaatttgacgttagaaaatggatttttttatggggtgtaattgcgtatatagcgtttgattggttcgtatgattatcggttcgcgaagattcgtttttagtataatgcgtagattttcggcgttaattgttattagtttttagttttttaagtaatacgtttttttgttgttcgtttcgatgcggttattagtacgattttgattggtttaatatatagttaaagcgtttaggttagtgtagttcggtatatagcgcggaaagtttattaaaattttgttcggtaatta

SEQ ID NO: 8036 - DNA, 538 bp, Artificial Sequence
  chemically treated genomic DNA (Homo sapiens) CpG-island No: 8036
taattaccgaacaaaattttaataaactttccgcgctatataccgaactacactaacctaaacgctttaactatatattaaaccaatcaaaatcgtactaataaccgcatcgaaacgaacaacaaaaaaacgtattacttaaaaaactaaaaactaataacaattaacgccgaaaatctacgcattatactaaaaacgaatcttcgcgaaccgataatcatacgaaccaatcaaacgctatatacgcaattacaccccataaaaaaatccattttctaacgtcaaattaacgacgaacataatacgctttattaacgcgataacttaatacaaaaactaatcgacctctaacaaccacttttccataacaaaaatcgacatataacattcaataatcccttcgataatccgcaaaaaacgtacgacatattacgcaatacgcaaaaacaattcaatctataaccgcaacaatacgtcttaccgacaaactaaaacataatatatcaaacgaaatcacaaacgtcctaccaacaataac

SEQ ID NO: 8037 - DNA, 963 bp, Artificial Sequence
  chemically treated genomic DNA (Homo sapiens) CpG-island No: 8037
ggacgggttattcgtttgattagtgaaaacggtagttatattatttttcgttacgatgtatttgatcggttgatataggaaatcggttttgacggtcgtatatagcgttattattacgatttgatcggtaaatttattcgtagcgaggatgagggtttggttatttattggtattatgacgaagtagatcgttttacgtatcgtatcgtgaagggtgaaatcgtagagcggtggtagtatgacgaacgtggttggttgatagatattagttatattagcgaagggtatcgggtggcggtgtattataggtatgatgagaaaggtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattatcgtttatatttttgtcgggtagttatagagttagtatttgaatagtttgttgtttgatcgcgattatatttggaacgataacggcgaatttattcgtattagtagttcgcgttagattcggagttatagttatagtattatcggtaggttgatcggcgtttatattatcgtagcgaatttggatattcgtatttcgtatgttatagattcggtaggtaatcgttgttcgatcggagttgtattcggatagattttagtatgtggtcggataatcgtatcgtcgtgacgcgtattatttttacggtatgacgttacgaggttgatagagaaaacgatttattcggaaagggtttcgacgatatagcgatttcgtttatat

SEQ ID NO: 8038 - DNA, 963 bp, Artificial Sequence
  chemically treated genomic DNA (Homo sapiens) CpG-island No: 8038
atataaacgaaatcgctatatcgtcgaaaccctttccgaataaatcgttttctctatcaacctcgtaacgtcataccgtaaaaataatacgcgtcacgacgatacgattatccgaccacatactaaaatctatccgaatacaactccgatcgaacaacgattacctaccgaatctataacatacgaaatacgaatatccaaattcgctacgataatataaacgccgatcaacctaccgataatactataactataactccgaatctaacgcgaactactaatacgaataaattcgccgttatcgttccaaatataatcgcgatcaaacaacaaactattcaaatactaactctataactacccgacaaaaatataaacgataataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgacctttctcatcatacctataatacaccgccacccgatacccttcgctaatataactaatatctatcaaccaaccacgttcgtcatactaccaccgctctacgatttcacccttcacgatacgatacgtaaaacgatctacttcgtcataataccaataaataaccaaaccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaacgaataacccgtcc

SEQ ID NO: 8039 - DNA, 963 bp, Artificial Sequence
  chemically treated genomic DNA (Homo sapiens) CpG-island No: 8039
gtatgaacgggatcgttatatcgtcggaatttttttcggatgagtcgttttttttgttagtttcgtgacgttatatcgtaaagatagtgcgcgttacggcgatacggttattcggttatatgttgaggtttgttcgggtgtagtttcggtcgggtagcggttatttgtcgggtttgtggtatacgggatgcggatatttagattcgttgcggtggtgtgaacgtcggttagtttgtcggtggtgttgtagttgtaatttcgggtttggcgcgggttgttgatgcggatgagttcgtcgttgtcgttttaggtgtaatcgcggttagatagtaggttgtttaggtgttggttttgtaattgttcggtaggggtataagcggtggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggttttttttattatatttgtaatgtatcgttattcggtgtttttcgttgatatggttgatgtttgttagttagttacgttcgttatattgttatcgttttgcggttttattttttacggtgcggtgcgtgaggcggtttgtttcgttatagtgttagtgggtgattagatttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggcggatgattcgttt

SEQ ID NO: 8040 - DNA, 963 bp, Artificial Sequence
  chemically treated genomic DNA (Homo sapiens) CpG-island No: 8040
aaacgaatcatccgcctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaatctaatcacccactaacactataacgaaacaaaccgcctcacgcaccgcaccgtaaaaaataaaaccgcaaaacgataacaatataacgaacgtaactaactaacaaacatcaaccatatcaacgaaaaacaccgaataacgatacattacaaatataataaaaaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaccgcttatacccctaccgaacaattacaaaaccaacacctaaacaacctactatctaaccgcgattacacctaaaacgacaacgacgaactcatccgcatcaacaacccgcgccaaacccgaaattacaactacaacaccaccgacaaactaaccgacgttcacaccaccgcaacgaatctaaatatccgcatcccgtataccacaaacccgacaaataaccgctacccgaccgaaactacacccgaacaaacctcaacatataaccgaataaccgtatcgccgtaacgcgcactatctttacgatataacgtcacgaaactaacaaaaaaaacgactcatccgaaaaaaattccgacgatataacgatcccgttcatac

SEQ ID NO: 8041 - DNA, 1044 bp, Artificial Sequence
  chemically treated genomic DNA (Homo sapiens) CpG-island No: 8041
  misc_feature (650)..(650): n is either a, c, g or t
taaaacggcgtgcgtttgttcgtttttaatcgcgtttcgtttatcgttaacgcgggcgaatgcgtggtgttttacggttatttcggtagcggtaaattaattttgttacgttcgttgtacgttaattatttgttcgacgaaggttaaatttagattaaatacggtgacgagtgggtagatttggttatcgcgttagcgcgtaaagtggtggaaattcgtaaaattatcgtcggttgggtgagttagtttttgcgcgttatttcgcgtattttagtattggaagtggtgatgtagtcgttgttcgatatcggcgtttcgcgtgaagtttgcgtcgttaaagtcgcgcgtttttttattcgtttgaacgtgtcggaacgtttgtggtatttggtattatcgatatttttcggtggcgaatagtagcgcgttaatatcgttcgcggttttatcgtcgattattttattttgttgtttgacgaatttatcgtttcgttggacgttaaaaatagcgtcgcggtggtggaattgattcgcgaagttaaaattcgtggcgtagttatcgtaggtattttttatgacgaagttgtacgtaatgacgtcgtcgatcgtttgtatttaatgggagtttttttatgattattaataacgtntagttggtgttggaaaacgaggtggtaagcggttcgttggaggtgtagaacggcgaaattcgcgtttttgtcgaaagttagagtcgtttgtcggaggcgatggacggcgaaggcggttggttgttgtcggggttgattgagttgtatatcgataatttggataaattttttatttcgcgttcgaaagttgattggtttgtttattcggcgatgagtagttacgacgcgttgatggtggcgagcggtattattatcgtattggatgtcgtggtaattggcgacgtgcgcgacggcggcgatcggttggagaatttggagaagatgattaacgttatcgaagagacgtagaaacgcggcgttaatcgcgtcgagtatcgtttgtatttgcgttgcg

SEQ ID NO: 8042 - DNA, 1044 bp, Artificial Sequence
  chemically treated genomic DNA (Homo sapiens) CpG-island No: 8042
  misc_feature (395)..(395): n is either a, c, g or t
cgcaacgcaaatacaaacgatactcgacgcgattaacgccgcgtttctacgtctcttcgataacgttaatcatcttctccaaattctccaaccgatcgccgccgtcgcgcacgtcgccaattaccacgacatccaatacgataataataccgctcgccaccatcaacgcgtcgtaactactcatcgccgaataaacaaaccaatcaactttcgaacgcgaaataaaaaatttatccaaattatcgatatacaactcaatcaaccccgacaacaaccaaccgccttcgccgtccatcgcctccgacaaacgactctaactttcgacaaaaacgcgaatttcgccgttctacacctccaacgaaccgcttaccacctcgttttccaacaccaactanacgttattaataatcataaaaaaactcccattaaatacaaacgatcgacgacgtcattacgtacaacttcgtcataaaaaatacctacgataactacgccacgaattttaacttcgcgaatcaattccaccaccgcgacgctatttttaacgtccaacgaaacgataaattcgtcaaacaacaaaataaaataatcgacgataaaaccgcgaacgatattaacgcgctactattcgccaccgaaaaatatcgataataccaaataccacaaacgttccgacacgttcaaacgaataaaaaaacgcgcgactttaacgacgcaaacttcacgcgaaacgccgatatcgaacaacgactacatcaccacttccaatactaaaatacgcgaaataacgcgcaaaaactaactcacccaaccgacgataattttacgaatttccaccactttacgcgctaacgcgataaccaaatctacccactcgtcaccgtatttaatctaaatttaaccttcgtcgaacaaataattaacgtacaacgaacgtaacaaaattaatttaccgctaccgaaataaccgtaaaacaccacgcattcgcccgcgttaacgataaacgaaacgcgattaaaaacgaacaaacgcacgccgtttta

SEQ ID NO: 8043 - DNA, 1044 bp, Artificial Sequence
  chemically treated genomic DNA (Homo sapiens) CpG-island No: 8043
  misc_feature (395)..(395): n is either a, c, g or t
cgtagcgtagatgtagacggtgttcggcgcggttgacgtcgcgtttttgcgttttttcgatggcgttgattattttttttagattttttagtcgatcgtcgtcgtcgcgtacgtcgttaattgttacggtatttagtacggtggtgatgtcgttcgttattattagcgcgtcgtggttgtttatcgtcgagtgggtaggttagttaattttcgggcgcggggtgaagaatttatttagattatcggtatgtagtttaattagtttcggtagtagttagtcgttttcgtcgtttatcgttttcggtaggcggttttggttttcggtaaaggcgcggatttcgtcgttttgtatttttagcgaatcgtttattatttcgttttttagtattagttanacgttattgataattatgaagaggtttttattgggtgtaggcggtcggcgacgttattacgtatagtttcgttatggaagatgtttacgatggttgcgttacgggttttggtttcgcgaattagttttattatcgcggcgttgtttttggcgtttagcgaggcggtaggttcgttaagtagtagaatggggtagtcgacgataaagtcgcgggcgatgttgacgcgttgttgttcgttatcggaaaatgtcgatggtgttaggtgttataggcgtttcggtacgtttaggcgggtgagaagacgcgcggttttagcggcgtaggttttacgcggaacgtcggtatcgagtagcggttgtattattatttttagtgttgagatacgcgggatgacgcgtagaaattggtttatttagtcgacggtggttttgcggatttttattattttgcgcgttggcgcggtgattaggtttatttattcgttatcgtgtttgatttggatttgattttcgtcgggtagatagttggcgtatagcgagcgtagtagagttgatttgtcgttgtcggaatggtcgtggagtattacgtattcgttcgcgttgacggtgagcgaggcgcgattgaggacgggtaggcgtacgtcgttttg

SEQ ID NO: 8044 - DNA, 1044 bp, Artificial Sequence
  chemically treated genomic DNA (Homo sapiens) CpG-island No: 8044
  misc_feature (650)..(650): n is either a, c, g or t
caaaacgacgtacgcctacccgtcctcaatcgcgcctcgctcaccgtcaacgcgaacgaatacgtaatactccacgaccattccgacaacgacaaatcaactctactacgctcgctatacgccaactatctacccgacgaaaatcaaatccaaatcaaacacgataacgaataaataaacctaatcaccgcgccaacgcgcaaaataataaaaatccgcaaaaccaccgtcgactaaataaaccaatttctacgcgtcatcccgcgtatctcaacactaaaaataataatacaaccgctactcgataccgacgttccgcgtaaaacctacgccgctaaaaccgcgcgtcttctcacccgcctaaacgtaccgaaacgcctataacacctaacaccatcgacattttccgataacgaacaacaacgcgtcaacatcgcccgcgactttatcgtcgactaccccattctactacttaacgaacctaccgcctcgctaaacgccaaaaacaacgccgcgataataaaactaattcgcgaaaccaaaacccgtaacgcaaccatcgtaaacatcttccataacgaaactatacgtaataacgtcgccgaccgcctacacccaataaaaacctcttcataattatcaataacgtntaactaatactaaaaaacgaaataataaacgattcgctaaaaatacaaaacgacgaaatccgcgcctttaccgaaaaccaaaaccgcctaccgaaaacgataaacgacgaaaacgactaactactaccgaaactaattaaactacataccgataatctaaataaattcttcaccccgcgcccgaaaattaactaacctacccactcgacgataaacaaccacgacgcgctaataataacgaacgacatcaccaccgtactaaataccgtaacaattaacgacgtacgcgacgacgacgatcgactaaaaaatctaaaaaaaataatcaacgccatcgaaaaaacgcaaaaacgcgacgtcaaccgcgccgaacaccgtctacatctacgctacg

SEQ ID NO: 8045 - DNA, 507 bp, Artificial Sequence
  chemically treated genomic DNA (Homo sapiens) CpG-island No: 8045
gtataacgtattgcggggtaaaatcgtagatgttttgtattaggcgtaacgtttcgcgttattgtatttggatgttatcgttatttaaatcgtttagatgttgatttaatatcgtttgtttatcgcgtattaggtagaaggtattttttagattcgcgtcgagatatagtataggcggaatatttttaaagttcggaggtaaagttagcgtattcggtatatattttcgcgaacggcgtagtatttcgtcgttttcgcgtattatcgaattatttattcgttgtacgatgtcgcggttatgtattaagaattcgtcggtaatgttttgtaaattcgttagcgtttgttcgttgttgatagttggtggtttatcgtttaggttgtcggaggttattattagcgggtattgtagtttttgtaatagtaaatgttggagcgggttcgtaggtaatattatttcgatttcgttaaggttaggggcgatattattataaagtttaggaacgt

SEQ ID NO: 8046 - DNA, 507 bp, Artificial Sequence
  chemically treated genomic DNA (Homo sapiens) CpG-island No: 8046
acgttcctaaactttataataatatcgcccctaaccttaacgaaatcgaaataatattacctacgaacccgctccaacatttactattacaaaaactacaatacccgctaataataacctccgacaacctaaacgataaaccaccaactatcaacaacgaacaaacgctaacgaatttacaaaacattaccgacgaattcttaatacataaccgcgacatcgtacaacgaataaataattcgataatacgcgaaaacgacgaaatactacgccgttcgcgaaaatatataccgaatacgctaactttacctccgaactttaaaaatattccgcctatactatatctcgacgcgaatctaaaaaataccttctacctaatacgcgataaacaaacgatattaaatcaacatctaaacgatttaaataacgataacatccaaatacaataacgcgaaacgttacgcctaatacaaaacatctacgattttaccccgcaatacgttatac

SEQ ID NO: 8047 - DNA, 507 bp, Artificial Sequence
  chemically treated genomic DNA (Homo sapiens) CpG-island No: 8047
acgtttttgagttttgtgatgatatcgtttttgattttaacgaagtcggggtaatgttgtttgcgaattcgttttagtatttgttgttataggaattgtaatgttcgttggtgatgattttcggtaatttgagcggtaaattattagttattagtaacgaataggcgttggcggatttgtagggtattgtcgacggatttttgatatataatcgcgatatcgtgtagcggatggatgattcggtggtgcgcgaaagcggcgaaatgttgcgtcgttcgcgggggtatgtgtcggatgcgttggttttgttttcgggttttaaaaatgtttcgtttgtgttgtgtttcggcgcggatttgaaaaatattttttgtttggtgcgcggtgaataagcggtgttgagttagtatttgggcgatttaagtgacgatggtatttagatgtagtggcgcgaagcgttacgtttgatgtaaaatatttacgattttatttcgtaatacgttgtgt

SEQ ID NO: 8048 - DNA, 507 bp, Artificial Sequence
  chemically treated genomic DNA (Homo sapiens) CpG-island No: 8048
acacaacgtattacgaaataaaatcgtaaatattttacatcaaacgtaacgcttcgcgccactacatctaaataccatcgtcacttaaatcgcccaaatactaactcaacaccgcttattcaccgcgcaccaaacaaaaaatatttttcaaatccgcgccgaaacacaacacaaacgaaacatttttaaaacccgaaaacaaaaccaacgcatccgacacatacccccgcgaacgacgcaacatttcgccgctttcgcgcaccaccgaatcatccatccgctacacgatatcgcgattatatatcaaaaatccgtcgacaataccctacaaatccgccaacgcctattcgttactaataactaataatttaccgctcaaattaccgaaaatcatcaccaacgaacattacaattcctataacaacaaatactaaaacgaattcgcaaacaacattaccccgacttcgttaaaatcaaaaacgatatcatcacaaaactcaaaaacgt

SEQ ID NO: 8049 - DNA, 1003 bp, Artificial Sequence
  chemically treated genomic DNA (Homo sapiens) CpG-island No: 8049
tagtttaacgttttttttatcggtatcgtcgttgcgtcggaagcgggtgcgacgttgattttataggtcgttagtttgagcggcggacgtatgttgcgttttattggtgcgggtattgtcgaagaacgaatgatcgtttcgtagttgtcggagtgtattttgtacgaatttatcgagcgttcgtattcgttttcgttcggtatcgatttgattttgatttgtggcgagcgtttgttggttatttcgcgaattatttatgtggaggtgtgttgatgtacgttgtcgtgaaagggggcgagaaggcgatcgacgtcgtttacgttttgtaagagagtcgacgtcgaggcgatatcgatttgttcgaattgagcgtcgtttagattgaatagtagtttaatttcgcggtagatcgcgtgatgatcgaaggcggtattgtcgatcgcgaattggcggcgttggcgttgaaataggttagcggcgataacgttgaagcgatttttttgttgcgcgtttatcgtattacgttggcgaagttggcggtaagcgagtcgttcgatattatcgggatgcgtttcgaacgtcgtattttcgtcgtttataaagatattttcggcggttagttgtttggtttaatttacgattatatttatcgtttgttcgattttattttgttggtaaacggcgaagcgtcgacgttgattatcgtcgatagcgaatagtagtcgtcgtcgtacgtttttagtttgttggcgcgttaggggttggcgaagtttgaagaggatagcggcgtatagtcggagatattattcgtacgtcgtcggttatttttgtttacgtttttttcgtttagcgatgcgggacgaaggttatttgttggcgttggtttacgtttatttaacgcggttacgggtaattacgttcgtaggcgaattcgtagcggtatgacgtgtggtcggaggttggtttgcggtgaacgtcggcgaatttgtttgattgattgagt

SEQ ID NO: 8050 - DNA, 1003 bp, Artificial Sequence
  chemically treated genomic DNA (Homo sapiens) CpG-island No: 8050
actcaatcaatcaaacaaattcgccgacgttcaccgcaaaccaacctccgaccacacgtcataccgctacgaattcgcctacgaacgtaattacccgtaaccgcgttaaataaacgtaaaccaacgccaacaaataaccttcgtcccgcatcgctaaacgaaaaaaacgtaaacaaaaataaccgacgacgtacgaataatatctccgactatacgccgctatcctcttcaaacttcgccaacccctaacgcgccaacaaactaaaaacgtacgacgacgactactattcgctatcgacgataatcaacgtcgacgcttcgccgtttaccaacaaaataaaatcgaacaaacgataaatataatcgtaaattaaaccaaacaactaaccgccgaaaatatctttataaacgacgaaaatacgacgttcgaaacgcatcccgataatatcgaacgactcgcttaccgccaacttcgccaacgtaatacgataaacgcgcaacaaaaaaatcgcttcaacgttatcgccgctaacctatttcaacgccaacgccgccaattcgcgatcgacaataccgccttcgatcatcacgcgatctaccgcgaaattaaactactattcaatctaaacgacgctcaattcgaacaaatcgatatcgcctcgacgtcgactctcttacaaaacgtaaacgacgtcgatcgccttctcgccccctttcacgacaacgtacatcaacacacctccacataaataattcgcgaaataaccaacaaacgctcgccacaaatcaaaatcaaatcgataccgaacgaaaacgaatacgaacgctcgataaattcgtacaaaatacactccgacaactacgaaacgatcattcgttcttcgacaatacccgcaccaataaaacgcaacatacgtccgccgctcaaactaacgacctataaaatcaacgtcgcacccgcttccgacgcaacgacgataccgataaaaaaaacgttaaacta

SEQ ID NO: 8051 - DNA, 1003 bp, Artificial Sequence
  chemically treated genomic DNA (Homo sapiens) CpG-island No: 8051
atttagttaattaagtaggttcgtcgacgtttatcgtaaattagttttcggttatacgttatgtcgttgcggattcgtttgcgaacgtgattgttcgtaatcgcgttgggtggacgtaggttagcgttagtaaatagttttcgtttcgtatcgttgaacgggaggagcgtgagtaggggtaatcggcggcgtgcgggtgatgttttcggttgtgcgtcgttattttttttaaatttcgttagtttttgacgcgttagtaggttgaaaacgtgcggcgacggttgttgttcgttgtcggcggtggttagcgtcggcgtttcgtcgtttgttagtagggtaaaatcgagtaggcgatgggtgtagtcgtaggttgggttaagtagttggtcgtcgggaatgtttttataaacggcggagatacggcgttcgagacgtatttcggtggtgtcgagcggttcgtttatcgttagtttcgttaacgtggtgcggtaggcgcgtagtaggaaaatcgttttaacgttatcgtcgttggtttgttttagcgttagcgtcgttagttcgcggtcggtaatgtcgttttcggttattacgcgatttatcgcgaggttaagttgttgtttaatttgggcgacgtttagttcgggtaaatcggtatcgtttcggcgtcggtttttttgtagggcgtgggcggcgtcgatcgttttttcgtttttttttacggtaacgtatattagtatatttttatatgagtggttcgcggaatagttagtaggcgttcgttataggttaggattaggtcgatgtcgagcgggaacggatgcgggcgttcggtgagttcgtgtagaatgtatttcggtagttgcggagcgattattcgtttttcggtaatattcgtattagtaaggcgtaatatgcgttcgtcgtttaggttggcgatttgtaaaattagcgtcgtattcgttttcggcgtaacggcggtgtcggtggaaagggcgttgagttg

SEQ ID NO: 8052 - DNA, 1003 bp, Artificial Sequence
  chemically treated genomic DNA (Homo sapiens) CpG-island No: 8052
caactcaacgccctttccaccgacaccgccgttacgccgaaaacgaatacgacgctaattttacaaatcgccaacctaaacgacgaacgcatattacgccttactaatacgaatattaccgaaaaacgaataatcgctccgcaactaccgaaatacattctacacgaactcaccgaacgcccgcatccgttcccgctcgacatcgacctaatcctaacctataacgaacgcctactaactattccgcgaaccactcatataaaaatatactaatatacgttaccgtaaaaaaaaacgaaaaaacgatcgacgccgcccacgccctacaaaaaaaccgacgccgaaacgataccgatttacccgaactaaacgtcgcccaaattaaacaacaacttaacctcgcgataaatcgcgtaataaccgaaaacgacattaccgaccgcgaactaacgacgctaacgctaaaacaaaccaacgacgataacgttaaaacgattttcctactacgcgcctaccgcaccacgttaacgaaactaacgataaacgaaccgctcgacaccaccgaaatacgtctcgaacgccgtatctccgccgtttataaaaacattcccgacgaccaactacttaacccaacctacgactacacccatcgcctactcgattttaccctactaacaaacgacgaaacgccgacgctaaccaccgccgacaacgaacaacaaccgtcgccgcacgttttcaacctactaacgcgtcaaaaactaacgaaatttaaaaaaaataacgacgcacaaccgaaaacatcacccgcacgccgccgattacccctactcacgctcctcccgttcaacgatacgaaacgaaaactatttactaacgctaacctacgtccacccaacgcgattacgaacaatcacgttcgcaaacgaatccgcaacgacataacgtataaccgaaaactaatttacgataaacgtcgacgaacctacttaattaactaaat

SEQ ID NO: 8053 - DNA, 646 bp, Artificial Sequence
  chemically treated genomic DNA (Homo sapiens) CpG-island No: 8053
ttgttcgcgttaattttacgttttttttcgttcgtacgttgtaatttcgtttcgttaatgaattggcgcggcgtgaagattggcgtggtttgttagtttttagttcggaaaagttcggaattatcgaagcgtaatgtaattattattatgcgaaatggaatatcgggtagagtgaagaagtttggtaaggggcgaaagagttgtggttaatcggtaagagttagtttaacgtttgtgataagttatttagcgtttggcgtgcgttaggtaaataagattcgttggcgtatttagagcgtattcgtttggcgatgaaagcgggtaatataggtttggtaatagtgttggtagggtagatgtttgtcgattattagattatcgtttcggtaattattttattggcgaataattttaatacggtattgattttcgcgcgtataattggcgcgaacgattttattcgttaaatggcggcggtggcgtttgttagtgtggcgcggtaggatgttgagaatgtacggttgatgattttatcgtttgtttaggcgtagtagtttaatgaagattagatttaggagttgcgcgatatcgtcgtttggcgtttgatgggtaacgatgttatcgacgagtaggcgaattggcgcga

SEQ ID NO: 8054 - DNA, 646 bp, Artificial Sequence
  chemically treated genomic DNA (Homo sapiens) CpG-island No: 8054
tcgcgccaattcgcctactcgtcgataacatcgttacccatcaaacgccaaacgacgatatcgcgcaactcctaaatctaatcttcattaaactactacgcctaaacaaacgataaaatcatcaaccgtacattctcaacatcctaccgcgccacactaacaaacgccaccgccgccatttaacgaataaaatcgttcgcgccaattatacgcgcgaaaatcaataccgtattaaaattattcgccaataaaataattaccgaaacgataatctaataatcgacaaacatctaccctaccaacactattaccaaacctatattacccgctttcatcgccaaacgaatacgctctaaatacgccaacgaatcttatttacctaacgcacgccaaacgctaaataacttatcacaaacgttaaactaactcttaccgattaaccacaactctttcgccccttaccaaacttcttcactctacccgatattccatttcgcataataataattacattacgcttcgataattccgaacttttccgaactaaaaactaacaaaccacgccaatcttcacgccgcgccaattcattaacgaaacgaaattacaacgtacgaacgaaaaaaaacgtaaaattaacgcgaacaa

SEQ ID NO: 8055 - DNA, 646 bp, Artificial Sequence
  chemically treated genomic DNA (Homo sapiens) CpG-island No: 8055
tcgcgttagttcgtttgttcgtcggtgatatcgttgtttattagacgttaggcgacgatatcgcgtagtttttgaatttgatttttattaagttgttgcgtttgggtaagcgatgggattattagtcgtgtatttttagtattttgtcgcgttatattggtaaacgttatcgtcgttatttgacgggtaaaatcgttcgcgttagttgtacgcgcgaaggttagtatcgtattagggttgttcgttagtgaaatgattgtcgaggcgatagtttggtaatcggtaggtatttgttttgttagtattgttattaggtttgtgttattcgtttttatcgttagacggatacgttttaaatacgttagcggattttgtttatttgacgtacgttagacgttaaataatttgttataggcgttaggttggtttttgtcggttagttatagttttttcgttttttgttaggtttttttattttgttcggtgttttatttcgtatagtagtaattatattgcgtttcggtagtttcgggttttttcgggttaaaggttaataagttacgttagtttttacgtcgcgttagtttattgacgaaacgagattgtagcgtgcgagcgggaggaagcgtggggttagcgcgaataa

SEQ ID NO: 8056 - DNA, 646 bp, Artificial Sequence
  chemically treated genomic DNA (Homo sapiens) CpG-island No: 8056
ttattcgcgctaaccccacgcttcctcccgctcgcacgctacaatctcgtttcgtcaataaactaacgcgacgtaaaaactaacgtaacttattaacctttaacccgaaaaaacccgaaactaccgaaacgcaatataattactactatacgaaataaaacaccgaacaaaataaaaaaacctaacaaaaaacgaaaaaactataactaaccgacaaaaaccaacctaacgcctataacaaattatttaacgtctaacgtacgtcaaataaacaaaatccgctaacgtatttaaaacgtatccgtctaacgataaaaacgaataacacaaacctaataacaatactaacaaaacaaatacctaccgattaccaaactatcgcctcgacaatcatttcactaacgaacaaccctaatacgatactaaccttcgcgcgtacaactaacgcgaacgattttacccgtcaaataacgacgataacgtttaccaatataacgcgacaaaatactaaaaatacacgactaataatcccatcgcttacccaaacgcaacaacttaataaaaatcaaattcaaaaactacgcgatatcgtcgcctaacgtctaataaacaacgatatcaccgacgaacaaacgaactaacgcga

SEQ ID NO: 8057 - DNA, 524 bp, Artificial Sequence
  chemically treated genomic DNA (Homo sapiens) CpG-island No: 8057
tggtaatcggtgttagtgtttttgtttcgtttgtgtttgggcgtgagttaatgttgacgttaaatagttagtaagagtatcgcgtttgtgaaacgtaattgcgggatgttcgacgcgtgttgattgttggcggtggtttgattggtagcgaattggcgatggatttttgtcgtgtaggtaaagcggttacgttaatcgataacgttgttagtattttggcgtcgttaatgttatcggaagtaagtagtcgtttgtagtatcggttgacggagatgggcgtttatttgttgttgaaattttagttataggggttggaaaaaacggattttggtatttaggtaacgttggatcgttagcgtaatatcgaagtggatgcggtaattgtcgttatcggattgcgttcggaaatcgttttggtacgacgcgtcgggttgacgattaatcgcggcgtttgcgtcgatagttatttgtaaattagtaatatcgatatttacgcgttgggcgattgcgcggaaattaacggt

SEQ ID NO: 8058 - DNA, 524 bp, Artificial Sequence
  chemically treated genomic DNA (Homo sapiens) CpG-island No: 8058
accgttaatttccgcgcaatcgcccaacgcgtaaatatcgatattactaatttacaaataactatcgacgcaaacgccgcgattaatcgtcaacccgacgcgtcgtaccaaaacgatttccgaacgcaatccgataacgacaattaccgcatccacttcgatattacgctaacgatccaacgttacctaaataccaaaatccgttttttccaacccctataactaaaatttcaacaacaaataaacgcccatctccgtcaaccgatactacaaacgactacttacttccgataacattaacgacgccaaaatactaacaacgttatcgattaacgtaaccgctttacctacacgacaaaaatccatcgccaattcgctaccaatcaaaccaccgccaacaatcaacacgcgtcgaacatcccgcaattacgtttcacaaacgcgatactcttactaactatttaacgtcaacattaactcacgcccaaacacaaacgaaacaaaaacactaacaccgattacca

SEQ ID NO: 8059 - DNA, 524 bp, Artificial Sequence
  chemically treated genomic DNA (Homo sapiens) CpG-island No: 8059
atcgttaattttcgcgtaatcgtttagcgcgtaaatatcggtattattggtttgtagataattatcgacgtaaacgtcgcgattaatcgttagttcggcgcgtcgtgttagggcggttttcgggcgtagttcggtggcggtaattatcgtatttatttcgatattgcgttggcggtttagcgttgtttgaatgttagaattcgttttttttagtttttgtaattgagattttaatagtagatgaacgtttattttcgttaatcgatgttgtaagcggttgtttattttcggtggtattaacgacgttagaatattggtagcgttgtcgattagcgtgatcgttttgtttgtacgataaaaatttatcgttagttcgttattaattaaattatcgttaataattaatacgcgtcgggtatttcgtagttgcgttttataggcgcgatatttttgttgattatttaacgttagtattaatttacgtttaggtataggcgggataaaggtattggtatcggttgtta

SEQ ID NO: 8060 - DNA, 524 bp, Artificial Sequence
  chemically treated genomic DNA (Homo sapiens) CpG-island No: 8060
taacaaccgataccaatacctttatcccgcctatacctaaacgtaaattaatactaacgttaaataatcaacaaaaatatcgcgcctataaaacgcaactacgaaatacccgacgcgtattaattattaacgataatttaattaataacgaactaacgataaatttttatcgtacaaacaaaacgatcacgctaatcgacaacgctaccaatattctaacgtcgttaataccaccgaaaataaacaaccgcttacaacatcgattaacgaaaataaacgttcatctactattaaaatctcaattacaaaaactaaaaaaaacgaattctaacattcaaacaacgctaaaccgccaacgcaatatcgaaataaatacgataattaccgccaccgaactacgcccgaaaaccgccctaacacgacgcgccgaactaacgattaatcgcgacgtttacgtcgataattatctacaaaccaataataccgatatttacgcgctaaacgattacgcgaaaattaacgat

SEQ ID NO: 8061 - DNA, 638 bp, Artificial Sequence
  chemically treated genomic DNA (Homo sapiens) CpG-island No: 8061
tcggttagcggatcggagagaagttaagtttaggaaattgtcgttttcgtcgtcggaaatgaataatttgagttttttagttaggttgtttaagtttcgtttttaaaaagcgagtatgcgtagttttcggttacggttttttttagcgtaggtttattttcgttatggagtatgcgtagtttttttgtcgtttcgtttttttttttttagagtttttagttttttagaaattaggcggcgcgttttcggtggcggcgttttggattttcgggttcgcgtattttcgttagttttttttaaggcggatgggtggttttcgagatttcgtcggatttatggtttttagtgtagcgcggagtgggcgatgttagcgtgttaggtgagaggcggttatcggtggcgggtgagggcgaaagagggtatggcgcggtcgggagcgggcgtcgatagggtttttttcgcggttcggcgtcggaggttggaggcgtggattcgtagagtcggggttggagggggtttgttttaattgtttgtaggcgcgtggagtggagggtcgttttgggattcgttttttttatcgtagaaataggattcgtaggtttggtggtagaattataggatttgggattttggaagaa

SEQ ID NO: 8062 - DNA, 638 bp, Artificial Sequence
  chemically treated genomic DNA (Homo sapiens) CpG-island No: 8062
ttcttccaaaatcccaaatcctataattctaccaccaaacctacgaatcctatttctacgataaaaaaaacgaatcccaaaacgaccctccactccacgcgcctacaaacaattaaaacaaaccccctccaaccccgactctacgaatccacgcctccaacctccgacgccgaaccgcgaaaaaaaccctatcgacgcccgctcccgaccgcgccataccctctttcgccctcacccgccaccgataaccgcctctcacctaacacgctaacatcgcccactccgcgctacactaaaaaccataaatccgacgaaatctcgaaaaccacccatccgccttaaaaaaaactaacgaaaatacgcgaacccgaaaatccaaaacgccgccaccgaaaacgcgccgcctaatttctaaaaaactaaaaactctaaaaaaaaaaaaacgaaacgacaaaaaaactacgcatactccataacgaaaataaacctacgctaaaaaaaaccgtaaccgaaaactacgcatactcgctttttaaaaacgaaacttaaacaacctaactaaaaaactcaaattattcatttccgacgacgaaaacgacaatttcctaaacttaacttctctccgatccgctaaccga

SEQ ID NO: 8063 - DNA, 638 bp, Artificial Sequence
  chemically treated genomic DNA (Homo sapiens) CpG-island No: 8063
tttttttaggattttaaattttataattttattattaagtttgcgggttttatttttgcggtggaaagggcgaattttaaggcgattttttattttacgcgtttgtaggtagttggaataagttttttttaatttcggttttgcgggtttacgtttttaattttcggcgtcgggtcgcggagaaggttttgtcggcgttcgttttcggtcgcgttatgttttttttcgtttttattcgttatcggtggtcgttttttatttggtacgttggtatcgtttatttcgcgttgtattggaaattatgggttcgacggggtttcgggggttatttattcgttttaaggaaggttggcggggatgcgcgggttcgggagtttagggcgtcgttatcgggaacgcgtcgtttggtttttaaggaattgggggttttggaaagggaggggcgggacggtaggaggattgcgtatgttttataacggggatgggtttgcgttgggaggggtcgtagtcgggagttgcgtatgttcgttttttgggggcggagtttaagtagtttggttaggaggtttaggttatttattttcggcggcggaggcggtagttttttaagtttggttttttttcggttcgttgatcgg

SEQ ID NO: 8064 - DNA, 638 bp, Artificial Sequence
  chemically treated genomic DNA (Homo sapiens) CpG-island No: 8064
ccgatcaacgaaccgaaaaaaaaccaaacttaaaaaactaccgcctccgccgccgaaaataaataacctaaacctcctaaccaaactacttaaactccgcccccaaaaaacgaacatacgcaactcccgactacgacccctcccaacgcaaacccatccccgttataaaacatacgcaatcctcctaccgtcccgcccctccctttccaaaacccccaattccttaaaaaccaaacgacgcgttcccgataacgacgccctaaactcccgaacccgcgcatccccgccaaccttccttaaaacgaataaataacccccgaaaccccgtcgaacccataatttccaatacaacgcgaaataaacgataccaacgtaccaaataaaaaacgaccaccgataacgaataaaaacgaaaaaaaacataacgcgaccgaaaacgaacgccgacaaaaccttctccgcgacccgacgccgaaaattaaaaacgtaaacccgcaaaaccgaaattaaaaaaaacttattccaactacctacaaacgcgtaaaataaaaaatcgccttaaaattcgccctttccaccgcaaaaataaaacccgcaaacttaataataaaattataaaatttaaaatcctaaaaaaa

SEQ ID NO: 8065 - DNA, 511 bp, Artificial Sequence
  chemically treated genomic DNA (Homo sapiens) CpG-island No: 8065
  misc_feature (222)..(223): n is either a, c, g or t
tgggttttcgttcgtggttgtcgagggacgtttgcgaaggattggtttttattgattcgggcgttgagtagacggcgttgcggtcgtatcgatagggatattatagagtgagttcgcgcggggtttttttgcgggtgatcgggggggtgtttagtattagtcggtattttcgaagtttttttttacgtagcgggatttagaggtttggcgtaggtttttttnntgtcgttagggtatacgttgttattagttgggtttgtcggtattagtggatcgcgacgttaagtcgtcgcgtagatttcgcggtatataatgtatacggatacgtcggtagagtagagttcgtgtattcggtacgttagacgtaggtatttaggtatcggtttatttacgtttttgttagaggtgtcgggttttcgttatcgatcgacgcggtaggaaggggggtcgcgcggggattttttattcggttgggaaggggtaggaaaggggcggcgcgcgcgaagaatgt

SEQ ID NO: 8066 - DNA, 511 bp, Artificial Sequence
  chemically treated genomic DNA (Homo sapiens) CpG-island No: 8066
  misc_feature (289)..(290): n is either a, c, g or t
acattcttcgcgcgcgccgcccctttcctaccccttcccaaccgaataaaaaatccccgcgcgaccccccttcctaccgcgtcgatcgataacgaaaacccgacacctctaacaaaaacgtaaataaaccgatacctaaatacctacgtctaacgtaccgaatacacgaactctactctaccgacgtatccgtatacattatataccgcgaaatctacgcgacgacttaacgtcgcgatccactaataccgacaaacccaactaataacaacgtataccctaacgacannaaaaaaacctacgccaaacctctaaatcccgctacgtaaaaaaaaacttcgaaaataccgactaatactaaacacccccccgatcacccgcaaaaaaaccccgcgcgaactcactctataatatccctatcgatacgaccgcaacgccgtctactcaacgcccgaatcaataaaaaccaatccttcgcaaacgtccctcgacaaccacgaacgaaaaccca

SEQ ID NO: 8067 - DNA, 511 bp, Artificial Sequence
  chemically treated genomic DNA (Homo sapiens) CpG-island No: 8067
  misc_feature (289)..(290): n is either a, c, g or t
atatttttcgcgcgcgtcgttttttttttgtttttttttagtcggatggagggttttcgcgcgatttttttttttgtcgcgtcggtcgatggcgagagttcggtatttttggtaggaacgtgggtggatcgatgtttgagtgtttacgtttgacgtatcgagtgtacgagttttgttttgtcggcgtgttcgtgtatattatgtgtcgcggagtttgcgcggcgatttagcgtcgcgatttattggtatcggtagatttagttggtggtagcgtgtgttttagcgatannggaaagatttgcgttagatttttggatttcgttgcgtgggagagggtttcggggatatcgattggtattggatattttttcgattattcgtagggaagtttcgcgcggatttattttatgatgtttttgtcggtgcggtcgtagcgtcgtttgtttagcgttcgggttaataggagttagtttttcgtaggcgtttttcggtagttacgagcgggggttta

SEQ ID NO: 8068 - DNA, 511 bp, Artificial Sequence
  chemically treated genomic DNA (Homo sapiens) CpG-island No: 8068
  misc_feature (222)..(223): n is either a, c, g or t
taaacccccgctcgtaactaccgaaaaacgcctacgaaaaactaactcctattaacccgaacgctaaacaaacgacgctacgaccgcaccgacaaaaacatcataaaataaatccgcgcgaaacttccctacgaataatcgaaaaaatatccaataccaatcgatatccccgaaaccctctcccacgcaacgaaatccaaaaatctaacgcaaatctttccnntatcgctaaaacacacgctaccaccaactaaatctaccgataccaataaatcgcgacgctaaatcgccgcgcaaactccgcgacacataatatacacgaacacgccgacaaaacaaaactcgtacactcgatacgtcaaacgtaaacactcaaacatcgatccacccacgttcctaccaaaaataccgaactctcgccatcgaccgacgcgacaaaaaaaaaaatcgcgcgaaaaccctccatccgactaaaaaaaaacaaaaaaaaaacgacgcgcgcgaaaaatat

SEQ ID NO: 8069 - DNA, 578 bp, Artificial Sequence
  chemically treated genomic DNA (Homo sapiens) CpG-island No: 8069
  misc_feature (515)..(515): n is either a, c, g or t
cggttttcgtttaggaagttttatttagcgggagttaggacgtcgcggcgtcggtagagtttacgagcgattcggcgagggcgcgtgcggcgtgacgacgcgattcgcggcgcgtttcgtgacgttatcgcgttcgtttttgaaagttggcgttcggggtcgttttttatgttgttttgcgttaatttttttttttattttttttttttcgttttttattcgtcgttcggtcggtttttttattcgtttttttttttattagtattcgcggtttcggtagcgtcgacgtaggcgtattgtatcgcgtcgtcgttattttgtgtttgagtttgtggagcgattaaatcgtgcgcggagttgtttttttggcggtagcggcggcggcggtggtcggtgcgacgcgcggagttcgtcggagacgtcgggtggtcggagtcgtggagcggcggcggagcgggcgtcgcggtggggtgtggttgcggaggtaagggggttcggggttggacggaggtttncgcggtgtttgtttttacggtgttatcgattgggtgtttgtttttgagtttggttgttaggtt

SEQ ID NO: 8070 - DNA, 578 bp, Artificial Sequence
  chemically treated genomic DNA (Homo sapiens) CpG-island No: 8070
  misc_feature (64)..(64): n is either a, c, g or t
aacctaacaaccaaactcaaaaacaaacacccaatcgataacaccgtaaaaacaaacaccgcgnaaacctccgtccaaccccgaacccccttacctccgcaaccacaccccaccgcgacgcccgctccgccgccgctccacgactccgaccacccgacgtctccgacgaactccgcgcgtcgcaccgaccaccgccgccgccgctaccgccaaaaaaacaactccgcgcacgatttaatcgctccacaaactcaaacacaaaataacgacgacgcgatacaatacgcctacgtcgacgctaccgaaaccgcgaatactaataaaaaaaaaaacgaataaaaaaaccgaccgaacgacgaataaaaaacgaaaaaaaaaaaataaaaaaaaaaattaacgcaaaacaacataaaaaacgaccccgaacgccaactttcaaaaacgaacgcgataacgtcacgaaacgcgccgcgaatcgcgtcgtcacgccgcacgcgccctcgccgaatcgctcgtaaactctaccgacgccgcgacgtcctaactcccgctaaataaaacttcctaaacgaaaaccg

SEQ ID NO: 8071 - DNA, 578 bp, Artificial Sequence
  chemically treated genomic DNA (Homo sapiens) CpG-island No: 8071
  misc_feature (64)..(64): n is either a, c, g or t
agtttagtagttagatttaggagtaggtatttagtcggtgatatcgtagaggtaggtatcgcgnaaattttcgtttaatttcgggtttttttattttcgtagttatattttatcgcggcgttcgtttcgtcgtcgttttacggtttcggttattcggcgttttcggcgagtttcgcgcgtcgtatcggttatcgtcgtcgtcgttgtcgttaaagaagtagtttcgcgtacggtttaatcgttttataggtttagatataaaatggcggcggcgcggtgtagtgcgtttgcgtcggcgttgtcggggtcgcgggtgttgataagggaagggacgggtggggggatcggtcgggcggcgagtagagggcgggggaggaaaggtgaggggaggggttggcgtagggtagtatgggaggcggtttcgggcgttaatttttaaaagcgggcgcgatggcgttacgggacgcgtcgcgagtcgcgtcgttacgtcgtacgcgttttcgtcgggtcgttcgtgggttttgtcggcgtcgcggcgttttggttttcgttgggtggggttttttgggcggaggtcg

SEQ ID NO: 8072 - DNA, 578 bp, Artificial Sequence
  chemically treated genomic DNA (Homo sapiens) CpG-island No: 8072
  misc_feature (515)..(515): n is either a, c, g or t
cgacctccgcccaaaaaaccccacccaacgaaaaccaaaacgccgcgacgccgacaaaacccacgaacgacccgacgaaaacgcgtacgacgtaacgacgcgactcgcgacgcgtcccgtaacgccatcgcgcccgcttttaaaaattaacgcccgaaaccgcctcccatactaccctacgccaacccctcccctcacctttcctcccccgccctctactcgccgcccgaccgatccccccacccgtcccttcccttatcaacacccgcgaccccgacaacgccgacgcaaacgcactacaccgcgccgccgccattttatatctaaacctataaaacgattaaaccgtacgcgaaactacttctttaacgacaacgacgacgacgataaccgatacgacgcgcgaaactcgccgaaaacgccgaataaccgaaaccgtaaaacgacgacgaaacgaacgccgcgataaaatataactacgaaaataaaaaaacccgaaattaaacgaaaatttncgcgatacctacctctacgatatcaccgactaaatacctactcctaaatctaactactaaact

SEQ ID NO: 8073 - DNA, 511 bp, Artificial Sequence
  chemically treated genomic DNA (Homo sapiens) CpG-island No: 8073
tggttgatgtgttggtgagtaagtagttttacgaagtaaataatatgattgatgcgttggcggcgttttttgcggcggttgtcgtatagttgttttgtcgtgacgcgttgatgtaggagtacgacgataagtggtattagaacggtttggtgatggataaatggtttattttgtaagttattagttcggcggcgaatgtgttggagacggtgcgcggtttgttgtagtatcgtttatttattatgagtaattcgaatcgtattcgttcgttgattggcgcgtttgcgggtagtaattcggtagcgttttatgtcgaagatggtagcggttatttgtttttggtggaaatgtttatcgattttaatagtcgtaattcgtaggtggttttacgtttgattgaatcgttgattcgtttgaaacgttacgatgttaaacgttaggagaaaatgcgcgcggcgttggaatagttgaaagggttggaaaatttttttggcgatttgtacgagaagat

SEQ ID NO: 8074 - DNA, 511 bp, Artificial Sequence
  chemically treated genomic DNA (Homo sapiens) CpG-island No: 8074
atcttctcgtacaaatcgccaaaaaaattttccaaccctttcaactattccaacgccgcgcgcattttctcctaacgtttaacatcgtaacgtttcaaacgaatcaacgattcaatcaaacgtaaaaccacctacgaattacgactattaaaatcgataaacatttccaccaaaaacaaataaccgctaccatcttcgacataaaacgctaccgaattactacccgcaaacgcgccaatcaacgaacgaatacgattcgaattactcataataaataaacgatactacaacaaaccgcgcaccgtctccaacacattcgccgccgaactaataacttacaaaataaaccatttatccatcaccaaaccgttctaataccacttatcgtcgtactcctacatcaacgcgtcacgacaaaacaactatacgacaaccgccgcaaaaaacgccgccaacgcatcaatcatattatttacttcgtaaaactacttactcaccaacacatcaacca

SEQ ID NO: 8075 - DNA, 511 bp, Artificial Sequence
  chemically treated genomic DNA (Homo sapiens) CpG-island No: 8075
attttttcgtatagatcgttagagagattttttagtttttttaattgttttagcgtcgcgcgtatttttttttgacgtttggtatcgtaacgttttaggcgaattagcggtttaattagacgtgaagttatttgcgggttacggttgttgaggtcggtaagtatttttattaggaataggtaatcgttgttattttcggtatggaacgttgtcggattgttgttcgtaaacgcgttaattaacgaacgaatacggttcgggttgtttatggtaaatgagcgatgttgtaataggtcgcgtatcgtttttagtatattcgtcgtcgggttggtggtttgtaggataaattatttatttattattagatcgttttgatgttatttgtcgtcgtatttttgtattagcgcgttacggtaaggtagttgtgcggtaatcgtcgtagaaagcgtcgttagcgtattagttatattgtttgtttcgtggaattgtttgtttattagtatattagtta

SEQ ID NO: 8076 - DNA, 511 bp, Artificial Sequence
  chemically treated genomic DNA (Homo sapiens) CpG-island No: 8076
taactaatatactaataaacaaacaattccacgaaacaaacaatataactaatacgctaacgacgctttctacgacgattaccgcacaactaccttaccgtaacgcgctaatacaaaaatacgacgacaaataacatcaaaacgatctaataataaataaataatttatcctacaaaccaccaacccgacgacgaatatactaaaaacgatacgcgacctattacaacatcgctcatttaccataaacaacccgaaccgtattcgttcgttaattaacgcgtttacgaacaacaatccgacaacgttccataccgaaaataacaacgattacctattcctaataaaaatacttaccgacctcaacaaccgtaacccgcaaataacttcacgtctaattaaaccgctaattcgcctaaaacgttacgataccaaacgtcaaaaaaaaatacgcgcgacgctaaaacaattaaaaaaactaaaaaatctctctaacgatctatacgaaaaaat

SEQ ID NO: 8077 - DNA, 646 bp, Artificial Sequence
  chemically treated genomic DNA (Homo sapiens) CpG-island No: 8077
cggattagcgcgtatgcgtataggtgagtgttcgtttcgttttcgggtttggttatttgtttaagaaatttgttggttgttgtttttaggtcgttttcgggcggggatacggaattcggttatggaagattcgtcgggggttcgcgagtttcgggttcggtcgagagagcgggattcgggacggcgtttttatttagattaaggtcgtatttacgatcgatcgcgggatcgattcggggattcgcgtaggaagcgaagtagcgacgggaatcggcgaagggacggggatcgggattcggagagagattaggagagggacgggaatcgcgatcggaatcgggatcgggagagggagagagagagggaaagagattttggatttgatgtgttttcgtcgggatatatatagggacgcgggttttcgcgtaggtaatacggagtttgggaaaaatcgcgttaaagtcggacgcgggacggagttcggggattgatttgggacgtagtcgcgttttttgggttcgcgttttggtggaagtttcggagtcgtcgtagtcgtagaggaagggagatttttgggcgtcgtagattcgaaaggtgacgacggggtttggtgtgtttgttgttgattttttgttgtcgtggtgat

SEQ ID NO: 8078 - DNA, 646 bp, Artificial Sequence
  chemically treated genomic DNA (Homo sapiens) CpG-island No: 8078
atcaccacgacaacaaaaaatcaacaacaaacacaccaaaccccgtcgtcacctttcgaatctacgacgcccaaaaatctcccttcctctacgactacgacgactccgaaacttccaccaaaacgcgaacccaaaaaacgcgactacgtcccaaatcaatccccgaactccgtcccgcgtccgactttaacgcgatttttcccaaactccgtattacctacgcgaaaacccgcgtccctatatatatcccgacgaaaacacatcaaatccaaaatctctttccctctctctctccctctcccgatcccgattccgatcgcgattcccgtccctctcctaatctctctccgaatcccgatccccgtcccttcgccgattcccgtcgctacttcgcttcctacgcgaatccccgaatcgatcccgcgatcgatcgtaaatacgaccttaatctaaataaaaacgccgtcccgaatcccgctctctcgaccgaacccgaaactcgcgaacccccgacgaatcttccataaccgaattccgtatccccgcccgaaaacgacctaaaaacaacaaccaacaaatttcttaaacaaataaccaaacccgaaaacgaaacgaacactcacctatacgcatacgcgctaatccg

SEQ ID NO: 8079 - DNA, 646 bp, Artificial Sequence
  chemically treated genomic DNA (Homo sapiens) CpG-island No: 8079
gttattacggtagtaggaggttagtagtaggtatattaggtttcgtcgttatttttcgggtttgcggcgtttaggggtttttttttttttgcggttgcggcggtttcggggtttttattagggcgcgggtttaggaggcgcggttgcgttttaggttagttttcgggtttcgtttcgcgttcggttttggcgcggttttttttaaatttcgtgttatttgcgcgagggttcgcgtttttgtgtgtgtttcggcgggggtatattaggtttagggtttttttttttttttttttttttttttcggtttcggtttcggtcgcggttttcgttttttttttggttttttttcgggtttcggttttcgttttttcgtcggttttcgtcgttgtttcgttttttgcgcgggttttcgggtcggtttcgcggtcgatcgtgggtgcggttttggtttgggtgggggcgtcgtttcgggtttcgttttttcggtcgggttcggggttcgcgagttttcgacggattttttatggtcgggtttcgtgttttcgttcgggagcgatttgagggtaataattaataagttttttgggtaggtggttaagttcgggggcggggcgggtatttatttgtgcgtatgcgcgttagttcg

SEQ ID NO: 8080 - DNA, 646 bp, Artificial Sequence
  chemically treated genomic DNA (Homo sapiens) CpG-island No: 8080
cgaactaacgcgcatacgcacaaataaatacccgccccgcccccgaacttaaccacctacccaaaaaacttattaattattaccctcaaatcgctcccgaacgaaaacacgaaacccgaccataaaaaatccgtcgaaaactcgcgaaccccgaacccgaccgaaaaaacgaaacccgaaacgacgcccccacccaaaccaaaaccgcacccacgatcgaccgcgaaaccgacccgaaaacccgcgcaaaaaacgaaacaacgacgaaaaccgacgaaaaaacgaaaaccgaaacccgaaaaaaaaccaaaaaaaaaacgaaaaccgcgaccgaaaccgaaaccgaaaaaaaaaaaaaaaaaaaaaaaaaaaccctaaacctaatatacccccgccgaaacacacacaaaaacgcgaaccctcgcgcaaataacacgaaatttaaaaaaaaccgcgccaaaaccgaacgcgaaacgaaacccgaaaactaacctaaaacgcaaccgcgcctcctaaacccgcgccctaataaaaaccccgaaaccgccgcaaccgcaaaaaaaaaaaaacccctaaacgccgcaaacccgaaaaataacgacgaaacctaatatacctactactaacctcctactaccgtaataac

SEQ ID NO: 8081 - DNA, 634 bp, Artificial Sequence
  chemically treated genomic DNA (Homo sapiens) CpG-island No: 8081
tgtcgtcgtggtcgttgtacgagtagtttatttcggtgtcggaatatgcggagagcgtttggttgcgggtggacgtggatacgttggtttatcgttatagttattcgtttgatggcgagacgtggtatatcgtgtcggtgacgtatgaggcgtggaagttgtcggacgattatatcggcgggcgcggtttttttatcggcgcgtttgtgggtttgtattgcgaggatattagcggcgacggttgttacgcggatttcgattattttatttacgagtcggtttaacggtttaggtcgggtagtttagcgcgcgcgagagcgcgagttcggtttgttgaagttgttcgcggaaattagttagtttcgcgtcgtttacgcgggaggttagcgtcgataggtttagggcggcgatgacgcgggattcgtggttttatatcggtatcgttacgtagcgtacgttttgttcgtttttttcgttgtttagggcgtagttttgttcgcgggtttgcgttagggcgtttattaaggtttcgcgagacgcgagggtggcgggcgtaaaggtagtgtattgatagttttttagtgtattgtatttattttgttggacgatgaaatggaatagtttttaatatgtt

SEQ ID NO: 8082 - DNA, 634 bp, Artificial Sequence
  chemically treated genomic DNA (Homo sapiens) CpG-island No: 8082
aacatattaaaaactattccatttcatcgtccaacaaaataaatacaatacactaaaaaactatcaatacactacctttacgcccgccaccctcgcgtctcgcgaaaccttaataaacgccctaacgcaaacccgcgaacaaaactacgccctaaacaacgaaaaaaacgaacaaaacgtacgctacgtaacgataccgatataaaaccacgaatcccgcgtcatcgccgccctaaacctatcgacgctaacctcccgcgtaaacgacgcgaaactaactaatttccgcgaacaacttcaacaaaccgaactcgcgctctcgcgcgcgctaaactacccgacctaaaccgttaaaccgactcgtaaataaaataatcgaaatccgcgtaacaaccgtcgccgctaatatcctcgcaatacaaacccacaaacgcgccgataaaaaaaccgcgcccgccgatataatcgtccgacaacttccacgcctcatacgtcaccgacacgatataccacgtctcgccatcaaacgaataactataacgataaaccaacgtatccacgtccacccgcaaccaaacgctctccgcatattccgacaccgaaataaactactcgtacaacgaccacgacgaca

SEQ ID NO: 8083 - DNA, 634 bp, Artificial Sequence
  chemically treated genomic DNA (Homo sapiens) CpG-island No: 8083
gatatattaggggttattttattttatcgtttaataaaatgggtgtagtatattggagggttattagtatattatttttacgttcgttattttcgcgtttcgcgaagttttaatgagcgttttggcgtagattcgcgagtaaggttacgttttggatagcgaagagaacgagtagggcgtgcgttgcgtggcggtgtcggtgtggaattacgagtttcgcgttatcgtcgttttgagtttgtcgacgttgatttttcgcgtggacgacgcggagttggttaattttcgcgagtagttttagtaggtcgggttcgcgttttcgcgcgcgttgggttattcggtttgagtcgttagatcggttcgtaggtgaagtagtcgaagttcgcgtagtagtcgtcgtcgttgatgttttcgtagtgtaggtttataaacgcgtcggtgaagaagtcgcgttcgtcgatgtagtcgttcgatagtttttacgttttatacgttatcggtacggtgtgttacgtttcgttattaaacgagtagttgtagcggtagattagcgtatttacgtttattcgtagttagacgtttttcgtatgtttcggtatcggaatgggttgttcgtgtagcggttacgacggta

SEQ ID NO: 8084 - DNA, 634 bp, Artificial Sequence
  chemically treated genomic DNA (Homo sapiens) CpG-island No: 8084
taccgtcgtaaccgctacacgaacaacccattccgataccgaaacatacgaaaaacgtctaactacgaataaacgtaaatacgctaatctaccgctacaactactcgtttaataacgaaacgtaacacaccgtaccgataacgtataaaacgtaaaaactatcgaacgactacatcgacgaacgcgacttcttcaccgacgcgtttataaacctacactacgaaaacatcaacgacgacgactactacgcgaacttcgactacttcacctacgaaccgatctaacgactcaaaccgaataacccaacgcgcgcgaaaacgcgaacccgacctactaaaactactcgcgaaaattaaccaactccgcgtcgtccacgcgaaaaatcaacgtcgacaaactcaaaacgacgataacgcgaaactcgtaattccacaccgacaccgccacgcaacgcacgccctactcgttctcttcgctatccaaaacgtaaccttactcgcgaatctacgccaaaacgctcattaaaacttcgcgaaacgcgaaaataacgaacgtaaaaataatatactaataaccctccaatatactacacccattttattaaacgataaaataaaataacccctaatatatc

SEQ ID NO: 8085 - DNA, 869 bp, Artificial Sequence
  chemically treated genomic DNA (Homo sapiens) CpG-island No: 8085
  misc_feature (53)..(53): n is either a, c, g or t
  misc_feature (62)..(62): n is either a, c, g or t
  misc_feature (65)..(65): n is either a, c, g or t
  misc_feature (74)..(75): n is either a, c, g or t
  misc_feature (821)..(821): n is either a, c, g or t
  misc_feature (831)..(831): n is either a, c, g or t
  misc_feature (845)..(846): n is either a, c, g or t
  misc_feature (854)..(859): n is either a, c, g or t
agtttatacgtttaaatcgggataatcgtcgtcggggggatttttagagtggnttgttcgantgntgttaaggnnattaatagtagatattcgtgttagtattttgtcgcgtattatggttgaagtattcgacgttgtttgtttaggtcgttttggttcggttttggtcgatattttaaaagatatttagttaggtagcggtgatttggaatcgtggtttattatcgttgaaaacgaagtgatttttttatatgtcgaagttgagtaagcgcgttagatgttggtaaaagcgtaaaaatcgatgttgtacgttggcggtggcgtgggtatggcgtaggtagtttcggttttatttgaattagggttgatttgttgtatagcgtacgaacgtcggacgtttcgaggttatcgcgttcgtttagcgcgttggtttcggtagacgatagttttttatgtagcgttgtatttacgttagcgcgttgtttacgttgattcgatggtcggtagcgataaataacgggttatagcgcgttttgttgcgttagatttaggttagttgttcgtttttatttattagtggggttagcgcgttcggttcgttggagagcggttcgaatttatcgtagagtcgttttttcgttacgttaatggtcggtatatttattaataagttaaaatggttggcgacgttaagacggcgaggatgcgagattttatgattatcgataaatattaaattcggtttttgcgatagtattttttacgttgttagtagcgtaggatattcgcggaaggaaagaaaggggattttttagagtggnttgtcgcgantgtagatttatggnnattagttnnnnnngggatttttt

SEQ ID NO: 8086 - DNA, 869 bp, Artificial Sequence
  chemically treated genomic DNA (Homo sapiens) CpG-island No: 8086
  misc_feature (11)..(16): n is either a, c, g or t
  misc_feature (24)..(25): n is either a, c, g or t
  misc_feature (39)..(39): n is either a, c, g or t
  misc_feature (49)..(49): n is either a, c, g or t
  misc_feature (795)..(796): n is either a, c, g or t
  misc_feature (805)..(805): n is either a, c, g or t
  misc_feature (808)..(808): n is either a, c, g or t
  misc_feature (817)..(817): n is either a, c, g or t
aaaaaatcccnnnnnnaactaatnnccataaatctacantcgcgacaanccactctaaaaaatcccctttctttccttccgcgaatatcctacgctactaacaacgtaaaaaatactatcgcaaaaaccgaatttaatatttatcgataatcataaaatctcgcatcctcgccgtcttaacgtcgccaaccattttaacttattaataaatataccgaccattaacgtaacgaaaaaacgactctacgataaattcgaaccgctctccaacgaaccgaacgcgctaaccccactaataaataaaaacgaacaactaacctaaatctaacgcaacaaaacgcgctataacccgttatttatcgctaccgaccatcgaatcaacgtaaacaacgcgctaacgtaaatacaacgctacataaaaaactatcgtctaccgaaaccaacgcgctaaacgaacgcgataacctcgaaacgtccgacgttcgtacgctatacaacaaatcaaccctaattcaaataaaaccgaaactacctacgccatacccacgccaccgccaacgtacaacatcgatttttacgcttttaccaacatctaacgcgcttactcaacttcgacatataaaaaaatcacttcgttttcaacgataataaaccacgattccaaatcaccgctacctaactaaatatcttttaaaatatcgaccaaaaccgaaccaaaacgacctaaacaaacaacgtcgaatacttcaaccataatacgcgacaaaatactaacacgaatatctactattaatnnccttaacancantcgaacaanccactctaaaaatccccccgacgacgattatcccgatttaaacgtataaact

SEQ ID NO: 8087 - DNA, 869 bp, Artificial Sequence
  chemically treated genomic DNA (Homo sapiens) CpG-island No: 8087
  misc_feature (11)..(16): n is either a, c, g or t
  misc_feature (24)..(25): n is either a, c, g or t
  misc_feature (39)..(39): n is either a, c, g or t
  misc_feature (49)..(49): n is either a, c, g or t
  misc_feature (795)..(796): n is either a, c, g or t
  misc_feature (805)..(805): n is either a, c, g or t
  misc_feature (808)..(808): n is either a, c, g or t
  misc_feature (817)..(817): n is either a, c, g or t
gaggggttttnnnnnnaattgatnnttatgagtttgtantcgcgatagnttattttagaggatttttttttttttttttcgcgaatattttgcgttgttggtagcgtgggagatgttgtcgtaaaagtcggatttagtgtttgtcgatggttatgggatttcgtattttcgtcgttttggcgtcgttagttattttggtttattggtggatgtgtcgattattggcgtggcgaaaaaacggttttgcggtaaattcgaatcgttttttagcgaatcgggcgcgttggttttattgatggataaaggcgagtagttggtttgggtttggcgtagtaaagcgcgttgtaattcgttgtttatcgttatcggttatcgggttagcgtggatagcgcgttggcgtgggtataacgttgtatgaaaggttatcgtttgtcggagttaacgcgttgggcggacgcggtggtttcggaacgttcggcgttcgtgcgttatatagtaaattagttttaatttaggtaaagtcggaattgtttgcgttatatttacgttatcgttaacgtatagtatcggtttttgcgtttttgttagtatttggcgcgtttgtttaatttcggtatgtgggaaagttatttcgtttttaacggtggtgaattacggttttaggttatcgttgtttaattggatattttttgggatatcgattagaatcggattaggacgatttgagtaggtaacgtcgaatgttttagttatgatgcgcggtagggtattagtacggatatttattattgatnnttttgatantantcggatagnttattttgaggattttttcggcgacggttgtttcggtttaagcgtgtaggtt

SEQ ID NO: 8088 - DNA, 869 bp, Artificial Sequence
  chemically treated genomic DNA (Homo sapiens) CpG-island No: 8088
  misc_feature (53)..(53): n is either a, c, g or t
  misc_feature (62)..(62): n is either a, c, g or t
  misc_feature (65)..(65): n is either a, c, g or t
  misc_feature (74)..(75): n is either a, c, g or t
  misc_feature (821)..(821): n is either a, c, g or t
  misc_feature (831)..(831): n is either a, c, g or t
  misc_feature (845)..(846): n is either a, c, g or t
  misc_feature (854)..(859): n is either a, c, g or t
aacctacacgcttaaaccgaaacaaccgtcgccgaaaaaatcctcaaaataanctatccgantantatcaaaannatcaataataaatatccgtactaataccctaccgcgcatcataactaaaacattcgacgttacctactcaaatcgtcctaatccgattctaatcgatatcccaaaaaatatccaattaaacaacgataacctaaaaccgtaattcaccaccgttaaaaacgaaataactttcccacataccgaaattaaacaaacgcgccaaatactaacaaaaacgcaaaaaccgatactatacgttaacgataacgtaaatataacgcaaacaattccgactttacctaaattaaaactaatttactatataacgcacgaacgccgaacgttccgaaaccaccgcgtccgcccaacgcgttaactccgacaaacgataacctttcatacaacgttatacccacgccaacgcgctatccacgctaacccgataaccgataacgataaacaacgaattacaacgcgctttactacgccaaacccaaaccaactactcgcctttatccatcaataaaaccaacgcgcccgattcgctaaaaaacgattcgaatttaccgcaaaaccgttttttcgccacgccaataatcgacacatccaccaataaaccaaaataactaacgacgccaaaacgacgaaaatacgaaatcccataaccatcgacaaacactaaatccgacttttacgacaacatctcccacgctaccaacaacgcaaaatattcgcgaaaaaaaaaaaaaaaaatcctctaaaataanctatcgcgantacaaactcataannatcaattnnnnnnaaaacccctc

SEQ ID NO: 8089 - DNA, 862 bp, Artificial Sequence
  chemically treated genomic DNA (Homo sapiens) CpG-island No: 8089
  misc_feature (697)..(697): n is either a, c, g or t
  misc_feature (737)..(737): n is either a, c, g or t
cgttgcgggaggggttgtgggttagaagtgcgtcggatagtataattgataggatatttatacgttattatttatcggattttagtttaacgatatttttcggcggtcggggaggcgcggacgcggcggttgggttattttatatttgttgtttttcgtttgtcgtaatatggttatcgtttatttttttgtatttgttcgtttataattggcgtatattataacgcgtggatttttgtatttatttttattatatcgaaaagggtggttggtttatttacgaatacgattacgacgtttattgcgaattgtaatagcgggaatttcgtagtttcggcgtatgttggtatttttgtgtggagttataatcgacggagaaacgacgtatcgtttgatagttattcggacggaggggtgattatggttaggatcgacgttgtgtgcgcggacggaatttgcgtcgcggtgatttttcggcggtttgattaatcggacgtattgatatattttttttcgtatagattgttattcgtttgacggttatattttttattttgaattgttttgtcgtttcgatcgttgttttatattgcgtttttaaatgacggcgttagtattattttttatttattacggttttaggcgtttaatggcgttttttaaggcgtgaaaagttacgatttgtttatgtaaagtnttcgtattttcgtgatttgatatatggttgatttgaagtngcgggttttattaatttttggttcgatttttgtttttgggcgtgttttgtagatacggtaatgttttggcgatattttttgcgatcgagtcgtttaatagttgatttttgttaattgggtcggcg

SEQ ID NO: 8090 - DNA, 862 bp, Artificial Sequence
  chemically treated genomic DNA (Homo sapiens) CpG-island No: 8090
  misc_feature (126)..(126): n is either a, c, g or t
  misc_feature (166)..(166): n is either a, c, g or t
cgccgacccaattaacaaaaatcaactattaaacgactcgatcgcaaaaaatatcgccaaaacattaccgtatctacaaaacacgcccaaaaacaaaaatcgaaccaaaaattaataaaacccgcnacttcaaatcaaccatatatcaaatcacgaaaatacgaanactttacataaacaaatcgtaacttttcacgccttaaaaaacgccattaaacgcctaaaaccgtaataaataaaaaataatactaacgccgtcatttaaaaacgcaatataaaacaacgatcgaaacgacaaaacaattcaaaataaaaaatataaccgtcaaacgaataacaatctatacgaaaaaaaatatatcaatacgtccgattaatcaaaccgccgaaaaatcaccgcgacgcaaattccgtccgcgcacacaacgtcgatcctaaccataatcacccctccgtccgaataactatcaaacgatacgtcgtttctccgtcgattataactccacacaaaaataccaacatacgccgaaactacgaaattcccgctattacaattcgcaataaacgtcgtaatcgtattcgtaaataaaccaaccacccttttcgatataataaaaataaatacaaaaatccacgcgttataatatacgccaattataaacgaacaaatacaaaaaaataaacgataaccatattacgacaaacgaaaaacaacaaatataaaataacccaaccgccgcgtccgcgcctccccgaccgccgaaaaatatcgttaaactaaaatccgataaataataacgtataaatatcctatcaattatactatccgacgcacttctaacccacaacccctcccgcaacg

SEQ ID NO: 8091 - DNA, 862 bp, Artificial Sequence
  chemically treated genomic DNA (Homo sapiens) CpG-island No: 8091
  misc_feature (126)..(126): n is either a, c, g or t
  misc_feature (166)..(166): n is either a, c, g or t
cgtcggtttaattaataaaggttaattgttaggcggttcggtcgtaaagggtatcgttaaagtattatcgtgtttgtagggtacgtttaaaagtaaaagtcgggttaaggattaataaagttcgtnattttaggttaattatgtgttaggttacgggggtgcgggnattttgtataggtaggtcgtagttttttacgttttaaggggcgttattaaacgtttagggtcgtggtaagtgggggatagtgttggcgtcgttatttgggggcgtaatatggggtagcggtcggggcggtagggtagtttagggtggggggtgtaatcgttaggcgggtggtagtttgtacgagggaaagtgtgttagtgcgttcggttaattaggtcgtcggggagttatcgcggcgtagatttcgttcgcgtatatagcgtcggttttagttatagttattttttcgttcgggtgattgttaggcggtgcgtcgttttttcgtcgattgtggttttatatagggatgttagtatgcgtcggggttacggggttttcgttattatagttcgtagtaaacgtcgtagtcgtattcgtgggtaagttagttatttttttcggtatagtagggatgggtgtaggggtttacgcgttatagtgtgcgttaattgtaagcgggtaagtgtagaagagtaggcgatagttatattgcggtaagcgggaagtagtaagtataaggtagtttagtcgtcgcgttcgcgttttttcggtcgtcggggggtgtcgttgggttaaaattcggtaaataatagcgtataggtgttttgttaattatgttattcggcgtatttttagtttataatttttttcgtagcg

SEQ ID NO: 8092 - DNA, 862 bp, Artificial Sequence
  chemically treated genomic DNA (Homo sapiens) CpG-island No: 8092
  misc_feature (697)..(697): n is either a, c, g or t
  misc_feature (737)..(737): n is either a, c, g or t
cgctacgaaaaaaattataaactaaaaatacgccgaataacataattaacaaaacacctatacgctattatttaccgaattttaacccaacgacaccccccgacgaccgaaaaaacgcgaacgcgacgactaaactaccttatacttactacttcccgcttaccgcaatataactatcgcctactcttctacacttacccgcttacaattaacgcacactataacgcgtaaacccctacacccatccctactataccgaaaaaaataactaacttacccacgaatacgactacgacgtttactacgaactataataacgaaaaccccgtaaccccgacgcatactaacatccctatataaaaccacaatcgacgaaaaaacgacgcaccgcctaacaatcacccgaacgaaaaaataactataactaaaaccgacgctatatacgcgaacgaaatctacgccgcgataactccccgacgacctaattaaccgaacgcactaacacactttccctcgtacaaactaccacccgcctaacgattacaccccccaccctaaactaccctaccgccccgaccgctaccccatattacgcccccaaataacgacgccaacactatcccccacttaccacgaccctaaacgtttaataacgccccttaaaacgtaaaaaactacgacctacctatacaaaatncccgcacccccgtaacctaacacataattaacctaaaatnacgaactttattaatccttaacccgacttttacttttaaacgtaccctacaaacacgataatactttaacgataccctttacgaccgaaccgcctaacaattaacctttattaattaaaccgacg

SEQ ID NO: 8093 - DNA, 559 bp, Artificial Sequence
  chemically treated genomic DNA (Homo sapiens) CpG-island No: 8093
agaggcgagacgcgtcgagtcgcggcggcgggattcgagatcgagaaagagaggaatatggaacggagacggcgcggcgttcggggtggcggacgcgtacgtaggaagacgagaataagaagataaagtagaagagcgggacgagcggacgaaaggtcgagaggtaaagcgtttagcgtatttagagaaaggtaggagggacggtgacggggataggagaggacggaagaggaggtggaggataggacgttgagagaattcgaggagtagagatgagaaagtaggcgaatagaacgaagacggtttacgagagagtaacgcgatagtaaagaagttagaaagtagggtaaaggacgagaatcgatcgagcgtaataacgagaaagaggaattacgacgagagagaggagggtagcggcgcgaggagagtagagagaacgtattaggtacgcgtagatagtatcgaagtaagcgacgtagggggggtcgaggataatcgttagaggataagagtaataataggggtaatagagtataaacgatgagtagttagagagagt

SEQ ID NO: 8094 - DNA, 559 bp, Artificial Sequence
  chemically treated genomic DNA (Homo sapiens) CpG-island No: 8094
actctctctaactactcatcgtttatactctattacccctattattactcttatcctctaacgattatcctcgaccccccctacgtcgcttacttcgatactatctacgcgtacctaatacgttctctctactctcctcgcgccgctaccctcctctctctcgtcgtaattcctctttctcgttattacgctcgatcgattctcgtcctttaccctactttctaacttctttactatcgcgttactctctcgtaaaccgtcttcgttctattcgcctactttctcatctctactcctcgaattctctcaacgtcctatcctccacctcctcttccgtcctctcctatccccgtcaccgtccctcctacctttctctaaatacgctaaacgctttacctctcgacctttcgtccgctcgtcccgctcttctactttatcttcttattctcgtcttcctacgtacgcgtccgccaccccgaacgccgcgccgtctccgttccatattcctctctttctcgatctcgaatcccgccgccgcgactcgacgcgtctcgcctct

SEQ ID NO: 8095 - DNA, 559 bp, Artificial Sequence
  chemically treated genomic DNA (Homo sapiens) CpG-island No: 8095
attttttttggttgtttatcgtttgtgttttgttgtttttgttgttgtttttattttttggcggttgttttcggttttttttgcgtcgtttgtttcggtgttgtttgcgcgtgtttggtgcgttttttttgtttttttcgcgtcgttgtttttttttttttcgtcgtggtttttttttttcgttgttgcgttcggtcggttttcgttttttgttttgttttttgatttttttgttgtcgcgttgttttttcgtgggtcgttttcgttttgttcgtttgtttttttatttttgtttttcgagtttttttagcgttttgttttttattttttttttcgtttttttttattttcgttatcgttttttttgtttttttttaggtgcgttggacgttttgtttttcggtttttcgttcgttcgtttcgtttttttgttttgtttttttgttttcgtttttttgcgtgcgcgttcgttatttcgagcgtcgcgtcgttttcgttttatgtttttttttttttcggtttcggatttcgtcgtcgcgattcgacgcgtttcgttttt

SEQ ID NO: 8096 - DNA, 559 bp, Artificial Sequence
  chemically treated genomic DNA (Homo sapiens) CpG-island No: 8096
aaaaacgaaacgcgtcgaatcgcgacgacgaaatccgaaaccgaaaaaaaaaaaaacataaaacgaaaacgacgcgacgctcgaaataacgaacgcgcacgcaaaaaaacgaaaacaaaaaaacaaaacaaaaaaacgaaacgaacgaacgaaaaaccgaaaaacaaaacgtccaacgcacctaaaaaaaaacaaaaaaaacgataacgaaaataaaaaaaaacgaaaaaaaaaataaaaaacaaaacgctaaaaaaactcgaaaaacaaaaataaaaaaacaaacgaacaaaacgaaaacgacccacgaaaaaacaacgcgacaacaaaaaaatcaaaaaacaaaacaaaaaacgaaaaccgaccgaacgcaacaacgaaaaaaaaaaaccacgacgaaaaaaaaaaaaacaacgacgcgaaaaaaacaaaaaaaacgcaccaaacacgcgcaaacaacaccgaaacaaacgacgcaaaaaaaaccgaaaacaaccgccaaaaaataaaaacaacaacaaaaacaacaaaacacaaacgataaacaaccaaaaaaaat

SEQ ID NO: 8097 - DNA, 668 bp, Artificial Sequence
  chemically treated genomic DNA (Homo sapiens) CpG-island No: 8097
tcgtttaggtttcgtggtagtattagattaagggcgaggttgcgttgttcgtttttagagtatataggtcggtagtttagtagttgtagcgtattagcgtatagtttttgtacgcggcggattttggtaaagggtagcgtatggcgttaggtttgggagacgttgagcgtatttttggacgaagttttgaaggtttcgcggcgcgtattaggtttagattcgtgggtgatgttatggatttaggtttcgagttgtggcgtgagattgagtttagtgaaggcgtagagcgtacggatttttgttagcggttttcgcgttaggttttcgaagcgtattaggcggtagcggtcgcgtagaaagggtggcggtttgagtgtggcggtttcggcgatgcgtacgtggttacggtatatttcgcgtattacgcgtaggtcggggtcggtttttatttacgtgtcgttggtgtttagtacgatgtcgttgttacgcgttagagttttggttgtttgttttcgggagcgtagtacggttcgcgggtcgcgtattaggtgtacgatgcgtaggttgagcgcggggtcgttgagtagcgggtagagtatttgtaggttgaagaagcgtatttttttgagtattacgtggttgtaggagcggtaggtttttcgggttag

SEQ ID NO: 8098 - DNA, 668 bp, Artificial Sequence
  chemically treated genomic DNA (Homo sapiens) CpG-island No: 8098
ctaacccgaaaaacctaccgctcctacaaccacgtaatactcaaaaaaatacgcttcttcaacctacaaatactctacccgctactcaacgaccccgcgctcaacctacgcatcgtacacctaatacgcgacccgcgaaccgtactacgctcccgaaaacaaacaaccaaaactctaacgcgtaacaacgacatcgtactaaacaccaacgacacgtaaataaaaaccgaccccgacctacgcgtaatacgcgaaatataccgtaaccacgtacgcatcgccgaaaccgccacactcaaaccgccaccctttctacgcgaccgctaccgcctaatacgcttcgaaaacctaacgcgaaaaccgctaacaaaaatccgtacgctctacgccttcactaaactcaatctcacgccacaactcgaaacctaaatccataacatcacccacgaatctaaacctaatacgcgccgcgaaaccttcaaaacttcgtccaaaaatacgctcaacgtctcccaaacctaacgccatacgctaccctttaccaaaatccgccgcgtacaaaaactatacgctaatacgctacaactactaaactaccgacctatatactctaaaaacgaacaacgcaacctcgcccttaatctaatactaccacgaaacctaaacga

SEQ ID NO: 8099 - DNA, 668 bp, Artificial Sequence
  chemically treated genomic DNA (Homo sapiens) CpG-island No: 8099
ttggttcgggaggtttgtcgtttttatagttacgtggtgtttaaggaggtgcgtttttttaatttgtaggtgttttattcgttgtttagcgatttcgcgtttaatttacgtatcgtgtatttggtgcgcgattcgcgggtcgtgttgcgttttcgggagtagatagttaaggttttggcgcgtgataacggtatcgtgttgggtattaacggtacgtgggtggaggtcgatttcggtttgcgcgtggtgcgcgaggtgtgtcgtagttacgtacgtatcgtcgaggtcgttatatttaagtcgttattttttttgcgcggtcgttatcgtttggtgcgtttcgaggatttggcgcgggagtcgttggtagaaattcgtgcgttttacgtttttattgggtttagttttacgttatagttcgaggtttggatttataatattatttacggatttggatttggtgcgcgtcgcgaagtttttaagatttcgtttaggaatgcgtttaacgttttttaggtttggcgttatgcgttgttttttgttaagattcgtcgcgtgtaggaattgtgcgttggtgcgttgtagttgttgggttatcggtttgtgtattttgaggacgagtagcgtaatttcgtttttgatttggtgttgttacgaggtttgaacgg

SEQ ID NO: 8100 - DNA, 668 bp, Artificial Sequence
  chemically treated genomic DNA (Homo sapiens) CpG-island No: 8100
ccgttcaaacctcgtaacaacaccaaatcaaaaacgaaattacgctactcgtcctcaaaatacacaaaccgataacccaacaactacaacgcaccaacgcacaattcctacacgcgacgaatcttaacaaaaaacaacgcataacgccaaacctaaaaaacgttaaacgcattcctaaacgaaatcttaaaaacttcgcgacgcgcaccaaatccaaatccgtaaataatattataaatccaaacctcgaactataacgtaaaactaaacccaataaaaacgtaaaacgcacgaatttctaccaacgactcccgcgccaaatcctcgaaacgcaccaaacgataacgaccgcgcaaaaaaaataacgacttaaatataacgacctcgacgatacgtacgtaactacgacacacctcgcgcaccacgcgcaaaccgaaatcgacctccacccacgtaccgttaatacccaacacgataccgttatcacgcgccaaaaccttaactatctactcccgaaaacgcaacacgacccgcgaatcgcgcaccaaatacacgatacgtaaattaaacgcgaaatcgctaaacaacgaataaaacacctacaaattaaaaaaacgcacctccttaaacaccacgtaactataaaaacgacaaacctcccgaaccaa

SEQ ID NO: 8101 - DNA, 524 bp, Artificial Sequence
  chemically treated genomic DNA (Homo sapiens) CpG-island No: 8101
cgcgcgtatagtggtttgtatacggtttcgttgttgatggcgtttcggggaaaggtattgtaggcgggtggcgagtatagtgtacggtttacggtttattggaagaggtcggataggttgcggcgttaaggtagataggtattaaatacgtttatgtcgtataggaagacggagcgtattaggtcgcgtatagttatgtgtagcgttgcggcgttgttttgcgatagggtggtttatacgtgttacgcgggttttattaggtagaagacgtcggggtgttggttgaagagttggtttacgaaggacgagttcgagcgttacgaggatagtattagtatatgtacgcgcgtttcgtcgtttgttggggacgagggttttggtcgggaaattagaaagaggaggaggaaggtttgcgttaggaggagcgcggttattgttgtgttggagacgcgcggtagttatatgttgattgttgggggttttagggaggagagcgtagcggttaggggttgtagtttgtacgt

SEQ ID NO: 8102 - DNA, 524 bp, Artificial Sequence
  chemically treated genomic DNA (Homo sapiens) CpG-island No: 8102
acgtacaaactacaacccctaaccgctacgctctcctccctaaaacccccaacaatcaacatataactaccgcgcgtctccaacacaacaataaccgcgctcctcctaacgcaaaccttcctcctcctctttctaatttcccgaccaaaaccctcgtccccaacaaacgacgaaacgcgcgtacatatactaatactatcctcgtaacgctcgaactcgtccttcgtaaaccaactcttcaaccaacaccccgacgtcttctacctaataaaacccgcgtaacacgtataaaccaccctatcgcaaaacaacgccgcaacgctacacataactatacgcgacctaatacgctccgtcttcctatacgacataaacgtatttaatacctatctaccttaacgccgcaacctatccgacctcttccaataaaccgtaaaccgtacactatactcgccacccgcctacaatacctttccccgaaacgccatcaacaacgaaaccgtatacaaaccactatacgcgcg

SEQ ID NO: 8103 - DNA, 524 bp, Artificial Sequence
  chemically treated genomic DNA (Homo sapiens) CpG-island No: 8103
gcgtgtaggttgtagtttttaatcgttgcgtttttttttttaaggtttttagtagttagtatgtggttgtcgcgcgtttttagtatagtagtgatcgcgttttttttggcgtagatttttttttttttttttttggtttttcggttagggttttcgtttttagtaggcggcgaggcgcgcgtgtatgtgttggtgttgttttcgtggcgttcgggttcgtttttcgtgggttaattttttaattagtatttcgacgttttttatttaatggagttcgcgtggtacgtgtggattattttgtcgtagggtagcgtcgtaacgttgtatatggttgtgcgcgatttggtgcgtttcgtttttttgtgcgatatggacgtgtttgatgtttatttgttttggcgtcgtaatttgttcgattttttttagtgggtcgtgagtcgtgtattgtgttcgttattcgtttgtagtgttttttttcgaggcgttattagtagcgaggtcgtgtgtaagttattgtgcgcgcg

SEQ ID NO: 8104 - DNA, 524 bp, Artificial Sequence
  chemically treated genomic DNA (Homo sapiens) CpG-island No: 8104
cgcgcgcacaataacttacacacgacctcgctactaataacgcctcgaaaaaaaacactacaaacgaataacgaacacaatacacgactcacgacccactaaaaaaaatcgaacaaattacgacgccaaaacaaataaacatcaaacacgtccatatcgcacaaaaaaacgaaacgcaccaaatcgcgcacaaccatatacaacgttacgacgctaccctacgacaaaataatccacacgtaccacgcgaactccattaaataaaaaacgtcgaaatactaattaaaaaattaacccacgaaaaacgaacccgaacgccacgaaaacaacaccaacacatacacgcgcgcctcgccgcctactaaaaacgaaaaccctaaccgaaaaaccaaaaaaaaaaaaaaaaaaatctacgccaaaaaaaacgcgatcactactatactaaaaacgcgcgacaaccacatactaactactaaaaaccttaaaaaaaaaaacgcaacgattaaaaactacaacctacacgc

SEQ ID NO: 8105 - DNA, 686 bp, Artificial Sequence
  chemically treated genomic DNA (Homo sapiens) CpG-island No: 8105
agcggtgtcgttcggggttgatcgacgagcgtttttagcgataaggggtcgtgtttatgtgtcggttttcgcgttgtaagagggggcggcggtcggagttgtttaacgggaggggagtatagaatcgttacgcgtatacgtttcgggtcggagcggtcgaggatgaggggtttgagggagcggacgttcgagaataggagtttttttggattatttgggttatagggtagacgttcgcgggggtagagcgcgttttacgtgaggcgtggggcggggtaattcgtttttcgttttaggcggaatcgtttattcgacggtacgtagttttcgttttttttcgacgtagagaagttttcggagtcgaatttttttatgttgttgtcgttcgacgttggttaaatttataagatcgtagtagtcgtttttaacggtaaagttttagggagagattatagagtttcggcggcggcgacggtagttagggcggttttcgatagcgttttgtatatgcgtagagagtattacgtggttgttttacgatattttcggtcgatgttttcgggttggcgtttttgaagttttcgttgggagttcgaattcgttcggacgcggtgtatgttggaatttgtagttttcggcgttgtttcgtcgttttaatataataaatttgtttaaataaaattata

SEQ ID NO: 8106 - DNA, 686 bp, Artificial Sequence
  chemically treated genomic DNA (Homo sapiens) CpG-island No: 8106
tataattttatttaaacaaatttattatattaaaacgacgaaacaacgccgaaaactacaaattccaacatacaccgcgtccgaacgaattcgaactcccaacgaaaacttcaaaaacgccaacccgaaaacatcgaccgaaaatatcgtaaaacaaccacgtaatactctctacgcatatacaaaacgctatcgaaaaccgccctaactaccgtcgccgccgccgaaactctataatctctccctaaaactttaccgttaaaaacgactactacgatcttataaatttaaccaacgtcgaacgacaacaacataaaaaaattcgactccgaaaacttctctacgtcgaaaaaaaacgaaaactacgtaccgtcgaataaacgattccgcctaaaacgaaaaacgaattaccccgccccacgcctcacgtaaaacgcgctctacccccgcgaacgtctaccctataacccaaataatccaaaaaaactcctattctcgaacgtccgctccctcaaacccctcatcctcgaccgctccgacccgaaacgtatacgcgtaacgattctatactcccctcccgttaaacaactccgaccgccgccccctcttacaacgcgaaaaccgacacataaacacgaccccttatcgctaaaaacgctcgtcgatcaaccccgaacgacaccgct

SEQ ID NO: 8107 - DNA, 686 bp, Artificial Sequence
  chemically treated genomic DNA (Homo sapiens) CpG-island No: 8107
tgtaattttatttaagtaggtttattatattaaggcggcgaggtagcgtcgaagattataagttttagtatgtatcgcgttcgggcgggttcgggtttttagcgagggttttagggacgttagttcggaggtatcggtcggaagtgtcgtagggtaattacgtagtattttttgcgtatgtgtaaagcgttgtcgggggtcgttttagttgtcgtcgtcgtcgtcggggttttatggtttttttttagagttttgtcgttggaggcggttgttgcggttttgtgagtttgattagcgtcgagcggtagtaatatggaggaattcgatttcgaagatttttttacgtcggaggaggacgaggattacgtgtcgtcgggtgagcgatttcgtttgaggcgagaagcgaattgtttcgttttacgttttacgtgaggcgcgttttgttttcgcgggcgtttgttttgtggtttaggtggtttaggggggtttttgttttcgaacgttcgtttttttaggttttttattttcggtcgtttcggttcgaggcgtgtgcgcgtggcggttttgtgtttttttttcgttgggtagtttcggtcgtcgtttttttttgtagcgcgggaatcggtatatggatacggttttttgtcgttagggacgttcgtcggttagtttcgaacgatatcgtt

SEQ ID NO: 8108 - DNA, 686 bp, Artificial Sequence
  chemically treated genomic DNA (Homo sapiens) CpG-island No: 8108
aacgatatcgttcgaaactaaccgacgaacgtccctaacgacaaaaaaccgtatccatataccgattcccgcgctacaaaaaaaaacgacgaccgaaactacccaacgaaaaaaaaacacaaaaccgccacgcgcacacgcctcgaaccgaaacgaccgaaaataaaaaacctaaaaaaacgaacgttcgaaaacaaaaacccccctaaaccacctaaaccacaaaacaaacgcccgcgaaaacaaaacgcgcctcacgtaaaacgtaaaacgaaacaattcgcttctcgcctcaaacgaaatcgctcacccgacgacacgtaatcctcgtcctcctccgacgtaaaaaaatcttcgaaatcgaattcctccatattactaccgctcgacgctaatcaaactcacaaaaccgcaacaaccgcctccaacgacaaaactctaaaaaaaaaccataaaaccccgacgacgacgacgacaactaaaacgacccccgacaacgctttacacatacgcaaaaaatactacgtaattaccctacgacacttccgaccgatacctccgaactaacgtccctaaaaccctcgctaaaaacccgaacccgcccgaacgcgatacatactaaaacttataatcttcgacgctacctcgccgccttaatataataaacctacttaaataaaattaca

SEQ ID NO: 8109 - DNA, 527 bp, Artificial Sequence
  chemically treated genomic DNA (Homo sapiens) CpG-island No: 8109
tgcggtgttttacgtatttatttttgtattagcgtcgtaattagtaatattattattagttcggttattagacgaatcgtcgtaaaattttagtcgaggataaagtttataaatattagcgtcgtcgggtttaatatcggattgtttatttagaatgttagcgtatcgtttatcgatatttgttggcgacgtattttcgtcgcgatcggagtcgtatagtaggtatatattatgttcggtaacgaaaatagcgtttttagtagcgtgtcgcgaaagcgcgattgtttaagcgtacgtaataattagttacgcgggtattagtattttgaattaacgaatcgaggattatttttagtatcgtcgttttttatatcgcgaggaaatagattatcgcgtaatttaacgtcgtttgtttatgggttagtattcgtttgcgtaagggatagatttatcgatattgtgggtttcggtagtagtaaacgttttgtcgtagtaaggtttttattttatatattagagatcggtaa

SEQ ID NO: 8110 - DNA, 527 bp, Artificial Sequence
  chemically treated genomic DNA (Homo sapiens) CpG-island No: 8110
ttaccgatctctaatatataaaataaaaaccttactacgacaaaacgtttactactaccgaaacccacaatatcgataaatctatcccttacgcaaacgaatactaacccataaacaaacgacgttaaattacgcgataatctatttcctcgcgatataaaaaacgacgatactaaaaataatcctcgattcgttaattcaaaatactaatacccgcgtaactaattattacgtacgcttaaacaatcgcgctttcgcgacacgctactaaaaacgctattttcgttaccgaacataatatatacctactatacgactccgatcgcgacgaaaatacgtcgccaacaaatatcgataaacgatacgctaacattctaaataaacaatccgatattaaacccgacgacgctaatatttataaactttatcctcgactaaaattttacgacgattcgtctaataaccgaactaataataatattactaattacgacgctaatacaaaaataaatacgtaaaacaccgca

SEQ ID NO: 8111 - DNA, 527 bp, Artificial Sequence
  chemically treated genomic DNA (Homo sapiens) CpG-island No: 8111
ttgtcggtttttggtatgtgaaatgggaattttattacggtaaagcgtttattgttgtcgaaatttatagtatcggtaaatttattttttgcgtaggcggatgttaatttatgggtaggcggcgttggattacgcgatgatttattttttcgcggtatggaaagcggcggtgttgggggtgattttcggttcgttgatttagggtgttgatgttcgcgtgattggttgttgcgtacgtttgggtaatcgcgttttcgcggtacgttgttgggaacgttgttttcgttgtcgggtatgatgtgtatttgttgtgcggtttcggtcgcggcgggaatgcgtcgttaataggtgtcgatgggcggtgcgttggtattttggatgggtaattcggtgttaaattcggcgacgttggtgtttatgggttttgttttcggttggggttttgcggcgattcgtttggtggtcgggttggtgatggtgttgttgattgcgacgttggtgtaaaaatgggtgcgtgaaatatcgta

SEQ ID NO: 8112 - DNA, 527 bp, Artificial Sequence
  chemically treated genomic DNA (Homo sapiens) CpG-island No: 8112
tacgatatttcacgcacccatttttacaccaacgtcgcaatcaacaacaccatcaccaacccgaccaccaaacgaatcgccgcaaaaccccaaccgaaaacaaaacccataaacaccaacgtcgccgaatttaacaccgaattacccatccaaaataccaacgcaccgcccatcgacacctattaacgacgcattcccgccgcgaccgaaaccgcacaacaaatacacatcatacccgacaacgaaaacaacgttcccaacaacgtaccgcgaaaacgcgattacccaaacgtacgcaacaaccaatcacgcgaacatcaacaccctaaatcaacgaaccgaaaatcacccccaacaccgccgctttccataccgcgaaaaaataaatcatcgcgtaatccaacgccgcctacccataaattaacatccgcctacgcaaaaaataaatttaccgatactataaatttcgacaacaataaacgctttaccgtaataaaattcccatttcacataccaaaaaccgacaa

SEQ ID NO: 8113 - DNA, 634 bp, Artificial Sequence
  chemically treated genomic DNA (Homo sapiens) CpG-island No: 8113
  misc_feature (427)..(427): n is either a, c, g or t
gttcgtagcgacgtagttgttcgatttgtcggtttaggtcgttgattttcgttatggtttattttcggcgcgggttagagtcggggtcgcgtttttttcgtacgtataggggttttttgggaaaggttaagacgagttcgcggattagtgttcgttcggggttcggagcggataattcgattttagagtcggttcggtttttttattttcgtttttttttatattggttttaggatttttcggcgtttaacggtttggtcgtattttcgttaattttcgtcgaatttcgcggtttcgcgttaaggacggtgatttagaggagtttcgtattattatcgtcgttgcgatttcggtttcggtttttcggttttttgttttttttttttatttcgttttcgatcgtcgtcgtcgtcgtcgtcgtcgtttntattttcggtttcgtcgcggaagtaaaggaggttagtttcgtcgcgcgtcggatgtggcgttatatacgttttttttttttcgtagcgatttttgattatttttttagtcgagatcgggaaggaggtggaggaattcggtggcggttagtggtagttttgtgggttttgtcgttgggcgatgtggaggttattagaaattttagatt

SEQ ID NO: 8114 - DNA, 634 bp, Artificial Sequence
  chemically treated genomic DNA (Homo sapiens) CpG-island No: 8114
  misc_feature (208)..(208): n is either a, c, g or t
aatctaaaatttctaataacctccacatcgcccaacgacaaaacccacaaaactaccactaaccgccaccgaattcctccacctccttcccgatctcgactaaaaaaataatcaaaaatcgctacgaaaaaaaaaaaacgtatataacgccacatccgacgcgcgacgaaactaacctcctttacttccgcgacgaaaccgaaaatanaaacgacgacgacgacgacgacgacgatcgaaaacgaaataaaaaaaaaaaacaaaaaaccgaaaaaccgaaaccgaaatcgcaacgacgataataatacgaaactcctctaaatcaccgtccttaacgcgaaaccgcgaaattcgacgaaaattaacgaaaatacgaccaaaccgttaaacgccgaaaaatcctaaaaccaatataaaaaaaaacgaaaataaaaaaaccgaaccgactctaaaatcgaattatccgctccgaaccccgaacgaacactaatccgcgaactcgtcttaacctttcccaaaaaacccctatacgtacgaaaaaaacgcgaccccgactctaacccgcgccgaaaataaaccataacgaaaatcaacgacctaaaccgacaaatcgaacaactacgtcgctacgaac

SEQ ID NO: 8115 - DNA, 634 bp, Artificial Sequence
  chemically treated genomic DNA (Homo sapiens) CpG-island No: 8115
  misc_feature (208)..(208): n is either a, c, g or t
ggtttagggtttttaatagtttttatatcgtttagcggtagagtttataaaattgttattggtcgttatcgggtttttttatttttttttcgatttcggttggagaagtggttaggggtcgttgcgaaaggagaggagcgtgtatgacgttatattcggcgcgcggcggaattggttttttttgttttcgcggcggggtcggaagtangagcggcggcggcggcggcggcggcggtcgaaagcggagtgaaagaaggaggtagggagtcggagagtcggaatcggagtcgtagcggcggtaatagtgcgagatttttttaagttatcgtttttagcgcgggatcgcggggttcgacgggagttagcgggggtgcggttaggtcgttggacgtcggggggttttggggttaatgtgaggggaggcgggggtgggggagtcgggtcggttttagaatcgagttgttcgtttcgagtttcggacggatattgattcgcgggttcgttttggttttttttaggagatttttgtgcgtgcggagggggcgcggtttcgattttgattcgcgtcgggggtgggttatggcggagattagcgatttggatcggtagatcgagtagttgcgtcgttgcgagt

SEQ ID NO: 8116 - DNA, 634 bp, Artificial Sequence
  chemically treated genomic DNA (Homo sapiens) CpG-island No: 8116
  misc_feature (427)..(427): n is either a, c, g or t
actcgcaacgacgcaactactcgatctaccgatccaaatcgctaatctccgccataacccacccccgacgcgaatcaaaatcgaaaccgcgccccctccgcacgcacaaaaatctcctaaaaaaaaccaaaacgaacccgcgaatcaatatccgtccgaaactcgaaacgaacaactcgattctaaaaccgacccgactcccccacccccgcctcccctcacattaaccccaaaaccccccgacgtccaacgacctaaccgcacccccgctaactcccgtcgaaccccgcgatcccgcgctaaaaacgataacttaaaaaaatctcgcactattaccgccgctacgactccgattccgactctccgactccctacctccttctttcactccgctttcgaccgccgccgccgccgccgccgccgctcntacttccgaccccgccgcgaaaacaaaaaaaaccaattccgccgcgcgccgaatataacgtcatacacgctcctctcctttcgcaacgacccctaaccacttctccaaccgaaatcgaaaaaaaaataaaaaaacccgataacgaccaataacaattttataaactctaccgctaaacgatataaaaactattaaaaaccctaaacc

SEQ ID NO: 8117 - DNA, 533 bp, Artificial Sequence
  chemically treated genomic DNA (Homo sapiens) CpG-island No: 8117
agtcgtgcgttgggagtattggcgtgatattatagagtagttgcgttttggcgaatggtagtacgggtgtttagttagcgtttggcgatattattcgtgtcggatcgttattagcgggtttggtatttgtagtttaggttatcgttattgagatatttttgttaggcggttgttgtaaataagtttaatatcgtcgtttttttagcgcggatagtttggcgttttaggatatacgagttattttgatttcgttaaacgcgacggcgcggtagtttattggtttgtaaattgagttatgtgcgtcgttgttatagtgtataaatacgcggtatgttttacgggcgtagtagttaacgtttagattgggttgtggataacgggagtgttaacgttttttgatatgtcgttagatgtaggttttttgggagcgtaggtcgacgttgggtcgattattttaagggggttgtatattaatgatagatttttgattattaaaggtgtaagtttttcgatatgtttgaattgaatttgag

SEQ ID NO: 8118 - DNA, 533 bp, Artificial Sequence
  chemically treated genomic DNA (Homo sapiens) CpG-island No: 8118
ctcaaattcaattcaaacatatcgaaaaacttacacctttaataatcaaaaatctatcattaatatacaacccccttaaaataatcgacccaacgtcgacctacgctcccaaaaaacctacatctaacgacatatcaaaaaacgttaacactcccgttatccacaacccaatctaaacgttaactactacgcccgtaaaacataccgcgtatttatacactataacaacgacgcacataactcaatttacaaaccaataaactaccgcgccgtcgcgtttaacgaaatcaaaataactcgtatatcctaaaacgccaaactatccgcgctaaaaaaacgacgatattaaacttatttacaacaaccgcctaacaaaaatatctcaataacgataacctaaactacaaataccaaacccgctaataacgatccgacacgaataatatcgccaaacgctaactaaacacccgtactaccattcgccaaaacgcaactactctataatatcacgccaatactcccaacgcacgact

SEQ ID NO: 8119 - DNA, 533 bp, Artificial Sequence
  chemically treated genomic DNA (Homo sapiens) CpG-island No: 8119
tttaggtttaatttaggtatatcgggagatttgtatttttagtagttaagggtttgttattggtgtgtaatttttttagaatagtcgatttaacgtcggtttacgtttttagggagtttatatttaacgatatattagaggacgttagtattttcgttgtttatagtttagtttgagcgttaattattacgttcgtggggtatatcgcgtgtttatgtattgtaataacggcgtatatggtttagtttatagattagtggattatcgcgtcgtcgcgtttggcggaattaaagtggttcgtgtattttggggcgttagattattcgcgttggaagggcgacgatgttaagtttatttatagtaatcgtttgatagaaatgttttaatgacggtggtttgggttataggtattaggttcgttgatggcggttcggtacggatgatgtcgttaaacgttgattgggtattcgtattgttattcgttagaacgtagttattttgtggtattacgttaatatttttaacgtacggtt

SEQ ID NO: 8120 - DNA, 533 bp, Artificial Sequence
  chemically treated genomic DNA (Homo sapiens) CpG-island No: 8120
aaccgtacgttaaaaatattaacgtaataccacaaaataactacgttctaacgaataacaatacgaatacccaatcaacgtttaacgacatcatccgtaccgaaccgccatcaacgaacctaatacctataacccaaaccaccgtcattaaaacatttctatcaaacgattactataaataaacttaacatcgtcgcccttccaacgcgaataatctaacgccccaaaatacacgaaccactttaattccgccaaacgcgacgacgcgataatccactaatctataaactaaaccatatacgccgttattacaatacataaacacgcgatataccccacgaacgtaataattaacgctcaaactaaactataaacaacgaaaatactaacgtcctctaatatatcgttaaatataaactccctaaaaacgtaaaccgacgttaaatcgactattctaaaaaaattacacaccaataacaaacccttaactactaaaaatacaaatctcccgatatacctaaattaaacctaaa

SEQ ID NO: 8121 - DNA, 543 bp, Artificial Sequence
  chemically treated genomic DNA (Homo sapiens) CpG-island No: 8121
cgttaggtaggtcgataattaagtgggaatatattttagttcgcgttgacgtgttagttgggttgtacgttgataataggtaaaatatggtcgcggttgatgcgatgtagtgttttgtcgtgggcggtttgtagtttagttttagttatatttcgtaattttggtttttatattcgtaaagtagtttagtatcgtattcggtacgtagttcgggcgggtatttatatataaacgataatattggtttggtttatcgtttgttgatatatagaacgtagtatcgaattttcgtaaaggtgttggtatacgtttgaaagtaggttagatagcgttagcgcggttaattaaattcgtttggtgcgttagttgttcggtaatggacgatgttgttgcgttttatcggtaaacgaggtaatattatagaatgtgagttattacgttcgatggtatcgttacggttagggtagttaaaatcgtttgtagcgttagtttatgtattttttgtttataacgacgggtgagattatattaaatatattgatt

SEQ ID NO: 8122 - DNA, 543 bp, Artificial Sequence
  chemically treated genomic DNA (Homo sapiens) CpG-island No: 8122
aatcaatatatttaatataatctcacccgtcgttataaacaaaaaatacataaactaacgctacaaacgattttaactaccctaaccgtaacgataccatcgaacgtaataactcacattctataatattacctcgtttaccgataaaacgcaacaacatcgtccattaccgaacaactaacgcaccaaacgaatttaattaaccgcgctaacgctatctaacctactttcaaacgtataccaacacctttacgaaaattcgatactacgttctatatatcaacaaacgataaaccaaaccaatattatcgtttatatataaatacccgcccgaactacgtaccgaatacgatactaaactactttacgaatataaaaaccaaaattacgaaatataactaaaactaaactacaaaccgcccacgacaaaacactacatcgcatcaaccgcgaccatattttacctattatcaacgtacaacccaactaacacgtcaacgcgaactaaaatatattcccacttaattatcgacctacctaacg

SEQ ID NO: 8123 - DNA, 543 bp, Artificial Sequence
  chemically treated genomic DNA (Homo sapiens) CpG-island No: 8123
agttaatatgtttggtgtgattttattcgtcgttatgggtaaaaggtgtataagttgacgttgtaggcggttttagttgttttaatcgtgacggtattatcgggcgtggtggtttatattttgtaatgttgtttcgtttgtcgatgaagcgtagtagtatcgtttattgtcgagtaattggcgtattaggcgaatttagttaatcgcgttaacgttatttggtttatttttaggcgtatattagtatttttgcggaagttcggtgttgcgttttatgtattagtaggcggtgagttaggttaatattgtcgtttgtgtgtgggtattcgttcggattgcgtgtcggatgcggtgttggattgttttgcgaatataaggattagggttacgaagtgtggttggagttgggttataaatcgtttacgataaaatattgtatcgtattaatcgcggttatattttgtttgttattagcgtataatttagttggtacgttagcgcgggttaaggtgtgtttttatttaattgtcggtttgtttggcg

SEQ ID NO: 8124 - DNA, 543 bp, Artificial Sequence
  chemically treated genomic DNA (Homo sapiens) CpG-island No: 8124
cgccaaacaaaccgacaattaaataaaaacacaccttaacccgcgctaacgtaccaactaaattatacgctaataacaaacaaaatataaccgcgattaatacgatacaatattttatcgtaaacgatttataacccaactccaaccacacttcgtaaccctaatccttatattcgcaaaacaatccaacaccgcatccgacacgcaatccgaacgaatacccacacacaaacgacaatattaacctaactcaccgcctactaatacataaaacgcaacaccgaacttccgcaaaaatactaatatacgcctaaaaataaaccaaataacgttaacgcgattaactaaattcgcctaatacgccaattactcgacaataaacgatactactacgcttcatcgacaaacgaaacaacattacaaaatataaaccaccacgcccgataataccgtcacgattaaaacaactaaaaccgcctacaacgtcaacttatacaccttttacccataacgacgaataaaatcacaccaaacatattaact

SEQ ID NO: 8125 - DNA, 608 bp, Artificial Sequence
  chemically treated genomic DNA (Homo sapiens) CpG-island No: 8125
  misc_feature (108)..(108): n is either a, c, g or t
  misc_feature (327)..(327): n is either a, c, g or t
  misc_feature (344)..(344): n is either a, c, g or t
  misc_feature (396)..(396): n is either a, c, g or t
  misc_feature (430)..(430): n is either a, c, g or t
  misc_feature (470)..(470): n is either a, c, g or t
gtggaagtttgtttgatttagcgttgatttttgagttaggcgcgttatttcgtttaaagggaagagttacgattcgttggatatcgatgaaattcgttggtttttagncgggtgtaaagttatttaacgtggtgttgacggacgtttgtaggttattttgtaggcgttgaaaatgaattgggcgatttcgtgttgtatatggatgggttgtgttgatgatttttttttatgacgttggtcgttggtagtggcgttattggggaaagggagttttatacgcgtatgtaatgttatttggcgatgtcgtaggataaggtgagtggtatngatagttagcgattatngttgatcgagtttttttacgggtttcgtatttagttataagtagcggtacgnatgacgcgtagtaagagtcgcgtttaagtttttngagtaagcgttatacgtttgggttattgttgttgtatagntatttcgtttcgtttagacgcgcgtcgttgttattggtattcgggtgtaaacgttgtttattggcggtagtgtgttatcgttattaatttaaaatttagcgtcgatgggcgcgattttatttattttttttttaaagg

SEQ ID NO: 8126 - DNA, 608 bp, Artificial Sequence
  chemically treated genomic DNA (Homo sapiens) CpG-island No: 8126
  misc_feature (139)..(139): n is either a, c, g or t
  misc_feature (179)..(179): n is either a, c, g or t
  misc_feature (213)..(213): n is either a, c, g or t
  misc_feature (265)..(265): n is either a, c, g or t
  misc_feature (282)..(282): n is either a, c, g or t
  misc_feature (501)..(501): n is either a, c, g or t
cctttaaaaaaaaaataaataaaatcgcgcccatcgacgctaaattttaaattaataacgataacacactaccgccaataaacaacgtttacacccgaataccaataacaacgacgcgcgtctaaacgaaacgaaatanctatacaacaacaataacccaaacgtataacgcttactcnaaaaacttaaacgcgactcttactacgcgtcatncgtaccgctacttataactaaatacgaaacccgtaaaaaaactcgatcaacnataatcgctaactatcnataccactcaccttatcctacgacatcgccaaataacattacatacgcgtataaaactccctttccccaataacgccactaccaacgaccaacgtcataaaaaaaaatcatcaacacaacccatccatatacaacacgaaatcgcccaattcattttcaacgcctacaaaataacctacaaacgtccgtcaacaccacgttaaataactttacacccgnctaaaaaccaacgaatttcatcgatatccaacgaatcgtaactcttccctttaaacgaaataacgcgcctaactcaaaaatcaacgctaaatcaaacaaacttccac

SEQ ID NO: 8127 - DNA, 608 bp, Artificial Sequence
  chemically treated genomic DNA (Homo sapiens) CpG-island No: 8127
  misc_feature (139)..(139): n is either a, c, g or t
  misc_feature (179)..(179): n is either a, c, g or t
  misc_feature (213)..(213): n is either a, c, g or t
  misc_feature (265)..(265): n is either a, c, g or t
  misc_feature (282)..(282): n is either a, c, g or t
  misc_feature (501)..(501): n is either a, c, g or t
tttttaaagaggaaataggtaggatcgcgtttatcgacgttaaattttaggttgatggcggtaatatattgtcgttagtgaatagcgtttgtattcgggtattagtgatagcggcgcgcgtttaaacggagcggaatgnttgtgtagtaatagtagtttagacgtatggcgtttgtttngagaatttaagcgcggtttttgttacgcgttatncgtatcgttatttgtaattaggtacgaaattcgtggagagattcggttagtngtaatcgttgattgttnatgttatttattttgttttgcgatatcgttaggtggtattgtatacgcgtgtaaaattttttttttttagtagcgttattgttagcggttagcgttatgggagaaaattattagtatagtttatttatatgtagtacgaaatcgtttagtttatttttagcgtttgtaagatggtttgtaaacgttcgttaatattacgttgggtgattttatattcgnttaaaggttagcggattttatcgatgtttagcgaatcgtgatttttttttttgaacgaagtaacgcgtttggtttaaaggttagcgttgggttagatagatttttat

SEQ ID NO: 8128 - DNA, 608 bp, Artificial Sequence
  chemically treated genomic DNA (Homo sapiens) CpG-island No: 8128
  misc_feature (108)..(108): n is either a, c, g or t
  misc_feature (327)..(327): n is either a, c, g or t
  misc_feature (344)..(344): n is either a, c, g or t
  misc_feature (396)..(396): n is either a, c, g or t
  misc_feature (430)..(430): n is either a, c, g or t
  misc_feature (470)..(470): n is either a, c, g or t
ataaaaatctatctaacccaacgctaacctttaaaccaaacgcgttacttcgttcaaaaaaaaaaatcacgattcgctaaacatcgataaaatccgctaacctttaancgaatataaaatcacccaacgtaatattaacgaacgtttacaaaccatcttacaaacgctaaaaataaactaaacgatttcgtactacatataaataaactatactaataattttctcccataacgctaaccgctaacaataacgctactaaaaaaaaaaaattttacacgcgtatacaataccacctaacgatatcgcaaaacaaaataaataacatnaacaatcaacgattacnactaaccgaatctctccacgaatttcgtacctaattacaaataacgatacgnataacgcgtaacaaaaaccgcgcttaaattctcnaaacaaacgccatacgtctaaactactattactacacaancattccgctccgtttaaacgcgcgccgctatcactaatacccgaatacaaacgctattcactaacgacaatatattaccgccatcaacctaaaatttaacgtcgataaacgcgatcctacctatttcctctttaaaaa

SEQ ID NO: 8129 - DNA, 507 bp, Artificial Sequence
  chemically treated genomic DNA (Homo sapiens) CpG-island No: 8129
  misc_feature (178)..(178): n is either a, c, g or t
  misc_feature (182)..(182): n is either a, c, g or t
tggcgttcggtcgaggcggtgtatttgacgttcgggagaagtagagcgcgttttttttggcgtggatttgggattttcgcgggttttaggggcggtacgttttggggtcggtattgggatttggttgcgaggtagttcggcggttaggaaggcgtcggcggcggcgggagggtgttangtantttcggttggtaattgttgttttagttttgtaatcgagcgtttttttttatcgcggtttgggttaatgatgggttttgtcggcgtgaacgtcgtgtttattatatttttattagtttaggggaggggtgcgcgtttgagcgttcggggtttaggaacgttagagttgtaacgtcgaaaattttttaggttgggaaaaggttttggggttttttatatacgtttttttcgtattcgtttggtttcgatttggttaagggcggattcggtttgtttttaggttggggggtttcggggtatcggggtgtattcggggttcgttttttt

SEQ ID NO: 8130 - DNA, 507 bp, Artificial Sequence
  chemically treated genomic DNA (Homo sapiens) CpG-island No: 8130
  misc_feature (326)..(326): n is either a, c, g or t
  misc_feature (330)..(330): n is either a, c, g or t
aaaaaaacgaaccccgaatacaccccgataccccgaaaccccccaacctaaaaacaaaccgaatccgcccttaaccaaatcgaaaccaaacgaatacgaaaaaaacgtatataaaaaaccccaaaaccttttcccaacctaaaaaattttcgacgttacaactctaacgttcctaaaccccgaacgctcaaacgcgcacccctcccctaaactaataaaaatataataaacacgacgttcacgccgacaaaacccatcattaacccaaaccgcgataaaaaaaaacgctcgattacaaaactaaaacaacaattaccaaccgaaantacntaacaccctcccgccgccgccgacgccttcctaaccgccgaactacctcgcaaccaaatcccaataccgaccccaaaacgtaccgcccctaaaacccgcgaaaatcccaaatccacgccaaaaaaaacgcgctctacttctcccgaacgtcaaatacaccgcctcgaccgaacgcca

SEQ ID NO: 8131 - DNA, 507 bp, Artificial Sequence
  chemically treated genomic DNA (Homo sapiens) CpG-island No: 8131
  misc_feature (326)..(326): n is either a, c, g or t
  misc_feature (330)..(330): n is either a, c, g or t
aagggggcgggtttcgggtgtatttcggtgtttcgaggttttttagtttgaaggtaggtcgaattcgtttttgattaagtcgaggttaagcgagtgcgaaaaaggcgtgtatgaggggttttaagatttttttttagtttgaaaagttttcggcgttgtagttttggcgtttttggatttcgggcgtttaggcgcgtattttttttttgggttggtgaaggtataataaatacggcgtttacgtcggtaggatttattattagtttaaatcgcggtggaaaggagcgttcggttgtagagttagaatagtagttattagtcggggntgtntggtattttttcgtcgtcgtcggcgtttttttggtcgtcgagttgtttcgtagttaggttttaatgtcgattttaaggcgtgtcgtttttggaattcgcgggggttttaggtttacgttaaaagaaacgcgttttgtttttttcgggcgttagatgtatcgtttcggtcggacgtta

SEQ ID NO: 8132 - DNA, 507 bp, Artificial Sequence
  chemically treated genomic DNA (Homo sapiens) CpG-island No: 8132
  misc_feature (178)..(178): n is either a, c, g or t
  misc_feature (182)..(182): n is either a, c, g or t
taacgtccgaccgaaacgatacatctaacgcccgaaaaaaacaaaacgcgtttcttttaacgtaaacctaaaacccccgcgaattccaaaaacgacacgccttaaaatcgacattaaaacctaactacgaaacaactcgacgaccaaaaaaacgccgacgacgacgaaaaaataccanacanccccgactaataactactattctaactctacaaccgaacgctcctttccaccgcgatttaaactaataataaatcctaccgacgtaaacgccgtatttattataccttcaccaacccaaaaaaaaaatacgcgcctaaacgcccgaaatccaaaaacgccaaaactacaacgccgaaaacttttcaaactaaaaaaaaatcttaaaacccctcatacacgcctttttcgcactcgcttaacctcgacttaatcaaaaacgaattcgacctaccttcaaactaaaaaacctcgaaacaccgaaatacacccgaaacccgccccctt

SEQ ID NO: 8133 - DNA, 580 bp, Artificial Sequence
  chemically treated genomic DNA (Homo sapiens) CpG-island No: 8133
  misc_feature (287)..(287): n is either a, c, g or t
  misc_feature (347)..(347): n is either a, c, g or t
gttggtttttcgggagggtttttgcggcgcggggcgtagtgtttatgtcgttcgggttttttgcgttgcggggagcgtagcgtaagttttcgtttgttatgagttattttttcgattttcggttgtttgttttggtcgtttcgtttatgttgtatttgtacggtttcgagagattcggtttttttttggttttcgttttcgcggttgttttagttgtttcgggtcgggtcgagatttcgtaaaagtttttttatagttatatcgcgtttatcggtatggcgatttangacgcgttcgagtagaaggttacgtttaacggtatttattaatttattatggatcggttntttttttattacgaatattcgtagggttggtagataagattcggtataattttttgtttaacgattggtttgttaaggtgttcgcgagaaaagggcggcgggtgtagtaaatagaatggcggtgtcggtggtagagaattagttaaatttaaatacggcggtatagtttaaaaaaataatatttttatgttttgcgtatcggagatgaggtttcgatttagtttttgaagaaa

SEQ ID NO: 8134 - DNA, 580 bp, Artificial Sequence
  chemically treated genomic DNA (Homo sapiens) CpG-island No: 8134
  misc_feature (234)..(234): n is either a, c, g or t
  misc_feature (294)..(294): n is either a, c, g or t
tttcttcaaaaactaaatcgaaacctcatctccgatacgcaaaacataaaaatattatttttttaaactataccgccgtatttaaatttaactaattctctaccaccgacaccgccattctatttactacacccgccgcccttttctcgcgaacaccttaacaaaccaatcgttaaacaaaaaattataccgaatcttatctaccaaccctacgaatattcgtaataaaaaaanaaccgatccataataaattaataaataccgttaaacgtaaccttctactcgaacgcgtcntaaatcgccataccgataaacgcgatataactataaaaaaacttttacgaaatctcgacccgacccgaaacaactaaaacaaccgcgaaaacgaaaaccaaaaaaaaaccgaatctctcgaaaccgtacaaatacaacataaacgaaacgaccaaaacaaacaaccgaaaatcgaaaaaataactcataacaaacgaaaacttacgctacgctccccgcaacgcaaaaaacccgaacgacataaacactacgccccgcgccgcaaaaaccctcccgaaaaaccaac

SEQ ID NO: 8135 - DNA, 580 bp, Artificial Sequence
  chemically treated genomic DNA (Homo sapiens) CpG-island No: 8135
  misc_feature (234)..(234): n is either a, c, g or t
  misc_feature (294)..(294): n is either a, c, g or t
tttttttagaggttgagtcggggttttattttcggtgcgtagagtatgaagatgttgtttttttggattatgtcgtcgtgtttaagtttgattggttttttgttatcggtatcgttattttgtttgttgtattcgtcgtttttttttcgcgggtattttaataaattagtcgttgagtaaaaggttgtgtcgaattttgtttgttagttttgcgggtgttcgtggtagaagggnaatcggtttatgatgaattggtagatgtcgttgagcgtgattttttgttcgggcgcgttntggatcgttatgtcgatgagcgcgatgtagttgtaggagggtttttgcggggtttcggttcggttcgaggtagttagagtagtcgcgggggcgaaggttagagggaggtcgggtttttcgggatcgtatagatatagtatgggcgaggcggttagggtaggtagtcggggatcgaagaggtgatttatggtaagcgagagtttgcgttgcgtttttcgtaacgtaggagattcgggcggtataggtattgcgtttcgcgtcgtaagggttttttcggggagttagt

SEQ ID NO: 8136 - DNA, 580 bp, Artificial Sequence
  chemically treated genomic DNA (Homo sapiens) CpG-island No: 8136
  misc_feature (287)..(287): n is either a, c, g or t
  misc_feature (347)..(347): n is either a, c, g or t
actaactccccgaaaaaacccttacgacgcgaaacgcaatacctataccgcccgaatctcctacgttacgaaaaacgcaacgcaaactctcgcttaccataaatcacctcttcgatccccgactacctaccctaaccgcctcgcccatactatatctatacgatcccgaaaaacccgacctccctctaaccttcgcccccgcgactactctaactacctcgaaccgaaccgaaaccccgcaaaaaccctcctacaactacatcgcgctcatcgacataacgatccanaacgcgcccgaacaaaaaatcacgctcaacgacatctaccaattcatcataaaccgattncccttctaccacgaacacccgcaaaactaacaaacaaaattcgacacaaccttttactcaacgactaatttattaaaatacccgcgaaaaaaaaacgacgaatacaacaaacaaaataacgataccgataacaaaaaaccaatcaaacttaaacacgacgacataatccaaaaaaacaacatcttcatactctacgcaccgaaaataaaaccccgactcaacctctaaaaaaa

SEQ ID NO: 8137 - DNA, 638 bp, Artificial Sequence
  chemically treated genomic DNA (Homo sapiens) CpG-island No: 8137
ttcggtacggtttcggtttcgtggtgtttcgtgtttcgcgttagggttttttcgatgtttttttgacgtttttaatttttttttatttcgtttgttttttttggatttttcggattttttttaatcgttttaaatatttttttggtttttttaacgtggtgttatcgcggtcgttttttatttatatttaaaatattatatcgtcgggtttcgcgtttaattggtggttttcggtcggggttatcgttttcgttatttttagtttcgaggtttttatttggtagggatttttcgtttttttcggtttcgttattttcgcgcgtttatttttacggtaacgttttttttagatggtgtcggtgtggaggatgcgtcggaatttcgtgtagatttgggttaagttgggtaggttcgtgttcggtagcgacgcgaagatttttattagtagttcgggcggtagttttagtagcgagtagcgcgggggcggcggcgaggggttcgcgtataagtcgttttcgatttcggcgttagtttcgatgcgttttttttcggggtttgtgttcggttcgttgtcggtcgtcgtcgtttcggtcgggtttcggcgttgttggcggcgttagatattcgcgcgacgggtt

SEQ ID NO: 8138 - DNA, 638 bp, Artificial Sequence
  chemically treated genomic DNA (Homo sapiens) CpG-island No: 8138
aacccgtcgcgcgaatatctaacgccgccaacaacgccgaaacccgaccgaaacgacgacgaccgacaacgaaccgaacacaaaccccgaaaaaaaacgcatcgaaactaacgccgaaatcgaaaacgacttatacgcgaacccctcgccgccgcccccgcgctactcgctactaaaactaccgcccgaactactaataaaaatcttcgcgtcgctaccgaacacgaacctacccaacttaacccaaatctacacgaaattccgacgcatcctccacaccgacaccatctaaaaaaaacgttaccgtaaaaataaacgcgcgaaaataacgaaaccgaaaaaaacgaaaaatccctaccaaataaaaacctcgaaactaaaaataacgaaaacgataaccccgaccgaaaaccaccaattaaacgcgaaacccgacgatataatattttaaatataaataaaaaacgaccgcgataacaccacgttaaaaaaaccaaaaaaatatttaaaacgattaaaaaaaatccgaaaaatccaaaaaaaacaaacgaaataaaaaaaaattaaaaacgtcaaaaaaacatcgaaaaaaccctaacgcgaaacacgaaacaccacgaaaccgaaaccgtaccgaa

SEQ ID NO: 8139 - DNA, 638 bp, Artificial Sequence
  chemically treated genomic DNA (Homo sapiens) CpG-island No: 8139
ggttcgtcgcgcggatgtttggcgtcgttagtagcgtcggggttcggtcgagacggcggcggtcgatagcgagtcggatatagatttcgaggaggagcgtatcgaggttagcgtcggggtcgggggcggtttgtgcgcgggtttttcgtcgtcgttttcgcgttgttcgttgttggagttgtcgttcgagttgttggtggagattttcgcgtcgttgtcgggtacggatttatttagtttggtttaggtttgtacgaagtttcggcgtattttttatatcgatattatttggaggaggcgttgtcgtgagggtgagcgcgcgggggtggcggggtcgggaggggcggggggtttttgttaggtggaggtttcggagttgggagtggcgggggcggtggtttcggtcgggggttattagttgggcgcggggttcggcgatgtggtgttttgggtgtgggtggggagcggtcgcggtgatattacgttgagggggttagggaggtatttgaggcggttagggagggttcgaggggtttaagagaggtagacggggtagggaggggttgagggcgttagggaggtatcgaagaggttttgacgcggggtacgggatattacggggtcgaggtcgtgtcggg

SEQ ID NO: 8140 - DNA, 638 bp, Artificial Sequence
  chemically treated genomic DNA (Homo sapiens) CpG-island No: 8140
cccgacacgacctcgaccccgtaatatcccgtaccccgcgtcaaaacctcttcgatacctccctaacgccctcaacccctccctaccccgtctacctctcttaaacccctcgaaccctccctaaccgcctcaaatacctccctaaccccctcaacgtaatatcaccgcgaccgctccccacccacacccaaaacaccacatcgccgaaccccgcgcccaactaataacccccgaccgaaaccaccgcccccgccactcccaactccgaaacctccacctaacaaaaaccccccgcccctcccgaccccgccacccccgcgcgctcaccctcacgacaacgcctcctccaaataatatcgatataaaaaatacgccgaaacttcgtacaaacctaaaccaaactaaataaatccgtacccgacaacgacgcgaaaatctccaccaacaactcgaacgacaactccaacaacgaacaacgcgaaaacgacgacgaaaaacccgcgcacaaaccgcccccgaccccgacgctaacctcgatacgctcctcctcgaaatctatatccgactcgctatcgaccgccgccgtctcgaccgaaccccgacgctactaacgacgccaaacatccgcgcgacgaacc

SEQ ID NO: 8141 - DNA, 622 bp, Artificial Sequence
  chemically treated genomic DNA (Homo sapiens) CpG-island No: 8141
ttttcgttagatggacgttggacgcgtgagtatttagtcgtaaagtttatacggttttatatggttattgtattagttagtagagagttcgtgtcgatttttaagttttcggattcgttcgttgttgcgtatcgttgaataagtggacgtttatattattttgtgcgatggtagtgattgattaacgtttcggttcgggtatggggattcgcgttaagtttattaattattatatgagtatcgcgtttaatgcgttttcggtagaagtcgtcgttttgtgcgaagttttgaatttttttttcgatgttgtcgttaaagtgatgagcggtatcgtcgtcggtaaaggttattttattattttttggttaaataaagtttttagcggagatttttttttcgtttttatgatcgattttgtttataaggattttggtatcgtttttgatgtcgttaattagttgtatgtgttaatgtcgttggggttcgttttacgggaggtttatagttaggcgcgcgtagcgggtcgcggtcgttaggattggttcgttattttggaataggttcgtgttagtgtcgggatgattgttaaagtaaaaatgtaacgattggataaaggaataaa

SEQ ID NO: 8142 - DNA, 622 bp, Artificial Sequence
  chemically treated genomic DNA (Homo sapiens) CpG-island No: 8142
tttattcctttatccaatcgttacatttttactttaacaatcatcccgacactaacacgaacctattccaaaataacgaaccaatcctaacgaccgcgacccgctacgcgcgcctaactataaacctcccgtaaaacgaaccccaacgacattaacacatacaactaattaacgacatcaaaaacgataccaaaatccttataaacaaaatcgatcataaaaacgaaaaaaaaatctccgctaaaaactttatttaaccaaaaaataataaaataacctttaccgacgacgataccgctcatcactttaacgacaacatcgaaaaaaaaattcaaaacttcgcacaaaacgacgacttctaccgaaaacgcattaaacgcgatactcatataataattaataaacttaacgcgaatccccatacccgaaccgaaacgttaatcaatcactaccatcgcacaaaataatataaacgtccacttattcaacgatacgcaacaacgaacgaatccgaaaacttaaaaatcgacacgaactctctactaactaatacaataaccatataaaaccgtataaactttacgactaaatactcacgcgtccaacgtccatctaacgaaaa

SEQ ID NO: 8143 - DNA, 622 bp, Artificial Sequence
  chemically treated genomic DNA (Homo sapiens) CpG-island No: 8143
tttatttttttatttagtcgttatatttttattttggtagttatttcggtattgatacggatttgttttagaatggcggattagttttggcgatcgcgattcgttgcgcgcgtttggttataaatttttcgtgaggcggattttagcggtattggtatatgtagttggttggcgatattaagggcgatgttaagatttttatgggtaagatcgattatgaaggcgggagaaagattttcgttgaggattttgtttggttaggaagtggtgaagtgatttttatcggcggcggtatcgtttattattttgacggtaatatcgaagggaagatttagggtttcgtataaaacggcggtttttgtcgaaagcgtattgagcgcgatgtttatgtagtagttgatgagtttaacgcggatttttatgttcggatcgaagcgttgattaattattgttatcgtataggatggtgtggacgtttatttgtttagcggtgcgtagtagcgaacgagttcgaaggtttgagaatcggtacggattttttgttagttggtgtaatggttatatagagtcgtgtgggttttacggttagatatttacgcgtttaacgtttatttgacggaga

SEQ ID NO: 8144 - DNA, 622 bp, Artificial Sequence
  chemically treated genomic DNA (Homo sapiens) CpG-island No: 8144
tctccgtcaaataaacgttaaacgcgtaaatatctaaccgtaaaacccacacgactctatataaccattacaccaactaacaaaaaatccgtaccgattctcaaaccttcgaactcgttcgctactacgcaccgctaaacaaataaacgtccacaccatcctatacgataacaataattaatcaacgcttcgatccgaacataaaaatccgcgttaaactcatcaactactacataaacatcgcgctcaatacgctttcgacaaaaaccgccgttttatacgaaaccctaaatcttcccttcgatattaccgtcaaaataataaacgataccgccgccgataaaaatcacttcaccacttcctaaccaaacaaaatcctcaacgaaaatctttctcccgccttcataatcgatcttacccataaaaatcttaacatcgcccttaatatcgccaaccaactacatataccaataccgctaaaatccgcctcacgaaaaatttataaccaaacgcgcgcaacgaatcgcgatcgccaaaactaatccgccattctaaaacaaatccgtatcaataccgaaataactaccaaaataaaaatataacgactaaataaaaaaataaa

SEQ ID NO: 8145 - DNA, 571 bp, Artificial Sequence
  chemically treated genomic DNA (Homo sapiens) CpG-island No: 8145
atagttttgttataacggatgtattttgtagttcgtcgagattattagcgattttattgaagattggtgtatggtcggtagtagcgtatcgagcgcgatgatgaagaatattattttgtttagtcgttgtagcgatattttttattttagacgtttaaatagtgtcggagtaaattttagtgttattacgtcgatatagatggttatatagatcgtcgtttcgaatagtatcgagtttacgttgaagtgattcggaatgtagaagtacggtaggttttagtagcgatttacgtcgatagtgatcgataagttatttagtgagtaattaaatagattcgttaatagcgtcggacgtattagcggatggtattgtttacggttaaagacgtatatcgtttacgttagcgtttagtcgttataggtaaagtcggtgttaattagtaggttaaacgcgatttatacgttttacgggaagtcgcgtttagggttagagatagagttagacgaatattagaagttttataattaggagtatatagatgacgatagacggtttaaaaattatgatcgg

SEQ ID NO: 8146 - DNA, 571 bp, Artificial Sequence
  chemically treated genomic DNA (Homo sapiens) CpG-island No: 8146
ccgatcataatttttaaaccgtctatcgtcatctatatactcctaattataaaacttctaatattcgtctaactctatctctaaccctaaacgcgacttcccgtaaaacgtataaatcgcgtttaacctactaattaacaccgactttacctataacgactaaacgctaacgtaaacgatatacgtctttaaccgtaaacaataccatccgctaatacgtccgacgctattaacgaatctatttaattactcactaaataacttatcgatcactatcgacgtaaatcgctactaaaacctaccgtacttctacattccgaatcacttcaacgtaaactcgatactattcgaaacgacgatctatataaccatctatatcgacgtaataacactaaaatttactccgacactatttaaacgtctaaaataaaaaatatcgctacaacgactaaacaaaataatattcttcatcatcgcgctcgatacgctactaccgaccatacaccaatcttcaataaaatcgctaataatctcgacgaactacaaaatacatccgttataacaaaactat

SEQ ID NO: 8147 - DNA, 571 bp, Artificial Sequence
  chemically treated genomic DNA (Homo sapiens) CpG-island No: 8147
tcggttatgatttttggatcgtttatcgttatttgtatgtttttgattgtgaagtttttggtgttcgtttggttttgtttttgattttgaacgcggtttttcgtggggcgtgtggatcgcgtttgatttgttgattggtatcggttttgtttgtggcggttgggcgttggcgtgggcggtatacgtttttaatcgtgggtaatattattcgttggtgcgttcggcgttgttggcgagtttgtttggttatttattgggtggtttgtcgattattatcgacgtgggtcgttattggaatttgtcgtatttttatatttcgggttattttaacgtgaattcggtattgttcgagacggcggtttgtatgattatttatatcggcgtgatggtattggagtttgtttcggtattgtttgaacgtttggggtggaaggtgtcgttatagcgattaaataaggtgatgttttttattatcgcgttcggtgcgttgttgtcgattatgtattagtttttaatggggtcgttgatgatttcggcgggttataaggtgtattcgttgtggtagagttat

SEQ ID NO: 8148 - DNA, 571 bp, Artificial Sequence
  chemically treated genomic DNA (Homo sapiens) CpG-island No: 8148
ataactctaccacaacgaatacaccttataacccgccgaaatcatcaacgaccccattaaaaactaatacataatcgacaacaacgcaccgaacgcgataataaaaaacatcaccttatttaatcgctataacgacaccttccaccccaaacgttcaaacaataccgaaacaaactccaataccatcacgccgatataaataatcatacaaaccgccgtctcgaacaataccgaattcacgttaaaataacccgaaatataaaaatacgacaaattccaataacgacccacgtcgataataatcgacaaaccacccaataaataaccaaacaaactcgccaacaacgccgaacgcaccaacgaataatattacccacgattaaaaacgtataccgcccacgccaacgcccaaccgccacaaacaaaaccgataccaatcaacaaatcaaacgcgatccacacgccccacgaaaaaccgcgttcaaaatcaaaaacaaaaccaaacgaacaccaaaaacttcacaatcaaaaacatacaaataacgataaacgatccaaaaatcataaccga

SEQ ID NO: 8149 - DNA, 1366 bp, Artificial Sequence
  chemically treated genomic DNA (Homo sapiens) CpG-island No: 8149
acggttagttcgatagtcgggtatcgtcgcgttgatcgacgatttgattaaagtaggcgttgacggtttgttttttttgggtagcggtggcgagtttttttagttcggcgtcgaagagcgtaaagttattgttcgttttgttatcgattatgtcgatcgtcgcgtgtcggtgttgatcggtatcggcggtattaacgttcgggaaattatcgaatttagttagtacgcgtagtaggcgggcgcggacggtatcgtggtgattaatttttattattggaaagtgtcggaagcgaatttgattcgttatttcgagtaggtggtcgatagcgttacgttgtcggtgatgttttataatttttcggcgttgatcgggtaggatttgatttcggcgttggtgaaaattttcgtcgattcgcgtagtaatattatcggtattaaagatattatcgatttcgtcgtttatttgcgtagtatgatttatatcgttaaaggtgtttattcgtattttatcgtgttttgcggttacgacgattatttgtttaatattttgttgttcggcggcgacggggcgatatcggcgagcggtaattttgtttcgtaggtgtcggtgaattttttgaaagtttggcgcgacggggacgtggcgaaagcggtcgggtattattagattttgttgtaaatttcgtagatgtattagttggatacgtcgttggtgaacgtgattaaagaggcgatcgtgttttgcggtcgttttgtttttacgtacgtgttgtcgttcgtttcgtcgttggacgagtcgcgtaaggcgtagttgaaaattttgttgtaatagtttaagttttgttgagtcggacgataacgatgattattgagaaaatttttatttcgtaggacgacgcgttttatgcggtgattatttacgcggcggggtcgtagggcgttttgtcgttgatttcgtagatgttgatggaattttttagcggtaatttgttcggtatgacgtagaacgtcgggatgggttgggacgttaataagtttatcggtaaagaggtgttgattatcggtatttagggcggtattcgcgtcggagacggacgttaatcggcgggttatatatcggtatgggagaacgggtggtaaagatagggcgggaagagaaatttcgaagggggaattcgtcgcggtttcgtagagaatcgcgaggggtttataggatagttacggattagatacggtggacgaaaatcggaagagttcggcggatttttcgttataggggggaaatggttatacgtaagggtttttaattcgtgcgaaaatcgtataatgtgcggagattacggaatagagatgttttataacgttg

SEQ ID NO: 8150 - DNA, 1366 bp, Artificial Sequence
  chemically treated genomic DNA (Homo sapiens) CpG-island No: 8150
caacgttataaaacatctctattccgtaatctccgcacattatacgattttcgcacgaattaaaaacccttacgtataaccatttcccccctataacgaaaaatccgccgaactcttccgattttcgtccaccgtatctaatccgtaactatcctataaacccctcgcgattctctacgaaaccgcgacgaattcccccttcgaaatttctcttcccgccctatctttaccacccgttctcccataccgatatataacccgccgattaacgtccgtctccgacgcgaataccgccctaaataccgataatcaacacctctttaccgataaacttattaacgtcccaacccatcccgacgttctacgtcataccgaacaaattaccgctaaaaaattccatcaacatctacgaaatcaacgacaaaacgccctacgaccccgccgcgtaaataatcaccgcataaaacgcgtcgtcctacgaaataaaaattttctcaataatcatcgttatcgtccgactcaacaaaacttaaactattacaacaaaattttcaactacgccttacgcgactcgtccaacgacgaaacgaacgacaacacgtacgtaaaaacaaaacgaccgcaaaacacgatcgcctctttaatcacgttcaccaacgacgtatccaactaatacatctacgaaatttacaacaaaatctaataatacccgaccgctttcgccacgtccccgtcgcgccaaactttcaaaaaattcaccgacacctacgaaacaaaattaccgctcgccgatatcgccccgtcgccgccgaacaacaaaatattaaacaaataatcgtcgtaaccgcaaaacacgataaaatacgaataaacacctttaacgatataaatcatactacgcaaataaacgacgaaatcgataatatctttaataccgataatattactacgcgaatcgacgaaaattttcaccaacgccgaaatcaaatcctacccgatcaacgccgaaaaattataaaacatcaccgacaacgtaacgctatcgaccacctactcgaaataacgaatcaaattcgcttccgacactttccaataataaaaattaatcaccacgataccgtccgcgcccgcctactacgcgtactaactaaattcgataatttcccgaacgttaataccgccgataccgatcaacaccgacacgcgacgatcgacataatcgataacaaaacgaacaataactttacgctcttcgacgccgaactaaaaaaactcgccaccgctacccaaaaaaaacaaaccgtcaacgcctactttaatcaaatcgtcgatcaacgcgacgatacccgactatcgaactaaccgt

SEQ ID NO: 8151 - DNA, 1366 bp, Artificial Sequence
  chemically treated genomic DNA (Homo sapiens) CpG-island No: 8151
tagcgttgtagggtatttttatttcgtggttttcgtatattgtgcggttttcgtacgagttggggatttttacgtgtagttattttttttttgtggcggggagttcgtcgaattttttcggttttcgtttatcgtgtttaattcgtggttattttgtgggtttttcgcggttttttgcgaggtcgcgacgggtttttttttcggggttttttttttcgttttgtttttgttattcgtttttttatgtcggtgtgtagttcgtcgattggcgttcgttttcggcgcggatgtcgttttgagtgtcgataattagtatttttttgtcggtgagtttgttggcgttttagtttatttcggcgttttgcgttatgtcgaataggttgtcgttgggagattttattagtatttgcggggttagcggtagagcgttttgcggtttcgtcgcgtgggtgattatcgtataaaacgcgtcgttttgcggggtgaaaatttttttaatggttatcgttatcgttcggtttagtaaagtttgagttgttgtagtagggtttttagttgcgttttgcgcggttcgtttagcggcgaggcgggcggtagtacgtgcgtggagataggacgatcgtagagtacgatcgtttttttaattacgtttattaacggcgtatttagttgatatatttgcggaatttgtagtaaggtttgatgatattcggtcgttttcgttacgttttcgtcgcgttaggtttttagaagatttatcgatatttgcggggtaaagttgtcgttcgtcgatatcgtttcgtcgtcgtcgagtagtagggtattgaatagatgatcgtcgtagtcgtagagtacggtgaagtgcggatgggtatttttgacggtatggattatgttgcgtaggtgggcgacggagtcgatggtgtttttgatgtcgataatattgttgcgcgagtcggcgagggtttttattagcgtcggagttagattttgttcggttagcgtcgggaagttatagagtattatcggtagcgtgacgttgtcggttatttgttcgaaatagcggattaggttcgttttcgatattttttagtagtaggggttgattattacgatgtcgttcgcgttcgtttgttgcgcgtgttggttgagttcgatggtttttcgggcgttggtgtcgtcggtgtcgattagtatcggtacgcgacgatcgatatgatcgatagtaaagcgggtaatggttttacgtttttcggcgtcgagttgggagaattcgttatcgttgtttaggaagaataggtcgttaacgtttgttttgattagatcgtcgattagcgcggcggtgttcggttatcgagttggtcgt

SEQ ID NO: 8152 - DNA, 1366 bp, Artificial Sequence
  chemically treated genomic DNA (Homo sapiens) CpG-island No: 8152
acgaccaactcgataaccgaacaccgccgcgctaatcgacgatctaatcaaaacaaacgttaacgacctattcttcctaaacaacgataacgaattctcccaactcgacgccgaaaaacgtaaaaccattacccgctttactatcgatcatatcgatcgtcgcgtaccgatactaatcgacaccgacgacaccaacgcccgaaaaaccatcgaactcaaccaacacgcgcaacaaacgaacgcgaacgacatcgtaataatcaacccctactactaaaaaatatcgaaaacgaacctaatccgctatttcgaacaaataaccgacaacgtcacgctaccgataatactctataacttcccgacgctaaccgaacaaaatctaactccgacgctaataaaaaccctcgccgactcgcgcaacaatattatcgacatcaaaaacaccatcgactccgtcgcccacctacgcaacataatccataccgtcaaaaatacccatccgcacttcaccgtactctacgactacgacgatcatctattcaataccctactactcgacgacgacgaaacgatatcgacgaacgacaactttaccccgcaaatatcgataaatcttctaaaaacctaacgcgacgaaaacgtaacgaaaacgaccgaatatcatcaaaccttactacaaattccgcaaatatatcaactaaatacgccgttaataaacgtaattaaaaaaacgatcgtactctacgatcgtcctatctccacgcacgtactaccgcccgcctcgccgctaaacgaaccgcgcaaaacgcaactaaaaaccctactacaacaactcaaactttactaaaccgaacgataacgataaccattaaaaaaattttcaccccgcaaaacgacgcgttttatacgataatcacccacgcgacgaaaccgcaaaacgctctaccgctaaccccgcaaatactaataaaatctcccaacgacaacctattcgacataacgcaaaacgccgaaataaactaaaacgccaacaaactcaccgacaaaaaaatactaattatcgacactcaaaacgacatccgcgccgaaaacgaacgccaatcgacgaactacacaccgacataaaaaaacgaataacaaaaacaaaacgaaaaaaaaaaccccgaaaaaaaaacccgtcgcgacctcgcaaaaaaccgcgaaaaacccacaaaataaccacgaattaaacacgataaacgaaaaccgaaaaaattcgacgaactccccgccacaaaaaaaaaataactacacgtaaaaatccccaactcgtacgaaaaccgcacaatatacgaaaaccacgaaataaaaataccctacaacgcta

SEQ ID NO: 8153 - DNA, 916 bp, Artificial Sequence
  chemically treated genomic DNA (Homo sapiens) CpG-island No: 8153
tatggtttatttttttatttgatgtataatatcgattatcgagttatcgcggtaacgtataacggtaacgacgcggtttgtgaatttaatcggttgtggtttatcggttagtagacgcgtacgttcgcgtagttatttaatggaaattattttaatgttcgttttttgtagacgttttgttagtttcggacgtgtcgggttaattgcgatatcgtggtttgtgattagaatatcgatattggagtttggggtgatgtaggttagtacgttatttattagagtcggaatacgatcgcgtattagcggcgcgacgatgatggaaagcgtagaggtaatcgcggtatcgtagtgattatcggaagtattacgtagtacgtcgttagagtcggttagtacgttaacgttgaattgggtgttaatttttagcgcgtttagtattattacgtcgagacgattaatcgatgcgtttttcgaattttagttagcgtattggttggcgttgatttcgatgtgattggggttacgggttagcgattgcgtagtatggttgttaaagttttgtatatttagtagtttgcggattagatttttttcgtgtaggttaattatcgtcgcggtaatatcgttaagggcgaagtcggcgcgaatatcgcggttacgtattttgttttttaggaaacgggttatcgttagcgatgcgtcgtcggtgtcggtttgtatggagaaattttttttgaagtagttagagttgataattatattcgtagcgttacgggtaataagtagttcgcgcgggttagtggttatacgggtcgcgttagcgtcgatttttgtagtatcgttaacgcggttaattttgacgattaaattaatttgattttgtttaatgtttgtcggattatgcggataaggtagt

SEQ ID NO: 8154 - DNA, 916 bp, Artificial Sequence
  chemically treated genomic DNA (Homo sapiens) CpG-island No: 8154
actaccttatccgcataatccgacaaacattaaacaaaatcaaattaatttaatcgtcaaaattaaccgcgttaacgatactacaaaaatcgacgctaacgcgacccgtataaccactaacccgcgcgaactacttattacccgtaacgctacgaatataattatcaactctaactacttcaaaaaaaatttctccatacaaaccgacaccgacgacgcatcgctaacgataacccgtttcctaaaaaacaaaatacgtaaccgcgatattcgcgccgacttcgcccttaacgatattaccgcgacgataattaacctacacgaaaaaaatctaatccgcaaactactaaatatacaaaactttaacaaccatactacgcaatcgctaacccgtaaccccaatcacatcgaaatcaacgccaaccaatacgctaactaaaattcgaaaaacgcatcgattaatcgtctcgacgtaataatactaaacgcgctaaaaattaacacccaattcaacgttaacgtactaaccgactctaacgacgtactacgtaatacttccgataatcactacgataccgcgattacctctacgctttccatcatcgtcgcgccgctaatacgcgatcgtattccgactctaataaataacgtactaacctacatcaccccaaactccaatatcgatattctaatcacaaaccacgatatcgcaattaacccgacacgtccgaaactaacaaaacgtctacaaaaaacgaacattaaaataatttccattaaataactacgcgaacgtacgcgtctactaaccgataaaccacaaccgattaaattcacaaaccgcgtcgttaccgttatacgttaccgcgataactcgataatcgatattatacatcaaataaaaaaataaaccata

SEQ ID NO: 8155 - DNA, 916 bp, Artificial Sequence
  chemically treated genomic DNA (Homo sapiens) CpG-island No: 8155
gttgttttattcgtataattcggtaagtattgagtaagattaggttgatttgatcgttaaagttgatcgcgttggcgatgttgtaaaaatcggcgttggcgcgattcgtatgattattaattcgcgcgaattgtttattgttcgtagcgttgcggatgtgattgttaattttggttattttaaagaaggtttttttatgtaaatcggtatcggcggcgtatcgttggcggtaattcgttttttggaagataaaatgcgtagtcgcgatattcgcgtcgatttcgtttttggcggtattatcgcgacgatggttgatttgtacgaaaaaggtttgattcgtaaattgttggatgtgtagagttttgatagttatgttgcgtaatcgttggttcgtaattttaattatatcgaaattagcgttaattagtacgttaattggggttcgaaaggcgtatcggttgatcgtttcgacgtggtggtattgagcgcgttggaaattgatatttagtttaacgttaacgtgttgatcggttttgacggcgtattgcgtggtgttttcggtggttattgcgatatcgcgattgtttttgcgttttttattatcgtcgcgtcgttggtacgcggtcgtatttcgattttggtggataacgtattgatttgtattattttaggttttagtgtcgatattttggttatagattacggtatcgtagttaattcggtacgttcggaattggtagaacgtttgtaggaagcgggtattaaagtggtttttattgagtggttgcgcgaacgtgcgcgtttgttgatcggtgaattatagtcgattgaatttatagatcgcgtcgttgtcgttgtgcgttatcgcgatggttcggtgatcgatgttgtgtattaggtgaaggaataagttatg

SEQ ID NO: 8156 - DNA, 916 bp, Artificial Sequence
  chemically treated genomic DNA (Homo sapiens) CpG-island No: 8156
cataacttattccttcacctaatacacaacatcgatcaccgaaccatcgcgataacgcacaacgacaacgacgcgatctataaattcaatcgactataattcaccgatcaacaaacgcgcacgttcgcgcaaccactcaataaaaaccactttaatacccgcttcctacaaacgttctaccaattccgaacgtaccgaattaactacgataccgtaatctataaccaaaatatcgacactaaaacctaaaataatacaaatcaatacgttatccaccaaaatcgaaatacgaccgcgtaccaacgacgcgacgataataaaaaacgcaaaaacaatcgcgatatcgcaataaccaccgaaaacaccacgcaatacgccgtcaaaaccgatcaacacgttaacgttaaactaaatatcaatttccaacgcgctcaataccaccacgtcgaaacgatcaaccgatacgcctttcgaaccccaattaacgtactaattaacgctaatttcgatataattaaaattacgaaccaacgattacgcaacataactatcaaaactctacacatccaacaatttacgaatcaaacctttttcgtacaaatcaaccatcgtcgcgataataccgccaaaaacgaaatcgacgcgaatatcgcgactacgcattttatcttccaaaaaacgaattaccgccaacgatacgccgccgataccgatttacataaaaaaaccttctttaaaataaccaaaattaacaatcacatccgcaacgctacgaacaataaacaattcgcgcgaattaataatcatacgaatcgcgccaacgccgatttttacaacatcgccaacgcgatcaactttaacgatcaaatcaacctaatcttactcaatacttaccgaattatacgaataaaacaac

SEQ ID NO: 8157 - DNA, 892 bp, Artificial Sequence
  chemically treated genomic DNA (Homo sapiens) CpG-island No: 8157
tatcgttaggttatgtcggtatcgggttttgtttcggtgttagttatagatcgtatagtttggcgattttagcgtagtttggtgtgacggtaatagttttggtttttttgtaacgtattttagtaaagaagtgagtattcggggtacgcgtttgcggtacgtttgatttttaggcgatgatgtagttggagttgtattagttagtagatttcggtacgttagtttgttcgttttaggtttgcggagacgtaggaggtaagtcgtagtattagtcgtagaagtttaagtaagtatcgttaattagcgagagatagcgtgtattcgatgcgtaagaaattatcgatattgtcggaattggcgagaaattagtaatacggttcgggtcgtagtttttgatggtgtaaacgttagatgcggcgattagttcgtttattttttgttaggaagaacgaataaatttatcgcgtttacgcgtttgtttaaagtttttcgttttatcggcgtttttaatgatagaagtttatgttttaatcggatcgttatgtagcgttttcgttttacgttatatttttattaggcgtttgcgtattatcgggtattttaggcggttggtattgtaaagatattaggagtagttggtatcgcgcgggtagtcgcgaggtttatggtttggtagattcggacgggtacgcggatagttagtttgttgggttttttaggtgattagatcgtttttgacgtagattttttagttgtaggagtcggtgtagtttatttcgtgggtagagcggacgattttgttatgttgttaacgttggcgatatttatttttttagttacggttggtattgagaagttggttatgtttatcggtaaaggttttatttttttg

SEQ ID NO: 8158 - DNA, 892 bp, Artificial Sequence
  chemically treated genomic DNA (Homo sapiens) CpG-island No: 8158
caaaaaaataaaacctttaccgataaacataaccaacttctcaataccaaccgtaactaaaaaaataaatatcgccaacgttaacaacataacaaaatcgtccgctctacccacgaaataaactacaccgactcctacaactaaaaaatctacgtcaaaaacgatctaatcacctaaaaaacccaacaaactaactatccgcgtacccgtccgaatctaccaaaccataaacctcgcgactacccgcgcgataccaactactcctaatatctttacaataccaaccgcctaaaatacccgataatacgcaaacgcctaataaaaatataacgtaaaacgaaaacgctacataacgatccgattaaaacataaacttctatcattaaaaacgccgataaaacgaaaaactttaaacaaacgcgtaaacgcgataaatttattcgttcttcctaacaaaaaataaacgaactaatcgccgcatctaacgtttacaccatcaaaaactacgacccgaaccgtattactaatttctcgccaattccgacaatatcgataatttcttacgcatcgaatacacgctatctctcgctaattaacgatacttacttaaacttctacgactaatactacgacttacctcctacgtctccgcaaacctaaaacgaacaaactaacgtaccgaaatctactaactaatacaactccaactacatcatcgcctaaaaatcaaacgtaccgcaaacgcgtaccccgaatactcacttctttactaaaatacgttacaaaaaaaccaaaactattaccgtcacaccaaactacgctaaaatcgccaaactatacgatctataactaacaccgaaacaaaacccgataccgacataacctaacgata

SEQ ID NO: 8159 - DNA, 892 bp, Artificial Sequence
  chemically treated genomic DNA (Homo sapiens) CpG-island No: 8159
tagaagggtgaaatttttgtcgatgggtatggttagttttttaatattaatcgtgattgggaggatggatatcgttagcgttggtagtatgataaaatcgttcgttttatttacggggtaaattgtatcggtttttgtagttggaaaatttacgttaaaaacggtttggttatttgggaaatttagtagattgattattcgcgtattcgttcggatttgttaaattatgaatttcgcggttgttcgcgcggtgttagttatttttggtatttttatagtgttaatcgtttgaaatattcgatgatgcgtaaacgtttgatgaaaatgtggcgtgaagcgaaggcgttgtatagcgattcggttgaggtatgggtttttattattgaagacgtcgataaagcgaaaagttttaagtaggcgcgtggacgcggtggatttgttcgttttttttggtaggaggtgaacgaattgatcgtcgtatttaacgtttatattattaaaaattacggttcggatcgtgttgttggtttttcgttaatttcggtaatgtcgatggttttttacgtatcgggtgtacgttatttttcgttgattggcggtatttgtttaagtttttacgattggtattgcgatttgttttttgcgttttcgtaaatttggggcgagtaaattgacgtatcggaatttgttgattggtataattttagttatattatcgtttgggggttaaacgtgtcgtagacgcgtatttcggatgtttatttttttattgaagtgcgttataaagggattaaaattgttgtcgttatattagattacgttgaaatcgttaaattgtgcgatttgtggttggtatcgaaatagggttcgatgtcggtatggtttggcgatg

SEQ ID NO: 8160 - DNA, 892 bp, Artificial Sequence
  chemically treated genomic DNA (Homo sapiens) CpG-island No: 8160
catcgccaaaccataccgacatcgaaccctatttcgataccaaccacaaatcgcacaatttaacgatttcaacgtaatctaatataacgacaacaattttaatccctttataacgcacttcaataaaaaaataaacatccgaaatacgcgtctacgacacgtttaacccccaaacgataatataactaaaattataccaatcaacaaattccgatacgtcaatttactcgccccaaatttacgaaaacgcaaaaaacaaatcgcaataccaatcgtaaaaacttaaacaaataccgccaatcaacgaaaaataacgtacacccgatacgtaaaaaaccatcgacattaccgaaattaacgaaaaaccaacaacacgatccgaaccgtaatttttaataatataaacgttaaatacgacgatcaattcgttcacctcctaccaaaaaaaacgaacaaatccaccgcgtccacgcgcctacttaaaacttttcgctttatcgacgtcttcaataataaaaacccatacctcaaccgaatcgctatacaacgccttcgcttcacgccacattttcatcaaacgtttacgcatcatcgaatatttcaaacgattaacactataaaaataccaaaaataactaacaccgcgcgaacaaccgcgaaattcataatttaacaaatccgaacgaatacgcgaataatcaatctactaaatttcccaaataaccaaaccgtttttaacgtaaattttccaactacaaaaaccgatacaatttaccccgtaaataaaacgaacgattttatcatactaccaacgctaacgatatccatcctcccaatcacgattaatattaaaaaactaaccatacccatcgacaaaaatttcacccttcta

SEQ ID NO: 8161 - DNA, 1066 bp, Artificial Sequence
  chemically treated genomic DNA (Homo sapiens) CpG-island No: 8161
ttttgtcgtttatttttttcgttatttatagtagttatcgtacgagtacgtttgtatcgttgggcgttttcggtttcggttggaaagcgttttttgatattcgtttatagttacgtgatgacggattgatatttaacgataacggcgggcggagtatttattttgagtcgttgttgtcgggggagtcggtgtatagtcgtagtgagttaatgtggttggtgcgcggtggtaaggtagtatagtcggacggttatacgttggcgcggttgtggggggcgttgtcgtcggatattcggttaagttcgtatttttatttggcgattaatagcgtataggggtcgtggtggatattggggtggtttgagcgggtgtcgggtgttgaggacgtattgttagcgtcgttgtcgtcgtatcgggtgtttatcgggatggcggatcgtttcgggcggacgttgacgtatcggcgtgaggtcgtcggtgatttggtcggggaaattatcggcgtgacggacggtgtcgggcgggagtttcgtttggtgttgattacgtaggcgtagcgtgcggaagaggttcgtattttttcgttatttttttttgatagttttcgtttttttttagttttagcgtttttcgatatattgttcggtatcgaatacggtttcgataggggtattcgtttttcggcggtgtggttgatgtacgattcggtatattcggagagtttgttcgttgcgttattggtgcggtatacgtatacggaagtcggtgaattgttggcggtatatgatcgtagtaatacgtaggtgcgcgtttttacgtatgacgcgtagtattcgggtcggatggtggcgtatcgttacgcgggaaggtcggagatgcgttatcgttacgacgatacggggcgggtggtggagtaattgaattcggtagggttaagttatcgttatttttatgagtaggatcgtattatcgttatcgatagtttgaatcggcgtgaggtgttgtatatagaaggcggggtcgggttgaaacgggtggtgaaaaaagaattggcggacggtagcgt

SEQ ID NO: 8162 - DNA, 1066 bp, Artificial Sequence
  chemically treated genomic DNA (Homo sapiens) CpG-island No: 8162
acgctaccgtccgccaattcttttttcaccacccgtttcaacccgaccccgccttctatatacaacacctcacgccgattcaaactatcgataacgataatacgatcctactcataaaaataacgataacttaaccctaccgaattcaattactccaccacccgccccgtatcgtcgtaacgataacgcatctccgaccttcccgcgtaacgatacgccaccatccgacccgaatactacgcgtcatacgtaaaaacgcgcacctacgtattactacgatcatataccgccaacaattcaccgacttccgtatacgtataccgcaccaataacgcaacgaacaaactctccgaatataccgaatcgtacatcaaccacaccgccgaaaaacgaatacccctatcgaaaccgtattcgataccgaacaatatatcgaaaaacgctaaaactaaaaaaaaacgaaaactatcaaaaaaaaataacgaaaaaatacgaacctcttccgcacgctacgcctacgtaatcaacaccaaacgaaactcccgcccgacaccgtccgtcacgccgataatttccccgaccaaatcaccgacgacctcacgccgatacgtcaacgtccgcccgaaacgatccgccatcccgataaacacccgatacgacgacaacgacgctaacaatacgtcctcaacacccgacacccgctcaaaccaccccaatatccaccacgacccctatacgctattaatcgccaaataaaaatacgaacttaaccgaatatccgacgacaacgccccccacaaccgcgccaacgtataaccgtccgactatactaccttaccaccgcgcaccaaccacattaactcactacgactatacaccgactcccccgacaacaacgactcaaaataaatactccgcccgccgttatcgttaaatatcaatccgtcatcacgtaactataaacgaatatcaaaaaacgctttccaaccgaaaccgaaaacgcccaacgatacaaacgtactcgtacgataactactataaataacgaaaaaaataaacgacaaaa

SEQ ID NO: 8163 - DNA, 1066 bp, Artificial Sequence
  chemically treated genomic DNA (Homo sapiens) CpG-island No: 8163
acgttgtcgttcgttagttttttttttattattcgttttagttcggtttcgttttttgtatgtagtattttacgtcggtttaggttgtcggtgacggtgatgcggttttgtttataaagatagcggtagtttaattttgtcgggtttagttgttttattattcgtttcgtatcgtcgtagcggtagcgtattttcggttttttcgcgtaacggtgcgttattattcggttcgggtgttgcgcgttatacgtgaaagcgcgtatttgcgtattgttgcggttatatatcgttagtagtttatcggttttcgtatacgtgtatcgtattagtggcgtagcgggtaggtttttcgggtatgtcgggtcgtgtattagttatatcgtcgaaaggcggatatttttgtcggggtcgtattcggtatcgggtagtgtgtcggggaacgttgaggttgagagagggcgggaattgttagaagaagatagcgaagaggtgcgggtttttttcgtacgttgcgtttgcgtggttagtattagacggaattttcgttcggtatcgttcgttacgtcggtgattttttcggttaggttatcggcggttttacgtcggtacgttagcgttcgttcgaagcggttcgttatttcggtaagtattcggtacggcggtagcggcgttggtagtacgtttttagtattcggtattcgtttagattattttagtatttattacggtttttgtgcgttgttggtcgttaggtaaagatgcgggtttaatcggatattcggcggtagcgttttttatagtcgcgttagcgtatggtcgttcggttgtgttgttttattatcgcgtattagttatattgatttattgcggttgtatatcggttttttcggtagtagcggtttaaagtgaatgtttcgttcgtcgttgtcgttgagtattagttcgttattacgtagttgtaagcggatattagaaggcgttttttagtcggggtcgaaaacgtttaacggtgtaggcgtattcgtacggtaattgttgtaagtagcggagagaatgaacggtagag

SEQ ID NO: 8164 - DNA, 1066 bp, Artificial Sequence
  chemically treated genomic DNA (Homo sapiens) CpG-island No: 8164
ctctaccgttcattctctccgctacttacaacaattaccgtacgaatacgcctacaccgttaaacgttttcgaccccgactaaaaaacgccttctaatatccgcttacaactacgtaataacgaactaatactcaacgacaacgacgaacgaaacattcactttaaaccgctactaccgaaaaaaccgatatacaaccgcaataaatcaatataactaatacgcgataataaaacaacacaaccgaacgaccatacgctaacgcgactataaaaaacgctaccgccgaatatccgattaaacccgcatctttacctaacgaccaacaacgcacaaaaaccgtaataaatactaaaataatctaaacgaataccgaatactaaaaacgtactaccaacgccgctaccgccgtaccgaatacttaccgaaataacgaaccgcttcgaacgaacgctaacgtaccgacgtaaaaccgccgataacctaaccgaaaaaatcaccgacgtaacgaacgataccgaacgaaaattccgtctaatactaaccacgcaaacgcaacgtacgaaaaaaacccgcacctcttcgctatcttcttctaacaattcccgccctctctcaacctcaacgttccccgacacactacccgataccgaatacgaccccgacaaaaatatccgcctttcgacgatataactaatacacgacccgacatacccgaaaaacctacccgctacgccactaatacgatacacgtatacgaaaaccgataaactactaacgatatataaccgcaacaatacgcaaatacgcgctttcacgtataacgcgcaacacccgaaccgaataataacgcaccgttacgcgaaaaaaccgaaaatacgctaccgctacgacgatacgaaacgaataataaaacaactaaacccgacaaaattaaactaccgctatctttataaacaaaaccgcatcaccgtcaccgacaacctaaaccgacgtaaaatactacatacaaaaaacgaaaccgaactaaaacgaataataaaaaaaaaactaacgaacgacaacgt

SEQ ID NO: 8165 - DNA, 1229 bp, Artificial Sequence
  chemically treated genomic DNA (Homo sapiens) CpG-island No: 8165
  misc_feature (533)..(533): n is either a, c, g or t
agggtgtcgtcgaacggaatgcgtagggtttgtagtttcgggttaagcgaattggcgtcgaaatcgtttcgttagttgttcggaacggttgtaggttgttcggttatttgcgggttttttacggttagttgcgcgtgtttgtcgttttttacgtacggttagtcgtcgcgttatttaatgcgggcgatgtcggtttcgcgttttagcgggtagtagtcgcgttcgtcggaggttagtagcggtacgtcgggtaggcgtagcgggcggttggtgaggtaggttatgtattatttattcgtatgcgtttgtagtagcgagtcgtggtcgtttttttgtagcgggtttttcggtaggtgttagttggttattatcgttacgttcgggtgtagttcgtacggttcgtcgatatttttggaacgtagtattacgacggcgtgttcgtagttggtgtcgttttcggcggttattaggtagtattatttcgcgtggcgatataggtgcgcgttttcggtgtagtagagcggcgtgtcggntaatagcgttttgcgttcgggcgagagcgtgtcggtttgcgggttaaacgtttgtaatacgatggtgttgtgcgggttgttgtggtggcgcggtttttacgggcggtagatatagtatttgcggttatcgtcgtcgtggaatagggacgggttaaattcgtcgttgtttatcgggattggttcgttttatggtttttcgatggagggcgcggtgacgaggaagttgcggtcgtttttttacggcgagtcgataatttttacgtcggtgtagagtagttagaatttatcgtcggcgtagtttaggtacggcgtttagatgtcgtcggagttcgggttgttttttatgtttagtatcgatacgcggtttaacggggtgttgattagcgattagttttttaggttacgggagtggtagatgcgtacgttcgggaattattcgaaggtcgaggtggcgatgtagtagttttcgttttggcggtatagggacgggttcgggttgaaagtcggtgagtatcgggttagtgatttttatattgttttcggttaatgggattgcggttgttcgttggcgtcgggaacggtttcgttttgcgtcgggcggtgtttaattagtttgtcggttgatggtttttacgcgggtatttcgtgagtttgtaagcgatagtattgattgatataattgtcgcgtttgaagta

SEQ ID NO: 8166 - DNA, 1229 bp, Artificial Sequence
  chemically treated genomic DNA (Homo sapiens) CpG-island No: 8166
  misc_feature (697)..(697): n is either a, c, g or t
tacttcaaacgcgacaattatatcaatcaatactatcgcttacaaactcacgaaatacccgcgtaaaaaccatcaaccgacaaactaattaaacaccgcccgacgcaaaacgaaaccgttcccgacgccaacgaacaaccgcaatcccattaaccgaaaacaatataaaaatcactaacccgatactcaccgactttcaacccgaacccgtccctataccgccaaaacgaaaactactacatcgccacctcgaccttcgaataattcccgaacgtacgcatctaccactcccgtaacctaaaaaactaatcgctaatcaacaccccgttaaaccgcgtatcgatactaaacataaaaaacaacccgaactccgacgacatctaaacgccgtacctaaactacgccgacgataaattctaactactctacaccgacgtaaaaattatcgactcgccgtaaaaaaacgaccgcaacttcctcgtcaccgcgccctccatcgaaaaaccataaaacgaaccaatcccgataaacaacgacgaatttaacccgtccctattccacgacgacgataaccgcaaatactatatctaccgcccgtaaaaaccgcgccaccacaacaacccgcacaacaccatcgtattacaaacgtttaacccgcaaaccgacacgctctcgcccgaacgcaaaacgctattanccgacacgccgctctactacaccgaaaacgcgcacctatatcgccacgcgaaataatactacctaataaccgccgaaaacgacaccaactacgaacacgccgtcgtaatactacgttccaaaaatatcgacgaaccgtacgaactacacccgaacgtaacgataataaccaactaacacctaccgaaaaacccgctacaaaaaaacgaccacgactcgctactacaaacgcatacgaataaataatacataacctacctcaccaaccgcccgctacgcctacccgacgtaccgctactaacctccgacgaacgcgactactacccgctaaaacgcgaaaccgacatcgcccgcattaaataacgcgacgactaaccgtacgtaaaaaacgacaaacacgcgcaactaaccgtaaaaaacccgcaaataaccgaacaacctacaaccgttccgaacaactaacgaaacgatttcgacgccaattcgcttaacccgaaactacaaaccctacgcattccgttcgacgacaccct

SEQ ID NO: 8167 - DNA, 1229 bp, Artificial Sequence
  chemically treated genomic DNA (Homo sapiens) CpG-island No: 8167
  misc_feature (697)..(697): n is either a, c, g or t
tgttttaaacgcggtaattgtattaattaatgttgtcgtttataagtttacgagatgttcgcgtggaggttattagtcggtaagttgattaagtatcgttcggcgtagggcgaggtcgttttcgacgttagcggatagtcgtaattttattaatcggaggtaatatggaaattattaattcgatatttatcggtttttaattcggattcgtttttgtgtcgttagggcgaggattattatatcgttatttcgattttcgagtggttttcgggcgtgcgtatttattattttcgtgatttgaaaaattggtcgttggttagtatttcgttggatcgcgtgtcgatgttggatatgaagggtaattcggatttcggcggtatttgggcgtcgtgtttgagttacgtcgacggtaaattttggttgttttatatcgacgtgaagattgtcgattcgtcgtggaaaaacggtcgtaattttttcgttatcgcgttttttatcgaggggttatggagcgagttaatttcgatgggtaacggcgggtttgattcgtttttgttttacgacgacgatggtcgtaaatattatatttatcgttcgtgggggtcgcgttattatagtaattcgtataatattatcgtgttataggcgtttgattcgtagatcggtacgttttcgttcgagcgtaaaacgttgttantcggtacgtcgttttgttatatcgaaggcgcgtatttgtatcgttacgcgggatggtattatttgatggtcgtcgagggcggtattagttacgagtacgtcgtcgtggtgttgcgttttaaaaatatcgacgggtcgtacgagttgtattcggacgtaacgatgatgattagttggtatttgtcggagaattcgttgtagaagagcggttacggttcgttgttgtagacgtatacgggtgaatggtatatggtttattttattagtcgttcgttgcgtttgttcggcgtgtcgttgttggttttcggcggacgcggttattgttcgttggggcgcgagatcggtatcgttcgtattgaatggcgcgacggttggtcgtacgtggaaggcggtaagtacgcgtagttgatcgtgaaaggttcgtaagtagtcgagtagtttgtagtcgtttcgggtaattggcgggacgatttcgacgttagttcgtttgattcggagttgtagattttgcgtatttcgttcgacgatatttt

SEQ ID NO: 8168 - DNA, 1229 bp, Artificial Sequence
  chemically treated genomic DNA (Homo sapiens) CpG-island No: 8168
  misc_feature (533)..(533): n is either a, c, g or t
aaaatatcgtcgaacgaaatacgcaaaatctacaactccgaatcaaacgaactaacgtcgaaatcgtcccgccaattacccgaaacgactacaaactactcgactacttacgaacctttcacgatcaactacgcgtacttaccgccttccacgtacgaccaaccgtcgcgccattcaatacgaacgataccgatctcgcgccccaacgaacaataaccgcgtccgccgaaaaccaacaacgacacgccgaacaaacgcaacgaacgactaataaaataaaccatataccattcacccgtatacgtctacaacaacgaaccgtaaccgctcttctacaacgaattctccgacaaataccaactaatcatcatcgttacgtccgaatacaactcgtacgacccgtcgatatttttaaaacgcaacaccacgacgacgtactcgtaactaataccgccctcgacgaccatcaaataataccatcccgcgtaacgatacaaatacgcgccttcgatataacaaaacgacgtaccgantaacaacgttttacgctcgaacgaaaacgtaccgatctacgaatcaaacgcctataacacgataatattatacgaattactataataacgcgacccccacgaacgataaatataatatttacgaccatcgtcgtcgtaaaacaaaaacgaatcaaacccgccgttacccatcgaaattaactcgctccataacccctcgataaaaaacgcgataacgaaaaaattacgaccgtttttccacgacgaatcgacaatcttcacgtcgatataaaacaaccaaaatttaccgtcgacgtaactcaaacacgacgcccaaataccgccgaaatccgaattacccttcatatccaacatcgacacgcgatccaacgaaatactaaccaacgaccaatttttcaaatcacgaaaataataaatacgcacgcccgaaaaccactcgaaaatcgaaataacgatataataatcctcgccctaacgacacaaaaacgaatccgaattaaaaaccgataaatatcgaattaataatttccatattacctccgattaataaaattacgactatccgctaacgtcgaaaacgacctcgccctacgccgaacgatacttaatcaacttaccgactaataacctccacgcgaacatctcgtaaacttataaacgacaacattaattaatacaattaccgcgtttaaaaca

SEQ ID NO: 8169 - DNA, 539 bp, Artificial Sequence
  chemically treated genomic DNA (Homo sapiens) CpG-island No: 8169
cggtacgcgttagtacgttcgttttgtcggttatttttatatataaggtgtcgaaatagtgcgtatggcgtagttttagatttttttgttgtaggttcgtcgttaggatatcggttagacggtgaatgcggttagcgatacgttttaggttaatcgggtcgtgataaacggtatataaggttggcgatgtttgttagtagtattttgggaagtataaatgttggagttcgtttttttacggcggatatgttgttcgcgagtttgtatcgttatgcgtagcgcggtattgttagttgtatttttcgatatatcgatatacggttcggtattgagcgtttgtatttatttttcgtcgtaaagaatgtcgcgtgtgggttatcgtagtttatcggtacgtcgaagcgttgcgtcgaattaaaaataatattcgcgttttgtttattcggcgtagttaatagtattagcgttataatatcggcggtaacgttgattataattttgcgtgattttagttcgttaataagcgtagtgtagtcgtg

SEQ ID NO: 8170 - DNA, 539 bp, Artificial Sequence
  chemically treated genomic DNA (Homo sapiens) CpG-island No: 8170
cacgactacactacgcttattaacgaactaaaatcacgcaaaattataatcaacgttaccgccgatattataacgctaatactattaactacgccgaataaacaaaacgcgaatattatttttaattcgacgcaacgcttcgacgtaccgataaactacgataacccacacgcgacattctttacgacgaaaaataaatacaaacgctcaataccgaaccgtatatcgatatatcgaaaaatacaactaacaataccgcgctacgcataacgatacaaactcgcgaacaacatatccgccgtaaaaaaacgaactccaacatttatacttcccaaaatactactaacaaacatcgccaaccttatataccgtttatcacgacccgattaacctaaaacgtatcgctaaccgcattcaccgtctaaccgatatcctaacgacgaacctacaacaaaaaaatctaaaactacgccatacgcactatttcgacaccttatatataaaaataaccgacaaaacgaacgtactaacgcgtaccg

SEQ ID NO: 8171 - DNA, 539 bp, Artificial Sequence
  chemically treated genomic DNA (Homo sapiens) CpG-island No: 8171
tacgattatattgcgtttattagcgaattgaaattacgtaaaattgtggttagcgttgtcgtcgatattatggcgttggtgttgttaattgcgtcgggtaaatagggcgcggatattgtttttggttcggcgtaacgtttcggcgtgtcgatgggttacggtggtttatacgcggtattttttgcggcgaaagatgaatataaacgtttaatgtcgggtcgtatatcggtgtatcgaaagatgtagttggtaatatcgcgttgcgtatggcgatgtagattcgcgagtaatatattcgtcgtgagaaagcgaattttaatatttgtattttttagggtattgttggtaaatatcgttagttttgtatgtcgtttattacggttcggttggtttgaaacgtatcgttaatcgtatttatcgtttgatcgatattttggcggcgggtttgtaataaaaaggtttgaaattgcgttatgcgtattatttcgatattttgtgtgtggaagtggtcgataaagcgggcgtattgacgcgtgtcg

SEQ ID NO: 8172 - DNA, 539 bp, Artificial Sequence
  chemically treated genomic DNA (Homo sapiens) CpG-island No: 8172
cgacacgcgtcaatacgcccgctttatcgaccacttccacacacaaaatatcgaaataatacgcataacgcaatttcaaacctttttattacaaacccgccgccaaaatatcgatcaaacgataaatacgattaacgatacgtttcaaaccaaccgaaccgtaataaacgacatacaaaactaacgatatttaccaacaataccctaaaaaatacaaatattaaaattcgctttctcacgacgaatatattactcgcgaatctacatcgccatacgcaacgcgatattaccaactacatctttcgatacaccgatatacgacccgacattaaacgtttatattcatctttcgccgcaaaaaataccgcgtataaaccaccgtaacccatcgacacgccgaaacgttacgccgaaccaaaaacaatatccgcgccctatttacccgacgcaattaacaacaccaacgccataatatcgacgacaacgctaaccacaattttacgtaatttcaattcgctaataaacgcaatataatcgta

SEQ ID NO: 8173 - DNA, 695 bp, Artificial Sequence
  chemically treated genomic DNA (Homo sapiens) CpG-island No: 8173
  misc_feature (8)..(8): n is either a, c, g or t
tgggttanggcgtgggaggattttagcgtcgggatgattttttcgtgtaggtatagcgttttgaaggttttaagggttttattatcggtaatagatacgtaattagcgcgtttagtgttgttaagatacgcgtgttgtgggtcgatagacgggaaatttagttcggcggagatggagtaagattttttaatttgttcgttttcggtttgtattatcggcgtttttatatcgaaatagatatttacgcgattatgttttagcggtgcgtcgtgttcgttagtttcgatatcgtgattatttggttttatattaattaggtcgacgttggttttattgatgaaattagtaaatatgtcgatggtattcgaatcgtcgttaatataggcgataacggtattcggtaggcgattttttttttttagaatttgcgttttggttttttcgttaattattcgttgaaatttacgtataatggtcggataaggatgcgggttagttgcggtgtttagtatatagtgcgcggtttcgtaattatcggattagtcgcgtagagtttcgattataggtatttattagacgtcgcggaatcgttatgtttcgggattattttcgtaattattaagcgtatacgaaaaacgttaggcgattggcgtttaacgtttttggaatttatatatatacggtatattaggtta

SEQ ID NO: 8174 - DNA, 695 bp, Artificial Sequence
  chemically treated genomic DNA (Homo sapiens) CpG-island No: 8174
  misc_feature (688)..(688): n is either a, c, g or t
taacctaatataccgtatatatataaattccaaaaacgttaaacgccaatcgcctaacgtttttcgtatacgcttaataattacgaaaataatcccgaaacataacgattccgcgacgtctaataaatacctataatcgaaactctacgcgactaatccgataattacgaaaccgcgcactatatactaaacaccgcaactaacccgcatccttatccgaccattatacgtaaatttcaacgaataattaacgaaaaaaccaaaacgcaaattctaaaaaaaaaaaatcgcctaccgaataccgttatcgcctatattaacgacgattcgaataccatcgacatatttactaatttcatcaataaaaccaacgtcgacctaattaatataaaaccaaataatcacgatatcgaaactaacgaacacgacgcaccgctaaaacataatcgcgtaaatatctatttcgatataaaaacgccgataatacaaaccgaaaacgaacaaattaaaaaatcttactccatctccgccgaactaaatttcccgtctatcgacccacaacacgcgtatcttaacaacactaaacgcgctaattacgtatctattaccgataataaaacccttaaaaccttcaaaacgctatacctacacgaaaaaatcatcccgacgctaaaatcctcccacgccntaaccca

SEQ ID NO: 8175 - DNA, 695 bp, Artificial Sequence
  chemically treated genomic DNA (Homo sapiens) CpG-island No: 8175
  misc_feature (688)..(688): n is either a, c, g or t
tggtttgatatgtcgtatgtatatgggttttaaagacgttgaacgttagtcgtttaacgtttttcgtatgcgtttaatggttgcggaagtgatttcggggtatagcggtttcgcgacgtttgatagatgtttgtaatcgaggttttgcgcgattggttcggtagttacgaaatcgcgtattatatgttgggtatcgtagttggttcgtatttttattcgattattgtgcgtgagttttagcggatgattggcgaagaaattaaagcgtagattttggaaagagaaggtcgtttgtcggatgtcgttatcgtttgtgttggcggcggttcgaatgttatcggtatgtttgttgattttattaatgaaattaacgtcggtttgattggtgtggagttaggtggttacggtatcgaaattggcgagtacggcgtatcgttaaaatatggtcgcgtgggtatttatttcggtatgaaagcgtcgatgatgtaaatcgaagacgggtagattgaagaattttattttattttcgtcggattggatttttcgtttgtcggtttataatacgcgtattttaatagtattggacgcgttgattacgtgtttattatcgatgatgaagtttttgaagtttttaaaacgttgtgtttgtacgaagggattatttcggcgttggaatttttttacgttntggttta

SEQ ID NO: 8176 - DNA, 695 bp, Artificial Sequence
  chemically treated genomic DNA (Homo sapiens) CpG-island No: 8176
  misc_feature (8)..(8): n is either a, c, g or t
taaaccanaacgtaaaaaaattccaacgccgaaataatcccttcgtacaaacacaacgttttaaaaacttcaaaaacttcatcatcgataataaacacgtaatcaacgcgtccaatactattaaaatacgcgtattataaaccgacaaacgaaaaatccaatccgacgaaaataaaataaaattcttcaatctacccgtcttcgatttacatcatcgacgctttcataccgaaataaatacccacgcgaccatattttaacgatacgccgtactcgccaatttcgataccgtaaccacctaactccacaccaatcaaaccgacgttaatttcattaataaaatcaacaaacataccgataacattcgaaccgccgccaacacaaacgataacgacatccgacaaacgaccttctctttccaaaatctacgctttaatttcttcgccaatcatccgctaaaactcacgcacaataatcgaataaaaatacgaaccaactacgatacccaacatataatacgcgatttcgtaactaccgaaccaatcgcgcaaaacctcgattacaaacatctatcaaacgtcgcgaaaccgctataccccgaaatcacttccgcaaccattaaacgcatacgaaaaacgttaaacgactaacgttcaacgtctttaaaacccatatacatacgacatatcaaacca

SEQ ID NO: 8177 - DNA, 519 bp, Artificial Sequence
  chemically treated genomic DNA (Homo sapiens) CpG-island No: 8177
ttggaagtatttagacgttgacgcgaataaaacgtaaagtgcgtttggttgttggtttgaatagcgaaaatgttttttttaatgaagtaatggagcgcggttggtaatgtttgcgtttgtttgttgaacgtttgtaagatatttttttttcgtaaattcgcgttgtcgttacggcgacgttacgttttgtcgttaagtgcgggtgattttattgttaaagcgtaggaaattttcggttgttcggtataggtgattagcggtgaagaggaagtacgtttgatttattagggcgtttgtttatattattggtggtgtcgattagcgtttggtggtggatataggcggagttagtattgaattggtaatcggtacgggtgtataaattatttcgttgtttagtttgtcgatgggttgcgttatttggttggaacgttattttgtcgatcgtaatttggggtaggaaaattttgatgttgtagaaaaagcggtacgcgaagtgttacgttcggttgtcgatga

SEQ ID NO: 8178 - DNA, 519 bp, Artificial Sequence
  chemically treated genomic DNA (Homo sapiens) CpG-island No: 8178
tcatcgacaaccgaacgtaacacttcgcgtaccgctttttctacaacatcaaaattttcctaccccaaattacgatcgacaaaataacgttccaaccaaataacgcaacccatcgacaaactaaacaacgaaataatttatacacccgtaccgattaccaattcaatactaactccgcctatatccaccaccaaacgctaatcgacaccaccaataatataaacaaacgccctaataaatcaaacgtacttcctcttcaccgctaatcacctataccgaacaaccgaaaatttcctacgctttaacaataaaatcacccgcacttaacgacaaaacgtaacgtcgccgtaacgacaacgcgaatttacgaaaaaaaaatatcttacaaacgttcaacaaacaaacgcaaacattaccaaccgcgctccattacttcattaaaaaaaacattttcgctattcaaaccaacaaccaaacgcactttacgttttattcgcgtcaacgtctaaatacttccaa

SEQ ID NO: 8179 - DNA, 519 bp, Artificial Sequence
  chemically treated genomic DNA (Homo sapiens) CpG-island No: 8179
ttatcggtaatcggacgtaatatttcgcgtgtcgttttttttgtagtattaaaatttttttgttttagattacgatcggtaaaatagcgttttagttaggtgacgtagtttatcgataggttgaataacgaggtggtttgtgtattcgtgtcggttattagtttagtattggtttcgtttatatttattattaggcgttgatcggtattattagtggtgtgagtaagcgttttgataaattagacgtgttttttttttatcgttgattatttgtatcggataatcgagaattttttgcgttttggtaataaaattattcgtatttgacggtaaggcgtaacgtcgtcgtagcgataacgcgaatttgcgagggaggaatattttgtagacgtttagtaaataggcgtaaatattgttaatcgcgttttattgttttattggagagggtattttcgttatttaggttagtagttagacgtattttgcgttttattcgcgttagcgtttggatgtttttag

SEQ ID NO: 8180 - DNA, 519 bp, Artificial Sequence
  chemically treated genomic DNA (Homo sapiens) CpG-island No: 8180
ctaaaaacatccaaacgctaacgcgaataaaacgcaaaatacgtctaactactaacctaaataacgaaaataccctctccaataaaacaataaaacgcgattaacaatatttacgcctatttactaaacgtctacaaaatattcctccctcgcaaattcgcgttatcgctacgacgacgttacgccttaccgtcaaatacgaataattttattaccaaaacgcaaaaaattctcgattatccgatacaaataatcaacgataaaaaaaaaacacgtctaatttatcaaaacgcttactcacaccactaataataccgatcaacgcctaataataaatataaacgaaaccaatactaaactaataaccgacacgaatacacaaaccacctcgttattcaacctatcgataaactacgtcacctaactaaaacgctattttaccgatcgtaatctaaaacaaaaaaattttaatactacaaaaaaaacgacacgcgaaatattacgtccgattaccgataa

SEQ ID NO: 8181 - DNA, 542 bp, Artificial Sequence
  chemically treated genomic DNA (Homo sapiens) CpG-island No: 8181
ggcgttgttgcgttagttcgttgatgttattttagtatggatgatgcgttaggcgggtcgttatttatcggaatataaagttacgcgcgtttaggtaggcgattttatgtcgttgtgtaaaaacgtcgagttggcgtgcgaagtgattttgtaatcgttgcgtcgttattcgttggatgcggcgattttttttttcgatatttttatcgtgtcggacgcgatggggttagggttttattttgaagtcggagaaggttcgcgttttatttcgttagttatttgtaaagttgacgtcgataaattgttaatttcggattcggaagatgaattgggttacgtgatgaacgcggtgcgtattattcgtcgcgaattgaaaggcgaagtgtcgttgattggttttttcggtagttcgtggacgttggcgatttatatggtggaaggcggtagtagtaaagtttttatcgtgattaaaaaaatgatgtatgtcgattcgtaggcgttgtacgttttgttcgataaattggcgaaaagcgttattttgt

SEQ ID NO: 8182 - DNA, 542 bp, Artificial Sequence
  chemically treated genomic DNA (Homo sapiens) CpG-island No: 8182
acaaaataacgcttttcgccaatttatcgaacaaaacgtacaacgcctacgaatcgacatacatcatttttttaatcacgataaaaactttactactaccgccttccaccatataaatcgccaacgtccacgaactaccgaaaaaaccaatcaacgacacttcgcctttcaattcgcgacgaataatacgcaccgcgttcatcacgtaacccaattcatcttccgaatccgaaattaacaatttatcgacgtcaactttacaaataactaacgaaataaaacgcgaaccttctccgacttcaaaataaaaccctaaccccatcgcgtccgacacgataaaaatatcgaaaaaaaaaatcgccgcatccaacgaataacgacgcaacgattacaaaatcacttcgcacgccaactcgacgtttttacacaacgacataaaatcgcctacctaaacgcgcgtaactttatattccgataaataacgacccgcctaacgcatcatccatactaaaataacatcaacgaactaacgcaacaacgcc

SEQ ID NO: 8183 - DNA, 542 bp, Artificial Sequence
  chemically treated genomic DNA (Homo sapiens) CpG-island No: 8183
ataaagtgacgtttttcgttagtttatcgagtagagcgtgtagcgtttgcggatcggtatatattatttttttgattacggtgaaggttttgttgttgtcgttttttattatgtaggtcgttagcgtttacgggttgtcggaaaaattaattagcggtatttcgttttttagttcgcgacgaatggtacgtatcgcgtttattacgtaatttagtttatttttcgggttcggaattggtagtttatcgacgttagttttgtaggtgattggcgaggtaaaacgcggatttttttcggttttaaaatagagttttaattttatcgcgttcggtacggtgaggatatcggaaaagaggatcgtcgtatttagcgggtagcgacgtagcggttgtaaagttatttcgtacgttagttcggcgtttttgtatagcgatataaaatcgtttgtttgggcgcgcgtggttttatatttcggtagatagcgattcgtttggcgtattatttatattggagtgatattaacgggttggcgtagtagcgtt

SEQ ID NO: 8184 - DNA, 542 bp, Artificial Sequence
  chemically treated genomic DNA (Homo sapiens) CpG-island No: 8184
aacgctactacgccaacccgttaatatcactccaatataaataatacgccaaacgaatcgctatctaccgaaatataaaaccacgcgcgcccaaacaaacgattttatatcgctatacaaaaacgccgaactaacgtacgaaataactttacaaccgctacgtcgctacccgctaaatacgacgatcctcttttccgatatcctcaccgtaccgaacgcgataaaattaaaactctattttaaaaccgaaaaaaatccgcgttttacctcgccaatcacctacaaaactaacgtcgataaactaccaattccgaacccgaaaaataaactaaattacgtaataaacgcgatacgtaccattcgtcgcgaactaaaaaacgaaataccgctaattaatttttccgacaacccgtaaacgctaacgacctacataataaaaaacgacaacaacaaaaccttcaccgtaatcaaaaaaataatatataccgatccgcaaacgctacacgctctactcgataaactaacgaaaaacgtcactttat

SEQ ID NO: 8185 - DNA, 525 bp, Artificial Sequence
  chemically treated genomic DNA (Homo sapiens) CpG-island No: 8185
gtttgcggtaaggggtttagttagagttcgtatttgtcggcgttggtgtagttatatcggttttattagtatagtcggagaagtttgcgttgtattttagatatgggcgtgttgcgtattgtggttttatgtgatattgggaacgttacgagtagggtcgaaattgtttacgtggaattagcggaatggtagtttggagatgtttttaagtttgttaatttgtaagtagtcgaatgtaatcgtatattttgcgtacgggtcgtcgatttattaattatgttatgggcgagaaaaagtggtttgaattcgtgttgttaatttttaaacgtgttcgcgcgttttattgcgtttttttcgtgttatatgcgttatattatggattgttgttcggtttcgggtaatggataggggttaatttaattggttcgttggattaaatttggtttcgtttggttggttattcgggcgtaattcgtaaaaggaggaatatatcgggatttgtattatacgaaaaggtgagtaaaa

SEQ ID NO: 8186 - DNA, 525 bp, Artificial Sequence
  chemically treated genomic DNA (Homo sapiens) CpG-island No: 8186
ttttactcaccttttcgtataatacaaatcccgatatattcctccttttacgaattacgcccgaataaccaaccaaacgaaaccaaatttaatccaacgaaccaattaaattaacccctatccattacccgaaaccgaacaacaatccataatataacgcatataacacgaaaaaaacgcaataaaacgcgcgaacacgtttaaaaattaacaacacgaattcaaaccactttttctcgcccataacataattaataaatcgacgacccgtacgcaaaatatacgattacattcgactacttacaaattaacaaacttaaaaacatctccaaactaccattccgctaattccacgtaaacaatttcgaccctactcgtaacgttcccaatatcacataaaaccacaatacgcaacacgcccatatctaaaatacaacgcaaacttctccgactatactaataaaaccgatataactacaccaacgccgacaaatacgaactctaactaaaccccttaccgcaaac

SEQ ID NO: 8187 - DNA, 525 bp, Artificial Sequence
  chemically treated genomic DNA (Homo sapiens) CpG-island No: 8187
ttttgtttattttttcgtgtggtataaatttcggtgtatttttttttttgcggattacgttcgggtaattaattaggcgaaattaggtttggtttaacggattaattgggttaatttttgtttattgttcggagtcgggtagtaatttatggtataacgtatgtgatacgggaaggacgtaatggagcgcgcgaatacgtttaagaattggtaatacgagtttaggttattttttttcgtttatggtataattgatgaatcggcgattcgtgcgtaggatgtgcgattgtattcggttgtttgtaaattgatagatttggagatatttttaagttgttatttcgttagttttacgtgggtaatttcgattttgttcgtgacgtttttagtgttatataaggttataatacgtagtacgtttatgtttagaatgtaacgtagattttttcggttatgttaatagagtcggtatggttgtattagcgtcgataggtgcgggttttaattaggttttttgtcgtaagt

SEQ ID NO: 8188 - DNA, 525 bp, Artificial Sequence
  chemically treated genomic DNA (Homo sapiens) CpG-island No: 8188
acttacgacaaaaaacctaattaaaacccgcacctatcgacgctaatacaaccataccgactctattaacataaccgaaaaaatctacgttacattctaaacataaacgtactacgtattataaccttatataacactaaaaacgtcacgaacaaaatcgaaattacccacgtaaaactaacgaaataacaacttaaaaatatctccaaatctatcaatttacaaacaaccgaatacaatcgcacatcctacgcacgaatcgccgattcatcaattataccataaacgaaaaaaaataacctaaactcgtattaccaattcttaaacgtattcgcgcgctccattacgtccttcccgtatcacatacgttataccataaattactacccgactccgaacaataaacaaaaattaacccaattaatccgttaaaccaaacctaatttcgcctaattaattacccgaacgtaatccgcaaaaaaaaaaatacaccgaaatttataccacacgaaaaaataaacaaaa

SEQ ID NO: 8189 - DNA, 737 bp, Artificial Sequence
  chemically treated genomic DNA (Homo sapiens) CpG-island No: 8189
agcgtttgtgtatcggtgatgcgtttgatcgtgaaaaatttgacgtttgggcggcgattgtttcgtatattatcggtaattcgttatattattggacgtatttcgaattgcgtcgttcgtttggtattattggtaaattgtttttttcgttaattgtcgatgaaatttggaacgaatgtaacgaattgttggcgtaggataattttttcgcgcgcggtattatgtagtagatgaacgtgaaaatggtcggtattatcgatgattcgatcgattttttggagtattacgtagagatcgttaaagacggtttttttattattaaagtgttgtcgagttggcgttcggataaagtttttaatatcgaataggcgatttttaacgattatatggcgaagttgggcgaagttttcgatatcgatattcgtcgttttgttgatttgtaaattgttttgattaaacgtttggattatttcgtcgtttacggttgtaaagtgtttgattacgcgttggatgtggtgatgtttgttgaagcgaacgaagcggaattggatagtattttggcgcgtcgtttggttggcgaaattttgagcgagtacgaagtggcgtagtttaaaattgcggtattggtgttttttggtgtcgaatatgtacgtcgcggttgggtatagtagtattatattggcgcgttgcgtaataataattgcgttagtttaaattgttggggtcggatgtaggtt

SEQ ID NO: 8190 - DNA, 737 bp, Artificial Sequence
  chemically treated genomic DNA (Homo sapiens) CpG-island No: 8190
aacctacatccgaccccaacaatttaaactaacgcaattattattacgcaacgcgccaatataatactactatacccaaccgcgacgtacatattcgacaccaaaaaacaccaataccgcaattttaaactacgccacttcgtactcgctcaaaatttcgccaaccaaacgacgcgccaaaatactatccaattccgcttcgttcgcttcaacaaacatcaccacatccaacgcgtaatcaaacactttacaaccgtaaacgacgaaataatccaaacgtttaatcaaaacaatttacaaatcaacaaaacgacgaatatcgatatcgaaaacttcgcccaacttcgccatataatcgttaaaaatcgcctattcgatattaaaaactttatccgaacgccaactcgacaacactttaataataaaaaaaccgtctttaacgatctctacgtaatactccaaaaaatcgatcgaatcatcgataataccgaccattttcacgttcatctactacataataccgcgcgcgaaaaaattatcctacgccaacaattcgttacattcgttccaaatttcatcgacaattaacgaaaaaaacaatttaccaataataccaaacgaacgacgcaattcgaaatacgtccaataatataacgaattaccgataatatacgaaacaatcgccgcccaaacgtcaaatttttcacgatcaaacgcatcaccgatacacaaacgct

SEQ ID NO: 8191 - DNA, 737 bp, Artificial Sequence
  chemically treated genomic DNA (Homo sapiens) CpG-island No: 8191
agtttatattcggttttagtagtttgaattgacgtagttgttattacgtagcgcgttaatgtggtattgttgtatttagtcgcgacgtgtatattcggtattaaggaatattagtatcgtagttttgaattgcgttatttcgtgttcgtttagggtttcgttagttagacggcgcgttagaatgttgtttagtttcgtttcgttcgttttagtaaatattattatatttagcgcgtggttagatattttatagtcgtgagcggcgaagtgatttagacgtttggttagggtagtttgtaggttagtaaagcggcgaatgtcggtatcggaaatttcgtttagtttcgttatgtagtcgttaaaggtcgtttgttcgatgttgaaggttttgttcggacgttagttcggtagtattttgatggtgaaagagtcgtttttggcgatttttgcgtgatgttttagagaatcgatcgggttatcggtggtgtcgattatttttacgtttatttgttgtatgatgtcgcgcgcggagaagttattttgcgttagtagttcgttatattcgttttagattttatcggtagttgacggagaaagtaatttgttagtgatattaaacggacggcgtagttcgaggtgcgtttagtggtataacgggttgtcgatagtgtgcggaatagtcgtcgtttaggcgttaaattttttacggttagacgtattatcggtatatagacgtt

SEQ ID NO: 8192 - DNA, 737 bp, Artificial Sequence
  chemically treated genomic DNA (Homo sapiens) CpG-island No: 8192
aacgtctatataccgataatacgtctaaccgtaaaaaatttaacgcctaaacgacgactattccgcacactatcgacaacccgttataccactaaacgcacctcgaactacgccgtccgtttaatatcactaacaaattactttctccgtcaactaccgataaaatctaaaacgaatataacgaactactaacgcaaaataacttctccgcgcgcgacatcatacaacaaataaacgtaaaaataatcgacaccaccgataacccgatcgattctctaaaacatcacgcaaaaatcgccaaaaacgactctttcaccatcaaaatactaccgaactaacgtccgaacaaaaccttcaacatcgaacaaacgacctttaacgactacataacgaaactaaacgaaatttccgataccgacattcgccgctttactaacctacaaactaccctaaccaaacgtctaaatcacttcgccgctcacgactataaaatatctaaccacgcgctaaatataataatatttactaaaacgaacgaaacgaaactaaacaacattctaacgcgccgtctaactaacgaaaccctaaacgaacacgaaataacgcaattcaaaactacgatactaatattccttaataccgaatatacacgtcgcgactaaatacaacaataccacattaacgcgctacgtaataacaactacgtcaattcaaactactaaaaccgaatataaact

SEQ ID NO: 8193 - DNA, 853 bp, Artificial Sequence
  chemically treated genomic DNA (Homo sapiens) CpG-island No: 8193
  misc_feature (247)..(247): n is either a, c, g or t
  misc_feature (267)..(267): n is either a, c, g or t
  misc_feature (720)..(720): n is either a, c, g or t
  misc_feature (722)..(723): n is either a, c, g or t
  misc_feature (740)..(740): n is either a, c, g or t
  misc_feature (753)..(753): n is either a, c, g or t
  misc_feature (769)..(770): n is either a, c, g or t
ataaattatcgtcgattagtgcgttacgttcgtttagtttatgggtttgcgatatattgtttgcggataggagtcgatattggtgacgtggtcgtgttttagtttatttatcgtttagttggacgatatagcggcggattgtcgttagtagaaggtagaattatacgttgtgtatagacgttttacggcgttttatttttacggtttagcgattcgatttgtataagagcgagcgggtttatgttgntttataggttttgttattgncgttgatatggttcgtaatttttgagagggaatcgtcgcgatattatttggtttattacgtaattgatgtttgggatcgagttagtagagtgtatattcgtatcgcgtagtatttatgttaagtatcgttcggattacgcgttgatgatagtttatagcgttcgcgttgcgagtagtgtcgttatcgattttttatcggtcgaacggtggatttagattagttcggtatggtttcgtaaatcggttttatatttttttagtcgttagttgttagcggagtggtagttatttcgcgattattcggtatacggtaagttacgtagagtttaattttttttaggttatttagtaacgtttacgtttagttaggtagaagttagatagggagtttagttgtatcgtacgacgaacggtaacggtgtttagttagtcggtacgacgacgacgtttcgntnnagttgttgtcgaagtgntcgttgattttgncgttgtacgaggaatnntcgttagttttatttaaatagttcggtcgggaacggatttgtatttatacgagtggagtaagttttgaggatatttagaacgt

SEQ ID NO: 8194 - DNA, 853 bp, Artificial Sequence
  chemically treated genomic DNA (Homo sapiens) CpG-island No: 8194
  misc_feature (84)..(85): n is either a, c, g or t
  misc_feature (101)..(101): n is either a, c, g or t
  misc_feature (114)..(114): n is either a, c, g or t
  misc_feature (131)..(132): n is either a, c, g or t
  misc_feature (134)..(134): n is either a, c, g or t
  misc_feature (587)..(587): n is either a, c, g or t
  misc_feature (607)..(607): n is either a, c, g or t
acgttctaaatatcctcaaaacttactccactcgtataaatacaaatccgttcccgaccgaactatttaaataaaactaacgannattcctcgtacaacgncaaaatcaacgancacttcgacaacaactnnancgaaacgtcgtcgtcgtaccgactaactaaacaccgttaccgttcgtcgtacgatacaactaaactccctatctaacttctacctaactaaacgtaaacgttactaaataacctaaaaaaaattaaactctacgtaacttaccgtataccgaataatcgcgaaataactaccactccgctaacaactaacgactaaaaaaatataaaaccgatttacgaaaccataccgaactaatctaaatccaccgttcgaccgataaaaaatcgataacgacactactcgcaacgcgaacgctataaactatcatcaacgcgtaatccgaacgatacttaacataaatactacgcgatacgaatatacactctactaactcgatcccaaacatcaattacgtaataaaccaaataatatcgcgacgattccctctcaaaaattacgaaccatatcaacgncaataacaaaacctataaancaacataaacccgctcgctcttatacaaatcgaatcgctaaaccgtaaaaataaaacgccgtaaaacgtctatacacaacgtataattctaccttctactaacgacaatccgccgctatatcgtccaactaaacgataaataaactaaaacacgaccacgtcaccaatatcgactcctatccgcaaacaatatatcgcaaacccataaactaaacgaacgtaacgcactaatcgacgataatttat

SEQ ID NO: 8195 - DNA, 853 bp, Artificial Sequence
  chemically treated genomic DNA (Homo sapiens) CpG-island No: 8195
  misc_feature (84)..(85): n is either a, c, g or t
  misc_feature (101)..(101): n is either a, c, g or t
  misc_feature (114)..(114): n is either a, c, g or t
  misc_feature (131)..(132): n is either a, c, g or t
  misc_feature (134)..(134): n is either a, c, g or t
  misc_feature (587)..(587): n is either a, c, g or t
  misc_feature (607)..(607): n is either a, c, g or t
acgttttgggtatttttaaagtttattttattcgtgtaggtgtaggttcgttttcgatcgaattgtttagatgaaattggcganngtttttcgtgtaacgntagggttaacgantatttcggtagtaattnnancggggcgtcgtcgtcgtatcggttggttggatatcgttgtcgttcgtcgtgcggtatagttgaattttttgtttggtttttgtttgattaaacgtggacgttgttggatggtttgaaagaggttaaattttgcgtggtttatcgtatgtcggatggtcgcgaagtgattattatttcgttggtagttgacgattggaaaggtgtagagtcgatttacgaaattatgtcgggttggtttgaatttatcgttcggtcggtgaaagatcggtagcggtattgttcgtagcgcggacgttgtagattattattagcgcgtgattcgaacgatgtttgatatgggtgttgcgcgatgcgaatatatattttgttagttcggttttaggtattagttacgtgataagttaagtgatatcgcggcgatttttttttaggagttgcgagttatgttagcgntaatgatagagtttgtgagntagtatgggttcgttcgtttttatatagatcggatcgttagatcgtggagatgagacgtcgtggggcgtttatgtataacgtgtaattttgttttttgttagcgataattcgtcgttgtgtcgtttagttaggcggtaaataggttgaagtacggttacgttattagtatcggtttttgttcgtaagtagtatgtcgtaagtttatgaattggacgaacgtggcgtattgatcggcggtaatttgt

SEQ ID NO: 8196 - DNA, 853 bp, Artificial Sequence
  chemically treated genomic DNA (Homo sapiens) CpG-island No: 8196
  misc_feature (247)..(247): n is either a, c, g or t
  misc_feature (267)..(267): n is either a, c, g or t
  misc_feature (720)..(720): n is either a, c, g or t
  misc_feature (722)..(723): n is either a, c, g or t
  misc_feature (740)..(740): n is either a, c, g or t
  misc_feature (753)..(753): n is either a, c, g or t
  misc_feature (769)..(770): n is either a, c, g or t
acaaattaccgccgatcaatacgccacgttcgtccaattcataaacttacgacatactacttacgaacaaaaaccgatactaataacgtaaccgtacttcaacctatttaccgcctaactaaacgacacaacgacgaattatcgctaacaaaaaacaaaattacacgttatacataaacgccccacgacgtctcatctccacgatctaacgatccgatctatataaaaacgaacgaacccatactanctcacaaactctatcattancgctaacataactcgcaactcctaaaaaaaaatcgccgcgatatcacttaacttatcacgtaactaatacctaaaaccgaactaacaaaatatatattcgcatcgcgcaacacccatatcaaacatcgttcgaatcacgcgctaataataatctacaacgtccgcgctacgaacaataccgctaccgatctttcaccgaccgaacgataaattcaaaccaacccgacataatttcgtaaatcgactctacacctttccaatcgtcaactaccaacgaaataataatcacttcgcgaccatccgacatacgataaaccacgcaaaatttaacctctttcaaaccatccaacaacgtccacgtttaatcaaacaaaaaccaaacaaaaaattcaactataccgcacgacgaacgacaacgatatccaaccaaccgatacgacgacgacgccccgntnnaattactaccgaaatantcgttaaccctancgttacacgaaaaacnntcgccaatttcatctaaacaattcgatcgaaaacgaacctacacctacacgaataaaataaactttaaaaatacccaaaacgt

SEQ ID NO: 8197 - DNA, 647 bp, Artificial Sequence
  chemically treated genomic DNA (Homo sapiens) CpG-island No: 8197
agatcggtcgttagtagtaatagcgtttcgtatagcgtcgtttgggttagtttttagcgagcggtgtcgttaatgcgtcgggtaatgtgcggtgcgattaaagtaataaaggaaatcggttcggtaagcgttgttgtcgtagcggtaagtattattgtaattagtattattaatagacgcgaacgttcgacgttgacgtttagcgtatacgcggtattatcgtttatttttagtaagcgtattcggcgtattagtaaggcggcggtaatgagtattaatataatgatgggtgcggaaggcgaggttttgtttacgttaggtcgtttgagcgattcggtattttataaatttgttgttacgcgtcgttttttaaacgacgttttttacgtaatacgttagttattaaacggttattagtatggcgcgaacgtcgatatcgattaataattaatcgtaaaggtgtttattgtcgtgcgttaggcgagtagttagattagtagcgaagttgataatgtcgtttattattgttgatagcgcgatattcgttaggttttgattaaatagtattatcgttattagtacgtcgttttacgtttcggttgttaaagtttattacgtttagggttgtcgagacgggttacgtatta

SEQ ID NO: 8198 - DNA, 647 bp, Artificial Sequence
  chemically treated genomic DNA (Homo sapiens) CpG-island No: 8198
taatacgtaacccgtctcgacaaccctaaacgtaataaactttaacaaccgaaacgtaaaacgacgtactaataacgataatactatttaatcaaaacctaacgaatatcgcgctatcaacaataataaacgacattatcaacttcgctactaatctaactactcgcctaacgcacgacaataaacacctttacgattaattattaatcgatatcgacgttcgcgccatactaataaccgtttaataactaacgtattacgtaaaaaacgtcgtttaaaaaacgacgcgtaacaacaaatttataaaataccgaatcgctcaaacgacctaacgtaaacaaaacctcgccttccgcacccatcattatattaatactcattaccgccgccttactaatacgccgaatacgcttactaaaaataaacgataataccgcgtatacgctaaacgtcaacgtcgaacgttcgcgtctattaataatactaattacaataatacttaccgctacgacaacaacgcttaccgaaccgatttcctttattactttaatcgcaccgcacattacccgacgcattaacgacaccgctcgctaaaaactaacccaaacgacgctatacgaaacgctattactactaacgaccgatct

SEQ ID NO: 8199 - DNA, 647 bp, Artificial Sequence
  chemically treated genomic DNA (Homo sapiens) CpG-island No: 8199
tgatgcgtaattcgtttcggtagttttgagcgtaatgggttttaatagtcggggcgtggagcggcgtgttggtggcgatggtgttgtttggttaggatttgacgggtatcgcgttgttagtaatggtgggcggtattgttagtttcgttgttggtttggttgttcgtttggcgtacggtagtggatatttttgcggttgattattagtcggtatcggcgttcgcgttatgttggtggtcgtttaatagttggcgtgttgcgtggagagcgtcgtttagagagcggcgcgtaatagtaggtttgtggaatgtcggatcgtttaagcggtttgacgtgggtaaaatttcgtttttcgtatttattattatattgatgtttattgtcgtcgttttattggtacgtcggatgcgtttgttggaaatgggcgatgatatcgcgtgtgcgttgggcgttagcgtcgaacgttcgcgtttgttaatgatgttggttgtagtggtgtttatcgttgcggtaatagcgtttgtcgggtcgattttttttattgttttagtcgtatcgtatattgttcgacgtattagcggtatcgttcgttgggggttaatttaggcggcgttatgcggggcgttgttattgttggcggtcgattt

SEQ ID NO: 8200 - DNA, 647 bp, Artificial Sequence
  chemically treated genomic DNA (Homo sapiens) CpG-island No: 8200
aaatcgaccgccaacaataacaacgccccgcataacgccgcctaaattaacccccaacgaacgataccgctaatacgtcgaacaatatacgatacgactaaaacaataaaaaaaatcgacccgacaaacgctattaccgcaacgataaacaccactacaaccaacatcattaacaaacgcgaacgttcgacgctaacgcccaacgcacacgcgatatcatcgcccatttccaacaaacgcatccgacgtaccaataaaacgacgacaataaacatcaatataataataaatacgaaaaacgaaattttacccacgtcaaaccgcttaaacgatccgacattccacaaacctactattacgcgccgctctctaaacgacgctctccacgcaacacgccaactattaaacgaccaccaacataacgcgaacgccgataccgactaataatcaaccgcaaaaatatccactaccgtacgccaaacgaacaaccaaaccaacaacgaaactaacaataccgcccaccattactaacaacgcgatacccgtcaaatcctaaccaaacaacaccatcgccaccaacacgccgctccacgccccgactattaaaacccattacgctcaaaactaccgaaacgaattacgcatca

SEQ ID NO: 8201 - DNA, 894 bp, Artificial Sequence
  chemically treated genomic DNA (Homo sapiens) CpG-island No: 8201
  misc_feature (608)..(608): n is either a, c, g or t
gttagattcgttaatttgtagtcgataaatgttataatatcggattagacgatcgtaatggcgatgttttttagttgtattagtaattgatggtttatcgttatatttttagcgaagtttacgtcgtttagcgagttggcggtaaaaatttcggttatgatatagtcgataatgttataaacgtcgtgtatatcgaagatatcgtagggattatttattcgtagtaagcgtttgagtatggtaacgttttataagttcgttagattagttattacgtcgataattaacgcgtcgttaattttaatgtagtcgtaggttggcgttacgtcgattagatcggtaatcgcgttagaatacgtttttagtagtgaaggtttattacgtagcgtttatttatcgaagatttagttaagaattgtcgtcgtcgttgcgattatagtatttataaatgttagtgtcgcgattttattcgtcgtgttcgttgattcggcgttaaagttaaattaatcgatatagagaatggtagtttcggtgaagattatcggtaggttgtgcggtttaaacgtttttttatcgaagtttacgcgtttttttattagatacgcgtntattagaacggcgatagcggcgtttatgtgtattaggtgttatcgggaaattagcgtacgcgagaagttaggaaatatcggttaattatatggtaatcgagggaaaaagggtgttaatataggaaatattcggttaaacggatcgtcgttaggcgtaaaaatggcgcgagaacgggaaatttcgagatcggtatggtatttttttttttttcgttttttttttttgtgttacgaggtttttatagtaggtttcgaaaaaaagatgcgacgtatatagggaatatag

SEQ ID NO: 8202 - DNA, 894 bp, Artificial Sequence
  chemically treated genomic DNA (Homo sapiens) CpG-island No: 8202
  misc_feature (287)..(287): n is either a, c, g or t
ctatattccctatatacgtcgcatctttttttcgaaacctactataaaaacctcgtaacacaaaaaaaaaaaacgaaaaaaaaaaaaataccataccgatctcgaaatttcccgttctcgcgccatttttacgcctaacgacgatccgtttaaccgaatatttcctatattaacaccctttttccctcgattaccatataattaaccgatatttcctaacttctcgcgtacgctaatttcccgataacacctaatacacataaacgccgctatcgccgttctaatanacgcgtatctaataaaaaaacgcgtaaacttcgataaaaaaacgtttaaaccgcacaacctaccgataatcttcaccgaaactaccattctctatatcgattaatttaactttaacgccgaatcaacgaacacgacgaataaaatcgcgacactaacatttataaatactataatcgcaacgacgacgacaattcttaactaaatcttcgataaataaacgctacgtaataaaccttcactactaaaaacgtattctaacgcgattaccgatctaatcgacgtaacgccaacctacgactacattaaaattaacgacgcgttaattatcgacgtaataactaatctaacgaacttataaaacgttaccatactcaaacgcttactacgaataaataatccctacgatatcttcgatatacacgacgtttataacattatcgactatatcataaccgaaatttttaccgccaactcgctaaacgacgtaaacttcgctaaaaatataacgataaaccatcaattactaatacaactaaaaaacatcgccattacgatcgtctaatccgatattataacatttatcgactacaaattaacgaatctaac

SEQ ID NO: 8203 - DNA, 894 bp, Artificial Sequence
  chemically treated genomic DNA (Homo sapiens) CpG-island No: 8203
  misc_feature (287)..(287): n is either a, c, g or t
ttgtgttttttgtatacgtcgtatttttttttcggaatttgttgtgggaatttcgtgatataagggagggaaacgagggggggggggatgttatatcggtttcggggtttttcgttttcgcgttatttttgcgtttggcggcgattcgtttaatcgggtattttttgtgttggtattttttttttttcggttgttatatggttggtcggtgttttttggtttttcgcgtgcgttgatttttcggtggtatttggtgtatatagacgtcgttatcgtcgttttggtgngcgcgtatttgataggaaaacgcgtgggtttcggtaaagaggcgtttaaatcgtataatttgtcgatggtttttatcgggattgttattttttatatcggttggtttggttttaacgtcgggttagcgggtacggcgaatgaaatcgcggtattggtatttgtgaatattgtggtcgtaacggcggcggtaatttttggttggattttcggtgaatgggcgttgcgtggtaagtttttattgttgggggcgtgttttggcgcgattgtcggtttggtcggcgtgacgttagtttgcggttatattggggttggcggcgcgttgattatcggcgtggtagttggtttggcgggtttgtggggcgttattatgtttaaacgtttgttgcgggtggatgatttttgcgatgttttcggtgtgtacggcgtttgtggtattgtcggttgtattatgatcgggatttttgtcgttagttcgttgggcggcgtgggtttcgttgaaggtgtgacgatgggttattagttgttggtatagttggaaagtatcgttattacgatcgtttggttcggtgttgtggtatttatcggttataaattggcggatttgat

SEQ ID NO: 8204 - DNA, 894 bp, Artificial Sequence
  chemically treated genomic DNA (Homo sapiens) CpG-island No: 8204
  misc_feature (608)..(608): n is either a, c, g or t
atcaaatccgccaatttataaccgataaataccacaacaccgaaccaaacgatcgtaataacgatactttccaactataccaacaactaataacccatcgtcacaccttcaacgaaacccacgccgcccaacgaactaacgacaaaaatcccgatcataatacaaccgacaataccacaaacgccgtacacaccgaaaacatcgcaaaaatcatccacccgcaacaaacgtttaaacataataacgccccacaaacccgccaaaccaactaccacgccgataatcaacgcgccgccaaccccaatataaccgcaaactaacgtcacgccgaccaaaccgacaatcgcgccaaaacacgcccccaacaataaaaacttaccacgcaacgcccattcaccgaaaatccaaccaaaaattaccgccgccgttacgaccacaatattcacaaataccaataccgcgatttcattcgccgtacccgctaacccgacgttaaaaccaaaccaaccgatataaaaaataacaatcccgataaaaaccatcgacaaattatacgatttaaacgcctctttaccgaaacccacgcgttttcctatcaaatacgcgcncaccaaaacgacgataacgacgtctatatacaccaaataccaccgaaaaatcaacgcacgcgaaaaaccaaaaaacaccgaccaaccatataacaaccgaaaaaaaaaaaataccaacacaaaaaatacccgattaaacgaatcgccgccaaacgcaaaaataacgcgaaaacgaaaaaccccgaaaccgatataacatccccccccccctcgtttccctcccttatatcacgaaattcccacaacaaattccgaaaaaaaaatacgacgtatacaaaaaacacaa

SEQ ID NO: 8205 - DNA, 526 bp, Artificial Sequence
  chemically treated genomic DNA (Homo sapiens) CpG-island No: 8205
atcgtcggagtaattgcgttattattgagtcgcgcgttgaatagtttgagtttcggtagtcgatatcgcgacggcgttgggtagtcgttgtggcgcgtatatagttgattggtttgttggcgattttcgtgttttgtggtcgtgttgttgtgttttcgttggttcgattgtttttattggtttgatgatgtcgtatatggcgcgttggttggtgggtgtcgattatcgttggtcgttgttcgttacgttatttgttatttttgttttgttgttgtttgtcgatattatcgggcgggtgattgtgttcggcgaattgcgcgtttttgtggttagtgcgtttattggtgtatcggtgttgatttttttcgtgcgacgtaaaacgcgaggtggtgtatgatttacgtttttcgtcgattatttattatttgtttgttgttggttttcgtttgtgtggttgtaggtatttggggattacgtaagcggatgttcgttacgttggaaatttcgtaggtattcgtcgcgttga

SEQ ID NO: 8206 - DNA, 526 bp, Artificial Sequence
  chemically treated genomic DNA (Homo sapiens) CpG-island No: 8206
tcaacgcgacgaatacctacgaaatttccaacgtaacgaacatccgcttacgtaatccccaaatacctacaaccacacaaacgaaaaccaacaacaaacaaataataaataatcgacgaaaaacgtaaatcatacaccacctcgcgttttacgtcgcacgaaaaaaatcaacaccgatacaccaataaacgcactaaccacaaaaacgcgcaattcgccgaacacaatcacccgcccgataatatcgacaaacaacaacaaaacaaaaataacaaataacgtaacgaacaacgaccaacgataatcgacacccaccaaccaacgcgccatatacgacatcatcaaaccaataaaaacaatcgaaccaacgaaaacacaacaacacgaccacaaaacacgaaaatcgccaacaaaccaatcaactatatacgcgccacaacgactacccaacgccgtcgcgatatcgactaccgaaactcaaactattcaacgcgcgactcaataataacgcaattactccgacgat

SEQ ID NO: 8207 - DNA, 526 bp, Artificial Sequence
  chemically treated genomic DNA (Homo sapiens) CpG-island No: 8207
ttagcgcggcgaatatttgcgaggtttttagcgtgacgggtattcgtttgcgtaatttttagatatttgtaattatataggcggaaattagtagtaaataggtgatgagtaatcggcgagagacgtaaattatgtattatttcgcgttttacgtcgtacgaggaagattagtatcggtgtattaataaacgtattgattatagaaacgcgtagttcgtcgggtataattattcgttcgatgatatcggtaaatagtagtagggtaggggtagtaagtagcgtgacgggtagcgattagcgatgatcggtatttattagttaacgcgttatatgcggtattattaggttaataaaggtaatcgggttaacgaggatatagtagtacgattataaagtacgggaatcgttagtagattaattaattgtgtgcgcgttatagcgattgtttagcgtcgtcgcggtatcgattgtcgaggtttaaattgtttagcgcgcgatttagtaatagcgtagttgtttcggcgat

SEQ ID NO: 8208 - DNA, 526 bp, Artificial Sequence
  chemically treated genomic DNA (Homo sapiens) CpG-island No: 8208
atcgccgaaacaactacgctattactaaatcgcgcgctaaacaatttaaacctcgacaatcgataccgcgacgacgctaaacaatcgctataacgcgcacacaattaattaatctactaacgattcccgtactttataatcgtactactatatcctcgttaacccgattacctttattaacctaataataccgcatataacgcgttaactaataaataccgatcatcgctaatcgctacccgtcacgctacttactacccctaccctactactatttaccgatatcatcgaacgaataattatacccgacgaactacgcgtttctataatcaatacgtttattaatacaccgatactaatcttcctcgtacgacgtaaaacgcgaaataatacataatttacgtctctcgccgattactcatcacctatttactactaatttccgcctatataattacaaatatctaaaaattacgcaaacgaatacccgtcacgctaaaaacctcgcaaatattcgccgcgctaa

SEQ ID NO: 8209 - DNA, 761 bp, Artificial Sequence
  chemically treated genomic DNA (Homo sapiens) CpG-island No: 8209
ggtgatggtcgagtattaaattttgtcgcgtttgcgcgagcgtttttttttatcgtagtcgtcggtttgtttgcgtttgattatttttggtcgttcggaaagcgatttggtataaagtttggatattttataattgtcgtcgggcgtaataatgggttatcgttttttaatgtttattatcgaattgaaatttatcggatcggtaagcgagtaataggcgatggaaaaattgtggttggatgttaaacgtgttgtcggatagagcgtgattttcgaaggtattgaaggattgttcgcgtagattagtcgcgaattgtaaaatcgttagtttagtttgacgttgagcgagtaatttatcggtggtttattggttttgtaattttttcgcgtaggtgttttattgttggcgtgtgaagtggtttttttataggaggaaattttggcgtaaattgcgtattggattatagaacggcgggttaattattttgtcgggttggtattggttgtttcgggtttcgagaacgagtattttaattttgcgttagttacgttagacggtattttcgttttgcgtgtgcgttttagtattacgcgttatagtttggttattcgttaggaagtgtgcgtaatgatggtattgaatatgttgcgtcgttggttaaacggttaggatatcgttagtgagtatggttggattgaggttgttgagtttatgattttatttgtttgatttcgttattttgtgtcggtttattgtatcg

SEQ ID NO: 8210 - DNA, 761 bp, Artificial Sequence
  chemically treated genomic DNA (Homo sapiens) CpG-island No: 8210
cgatacaataaaccgacacaaaataacgaaatcaaacaaataaaatcataaactcaacaacctcaatccaaccatactcactaacgatatcctaaccgtttaaccaacgacgcaacatattcaataccatcattacgcacacttcctaacgaataaccaaactataacgcgtaatactaaaacgcacacgcaaaacgaaaataccgtctaacgtaactaacgcaaaattaaaatactcgttctcgaaacccgaaacaaccaataccaacccgacaaaataattaacccgccgttctataatccaatacgcaatttacgccaaaatttcctcctataaaaaaaccacttcacacgccaacaataaaacacctacgcgaaaaaattacaaaaccaataaaccaccgataaattactcgctcaacgtcaaactaaactaacgattttacaattcgcgactaatctacgcgaacaatccttcaataccttcgaaaatcacgctctatccgacaacacgtttaacatccaaccacaatttttccatcgcctattactcgcttaccgatccgataaatttcaattcgataataaacattaaaaaacgataacccattattacgcccgacgacaattataaaatatccaaactttataccaaatcgctttccgaacgaccaaaaataatcaaacgcaaacaaaccgacgactacgataaaaaaaaacgctcgcgcaaacgcgacaaaatttaatactcgaccatcacc

SEQ ID NO: 8211 - DNA, 761 bp, Artificial Sequence
  chemically treated genomic DNA (Homo sapiens) CpG-island No: 8211
cggtgtagtaaatcggtatagagtggcggaattagatagataaggttatggatttaataattttaatttagttatgtttattggcgatattttggtcgtttaattaacggcgtagtatatttagtgttattattgcgtatattttttgacggatagttaggttgtagcgcgtagtgttgaaacgtatacgtagagcgaaagtgtcgtttggcgtggttagcgtaaagttgagatgttcgttttcgaaattcgaaatagttagtgttagttcggtaaaatggttggttcgtcgttttgtaatttagtgcgtagtttgcgttagggtttttttttgtgaaggaattattttatacgttagtaatggagtatttgcgcgagaaagttgtaaagttaataaattatcggtgaattgttcgtttaacgttaggttgaattggcggttttgtaattcgcgattgatttgcgcgggtagttttttagtgttttcgaaaattacgttttgttcggtaatacgtttaatatttagttatagtttttttatcgtttgttgttcgtttgtcggttcggtgagttttagttcgatgataggtattgaggagcgatagtttattgttacgttcggcggtagttgtagagtgtttaggttttgtgttagatcgtttttcgaacgattaaaagtagttaaacgtagataaatcggcggttgcggtaaagaaaaacgttcgcgtaggcgcggtaggatttggtgttcgattattatt

SEQ ID NO: 8212 - DNA, 761 bp, Artificial Sequence
  chemically treated genomic DNA (Homo sapiens) CpG-island No: 8212
aataataatcgaacaccaaatcctaccgcgcctacgcgaacgtttttctttaccgcaaccgccgatttatctacgtttaactacttttaatcgttcgaaaaacgatctaacacaaaacctaaacactctacaactaccgccgaacgtaacaataaactatcgctcctcaatacctatcatcgaactaaaactcaccgaaccgacaaacgaacaacaaacgataaaaaaactataactaaatattaaacgtattaccgaacaaaacgtaattttcgaaaacactaaaaaactacccgcgcaaatcaatcgcgaattacaaaaccgccaattcaacctaacgttaaacgaacaattcaccgataatttattaactttacaactttctcgcgcaaatactccattactaacgtataaaataattccttcacaaaaaaaaaccctaacgcaaactacgcactaaattacaaaacgacgaaccaaccattttaccgaactaacactaactatttcgaatttcgaaaacgaacatctcaactttacgctaaccacgccaaacgacactttcgctctacgtatacgtttcaacactacgcgctacaacctaactatccgtcaaaaaatatacgcaataataacactaaatatactacgccgttaattaaacgaccaaaatatcgccaataaacataactaaattaaaattattaaatccataaccttatctatctaattccgccactctataccgatttactacaccg

SEQ ID NO: 8213 - DNA, 649 bp, Artificial Sequence
  chemically treated genomic DNA (Homo sapiens) CpG-island No: 8213
  misc_feature (598)..(598): n is either a, c, g or t
gtatatttattacgtcgttagttacgttacgggacgcgttttattgttggaagataattttgttgaattggttttcgatatttcgttatggttggtagataacgatcgtttggtattgcgcgatatttttgttcgtaatacgttggtcggagcgcgcgtcgtgatgtttaattcgtcgcgtcgcggtaaacgtaagtcggaatatttgtaatggttggcgttttttgtacgggcgtagagcgatgtcgatgcgttatttgtttatttggaacgcggcgcggttaattttgcggatttcgtttgggcgcgttagtttaacggcgaagggatgcgcgaattgttgtaatagtttggttatatttaggttggttatagtttgttgaatgcgtcggttgtcgttcgttggtagcggaaaattttcgatatattagcgatttattatgagtaatatcgcgatgaatttggttttgggcgcgaacgtttgcgacgtatggcgttgttaatggaagatgaagcgttggtattgttgttgattgaaaagatgcgcgaaagcggcgatatttatagttattacggttggttgtatttgttagattantaagcgggttttagcgaagagtagaaggtatttggtaaaagcgagttttgt

SEQ ID NO: 8214 - DNA, 649 bp, Artificial Sequence
  chemically treated genomic DNA (Homo sapiens) CpG-island No: 8214
  misc_feature (52)..(52): n is either a, c, g or t
acaaaactcgcttttaccaaataccttctactcttcgctaaaacccgcttantaatctaacaaatacaaccaaccgtaataactataaatatcgccgctttcgcgcatcttttcaatcaacaacaataccaacgcttcatcttccattaacaacgccatacgtcgcaaacgttcgcgcccaaaaccaaattcatcgcgatattactcataataaatcgctaatatatcgaaaattttccgctaccaacgaacgacaaccgacgcattcaacaaactataaccaacctaaatataaccaaactattacaacaattcgcgcatcccttcgccgttaaactaacgcgcccaaacgaaatccgcaaaattaaccgcgccgcgttccaaataaacaaataacgcatcgacatcgctctacgcccgtacaaaaaacgccaaccattacaaatattccgacttacgtttaccgcgacgcgacgaattaaacatcacgacgcgcgctccgaccaacgtattacgaacaaaaatatcgcgcaataccaaacgatcgttatctaccaaccataacgaaatatcgaaaaccaattcaacaaaattatcttccaacaataaaacgcgtcccgtaacgtaactaacgacgtaataaatatac

SEQ ID NO: 8215 - DNA, 649 bp, Artificial Sequence
  chemically treated genomic DNA (Homo sapiens) CpG-island No: 8215
  misc_feature (52)..(52): n is either a, c, g or t
atagggttcgtttttgttagatgttttttgtttttcgttgaagttcgtttgntgatttggtagatgtagttagtcgtgatggttgtggatgtcgtcgttttcgcgtatttttttaattagtaatagtattagcgttttattttttattggtaacgttatacgtcgtagacgttcgcgtttagggttaggtttatcgcgatgttgtttatgataagtcgttaatgtgtcgagaatttttcgttgttagcgggcggtaatcggcgtatttaataagttataattagtttgaatataattaggttgttgtagtaattcgcgtattttttcgtcgttgagttggcgcgtttaggcgaaattcgtaaggttaatcgcgtcgcgttttagatgaatagataacgtatcggtatcgttttgcgttcgtgtaagagacgttagttattgtagatatttcggtttacgtttatcgcgacgcggcgggttaagtattacgacgcgcgtttcggttagcgtgttgcgggtagagatatcgcgtaatattaggcggtcgttatttgttagttataacggggtgtcgaagattagtttagtaaggttattttttagtagtgaaacgcgtttcgtgacgtggttggcggcgtggtgaatatgt

SEQ ID NO: 8216 - DNA, 649 bp, Artificial Sequence
  chemically treated genomic DNA (Homo sapiens) CpG-island No: 8216
  misc_feature (598)..(598): n is either a, c, g or t
acatattcaccacgccgccaaccacgtcacgaaacgcgtttcactactaaaaaataaccttactaaactaatcttcgacaccccgttataactaacaaataacgaccgcctaatattacgcgatatctctacccgcaacacgctaaccgaaacgcgcgtcgtaatacttaacccgccgcgtcgcgataaacgtaaaccgaaatatctacaataactaacgtctcttacacgaacgcaaaacgataccgatacgttatctattcatctaaaacgcgacgcgattaaccttacgaatttcgcctaaacgcgccaactcaacgacgaaaaaatacgcgaattactacaacaacctaattatattcaaactaattataacttattaaatacgccgattaccgcccgctaacaacgaaaaattctcgacacattaacgacttatcataaacaacatcgcgataaacctaaccctaaacgcgaacgtctacgacgtataacgttaccaataaaaaataaaacgctaatactattactaattaaaaaaatacgcgaaaacgacgacatccacaaccatcacgactaactacatctaccaaatcancaaacgaacttcaacgaaaaacaaaaaacatctaacaaaaacgaaccctat

SEQ ID NO: 8217 - DNA, 545 bp, Artificial Sequence
  chemically treated genomic DNA (Homo sapiens) CpG-island No: 8217
tacgcggtcgggtttacgagttttttttaatcgtcgtttcgggtttcggggttgtcgttttttttagcgtcggttttgtttttagaagcgaaggtcgttttgcgttcggtttcggtttttttttgttttttggtcggtttttttttcgcggtcgtttcgggatttgtgtttagatttttggggttacgattacgttttagtcgtttaagttatcgtttttttttttttttttagcgttttcgttcgggcggtgtatggtggtttcggtgtatggtggttttcgtacgtatagtcgtaggggtttttttttttagattcgaggcggtggcgtatttgtattttttaaaattttttcgtcggttttcgcggtttagcgggaggcgcggagggtcgagcgaggcgatgggagagtcgagttggggtgcgtgcgagcgggcgttaggaaagcgcggggtcgttttaggggttaggtttttttttaaatagtgggaggtttacgaagtgtttgaagttcgaggtttttttttttgttttagttcgttttt

SEQ ID NO: 8218 - DNA, 545 bp, Artificial Sequence
  chemically treated genomic DNA (Homo sapiens) CpG-island No: 8218
aaaaacgaactaaaacaaaaaaaaaaacctcgaacttcaaacacttcgtaaacctcccactatttaaaaaaaaacctaacccctaaaacgaccccgcgctttcctaacgcccgctcgcacgcaccccaactcgactctcccatcgcctcgctcgaccctccgcgcctcccgctaaaccgcgaaaaccgacgaaaaaattttaaaaaatacaaatacgccaccgcctcgaatctaaaaaaaaaaacccctacgactatacgtacgaaaaccaccatacaccgaaaccaccatacaccgcccgaacgaaaacgctaaaaaaaaaaaaaaaaacgataacttaaacgactaaaacgtaatcgtaaccccaaaaatctaaacacaaatcccgaaacgaccgcgaaaaaaaaaccgaccaaaaaacaaaaaaaaaccgaaaccgaacgcaaaacgaccttcgcttctaaaaacaaaaccgacgctaaaaaaaacgacaaccccgaaacccgaaacgacgattaaaaaaaactcgtaaacccgaccgcgta

SEQ ID NO: 8219 - DNA, 545 bp, Artificial Sequence
  chemically treated genomic DNA (Homo sapiens) CpG-island No: 8219
gagagcgaattaaaataaaaaggggagtttcgggttttagatatttcgtgggttttttattgtttaaagaaaggtttagtttttagggcggtttcgcgtttttttggcgttcgttcgtacgtattttagttcggtttttttatcgtttcgttcggtttttcgcgtttttcgttagatcgcgagggtcgacgggggagttttagagggtgtaggtgcgttatcgtttcgagtttaggagaggaaatttttgcggttgtgcgtgcgagaattattatatatcggagttattatatatcgttcgggcgggaacgttggaagggaggggaggggcggtgatttgggcggttggggcgtgatcgtggttttaggggtttgggtataggtttcgggacggtcgcgggaggaggatcggttagagggtagggaaaggtcgggatcgggcgtagggcggttttcgtttttgggggtagagtcgacgttgaggggagcggtagtttcgaggttcggggcggcggttggaggaggttcgtgggttcggtcgcgtg

SEQ ID NO: 8220 - DNA, 545 bp, Artificial Sequence
  chemically treated genomic DNA (Homo sapiens) CpG-island No: 8220
cacgcgaccgaacccacgaacctcctccaaccgccgccccgaacctcgaaactaccgctcccctcaacgtcgactctacccccaaaaacgaaaaccgccctacgcccgatcccgacctttccctaccctctaaccgatcctcctcccgcgaccgtcccgaaacctatacccaaacccctaaaaccacgatcacgccccaaccgcccaaatcaccgcccctcccctcccttccaacgttcccgcccgaacgatatataataactccgatatataataattctcgcacgcacaaccgcaaaaatttcctctcctaaactcgaaacgataacgcacctacaccctctaaaactcccccgtcgaccctcgcgatctaacgaaaaacgcgaaaaaccgaacgaaacgataaaaaaaccgaactaaaatacgtacgaacgaacgccaaaaaaacgcgaaaccgccctaaaaactaaacctttctttaaacaataaaaaacccacgaaatatctaaaacccgaaactcccctttttattttaattcgctctc

SEQ ID NO: 8221 - DNA, 543 bp, Artificial Sequence
  chemically treated genomic DNA (Homo sapiens) CpG-island No: 8221
gtgggcgcgcgacgggggcggttatttattcgtcggcgttagtttcgggatttggtagtcgagaagtcgtatagttgcgggtagtgtggaaagcgttttcgttggggttcggatttggcgcggtattagcgtacgtatacgggcgagaagttatataagtgttttgagtgcgataagagttttcgtagtttttcggatttggtgcgttattaaggcgtgtatacgggcgagaagttttttttttgtttcgagtgcggtaagagttttagtcgtagcgtttatttggtcgattattagcgtatatatacgggcgagaagtttttcggttgtagcgattgcggtaagagtttttcgttgcgtttttatttgttggattatcggcgtgtgtatatcggtgagcggtttttcggttgcggagagtgcgataagagttttaagtagcgcgcgtattttatcgcgtattagagtttgtacgttaagatggtttagttcgtggggtgagtagttggtttggtcggaaattcgggggaggtttagttacgg

SEQ ID NO: 8222 - DNA, 543 bp, Artificial Sequence
  chemically treated genomic DNA (Homo sapiens) CpG-island No: 8222
ccgtaactaaacctcccccgaatttccgaccaaaccaactactcaccccacgaactaaaccatcttaacgtacaaactctaatacgcgataaaatacgcgcgctacttaaaactcttatcgcactctccgcaaccgaaaaaccgctcaccgatatacacacgccgataatccaacaaataaaaacgcaacgaaaaactcttaccgcaatcgctacaaccgaaaaacttctcgcccgtatatatacgctaataatcgaccaaataaacgctacgactaaaactcttaccgcactcgaaacaaaaaaaaaacttctcgcccgtatacacgccttaataacgcaccaaatccgaaaaactacgaaaactcttatcgcactcaaaacacttatataacttctcgcccgtatacgtacgctaataccgcgccaaatccgaaccccaacgaaaacgctttccacactacccgcaactatacgacttctcgactaccaaatcccgaaactaacgccgacgaataaataaccgcccccgtcgcgcgcccac

SEQ ID NO: 8223 - DNA, 543 bp, Artificial Sequence
  chemically treated genomic DNA (Homo sapiens) CpG-island No: 8223
tcgtggttgggtttttttcgggttttcggttaagttagttgtttattttacgggttgggttattttggcgtgtaggttttgatgcgcgatgaggtgcgcgcgttgtttgaagtttttgtcgtatttttcgtagtcgaagggtcgtttatcggtgtgtatacgtcgatggtttagtaggtaggagcgtagcgagaagtttttgtcgtagtcgttgtagtcgaaaggtttttcgttcgtgtgtatgcgttggtggtcggttaggtaggcgttgcggttgaagtttttgtcgtattcggaataggagaagggtttttcgttcgtgtgtacgttttggtggcgtattaggttcgaggagttgcggaagtttttgtcgtatttagggtatttgtgtggtttttcgttcgtgtgcgtgcgttggtgtcgcgttaggttcgagttttagcggaagcgttttttatattgttcgtagttgtgcggtttttcggttgttaggtttcggaattggcgtcggcgagtgggtggtcgttttcgtcgcgcgtttat

SEQ ID NO: 8224 - DNA, 543 bp, Artificial Sequence
  chemically treated genomic DNA (Homo sapiens) CpG-island No: 8224
ataaacgcgcgacgaaaacgaccacccactcgccgacgccaattccgaaacctaacaaccgaaaaaccgcacaactacgaacaatataaaaaacgcttccgctaaaactcgaacctaacgcgacaccaacgcacgcacacgaacgaaaaaccacacaaataccctaaatacgacaaaaacttccgcaactcctcgaacctaatacgccaccaaaacgtacacacgaacgaaaaacccttctcctattccgaatacgacaaaaacttcaaccgcaacgcctacctaaccgaccaccaacgcatacacacgaacgaaaaacctttcgactacaacgactacgacaaaaacttctcgctacgctcctacctactaaaccatcgacgtatacacaccgataaacgacccttcgactacgaaaaatacgacaaaaacttcaaacaacgcgcgcacctcatcgcgcatcaaaacctacacgccaaaataacccaacccgtaaaataaacaactaacttaaccgaaaacccgaaaaaaacccaaccacga

SEQ ID NO: 8225 - DNA, 660 bp, Artificial Sequence
  chemically treated genomic DNA (Homo sapiens) CpG-island No: 8225
ggcgtacgtatacgggcgagaagttttacgtttgtattgattgcgggaagcgtttcggtcgtagttcgtattttatttagtattagattatttatacgggcgagaagttttatatttgtttcgtttgtcggaagagttttagttattattttacgttgatttagtattagcgtatttatatcggagagaagttttacgtgtgcgatcgttgcgttaagcgttttattcgtcgttcggatttggttatttattagggtatttatacgggcgttaagtcgtataagtgttttatttgcgttaagtgttttacgtagagttcggcgttagttatttattagcgtatttatattggggttaagttttattcgtgtttcgagtgcggtaagtgttttagttagcgttttaattttatcgcgtataatcgtatatatataggcgagaagttttattattgtttcgattgcggtaagagttttagttatagttcgtattttatcgcgtattagcgtatttatcgtggcgtgcggttttacgtttgttcgttgtgcggtaagagttttagtcggcgttttaatttgtatcggtacgagaagatttatattatcgggtttaaggttttggttatgttgatgttgggggcggcggcggcgggggttttgg

SEQ ID NO: 8226 - DNA, 660 bp, Artificial Sequence
  chemically treated genomic DNA (Homo sapiens) CpG-island No: 8226
ccaaaacccccgccgccgccgcccccaacatcaacataaccaaaaccttaaacccgataatataaatcttctcgtaccgatacaaattaaaacgccgactaaaactcttaccgcacaacgaacaaacgtaaaaccgcacgccacgataaatacgctaatacgcgataaaatacgaactataactaaaactcttaccgcaatcgaaacaataataaaacttctcgcctatatatatacgattatacgcgataaaattaaaacgctaactaaaacacttaccgcactcgaaacacgaataaaacttaaccccaatataaatacgctaataaataactaacgccgaactctacgtaaaacacttaacgcaaataaaacacttatacgacttaacgcccgtataaataccctaataaataaccaaatccgaacgacgaataaaacgcttaacgcaacgatcgcacacgtaaaacttctctccgatataaatacgctaatactaaatcaacgtaaaataataactaaaactcttccgacaaacgaaacaaatataaaacttctcgcccgtataaataatctaatactaaataaaatacgaactacgaccgaaacgcttcccgcaatcaatacaaacgtaaaacttctcgcccgtatacgtacgcc

SEQ ID NO: 8227 - DNA, 660 bp, Artificial Sequence
  chemically treated genomic DNA (Homo sapiens) CpG-island No: 8227
ttagagttttcgtcgtcgtcgtttttagtattagtatggttagggttttgggttcggtggtgtggattttttcgtgtcggtgtaggttggagcgtcggttgaagtttttgtcgtataacgggtaggcgtagggtcgtacgttacggtgggtgcgttggtgcgcggtgaggtgcgagttgtggttgaagtttttgtcgtagtcgaggtagtggtagggtttttcgtttgtgtgtgtgcggttgtgcgcgatgaggttggaacgttggttgaagtatttgtcgtattcggggtacggatagggtttgattttagtgtgggtgcgttggtgggtgattagcgtcgagttttgcgtgaagtatttggcgtagatggggtatttgtgcggtttggcgttcgtgtgggtgttttggtgggtgattaagttcgagcggcgggtgaagcgtttggcgtagcggtcgtatacgtagggttttttttcggtgtggatgcgttggtgttgaattagcgtggagtggtggttgaagttttttcggtaggcggggtaggtgtagggtttttcgttcgtgtggatgatttggtgttggatgaggtgcgagttgcggtcgaagcgtttttcgtagttagtgtaggcgtagggtttttcgttcgtgtgcgtgcgtt

SEQ ID NO: 8228 - DNA, 660 bp, Artificial Sequence
  chemically treated genomic DNA (Homo sapiens) CpG-island No: 8228
aacgcacgcacacgaacgaaaaaccctacgcctacactaactacgaaaaacgcttcgaccgcaactcgcacctcatccaacaccaaatcatccacacgaacgaaaaaccctacacctaccccgcctaccgaaaaaacttcaaccaccactccacgctaattcaacaccaacgcatccacaccgaaaaaaaaccctacgtatacgaccgctacgccaaacgcttcacccgccgctcgaacttaatcacccaccaaaacacccacacgaacgccaaaccgcacaaataccccatctacgccaaatacttcacgcaaaactcgacgctaatcacccaccaacgcacccacactaaaatcaaaccctatccgtaccccgaatacgacaaatacttcaaccaacgttccaacctcatcgcgcacaaccgcacacacacaaacgaaaaaccctaccactacctcgactacgacaaaaacttcaaccacaactcgcacctcaccgcgcaccaacgcacccaccgtaacgtacgaccctacgcctacccgttatacgacaaaaacttcaaccgacgctccaacctacaccgacacgaaaaaatccacaccaccgaacccaaaaccctaaccatactaatactaaaaacgacgacgacgaaaactctaa

SEQ ID NO: 8229 - DNA, 655 bp, Artificial Sequence
  chemically treated genomic DNA (Homo sapiens) CpG-island No: 8229
gggggcgtgtgtgtgtgggggagtggggtgtggtgggtggtggggcggggtgatgggttgggggtgatgtggtgtatgtgtggtggtgtgtggtgtggtgtggtggtgttggttggggggtggtggggttatgtggtgtagcgtgtttgttgtggttgggtttgtgtgtgtggtttagttgatgtgcgtgggtggtgtggggcgtggtttggtgtgtgttggttgttgggtgttgtcgtgtggtgtagttgtgttggtggggtggttgttgtgggtggggtagtgtgcgttgtgtcggtgttcgggtggtgtggtggttggagtgcggtggcgagggcgatgcgcggggttttgggtgtgggttagttgattgttttgttgtggggttgtgtggttgtggtgtggggcgttgtcgagcgtgcggtacgtgtgtttgtagttttttttattcgcgcgttagtgtgtattcgatacgattcgtgatttttcgttacgttttttgtacgttttcgttattttttcgtatttttcgtatttttcgttagtttcgtattattttcgttattttcgttatattttattatttttttattttttttattttttattttttttatttttttattttttttatttttttatttcgaggtttaaa

SEQ ID NO: 8230 - DNA, 655 bp, Artificial Sequence
  chemically treated genomic DNA (Homo sapiens) CpG-island No: 8230
tttaaacctcgaaataaaaaaataaaaaaaataaaaaaataaaaaaaataaaaaataaaaaaaataaaaaaataataaaatataacgaaaataacgaaaataatacgaaactaacgaaaaatacgaaaaatacgaaaaaataacgaaaacgtacaaaaaacgtaacgaaaaatcacgaatcgtatcgaatacacactaacgcgcgaataaaaaaaactacaaacacacgtaccgcacgctcgacaacgccccacaccacaaccacacaaccccacaacaaaacaatcaactaacccacacccaaaaccccgcgcatcgccctcgccaccgcactccaaccaccacaccacccgaacaccgacacaacgcacactaccccacccacaacaaccaccccaccaacacaactacaccacacgacaacacccaacaaccaacacacaccaaaccacgccccacaccacccacgcacatcaactaaaccacacacacaaacccaaccacaacaaacacgctacaccacataaccccaccaccccccaaccaacaccaccacaccacaccacacaccaccacacatacaccacatcacccccaacccatcaccccgccccaccacccaccacaccccactcccccacacacacacgccccc

SEQ ID NO: 8231 - DNA, 655 bp, Artificial Sequence
  chemically treated genomic DNA (Homo sapiens) CpG-island No: 8231
tttaagtttcggggtaggggggtggggagggtaggggggtggggagggtagggggtggggagggtaggggggtggtggggtgtggcgagggtagcgggggtggtgcggggttggcgaagggtacgaggggtgcggaggagtggcggagacgtatagagggcgtggcgaagagttacggatcgtgtcgggtgtatattaacgcgcgagtgaaagaggttgtaagtatacgtatcgtacgttcgataacgttttatattataattatataattttataataaaataattaattaatttatatttagaatttcgcgtatcgttttcgttatcgtattttaattattatattattcgagtatcgatataacgtatattattttatttataataattattttattaatataattatattatacgataatatttaataattaatatatattaaattacgttttatattatttacgtatattaattaaattatatatatagatttaattataatagatacgttatattatataattttattattttttaattaatattattatattatattatatattattatatatatattatattatttttaatttattatttcgttttattatttattatattttatttttttatatatatacgttttt

SEQ ID NO: 8232 - DNA, 655 bp, Artificial Sequence
  chemically treated genomic DNA (Homo sapiens) CpG-island No: 8232
aaaaacgtatatatataaaaaaataaaatataataaataataaaacgaaataataaattaaaaataatataatatatatataataatatataatataatataataatattaattaaaaaataataaaattatataatataacgtatctattataattaaatctatatatataatttaattaatatacgtaaataatataaaacgtaatttaatatatattaattattaaatattatcgtataatataattatattaataaaataattattataaataaaataatatacgttatatcgatactcgaataatataataattaaaatacgataacgaaaacgatacgcgaaattctaaatataaattaattaattattttattataaaattatataattataatataaaacgttatcgaacgtacgatacgtatacttacaacctctttcactcgcgcgttaatatacacccgacacgatccgtaactcttcgccacgccctctatacgtctccgccactcctccgcacccctcgtacccttcgccaaccccgcaccacccccgctaccctcgccacaccccaccacccccctaccctccccaccccctaccctccccacccccctaccctccccacccccctaccccgaaacttaaa

SEQ ID NO: 8233 - DNA, 859 bp, Artificial Sequence
  chemically treated genomic DNA (Homo sapiens) CpG-island No: 8233
tagttgttgaaagtgtatcgggcgttgttgatcgaaggcgtttttttgcgcgatatcgttattatcgttatcgtgttggtcgttagtagtacggtgacgaaagattatattttgttggcggtcgatgtgcgtttggtattgcggcgtagtattatttattcgttcgttcgtaagtaggagttgacggtgtatacgttgaataatgagttggaaaatttgttgattaacgtggtgaattaggcgtaatagggcgggaaagtgatgttcgatagcgtgtcggtcgattcgaatatgtttaattagttttagagtacgatgttataggtgaaagagtagatgaaagcggcggggaaagattcggtgttgttggtgttatcgtagttgcgttttttgttggcgcgttatgtaaggttgtttgcgtcggggttgtatgtgttgtcgtataacgaagtgtcggatgagttggagttgaagattatgggggcgttgatgtaagtatttagtattggtgtataattgtcggatgcggcgtgaacgttttattcgttttatcgtttaggtataagtttgtaggtatgataagacgcgttagcgtcgtattaggtatttgcgtataattgtcggatgcggtataaacgttttattcggtttatcgattcggtataagtttgtaggtatgataagacgcgttagcgtcgtattaggtatttgcgtataattatgaaatgatacgtttttcggtattaaaattcgttacgtttttcgtttaatcgatgggatataattttcgcgcgatatcgcgatggaacgttgagaatggttaattatttatttgttttatttaattatgttttattgg

SEQ ID NO: 8234 - DNA, 859 bp, Artificial Sequence
  chemically treated genomic DNA (Homo sapiens) CpG-island No: 8234
ccaataaaacataattaaataaaacaaataaataattaaccattctcaacgttccatcgcgatatcgcgcgaaaattatatcccatcgattaaacgaaaaacgtaacgaattttaataccgaaaaacgtatcatttcataattatacgcaaatacctaatacgacgctaacgcgtcttatcatacctacaaacttataccgaatcgataaaccgaataaaacgtttataccgcatccgacaattatacgcaaatacctaatacgacgctaacgcgtcttatcatacctacaaacttatacctaaacgataaaacgaataaaacgttcacgccgcatccgacaattatacaccaatactaaatacttacatcaacgcccccataatcttcaactccaactcatccgacacttcgttatacgacaacacatacaaccccgacgcaaacaaccttacataacgcgccaacaaaaaacgcaactacgataacaccaacaacaccgaatctttccccgccgctttcatctactctttcacctataacatcgtactctaaaactaattaaacatattcgaatcgaccgacacgctatcgaacatcactttcccgccctattacgcctaattcaccacgttaatcaacaaattttccaactcattattcaacgtatacaccgtcaactcctacttacgaacgaacgaataaataatactacgccgcaataccaaacgcacatcgaccgccaacaaaatataatctttcgtcaccgtactactaacgaccaacacgataacgataataacgatatcgcgcaaaaaaacgccttcgatcaacaacgcccgatacactttcaacaacta

SEQ ID NO: 8235 - DNA, 859 bp, Artificial Sequence
  chemically treated genomic DNA (Homo sapiens) CpG-island No: 8235
ttagtaaagtatggttgggtaaagtaagtgagtgattggttatttttaacgttttatcgcgatgtcgcgcgagggttatattttatcgattgggcgggggacgtaacggattttagtgtcggggagcgtattattttataattgtgcgtagatgtttgatgcgacgttagcgcgttttattatgtttataaatttgtgtcggatcggtaggtcggataaggcgtttatgtcgtattcggtagttatgcgtagatgtttgatgcgacgttggcgcgttttattatgtttataaatttgtgtttgaacggtaggacggataaggcgtttacgtcgtattcggtagttgtgtattaatgttggatatttatattaacgtttttataatttttaattttagtttattcggtatttcgttatacgatagtatatgtagtttcggcgtaaataattttgtataacgcgttagtaaagggcgtagttgcggtggtattagtagtatcgggttttttttcgtcgtttttatttgtttttttatttgtggtatcgtattttggaattggttgagtatattcggatcgatcggtacgttgtcgagtattattttttcgttttgttgcgtttgatttattacgttggttagtagattttttagtttattatttagcgtatatatcgttagtttttgtttgcgaacgaacggatgggtaatgttgcgtcgtaatgttaggcgtatatcggtcgttagtagaatatgatttttcgttatcgtgttattggcgattagtacggtggcgatggtgacgatatcgcgtagggaaacgttttcggttagtagcgttcggtatatttttagtaattg

SEQ ID NO: 8236 - DNA, 859 bp, Artificial Sequence
  chemically treated genomic DNA (Homo sapiens) CpG-island No: 8236
caattactaaaaatataccgaacgctactaaccgaaaacgtttccctacgcgatatcgtcaccatcgccaccgtactaatcgccaataacacgataacgaaaaatcatattctactaacgaccgatatacgcctaacattacgacgcaacattacccatccgttcgttcgcaaacaaaaactaacgatatatacgctaaataataaactaaaaaatctactaaccaacgtaataaatcaaacgcaacaaaacgaaaaaataatactcgacaacgtaccgatcgatccgaatatactcaaccaattccaaaatacgataccacaaataaaaaaacaaataaaaacgacgaaaaaaaacccgatactactaataccaccgcaactacgccctttactaacgcgttatacaaaattatttacgccgaaactacatatactatcgtataacgaaataccgaataaactaaaattaaaaattataaaaacgttaatataaatatccaacattaatacacaactaccgaatacgacgtaaacgccttatccgtcctaccgttcaaacacaaatttataaacataataaaacgcgccaacgtcgcatcaaacatctacgcataactaccgaatacgacataaacgccttatccgacctaccgatccgacacaaatttataaacataataaaacgcgctaacgtcgcatcaaacatctacgcacaattataaaataatacgctccccgacactaaaatccgttacgtcccccgcccaatcgataaaatataaccctcgcgcgacatcgcgataaaacgttaaaaataaccaatcactcacttactttacccaaccatactttactaa

SEQ ID NO: 8237 - DNA, 650 bp, Artificial Sequence
  chemically treated genomic DNA (Homo sapiens) CpG-island No: 8237
  misc_feature (300)..(300): n is either a, c, g or t
  misc_feature (306)..(307): n is either a, c, g or t
  misc_feature (324)..(324): n is either a, c, g or t
attattcggtttaggttgggaatattgagcgtttcgcgattaattattattgcgtcgtagtcgttgatcgttatgtattgttgcgcgttttgttagttttagattttatcgttggtaattatcggaatatttagtcgttggcgaatatcgttaatcgtttgttagttaatatgtttcgcgcggtaattttgttttttcgttcgtttatgtattattagtttcgtagcgttagtttgttgaatcgtatcggcgattttaaatttttttttatcgttgttttagtttagacgtatttttatngttgannttgggtaaatgcgtcgngtatagttttacgtatcgtttttgtattttggtagatgagtttaggatttttgagtaacgtcgtttcgtcgtcgttatcgttatcgttttcgacgggtagtcgtaattgagatttacgttttaggaatttaattttatcgtacgggcggcgttttttgttagttattgtgggaattgatttaataattgtacgcgtattagcgttttagatggtgttcggttggcgttttggtagttttagggtaaatgcgatgaaagatttttatcgggtagttagtttgaattttattacgtcggaataaattcggtgatgtatagatcgtagt

SEQ ID NO: 8238 - DNA, 650 bp, Artificial Sequence
  chemically treated genomic DNA (Homo sapiens) CpG-island No: 8238
  misc_feature (327)..(327): n is either a, c, g or t
  misc_feature (344)..(345): n is either a, c, g or t
  misc_feature (351)..(351): n is either a, c, g or t
actacgatctatacatcaccgaatttattccgacgtaataaaattcaaactaactacccgataaaaatctttcatcgcatttaccctaaaactaccaaaacgccaaccgaacaccatctaaaacgctaatacgcgtacaattattaaatcaattcccacaataactaacaaaaaacgccgcccgtacgataaaattaaattcctaaaacgtaaatctcaattacgactacccgtcgaaaacgataacgataacgacgacgaaacgacgttactcaaaaatcctaaactcatctaccaaaatacaaaaacgatacgtaaaactatacncgacgcatttacccaanntcaacnataaaaatacgtctaaactaaaacaacgataaaaaaaaatttaaaatcgccgatacgattcaacaaactaacgctacgaaactaataatacataaacgaacgaaaaaacaaaattaccgcgcgaaacatattaactaacaaacgattaacgatattcgccaacgactaaatattccgataattaccaacgataaaatctaaaactaacaaaacgcgcaacaatacataacgatcaacgactacgacgcaataataattaatcgcgaaacgctcaatattcccaacctaaaccgaataat

SEQ ID NO: 8239 - DNA, 650 bp, Artificial Sequence
  chemically treated genomic DNA (Homo sapiens) CpG-island No: 8239
  misc_feature (327)..(327): n is either a, c, g or t
  misc_feature (344)..(345): n is either a, c, g or t
  misc_feature (351)..(351): n is either a, c, g or t
attacgatttgtgtattatcgagtttgtttcggcgtggtggaatttaaattggttgttcggtaaaagttttttatcgtatttgttttgaagttattaaaacgttagtcggatattatttggaacgttggtgcgcgtgtagttgttaggttagtttttataatggttggtagagaacgtcgttcgtgcggtggagttaggtttttggggcgtggattttaattgcggttgttcgtcgaaaacggtaacggtagcggcggcggggcgacgttatttaaagattttgaatttatttattagggtgtaaaagcgatgcgtgaagttgtatncggcgtatttgtttagnnttagtngtgaaagtgcgtttgggttgggatagcggtgagaagaaatttgaaatcgtcgatgcggtttaataggttggcgttacggagttggtggtgtatgggcggacgaaagagtagggttatcgcgcggagtatattgattggtaggcgattggcgatattcgttagcggttgaatatttcggtgattgttaacggtgaaatttgggattggtagagcgcgtaataatgtatggcgattagcggttgcgacgtagtgatgattggtcgcggggcgtttaatatttttaatttgagtcgggtggt

SEQ ID NO: 8240 - DNA, 650 bp, Artificial Sequence
  chemically treated genomic DNA (Homo sapiens) CpG-island No: 8240
  misc_feature (300)..(300): n is either a, c, g or t
  misc_feature (306)..(307): n is either a, c, g or t
  misc_feature (324)..(324): n is either a, c, g or t
accacccgactcaaattaaaaatattaaacgccccgcgaccaatcatcactacgtcgcaaccgctaatcgccatacattattacgcgctctaccaatcccaaatttcaccgttaacaatcaccgaaatattcaaccgctaacgaatatcgccaatcgcctaccaatcaatatactccgcgcgataaccctactctttcgtccgcccatacaccaccaactccgtaacgccaacctattaaaccgcatcgacgatttcaaatttcttctcaccgctatcccaacccaaacgcactttcacnactaannctaaacaaatacgccgnatacaacttcacgcatcgcttttacaccctaataaataaattcaaaatctttaaataacgtcgccccgccgccgctaccgttaccgttttcgacgaacaaccgcaattaaaatccacgccccaaaaacctaactccaccgcacgaacgacgttctctaccaaccattataaaaactaacctaacaactacacgcgcaccaacgttccaaataatatccgactaacgttttaataacttcaaaacaaatacgataaaaaacttttaccgaacaaccaatttaaattccaccacgccgaaacaaactcgataatacacaaatcgtaat

SEQ ID NO: 8241 - DNA, 533 bp, Artificial Sequence
  chemically treated genomic DNA (Homo sapiens) CpG-island No: 8241
ttgtagcgaattgatcgtaatgttaagttgttgtaatatcgggttatgtatcgattgtagtatcgtttcgtggtagcgaatattcgtttcgttaaacgtttcgcggttttgattgttggtaattatttcgtttagcgtcgatttaatttgcgttagatcgttggaagtcgcgcgttttgttgtttaacgggtaatcgtcggttttattagatttcgtatttcgtttatggtattgataagtcgtgggtcgtagttattttttagtatttattgtagtacgttagtgtcgaggtaattttattggttacgcggtgttataaacgtttcgcgataacgttttattttaattagtcgtttcgttattagcgaacggaatattttacggatgatgttgcgcgaggttgtaaattttttatagagtttcgttttagtcggaagcggcgagtttggtacgtatttgtcgtgaacgatttgtttatttagcgtaatgataatgcgatcggttttattgagagttatggagagtttttgtg

SEQ ID NO: 8242 - DNA, 533 bp, Artificial Sequence
  chemically treated genomic DNA (Homo sapiens) CpG-island No: 8242
cacaaaaactctccataactctcaataaaaccgatcgcattatcattacgctaaataaacaaatcgttcacgacaaatacgtaccaaactcgccgcttccgactaaaacgaaactctataaaaaatttacaacctcgcgcaacatcatccgtaaaatattccgttcgctaataacgaaacgactaattaaaataaaacgttatcgcgaaacgtttataacaccgcgtaaccaataaaattacctcgacactaacgtactacaataaatactaaaaaataactacgacccacgacttatcaataccataaacgaaatacgaaatctaataaaaccgacgattacccgttaaacaacaaaacgcgcgacttccaacgatctaacgcaaattaaatcgacgctaaacgaaataattaccaacaatcaaaaccgcgaaacgtttaacgaaacgaatattcgctaccacgaaacgatactacaatcgatacataacccgatattacaacaacttaacattacgatcaattcgctacaa

SEQ ID NO: 8243 - DNA, 533 bp, Artificial Sequence
  chemically treated genomic DNA (Homo sapiens) CpG-island No: 8243
tataaggattttttatgatttttaataaaatcgatcgtattgttattacgttgggtaaatagatcgtttacggtaaatacgtgttaggttcgtcgttttcggttgaggcggaattttgtgaggagtttgtaatttcgcgtaatattattcgtgaggtgtttcgttcgttgatggcgaagcggttgattgaaatgaaacgttatcgcggggcgtttgtggtatcgcgtaattagtggaattatttcgatattgacgtattgtaatgggtgttggaaaatgattacgatttacggtttattagtgttatgagcgaagtgcgaaatttggtggaatcggcgattgttcgttgggtagtagagcgcgcgatttttagcgatttggcgtagattgaatcggcgttgaacgagatgattgttaataattaggatcgcgaagcgtttaacgaagcggatattcgttattacgaggcggtgttgtagtcggtgtataattcggtgttatagtaatttagtattgcgattagttcgttgtag

SEQ ID NO: 8244 - DNA, 533 bp, Artificial Sequence
  chemically treated genomic DNA (Homo sapiens) CpG-island No: 8244
ctacaacgaactaatcgcaatactaaattactataacaccgaattatacaccgactacaacaccgcctcgtaataacgaatatccgcttcgttaaacgcttcgcgatcctaattattaacaatcatctcgttcaacgccgattcaatctacgccaaatcgctaaaaatcgcgcgctctactacccaacgaacaatcgccgattccaccaaatttcgcacttcgctcataacactaataaaccgtaaatcgtaatcattttccaacacccattacaatacgtcaatatcgaaataattccactaattacgcgataccacaaacgccccgcgataacgtttcatttcaatcaaccgcttcgccatcaacgaacgaaacacctcacgaataatattacgcgaaattacaaactcctcacaaaattccgcctcaaccgaaaacgacgaacctaacacgtatttaccgtaaacgatctatttacccaacgtaataacaatacgatcgattttattaaaaatcataaaaaatccttata

SEQ ID NO: 8245 - DNA, 886 bp, Artificial Sequence
  chemically treated genomic DNA (Homo sapiens) CpG-island No: 8245
  misc_feature (776)..(776): n is either a, c, g or t
tttgtatttttgtcggtgtgcgtttgagtcgcggtttcgaagagcgtaaagaaattttgtagatgtttaacgacggcggttatagcgtggttgattttttcgacgacgaaatggcgaagttatacgtgcgttatatggtcggcggacgtttatcgtattcgttgtaggaacgtttttatagtttcgaattttcggaattatcgggcgcgttgttgcgtttttttaatacgttgggtacgtattggaatatttttttgttttattatcgtagttatggtatcgattacgggcgcgtattggcggcgttcgaatttggcgattatgaatcggatttcgaaattcggttgaatgagttgggttacgattgttacgacgaaattaataattcggcgtttaggttttttttggcgggttagggaaaaatgtttgatagcgtttcgtttattaggtttattcgcgcgataacgttatttgtggttcggtaaaattttttagaatgttttaattagcggtttatgtagtcgttttttttgcgtatatacgtttagtttaaacggcgtttttttatcgttgcgttttaaaattattacgcggttacgtatcggttcggggttgttttttagtattattttcggtaataatgttacgttatagtcgagtgttattatcgatattatcgttttatgttcgttaatcgtggcgtaaattatcgggttattgattttattgcgtcgaaattatagtttaatgcggcggcgtatcggtttttgatcggntataataaacggtatcgttgattagttcggtttttttatcgatattgtattacgtatcgggtagggtaacgcgggggttattagatttattggtcgaattttttagattt

SEQ ID NO: 8246 - DNA, 886 bp, Artificial Sequence
  chemically treated genomic DNA (Homo sapiens) CpG-island No: 8246
  misc_feature (111)..(111): n is either a, c, g or t
aaatctaaaaaattcgaccaataaatctaataacccccgcgttaccctacccgatacgtaatacaatatcgataaaaaaaccgaactaatcaacgataccgtttattatanccgatcaaaaaccgatacgccgccgcattaaactataatttcgacgcaataaaatcaataacccgataatttacgccacgattaacgaacataaaacgataatatcgataataacactcgactataacgtaacattattaccgaaaataatactaaaaaacaaccccgaaccgatacgtaaccgcgtaataattttaaaacgcaacgataaaaaaacgccgtttaaactaaacgtatatacgcaaaaaaaacgactacataaaccgctaattaaaacattctaaaaaattttaccgaaccacaaataacgttatcgcgcgaataaacctaataaacgaaacgctatcaaacatttttccctaacccgccaaaaaaaacctaaacgccgaattattaatttcgtcgtaacaatcgtaacccaactcattcaaccgaatttcgaaatccgattcataatcgccaaattcgaacgccgccaatacgcgcccgtaatcgataccataactacgataataaaacaaaaaaatattccaatacgtacccaacgtattaaaaaaacgcaacaacgcgcccgataattccgaaaattcgaaactataaaaacgttcctacaacgaatacgataaacgtccgccgaccatataacgcacgtataacttcgccatttcgtcgtcgaaaaaatcaaccacgctataaccgccgtcgttaaacatctacaaaatttctttacgctcttcgaaaccgcgactcaaacgcacaccgacaaaaatacaaa

SEQ ID NO: 8247 - DNA, 886 bp, Artificial Sequence
  chemically treated genomic DNA (Homo sapiens) CpG-island No: 8247
  misc_feature (111)..(111): n is either a, c, g or t
agatttggaaaattcggttagtaggtttgatggttttcgcgttgttttgttcggtgcgtaatatagtgtcggtagagaagtcggattggttaacggtgtcgtttattatgntcgattaggggtcggtacgtcgtcgtattgaattgtggtttcgacgtaataaaattagtaattcgatgatttacgttacggttggcgggtatgaagcgatggtatcgatggtggtattcggttgtggcgtggtattgttgtcggaagtggtgttggaaaatagtttcgaatcggtgcgtaatcgcgtgatgattttagagcgtagcgatgagaaaacgtcgtttgagttgggcgtgtgtgcgtagaaaaagcggttatatgagtcgttaattgaggtattttggaagattttgtcgaattataaatgacgttgtcgcgcgggtaggtttgataagcgaagcgttattaggtatttttttttaattcgttaaaaagaatttgaacgtcgggttattggtttcgtcgtggtaatcgtagtttagtttatttagtcgggtttcgaaattcggtttatggtcgttaagttcgaacgtcgttagtacgcgttcgtagtcggtgttatggttgcgatagtggaataaagaaatgttttagtacgtatttagcgtgttgaggaagcgtagtagcgcgttcggtgatttcgggaattcgaagttgtagaggcgtttttgtaacggatgcgatggacgttcgtcgattatatagcgtacgtgtagtttcgttatttcgtcgtcggagagattaattacgttgtagtcgtcgtcgttgagtatttgtaaaatttttttgcgtttttcgaggtcgcggtttaggcgtatatcgataaagatgtagg

SEQ ID NO: 8248 - DNA, 886 bp, Artificial Sequence
  chemically treated genomic DNA (Homo sapiens) CpG-island No: 8248
  misc_feature (776)..(776): n is either a, c, g or t
cctacatctttatcgatatacgcctaaaccgcgacctcgaaaaacgcaaaaaaattttacaaatactcaacgacgacgactacaacgtaattaatctctccgacgacgaaataacgaaactacacgtacgctatataatcgacgaacgtccatcgcatccgttacaaaaacgcctctacaacttcgaattcccgaaatcaccgaacgcgctactacgcttcctcaacacgctaaatacgtactaaaacatttctttattccactatcgcaaccataacaccgactacgaacgcgtactaacgacgttcgaacttaacgaccataaaccgaatttcgaaacccgactaaataaactaaactacgattaccacgacgaaaccaataacccgacgttcaaattctttttaacgaattaaaaaaaaatacctaataacgcttcgcttatcaaacctacccgcgcgacaacgtcatttataattcgacaaaatcttccaaaatacctcaattaacgactcatataaccgctttttctacgcacacacgcccaactcaaacgacgttttctcatcgctacgctctaaaatcatcacgcgattacgcaccgattcgaaactattttccaacaccacttccgacaacaataccacgccacaaccgaataccaccatcgataccatcgcttcatacccgccaaccgtaacgtaaatcatcgaattactaattttattacgtcgaaaccacaattcaatacgacgacgtaccgacccctaatcgancataataaacgacaccgttaaccaatccgacttctctaccgacactatattacgcaccgaacaaaacaacgcgaaaaccatcaaacctactaaccgaattttccaaatct

SEQ ID NO: 8249 - DNA, 724 bp, Artificial Sequence
  chemically treated genomic DNA (Homo sapiens) CpG-island No: 8249
cgaagggattttcgcggagttttcgagaagtcgttagcgttttcggttttggtttttcgaaaattataaattttaaagggtagcgcgtttcgatgcggcgttttagggtcgaggggttcgtcgggagttgtagttttttcgggtaggatttcgtatttaaaggtttatttgtgggatcgcgttgttagtttcggcgtttgcgtttcgttttaggaagaaagcgttaaggcgaggtatggcggttttcgtgcgtatcggtagtttttcgtgggatattaggatgtcgtttaaagaaagaaagttttttttaggttttagcgtattcgattttattcggaaataagtttttgatatggcggttatttgagttttttcgtttttattcgcgtgattcggaggagttttaggagttaggggtgtataagacggggaagcggagattgggtaggatggttggggttaggaaagtggattgaaattcgtttttcgcgttcggggacgtattagataggagtagttaattcgggcggtatcgtttaggtagaagtaatcgattaagtttgtagatttagagtagcgggatacggttggggagcggtaggtgggggcgtcggaagttttttttttttcgtttgttgtacggtgtgggaacgttacgaagaagttggaacgttcgttgaagtttttggatttatttgtattggattgtgtttatgtgattttt

SEQ ID NO: 8250 - DNA, 724 bp, Artificial Sequence
  chemically treated genomic DNA (Homo sapiens) CpG-island No: 8250
aaaaatcacataaacacaatccaatacaaataaatccaaaaacttcaacgaacgttccaacttcttcgtaacgttcccacaccgtacaacaaacgaaaaaaaaaaaacttccgacgcccccacctaccgctccccaaccgtatcccgctactctaaatctacaaacttaatcgattacttctacctaaacgataccgcccgaattaactactcctatctaatacgtccccgaacgcgaaaaacgaatttcaatccactttcctaaccccaaccatcctacccaatctccgcttccccgtcttatacacccctaactcctaaaactcctccgaatcacgcgaataaaaacgaaaaaactcaaataaccgccatatcaaaaacttatttccgaataaaatcgaatacgctaaaacctaaaaaaaactttctttctttaaacgacatcctaatatcccacgaaaaactaccgatacgcacgaaaaccgccatacctcgccttaacgctttcttcctaaaacgaaacgcaaacgccgaaactaacaacgcgatcccacaaataaacctttaaatacgaaatcctacccgaaaaaactacaactcccgacgaacccctcgaccctaaaacgccgcatcgaaacgcgctaccctttaaaatttataattttcgaaaaaccaaaaccgaaaacgctaacgacttctcgaaaactccgcgaaaatcccttcg

SEQ ID NO: 8251 - DNA, 724 bp, Artificial Sequence
  chemically treated genomic DNA (Homo sapiens) CpG-island No: 8251
aaggattatatgaatataatttagtataaatgggtttaggagttttaacgagcgttttagttttttcgtaacgtttttatatcgtgtagtaagcggagggaagagaattttcggcgtttttatttatcgttttttagtcgtgtttcgttgttttaaatttgtagatttgatcgattgtttttgtttgggcggtatcgttcgaattgattgtttttgtttgatgcgttttcgggcgcgggaaacgagttttaatttatttttttgattttaattattttgtttagttttcgttttttcgttttgtatatttttaatttttgaggttttttcgaattacgcgagtggaagcggagaagtttaagtggtcgttatgttagaggtttattttcgagtggagtcgggtgcgttggggtttgaggagaattttttttttttggacgatattttgatgttttacgagaagttgtcggtgcgtacggagatcgttatgtttcgttttggcgttttttttttggagcggagcgtaggcgtcgagattgataacgcggttttataggtgagtttttgggtgcggggttttgttcggaaagattgtagttttcggcgggtttttcggttttgggacgtcgtatcggggcgcgttgttttttgggatttgtagttttcgaggagttagggtcgaaggcgttaacgatttttcggaaatttcgcgggggttttttcg

SEQ ID NO: 8252 - DNA, 724 bp, Artificial Sequence
  chemically treated genomic DNA (Homo sapiens) CpG-island No: 8252
cgaaaaaacccccgcgaaatttccgaaaaatcgttaacgccttcgaccctaactcctcgaaaactacaaatcccaaaaaacaacgcgccccgatacgacgtcccaaaaccgaaaaacccgccgaaaactacaatctttccgaacaaaaccccgcacccaaaaactcacctataaaaccgcgttatcaatctcgacgcctacgctccgctccaaaaaaaaaacgccaaaacgaaacataacgatctccgtacgcaccgacaacttctcgtaaaacatcaaaatatcgtccaaaaaaaaaaaattctcctcaaaccccaacgcacccgactccactcgaaaataaacctctaacataacgaccacttaaacttctccgcttccactcgcgtaattcgaaaaaacctcaaaaattaaaaatatacaaaacgaaaaaacgaaaactaaacaaaataattaaaatcaaaaaaataaattaaaactcgtttcccgcgcccgaaaacgcatcaaacaaaaacaatcaattcgaacgataccgcccaaacaaaaacaatcgatcaaatctacaaatttaaaacaacgaaacacgactaaaaaacgataaataaaaacgccgaaaattctcttccctccgcttactacacgatataaaaacgttacgaaaaaactaaaacgctcgttaaaactcctaaacccatttatactaaattatattcatataatcctt

SEQ ID NO: 8253 - DNA, 732 bp, Artificial Sequence
  chemically treated genomic DNA (Homo sapiens) CpG-island No: 8253
ttcgtagcgcgtgagtgtaattggagattttggatttaagatgtttttatgaggaacgattttagttcgcggtaatttcggttagtttgtagcgtggacgataaaataggtattacgtggtttcggcgtcggggcggggttagagacgtcggaagtgatcgcgcggtgcgtcggttcgcgaggaaacgcgtttttagattatggcgatttaggcgaagcgtttacgggtgagtggcgggcgcggggtttagttttttttttcgcgttttatttttttttcgttcgtagaatcgttcgtttgcgtttttttcgtttttttttcgcgggtttcgcgttttttttcgttcgtttttttttttatttaaagttcgttttgcgttcgcgtcgcggttttttgtagtttttagcggtttttttgggggtcggatttggttattgcgcgtatttattttaggtggcggggttcgtggacggcggcgatttgtattttgtggtttgttttttgagttggtgtcggcggttcgcgttggagttgagttttaacgtgcgcgagcgagtcgtcgggcggatgattcgcggcgcggcgcgcgttgtttgtttagtttttttgtttaggtggcggttagtcgttttgtcggttgtcggtacggtttggttgtcgggttatgtgttgtttttatttgtgtcgggtttcgggttcgttttttggcgttcgtttttcgcggtttttgt

SEQ ID NO: 8254 - DNA, 732 bp, Artificial Sequence
  chemically treated genomic DNA (Homo sapiens) CpG-island No: 8254
acaaaaaccgcgaaaaacgaacgccaaaaaacgaacccgaaacccgacacaaataaaaacaacacataacccgacaaccaaaccgtaccgacaaccgacaaaacgactaaccgccacctaaacaaaaaaactaaacaaacaacgcgcgccgcgccgcgaatcatccgcccgacgactcgctcgcgcacgttaaaactcaactccaacgcgaaccgccgacaccaactcaaaaaacaaaccacaaaatacaaatcgccgccgtccacgaaccccgccacctaaaataaatacgcgcaataaccaaatccgacccccaaaaaaaccgctaaaaactacaaaaaaccgcgacgcgaacgcaaaacgaactttaaataaaaaaaaaaacgaacgaaaaaaaacgcgaaacccgcgaaaaaaaaacgaaaaaaacgcaaacgaacgattctacgaacgaaaaaaaaataaaacgcgaaaaaaaaaactaaaccccgcgcccgccactcacccgtaaacgcttcgcctaaatcgccataatctaaaaacgcgtttcctcgcgaaccgacgcaccgcgcgatcacttccgacgtctctaaccccgccccgacgccgaaaccacgtaatacctattttatcgtccacgctacaaactaaccgaaattaccgcgaactaaaatcgttcctcataaaaacatcttaaatccaaaatctccaattacactcacgcgctacgaa

SEQ ID NO: 8255 - DNA, 732 bp, Artificial Sequence
  chemically treated genomic DNA (Homo sapiens) CpG-island No: 8255
gtaagagtcgcgaggaacgggcgttaagaggcggattcgggattcgatataagtgagagtaatatataattcggtaattaagtcgtgtcggtagtcggtaagacggttgatcgttatttgagtaggagggttggataggtagcgcgcgtcgcgtcgcgggttattcgttcgacggttcgttcgcgtacgttgggatttagttttagcgcgagtcgtcggtattagtttaggaagtaggttataggatgtagatcgtcgtcgtttacgggtttcgttatttgagataagtgcgcgtagtgattaggttcgatttttagagaggtcgttgggaattgtaggagatcgcggcgcgagcgtagaacgggttttggatggaggaggggacgagcggagaggggcgcgggattcgcgggagggagacggagggggcgtaggcggacggttttgcgaacggagaaggggtgaggcgcggaggaaaaggttggatttcgcgttcgttatttattcgtggacgtttcgtttgggtcgttatggtttaagagcgcgttttttcgcgggtcggcgtatcgcgcggttattttcggcgtttttggtttcgtttcggcgtcggaattacgtggtgtttgttttgtcgtttacgttgtagattggtcggagttatcgcgggttggaatcgttttttatgaaaatattttgagtttaggatttttaattgtatttacgcgttgcgag

SEQ ID NO: 8256 - DNA, 732 bp, Artificial Sequence
  chemically treated genomic DNA (Homo sapiens) CpG-island No: 8256
ctcgcaacgcgtaaatacaattaaaaatcctaaactcaaaatattttcataaaaaacgattccaacccgcgataactccgaccaatctacaacgtaaacgacaaaacaaacaccacgtaattccgacgccgaaacgaaaccaaaaacgccgaaaataaccgcgcgatacgccgacccgcgaaaaaacgcgctcttaaaccataacgacccaaacgaaacgtccacgaataaataacgaacgcgaaatccaaccttttcctccgcgcctcaccccttctccgttcgcaaaaccgtccgcctacgccccctccgtctccctcccgcgaatcccgcgcccctctccgctcgtcccctcctccatccaaaacccgttctacgctcgcgccgcgatctcctacaattcccaacgacctctctaaaaatcgaacctaatcactacgcgcacttatctcaaataacgaaacccgtaaacgacgacgatctacatcctataacctacttcctaaactaataccgacgactcgcgctaaaactaaatcccaacgtacgcgaacgaaccgtcgaacgaataacccgcgacgcgacgcgcgctacctatccaaccctcctactcaaataacgatcaaccgtcttaccgactaccgacacgacttaattaccgaattatatattactctcacttatatcgaatcccgaatccgcctcttaacgcccgttcctcgcgactcttac

SEQ ID NO: 8257 - DNA, 1163 bp, Artificial Sequence
  chemically treated genomic DNA (Homo sapiens) CpG-island No: 8257
ggtcgtcgcgttcggagttcgttttaattcggaaagtggcggtcggttgcggggtaggcgggcggtatttgtgagtagttttagtcggtgttttagtatttttatttcggcgttcggcgcggttcggttttgggtggcggcgtcggggtagcgcgttcggtcgagtcggggagaggagcgcgggagattcggagcggagcggtaggagagcgcggagcgaagcggtaggagtagtttatagttaggagcgttttttcgtttttaacgtcgcgtttttttttttaaaacggtttaaaaaaatttattaattgtatggtcgcgtatttttaaaaaggtattcgtcgttatttggtttcggtgaattttaggaggcggaggaagggcgcggggtgggtgcggtgatatcgtgggaggtggtttttcgtgttcgtcgttcgaataaagagatttcgtcgttttcgggcgtcgcggtggggggtcgcggacggcggttgggggtttttagcgcggtcgggaaggcgaggaaggagagcgggagtcgcggggaggagggggcgtcgttttcgcggaggcgaaatggggcgggagcgagtcggtgcgggattcgcggggttagggtcgtgcgtggggttggggtcgtgttcggggttgggttgggttgggcggggacgcgcgtagtagtcgcggcggcgagagaagttggttttgggtttaggggcgagggcgtcgtcgatttatcgcggagatgcggacgagatagacgcgtaggcggggagcggggtttcggcgtcgtcgacgcgcgggtgtaggtgcgggtagttaggagttttttcgcgtgttcgcggttgtaggggcggaggtcgggttgggggcggtgcgtcgcgggggcgtgttcgcgtgggtttggcgggtgtgggcgttcggttcgcggggcggtgtcgggtttggggttagtttcggacggatcgcggtttttcgcgcgtggttttcgttttttgcgcggttggggtgttcggtgggcgggcgggagggcgagcggggatcgcgacgcggagtttgggggatatttcggtcgattcgcgttttcgtcgattttttattcgtttcgtcgcgcggattgtgttgggtgcgttgcgaggttttgttcgtttttttaggttttt

SEQ ID NO: 8258 - DNA, 1163 bp, Artificial Sequence
  chemically treated genomic DNA (Homo sapiens) CpG-island No: 8258
aaaaacctaaaaaaacgaacaaaacctcgcaacgcacccaacacaatccgcgcgacgaaacgaataaaaaatcgacgaaaacgcgaatcgaccgaaatatcccccaaactccgcgtcgcgatccccgctcgccctcccgcccgcccaccgaacaccccaaccgcgcaaaaaacgaaaaccacgcgcgaaaaaccgcgatccgtccgaaactaaccccaaacccgacaccgccccgcgaaccgaacgcccacacccgccaaacccacgcgaacacgcccccgcgacgcaccgcccccaacccgacctccgcccctacaaccgcgaacacgcgaaaaaactcctaactacccgcacctacacccgcgcgtcgacgacgccgaaaccccgctccccgcctacgcgtctatctcgtccgcatctccgcgataaatcgacgacgccctcgcccctaaacccaaaaccaacttctctcgccgccgcgactactacgcgcgtccccgcccaacccaacccaaccccgaacacgaccccaaccccacgcacgaccctaaccccgcgaatcccgcaccgactcgctcccgccccatttcgcctccgcgaaaacgacgccccctcctccccgcgactcccgctctccttcctcgccttcccgaccgcgctaaaaacccccaaccgccgtccgcgaccccccaccgcgacgcccgaaaacgacgaaatctctttattcgaacgacgaacacgaaaaaccacctcccacgatatcaccgcacccaccccgcgcccttcctccgcctcctaaaattcaccgaaaccaaataacgacgaatacctttttaaaaatacgcgaccatacaattaataaatttttttaaaccgttttaaaaaaaaaaacgcgacgttaaaaacgaaaaaacgctcctaactataaactactcctaccgcttcgctccgcgctctcctaccgctccgctccgaatctcccgcgctcctctccccgactcgaccgaacgcgctaccccgacgccgccacccaaaaccgaaccgcgccgaacgccgaaataaaaatactaaaacaccgactaaaactactcacaaataccgcccgcctaccccgcaaccgaccgccactttccgaattaaaacgaactccgaacgcgacgacc

SEQ ID NO: 8259 - DNA, 1163 bp, Artificial Sequence
  chemically treated genomic DNA (Homo sapiens) CpG-island No: 8259
gggggtttggaggggcgggtagggtttcgtagcgtatttagtatagttcgcgcggcggagcgggtgagaagtcggcgggggcgcggatcgatcggggtgttttttaggtttcgcgtcgcggttttcgttcgttttttcgttcgtttatcgggtattttagtcgcgtagaaggcggaagttacgcgcgagggatcgcggttcgttcgggattagttttaggttcggtatcgtttcgcgggtcgagcgtttatattcgttaaatttacgcgggtacgttttcgcggcgtatcgtttttagttcggttttcgtttttgtagtcgcgggtacgcggaggggtttttggttgttcgtatttgtattcgcgcgtcggcggcgtcgaagtttcgtttttcgtttgcgcgtttgtttcgttcgtattttcgcggtgagtcggcggcgttttcgtttttgagtttagggttagtttttttcgtcgtcgcggttgttgcgcgcgttttcgtttagtttagtttagtttcgagtacgattttagttttacgtacgattttagtttcgcgagtttcgtatcgattcgttttcgttttatttcgttttcgcgggggcggcgttttttttttttcgcggttttcgtttttttttttcgttttttcggtcgcgttggggatttttagtcgtcgttcgcgattttttatcgcgacgttcggaggcggcggggtttttttgttcgggcggcgggtacgggggattattttttacggtgttatcgtatttatttcgcgtttttttttcgttttttggagtttatcgggattaggtggcggcgggtgtttttttgggggtgcgcggttatgtaattggtggatttttttaaatcgttttggaggggggagcgcggcgttgggggcgggagagcgtttttggttgtgagttgtttttgtcgtttcgtttcgcgtttttttgtcgtttcgtttcgggtttttcgcgttttttttttcggttcggtcgagcgcgttgtttcgacgtcgttatttagagtcgggtcgcgtcgggcgtcgagatgaaggtgttgggatatcggttggagttgtttataggtatcgttcgtttgtttcgtagtcggtcgttatttttcgagttggagcggatttcgggcgcggcggtt

SEQ ID NO: 8260 - DNA, 1163 bp, Artificial Sequence
  chemically treated genomic DNA (Homo sapiens) CpG-island No: 8260
aaccgccgcgcccgaaatccgctccaactcgaaaaataacgaccgactacgaaacaaacgaacgatacctataaacaactccaaccgatatcccaacaccttcatctcgacgcccgacgcgacccgactctaaataacgacgtcgaaacaacgcgctcgaccgaaccgaaaaaaaaaacgcgaaaaacccgaaacgaaacgacaaaaaaacgcgaaacgaaacgacaaaaacaactcacaaccaaaaacgctctcccgcccccaacgccgcgctcccccctccaaaacgatttaaaaaaatccaccaattacataaccgcgcacccccaaaaaaacacccgccgccacctaatcccgataaactccaaaaaacgaaaaaaaaacgcgaaataaatacgataacaccgtaaaaaataatcccccgtacccgccgcccgaacaaaaaaaccccgccgcctccgaacgtcgcgataaaaaatcgcgaacgacgactaaaaatccccaacgcgaccgaaaaaacgaaaaaaaaaaacgaaaaccgcgaaaaaaaaaaaacgccgcccccgcgaaaacgaaataaaacgaaaacgaatcgatacgaaactcgcgaaactaaaatcgtacgtaaaactaaaatcgtactcgaaactaaactaaactaaacgaaaacgcgcgcaacaaccgcgacgacgaaaaaaactaaccctaaactcaaaaacgaaaacgccgccgactcaccgcgaaaatacgaacgaaacaaacgcgcaaacgaaaaacgaaacttcgacgccgccgacgcgcgaatacaaatacgaacaaccaaaaacccctccgcgtacccgcgactacaaaaacgaaaaccgaactaaaaacgatacgccgcgaaaacgtacccgcgtaaatttaacgaatataaacgctcgacccgcgaaacgataccgaacctaaaactaatcccgaacgaaccgcgatccctcgcgcgtaacttccgccttctacgcgactaaaatacccgataaacgaacgaaaaaacgaacgaaaaccgcgacgcgaaacctaaaaaacaccccgatcgatccgcgcccccgccgacttctcacccgctccgccgcgcgaactatactaaatacgctacgaaaccctacccgcccctccaaaccccc

SEQ ID NO: 8261 - DNA, 1206 bp, Artificial Sequence
  chemically treated genomic DNA (Homo sapiens) CpG-island No: 8261
cggattgttggtcgttcgaagagggtagatgtttcgttttatttcgggagtttcgttagcgtttgtttcgagattttcgtcgtagagttattatttcgttacgtaggcggtacgaaatggaatacgttcggcgatgaataatcggtcggaattttcgttagtattttttcgcgtaaatcgcggttagtcgtcgttagtacgcgttatcgattcgtatataacgtttatcgttaacgcgttgaatatcgttatatgtaatatttttagtagtttggtttgtaatgttaacgattattcgtcgatttatttagaaatagcgtgtcgttattcgttattttaaatttttcgttggattattgatagcgttagtaaacgttttttttatatgttcgaataattttttttcgttatatttttcggtagtgtagtatagttgagatagattagcgatttatcgttcgtggcgaggttttatgaatcgttttcgttattagtttttatcggttttagttttatcgttgattaggacgttgagatcggacgtcgtataattttaatttttttttttagttgcgttatgttaggggataagttaatatttgcgtttgttttatcgttttaaacggcgtggtatcgtttggtagttattttggttttttagttgtttaattagtaacgtattgtttaacgtttcgtcgttagcgtagtaattagtcgtagtttttcgtcgttgaaaatatcgattgatcgggttgtatttcgtcgagcgttagtgcgtcgattaggttttgtcggtaaataatggtagattaacgtaggcgtgaatttttagatttttttgttaggaattaaatcgttatagggatcgggtaattcgttgtttgcgggaagcgtattatattttcggcgcgggtaatcgtttttagtcgtggatgttttttagcgtaaagcgtttatcgagtatattttttgttagatcgtcgatggtagcggaataaattgtcgcgaatcgtaacgtagtaacgtagacgtatcgtttttagtatttgacgtagcgtggtgattaggcgttgaaaacgattttgggattaattttacgttggtattcgatggcgatttcgttagtaattaaggatatttttttggtttcgtttatggttatgtattggttttcgtttttgttgttttttcggatttttaggggtt

SEQ ID NO: 8262 - DNA, 1206 bp, Artificial Sequence
  chemically treated genomic DNA (Homo sapiens) CpG-island No: 8262
aacccctaaaaatccgaaaaaacaacaaaaacgaaaaccaatacataaccataaacgaaaccaaaaaaatatccttaattactaacgaaatcgccatcgaataccaacgtaaaattaatcccaaaatcgttttcaacgcctaatcaccacgctacgtcaaatactaaaaacgatacgtctacgttactacgttacgattcgcgacaatttattccgctaccatcgacgatctaacaaaaaatatactcgataaacgctttacgctaaaaaacatccacgactaaaaacgattacccgcgccgaaaatataatacgcttcccgcaaacaacgaattacccgatccctataacgatttaattcctaacaaaaaaatctaaaaattcacgcctacgttaatctaccattatttaccgacaaaacctaatcgacgcactaacgctcgacgaaatacaacccgatcaatcgatattttcaacgacgaaaaactacgactaattactacgctaacgacgaaacgttaaacaatacgttactaattaaacaactaaaaaaccaaaataactaccaaacgataccacgccgtttaaaacgataaaacaaacgcaaatattaacttatcccctaacataacgcaactaaaaaaaaaaattaaaattatacgacgtccgatctcaacgtcctaatcaacgataaaactaaaaccgataaaaactaataacgaaaacgattcataaaacctcgccacgaacgataaatcgctaatctatctcaactatactacactaccgaaaaatataacgaaaaaaaattattcgaacatataaaaaaaacgtttactaacgctatcaataatccaacgaaaaatttaaaataacgaataacgacacgctatttctaaataaatcgacgaataatcgttaacattacaaaccaaactactaaaaatattacatataacgatattcaacgcgttaacgataaacgttatatacgaatcgataacgcgtactaacgacgactaaccgcgatttacgcgaaaaaatactaacgaaaattccgaccgattattcatcgccgaacgtattccatttcgtaccgcctacgtaacgaaataataactctacgacgaaaatctcgaaacaaacgctaacgaaactcccgaaataaaacgaaacatctaccctcttcgaacgaccaacaatccg

SEQ ID NO: 8263 - DNA, 1206 bp, Artificial Sequence
  chemically treated genomic DNA (Homo sapiens) CpG-island No: 8263
agtttttagggattcgaagggatagtaagggcgaaggttaatgtatggttatggacggagttaagagagtgtttttgattgttggcgaaatcgttatcgaatgttagcgtgggattggttttaggatcgtttttagcgtttgattattacgttacgttaggtgttggaggcgatgcgtttgcgttgttacgttacgattcgcggtagtttatttcgttgttatcgacggtttggtaaaggatgtattcggtagacgttttgcgttggagggtatttacggttggaagcgattgttcgcgtcggggatgtggtgcgtttttcgtagatagcgaattgttcgatttttatgacggtttgatttttggtaggagagtttgaaggtttacgtttgcgttggtttgttattgtttgtcggtaaaatttgatcggcgtattgacgttcgacgggatgtagttcgattagtcgatgtttttagcgacgaagagttacggttgattgttgcgttggcggcggagcgttaagtaatgcgttgttgattgaataattggaaagttagaatagttgttaggcgatgttacgtcgtttgaagcggtgaaatagacgtagatgttggtttgttttttggtatgacgtaattgaaaaaagagattgagattgtgcggcgttcgattttaacgttttgattagcggtgagattggaatcggtaggagttggtggcgaaagcgatttatgaagtttcgttacgggcggtgaatcgttggtttattttaattgtgttgtattgtcggaaagtgtggcggaaaggagttgttcgggtatgtgaaaggagcgtttattggcgttattagtaatttagcgggaagtttgaaatggcggataacggtacgttgtttttggatgagtcggcgagtagtcgttggtattgtaggttaagttgttgagggtgttgtatatggcgatatttagcgcgttggcgatgaacgttgtatgcgggtcgatggcgcgtgttggcggcgattaatcgcgatttacgcgaagaggtgttggcggagatttcggtcgattgtttatcgtcgagcgtgttttatttcgtgtcgtttgcgtgacgaggtgatgattttgcggcggggatttcggagtaggcgttggcggggttttcgagataaggcggggtatttgtttttttcggacggttagtagttcg

SEQ ID NO: 8264 - DNA, 1206 bp, Artificial Sequence
  chemically treated genomic DNA (Homo sapiens) CpG-island No: 8264
cgaactactaaccgtccgaaaaaaacaaataccccgccttatctcgaaaaccccgccaacgcctactccgaaatccccgccgcaaaatcatcacctcgtcacgcaaacgacacgaaataaaacacgctcgacgataaacaatcgaccgaaatctccgccaacacctcttcgcgtaaatcgcgattaatcgccgccaacacgcgccatcgacccgcatacaacgttcatcgccaacgcgctaaatatcgccatatacaacaccctcaacaacttaacctacaataccaacgactactcgccgactcatccaaaaacaacgtaccgttatccgccatttcaaacttcccgctaaattactaataacgccaataaacgctcctttcacatacccgaacaactcctttccgccacactttccgacaatacaacacaattaaaataaaccaacgattcaccgcccgtaacgaaacttcataaatcgctttcgccaccaactcctaccgattccaatctcaccgctaatcaaaacgttaaaatcgaacgccgcacaatctcaatctcttttttcaattacgtcataccaaaaaacaaaccaacatctacgtctatttcaccgcttcaaacgacgtaacatcgcctaacaactattctaactttccaattattcaatcaacaacgcattacttaacgctccgccgccaacgcaacaatcaaccgtaactcttcgtcgctaaaaacatcgactaatcgaactacatcccgtcgaacgtcaatacgccgatcaaattttaccgacaaacaataacaaaccaacgcaaacgtaaaccttcaaactctcctaccaaaaatcaaaccgtcataaaaatcgaacaattcgctatctacgaaaaacgcaccacatccccgacgcgaacaatcgcttccaaccgtaaataccctccaacgcaaaacgtctaccgaatacatcctttaccaaaccgtcgataacaacgaaataaactaccgcgaatcgtaacgtaacaacgcaaacgcatcgcctccaacacctaacgtaacgtaataatcaaacgctaaaaacgatcctaaaaccaatcccacgctaacattcgataacgatttcgccaacaatcaaaaacactctcttaactccgtccataaccatacattaaccttcgcccttactatcccttcgaatccctaaaaact

SEQ ID NO: 8265 - DNA, 577 bp, Artificial Sequence
  chemically treated genomic DNA (Homo sapiens) CpG-island No: 8265
acgaatacgtatgtcgttacggttgattcgataattttcgttgcgaaacgggtgtcggtttcggttttgttttttagaagcgtgcgtataattagttattaatattacgttttgttattcggttggacggcgacgttcggttatttggatcgtgattttttttgtgggcgcgtttagtttcggttttgattaatcggttttagtagatcggggttgatttggtggttattatcggttcgcgtaagtttcgtggggtttgtttcgatcggggttaacgatatttcgggggtatttgacgttgttaatttaatgttggtttaaattcggaagttaaatattggttgatcgtcggtatgaacgatagtatcgtttgggcggcgtacgcgcgacggaaggttagggttttaaagcggtcgatatatcggtatgggtattaacggtgtggatgcggtgagcgaattgttttaatataggtaatcggtttttacggttttttgttgttaagttcggacgtataggttataaatttagcgaaatgttttataattgggtagtaaaagacgttgatcgttaaaat

SEQ ID NO: 8266 - DNA, 577 bp, Artificial Sequence
  chemically treated genomic DNA (Homo sapiens) CpG-island No: 8266
attttaacgatcaacgtcttttactacccaattataaaacatttcgctaaatttataacctatacgtccgaacttaacaacaaaaaaccgtaaaaaccgattacctatattaaaacaattcgctcaccgcatccacaccgttaatacccataccgatatatcgaccgctttaaaaccctaaccttccgtcgcgcgtacgccgcccaaacgatactatcgttcataccgacgatcaaccaatatttaacttccgaatttaaaccaacattaaattaacaacgtcaaatacccccgaaatatcgttaaccccgatcgaaacaaaccccacgaaacttacgcgaaccgataataaccaccaaatcaaccccgatctactaaaaccgattaatcaaaaccgaaactaaacgcgcccacaaaaaaaatcacgatccaaataaccgaacgtcgccgtccaaccgaataacaaaacgtaatattaataactaattatacgcacgcttctaaaaaacaaaaccgaaaccgacacccgtttcgcaacgaaaattatcgaatcaaccgtaacgacatacgtattcgt

SEQ ID NO: 8267 - DNA, 577 bp, Artificial Sequence
  chemically treated genomic DNA (Homo sapiens) CpG-island No: 8267
attttggcggttaacgttttttgttatttagttgtaaagtatttcgttggatttatagtttgtacgttcgggtttggtagtagggaatcgtagaagtcggttgtttgtgttgagatagttcgtttatcgtatttatatcgttaatgtttatgtcgatgtatcggtcgttttaaagttttgatttttcgtcgcgcgtacgtcgtttagacggtgttgtcgtttatatcgacgattagttaatgtttaattttcggatttgaattagtattgagttggtagcgttaaatgttttcgggatgtcgttagtttcggtcggaataaattttacggggtttgcgcgaatcgataatagttattaggttaatttcggtttgttgaaatcggttaattaaagtcgaaattggacgcgtttataggaggaattacggtttaaatggtcgagcgtcgtcgtttaatcggatggtagaacgtgatgttggtgattggttatacgtacgtttttgaaagataaagtcgggatcgatattcgtttcgtagcggaaattgtcgaattagtcgtggcggtatgcgtgttcgt

SEQ ID NO: 8268 - DNA, 577 bp, Artificial Sequence
  chemically treated genomic DNA (Homo sapiens) CpG-island No: 8268
acgaacacgcataccgccacgactaattcgacaatttccgctacgaaacgaatatcgatcccgactttatctttcaaaaacgtacgtataaccaatcaccaacatcacgttctaccatccgattaaacgacgacgctcgaccatttaaaccgtaattcctcctataaacgcgtccaatttcgactttaattaaccgatttcaacaaaccgaaattaacctaataactattatcgattcgcgcaaaccccgtaaaatttattccgaccgaaactaacgacatcccgaaaacatttaacgctaccaactcaatactaattcaaatccgaaaattaaacattaactaatcgtcgatataaacgacaacaccgtctaaacgacgtacgcgcgacgaaaaatcaaaactttaaaacgaccgatacatcgacataaacattaacgatataaatacgataaacgaactatctcaacacaaacaaccgacttctacgattccctactaccaaacccgaacgtacaaactataaatccaacgaaatactttacaactaaataacaaaaaacgttaaccgccaaaat

SEQ ID NO: 8269 - DNA, 735 bp, Artificial Sequence
  chemically treated genomic DNA (Homo sapiens) CpG-island No: 8269
gtttttggttaaaatgtttttttttaaatatttcggtagaaaggtagcgatcgtacgatcgtagatgatcgttattattatcgcgttagggttagtttttgttttcgtagtgtttcggtaatcgcgtcgtcggagttgacgttatagaatatttttttcggtatcgttagttcgcgtatggtgttttcgtatcgcgttggagaatatttaggtatttttatttattagagaagcgttgaaaattttcggcgatatttcgtaggttagcggcgaatgtcgggaatgttgttgtttttttcggttgtaggtcgatatggttatcggtttggattgttcgcgtataaagcggagacgtcggtgatagtgtcggtcgtttttatgttggagataaatgagtatgcgttcgtcggtttgttgttaagatttttcgggttttagggtggggaggggtggtaatggcgtatagggttcgggatttgacgtcgagcgttttttttacgattcgtatttcgcgtttaggatcgcgtcgtatttttttatgttcgttttttttgggtggaatttacggtaaaatttttaggttttttcgatttttttatttttttgattaaggttaggggtttacgtcggtattattgttacgtgatatttgttgttaacggcgttattattgttattagcgacgatttattaacgattttgttaatttatatttcgtaaaaattgttagttatt

SEQ ID NO: 8270 - DNA, 735 bp, Artificial Sequence
  chemically treated genomic DNA (Homo sapiens) CpG-island No: 8270
aataactaacaatttttacgaaatataaattaacaaaatcgttaataaatcgtcgctaataacaataataacgccgttaacaacaaatatcacgtaacaataataccgacgtaaacccctaaccttaatcaaaaaaataaaaaaatcgaaaaaacctaaaaattttaccgtaaattccacccaaaaaaaacgaacataaaaaaatacgacgcgatcctaaacgcgaaatacgaatcgtaaaaaaaacgctcgacgtcaaatcccgaaccctatacgccattaccacccctccccaccctaaaacccgaaaaatcttaacaacaaaccgacgaacgcatactcatttatctccaacataaaaacgaccgacactatcaccgacgtctccgctttatacgcgaacaatccaaaccgataaccatatcgacctacaaccgaaaaaaacaacaacattcccgacattcgccgctaacctacgaaatatcgccgaaaattttcaacgcttctctaataaataaaaatacctaaatattctccaacgcgatacgaaaacaccatacgcgaactaacgataccgaaaaaaatattctataacgtcaactccgacgacgcgattaccgaaacactacgaaaacaaaaactaaccctaacgcgataataataacgatcatctacgatcgtacgatcgctacctttctaccgaaatatttaaaaaaaaacattttaaccaaaaac

SEQ ID NO: 8271 - DNA, 735 bp, Artificial Sequence
  chemically treated genomic DNA (Homo sapiens) CpG-island No: 8271
aatagttggtaatttttacgaggtgtaagttagtagggtcgttggtggatcgtcgttggtagtagtaatgacgtcgttggtagtaggtattacgtagtagtaatatcgacgtaggtttttggttttggttaaggaaatggaaggatcggggaaatttgggaattttgtcgtgggttttatttaaaaggagcgggtatggaagggtgcggcgcgattttgggcgcgggatgcgaatcgtgggaggaacgttcgacgttaaatttcgaattttatgcgttattattatttttttttattttggggttcgggaaattttggtagtaaatcggcgggcgtatatttatttgtttttagtatggggacgatcggtattattatcggcgttttcgttttatgcgcgaataatttaaatcggtgattatgtcggtttgtaatcgaagagggtagtagtattttcggtattcgtcgttggtttacggaatatcgtcggggatttttaacgtttttttggtggatgaaggtgtttggatattttttagcgcgatgcggaaatattatgcgcgaattggcggtgtcgggaaggatattttgtggcgttagtttcggcggcgcggttgtcggagtattgcgggggtaaaagttaattttgacgcggtggtggtggcgattatttgcgatcgtgcgatcgttatttttttatcggggtgtttggggaagagtattttagttaggggt

SEQ ID NO: 8272 - DNA, 735 bp, Artificial Sequence
  chemically treated genomic DNA (Homo sapiens) CpG-island No: 8272
acccctaactaaaatactcttccccaaacaccccgataaaaaaataacgatcgcacgatcgcaaataatcgccaccaccaccgcgtcaaaattaacttttacccccgcaatactccgacaaccgcgccgccgaaactaacgccacaaaatatccttcccgacaccgccaattcgcgcataatatttccgcatcgcgctaaaaaatatccaaacaccttcatccaccaaaaaaacgttaaaaatccccgacgatattccgtaaaccaacgacgaataccgaaaatactactaccctcttcgattacaaaccgacataatcaccgatttaaattattcgcgcataaaacgaaaacgccgataataataccgatcgtccccatactaaaaacaaataaatatacgcccgccgatttactaccaaaatttcccgaaccccaaaataaaaaaaaataataataacgcataaaattcgaaatttaacgtcgaacgttcctcccacgattcgcatcccgcgcccaaaatcgcgccgcacccttccatacccgctccttttaaataaaacccacgacaaaattcccaaatttccccgatccttccatttccttaaccaaaaccaaaaacctacgtcgatattactactacgtaatacctactaccaacgacgtcattactactaccaacgacgatccaccaacgaccctactaacttacacctcgtaaaaattaccaactatt

SEQ ID NO: 8273 - DNA, 524 bp, Artificial Sequence
  chemically treated genomic DNA (Homo sapiens) CpG-island No: 8273
gacgggggttaaaggaatttatgtgtaatattgtttatagtgcggtttgattatttttgatacgatatttcgtttaatgcgggttaaaagtatgtgtttcggtttggttgtcgtagtttgtattagatttcgggttggtgttggcgcgcgcgtatttttgtcggttattggtgtgtaaaagggacgttgcgatatgtcgcggttgtatgtagatgtgggcgtattgtgggtttgacgtcggattgattttgaagagggcgggacgcgtaaggaatttatgattaaaattgtttatagtgtcgttgacgattatttggtattaacgtaataattcgttttatgtcgggtaatggatgatttgcggtttgggttcgcgttattcgttatgttattttgtcgtggcgtcggcgcgcgcgtatttttttattagtgtgtaatagggtggtacgatttgacgcggtatagatgacgcggatttgtttgtttttcggatatttttgacgttggatgtatttgggtttttt

SEQ ID NO: 8274 - DNA, 524 bp, Artificial Sequence
  chemically treated genomic DNA (Homo sapiens) CpG-island No: 8274
aaaaaacccaaatacatccaacgtcaaaaatatccgaaaaacaaacaaatccgcgtcatctataccgcgtcaaatcgtaccaccctattacacactaataaaaaaatacgcgcgcgccgacgccacgacaaaataacataacgaataacgcgaacccaaaccgcaaatcatccattacccgacataaaacgaattattacgttaataccaaataatcgtcaacgacactataaacaattttaatcataaattccttacgcgtcccgccctcttcaaaatcaatccgacgtcaaacccacaatacgcccacatctacatacaaccgcgacatatcgcaacgtcccttttacacaccaataaccgacaaaaatacgcgcgcgccaacaccaacccgaaatctaatacaaactacgacaaccaaaccgaaacacatacttttaacccgcattaaacgaaatatcgtatcaaaaataatcaaaccgcactataaacaatattacacataaattcctttaacccccgtc

SEQ ID NO: 8275 - DNA, 524 bp, Artificial Sequence
  chemically treated genomic DNA (Homo sapiens) CpG-island No: 8275
aaaaggtttaaatatatttaacgttagaggtattcggggggtaaataggttcgcgttatttatatcgcgttaaatcgtattattttattatatattagtgggggggtacgcgcgcgtcggcgttacggtaaggtgatataacgggtagcgcgggtttaggtcgtaggttatttattattcggtataaggcgggttattacgttagtattaggtggtcgttagcggtattgtaggtagttttggttataggttttttacgcgtttcgttttttttaaaattaattcggcgttaagtttatagtacgtttatatttatatataatcgcgatatatcgtaacgttttttttatatattagtggtcggtaagggtgcgcgcgcgttagtattagttcgaggtttaatataggttgcggtagttaggtcgaagtatatatttttagttcgtattaggcggggtatcgtattagaagtggttaggtcgtattgtaggtagtattgtatataggtttttttggttttcgtt

SEQ ID NO: 8276 - DNA, 524 bp, Artificial Sequence
  chemically treated genomic DNA (Homo sapiens) CpG-island No: 8276
aacgaaaaccaaaaaaacctatatacaatactacctacaatacgacctaaccacttctaatacgataccccgcctaatacgaactaaaaatatatacttcgacctaactaccgcaacctatattaaacctcgaactaatactaacgcgcgcgcacccttaccgaccactaatatataaaaaaaacgttacgatatatcgcgattatatataaatataaacgtactataaacttaacgccgaattaattttaaaaaaaacgaaacgcgtaaaaaacctataaccaaaactacctacaataccgctaacgaccacctaatactaacgtaataacccgccttataccgaataataaataacctacgacctaaacccgcgctacccgttatatcaccttaccgtaacgccgacgcgcgcgtacccccccactaatatataataaaataatacgatttaacgcgatataaataacgcgaacctatttaccccccgaatacctctaacgttaaatatatttaaacctttt

SEQ ID NO: 8277 - DNA, 544 bp, Artificial Sequence
  chemically treated genomic DNA (Homo sapiens) CpG-island No: 8277
gggtttgacgtttgttagtttttattattaatgacggtttttgtggttatcgttttttttgtatttattgttcgttattatttagcgtggtgtttatagttcgtttttaaggttttgttcgttttcggtattgataatcgtgtttgagatatttttacggggtttattttttgaagattattattggtgatagtcgttttgttggcgtttcgttattttgtatttattgttcgtcggtattggtttcgttattcgtttatattttagttcggtattgatggttatttcgttggtcgtatcgaagtaatttggttgttatgatttgttagtgtttcgtcgtttacggttttttcgggtgtataacgatgttagtagttagtatcgggagtgacgtgattgcggaagagatagtgtaatcgttatatcgttacgtttatttcgtgcgcgggtcgttcggaggtaattacgaaagcgttcgttatgtgattttatattagttttagtaggtatttagatgtcgttttattagtttttttttagattg

SEQ ID NO: 8278 - DNA, 544 bp, Artificial Sequence
  chemically treated genomic DNA (Homo sapiens) CpG-island No: 8278
caatctaaaaaaaaactaataaaacgacatctaaatacctactaaaactaatataaaatcacataacgaacgctttcgtaattacctccgaacgacccgcgcacgaaataaacgtaacgatataacgattacactatctcttccgcaatcacgtcactcccgatactaactactaacatcgttatacacccgaaaaaaccgtaaacgacgaaacactaacaaatcataacaaccaaattacttcgatacgaccaacgaaataaccatcaataccgaactaaaatataaacgaataacgaaaccaataccgacgaacaataaatacaaaataacgaaacgccaacaaaacgactatcaccaataataatcttcaaaaaataaaccccgtaaaaatatctcaaacacgattatcaataccgaaaacgaacaaaaccttaaaaacgaactataaacaccacgctaaataataacgaacaataaatacaaaaaaaacgataaccacaaaaaccgtcattaataataaaaactaacaaacgtcaaaccc

SEQ ID NO: 8279 - DNA, 544 bp, Artificial Sequence
  chemically treated genomic DNA (Homo sapiens) CpG-island No: 8279
taatttaaggaaaagttgatgaaacgatatttgaatatttgttaaggttggtatggaattatatgacgggcgttttcgtggttgttttcgaacggttcgcgtacggggtaaacgtggcggtgtggcggttgtattgtttttttcgtagttacgttattttcggtgttggttgttgatatcgttgtgtattcggagaaatcgtgaacggcggaatattggtaaattatgataattagattgtttcggtacgattaacggaatgattattagtatcgggttggagtatgggcggataacgaggttaatatcggcgggtaatgggtataggatggcggaacgttaataaaacgattgttattagtggtggtttttagagagtgaatttcgtggaagtgttttagatacggttattagtgtcggaggcggatagagttttagggacgggttgtgaatattacgttgaatggtggcgaatagtggatgtagagggggcgatagttataggaatcgttattaatgataagggttggtaggcgttaagttt

SEQ ID NO: 8280 - DNA, 544 bp, Artificial Sequence
  chemically treated genomic DNA (Homo sapiens) CpG-island No: 8280
aaacttaacgcctaccaacccttatcattaataacgattcctataactatcgccccctctacatccactattcgccaccattcaacgtaatattcacaacccgtccctaaaactctatccgcctccgacactaataaccgtatctaaaacacttccacgaaattcactctctaaaaaccaccactaataacaatcgttttattaacgttccgccatcctatacccattacccgccgatattaacctcgttatccgcccatactccaacccgatactaataatcattccgttaatcgtaccgaaacaatctaattatcataatttaccaatattccgccgttcacgatttctccgaatacacaacgatatcaacaaccaacaccgaaaataacgtaactacgaaaaaaacaatacaaccgccacaccgccacgtttaccccgtacgcgaaccgttcgaaaacaaccacgaaaacgcccgtcatataattccataccaaccttaacaaatattcaaatatcgtttcatcaacttttccttaaatta

SEQ ID NO: 8281 - DNA, 575 bp, Artificial Sequence
  chemically treated genomic DNA (Homo sapiens) CpG-island No: 8281
ttgcgttaacgttagtcgagcgtcgtttttagtttttgttttatatcggtttttgtcgtaatattaaaatggtggtcggtttgattttacgcgtcggattgttttgcgttagagatagttacgcgtcgttttgtttaggttgttttggcgtaattcggtttggatattagttggttcgttagttttagtatcgcgcgcgtgtcgtcgttaatagttttagttttagtttatagataggtttagtaaatttattcgttttttttttttttggtcgagggcgattttaatttggttattatcgatcgttatagttatttttcgcgataaaaatcggtgttgaatagcggttgtacgcgggggcgagatcggcgggtaattcgtcgttcggttagattttcgtcggtaacgcgttaggtcgagcgtcggttcgtttaacgttacgttatatttcgggcgtgatgtaagtcgtttgttattttttttgtaatttttatggttattttatgcgatcgttttcgttacgaatacgtaagtttatatcgtgtttacgtagtagttattcggcgtttcgtagt

SEQ ID NO: 8282 - DNA, 575 bp, Artificial Sequence
  chemically treated genomic DNA (Homo sapiens) CpG-island No: 8282
actacgaaacgccgaataactactacgtaaacacgatataaacttacgtattcgtaacgaaaacgatcgcataaaataaccataaaaattacaaaaaaaataacaaacgacttacatcacgcccgaaatataacgtaacgttaaacgaaccgacgctcgacctaacgcgttaccgacgaaaatctaaccgaacgacgaattacccgccgatctcgcccccgcgtacaaccgctattcaacaccgatttttatcgcgaaaaataactataacgatcgataataaccaaattaaaatcgccctcgaccaaaaaaaaaaaaaacgaataaatttactaaacctatctataaactaaaactaaaactattaacgacgacacgcgcgcgatactaaaactaacgaaccaactaatatccaaaccgaattacgccaaaacaacctaaacaaaacgacgcgtaactatctctaacgcaaaacaatccgacgcgtaaaatcaaaccgaccaccattttaatattacgacaaaaaccgatataaaacaaaaactaaaaacgacgctcgactaacgttaacgcaa

SEQ ID NO: 8283 - DNA, 575 bp, Artificial Sequence
  chemically treated genomic DNA (Homo sapiens) CpG-island No: 8283
attacgaaacgtcggataattgttgcgtgggtacgatatgggtttacgtattcgtggcgaaaacggtcgtatgagatgattatgaaagttgtaggaagagtgataggcggtttatattacgttcggaatataacgtggcgttgagcgaatcgacgttcgatttggcgcgttatcgacggaagtttggtcgaacggcgaattgttcgtcgatttcgttttcgcgtgtagtcgttgtttagtatcgatttttatcgcgaaaaatggttgtggcggtcgatggtagttaaattgaaatcgttttcgattagggggaaggaaagcgggtgaatttgttgaatttatttgtgagttggaattggaattgttagcggcgatacgcgcgcggtgttgaaattggcgaattaattggtatttaaatcggattacgttagggtagtttgagtaaagcggcgcgtggttatttttggcgtagggtaattcggcgcgtgaaattaaatcgattattattttgatgttgcggtaaaagtcgatgtggaataggggttggaagcggcgttcgattggcgttagcgtaa

SEQ ID NO: 8284 - DNA, 575 bp, Artificial Sequence
  chemically treated genomic DNA (Homo sapiens) CpG-island No: 8284
ttacgctaacgccaatcgaacgccgcttccaacccctattccacatcgacttttaccgcaacatcaaaataataatcgatttaatttcacgcgccgaattaccctacgccaaaaataaccacgcgccgctttactcaaactaccctaacgtaatccgatttaaataccaattaattcgccaatttcaacaccgcgcgcgtatcgccgctaacaattccaattccaactcacaaataaattcaacaaattcacccgctttccttccccctaatcgaaaacgatttcaatttaactaccatcgaccgccacaaccatttttcgcgataaaaatcgatactaaacaacgactacacgcgaaaacgaaatcgacgaacaattcgccgttcgaccaaacttccgtcgataacgcgccaaatcgaacgtcgattcgctcaacgccacgttatattccgaacgtaatataaaccgcctatcactcttcctacaactttcataatcatctcatacgaccgttttcgccacgaatacgtaaacccatatcgtacccacgcaacaattatccgacgtttcgtaat

SEQ ID NO: 8285 - DNA, 718 bp, Artificial Sequence
  chemically treated genomic DNA (Homo sapiens) CpG-island No: 8285
tatgattcgtacggacgcgaagttatttcggggtacggagttaagggcgttttgcgtttatttttgtgtttgcgttatggttgcggggcgtaggtattgtggggcgttttggcggtttgtgtttgttcgttagtcgttcgggtttcgcgcgtatacgatatgtggggtttgggttcgtgggagtataaatggcgttttcggtattatgttagtgttcgggttgtaacggggtatcgtcggatcgtcgtgagcgggaggttgtattttatcgggatgtacgttaataattattgaagcggaaatgtatcgtatcgcgtcgtgcggcgatcgtggtttataagcgcggacgcggtaggtcggtagcgggtgttatttgatgttggtaaaagcgaaagggaaattattacgttttgtttgttgatttatgatttagaggattgttgtaaacgtgttaacgttagtcgtcgatgtgacgttttgtcgtaaagcgttgttttagttggtgagcgtgggttttgatataaggggggagggggagggaaggaaggagtttgttagatgtttgttagtaattcgtttatcgcgttcgtcgttttaacgtttattcgcgatggtttattgtacgttttacgatttttgtattttatttgtttattatatcggtttcggtttttaaattggaggggaggaagaagtgaagttatggcgttttaaggtt

SEQ ID NO: 8286 - DNA, 718 bp, Artificial Sequence
  chemically treated genomic DNA (Homo sapiens) CpG-island No: 8286
aaccttaaaacgccataacttcacttcttcctcccctccaatttaaaaaccgaaaccgatataataaacaaataaaatacaaaaatcgtaaaacgtacaataaaccatcgcgaataaacgttaaaacgacgaacgcgataaacgaattactaacaaacatctaacaaactccttccttccctccccctccccccttatatcaaaacccacgctcaccaactaaaacaacgctttacgacaaaacgtcacatcgacgactaacgttaacacgtttacaacaatcctctaaatcataaatcaacaaacaaaacgtaataatttccctttcgcttttaccaacatcaaataacacccgctaccgacctaccgcgtccgcgcttataaaccacgatcgccgcacgacgcgatacgatacatttccgcttcaataattattaacgtacatcccgataaaatacaacctcccgctcacgacgatccgacgataccccgttacaacccgaacactaacataataccgaaaacgccatttatactcccacgaacccaaaccccacatatcgtatacgcgcgaaacccgaacgactaacgaacaaacacaaaccgccaaaacgccccacaatacctacgccccgcaaccataacgcaaacacaaaaataaacgcaaaacgcccttaactccgtaccccgaaataacttcgcgtccgtacgaatcata

SEQ ID NO: 8287 - DNA, 718 bp, Artificial Sequence
  chemically treated genomic DNA (Homo sapiens) CpG-island No: 8287
ggttttagaacgttatgattttattttttttttttttttaatttgagaatcgagatcgatgtggtgaataaatggggtataagaatcgtgaagcgtgtagtaggttatcgcgggtaagcgttagagcggcgggcgcgataggcgggttattagtaaatatttaataagttttttttttttttttttttttttttttatattaaaatttacgtttattagttaaaataacgttttgcggtaaagcgttatatcggcggttggcgttggtacgtttatagtaattttttaagttataggttaataggtaaggcgtggtagtttttttttcgtttttattagtattaggtagtattcgttgtcggtttgtcgcgttcgcgtttgtgaattacggtcgtcgtacggcgcggtgcggtgtattttcgttttagtggttgttggcgtatatttcggtggggtataatttttcgtttacggcggttcggcgatgtttcgttatagttcgggtattagtatggtgtcgggggcgttatttgtgtttttacgggtttaagttttatatgtcgtgtgcgcgcggaattcgggcggttggcgaataagtataagtcgttaaagcgttttataatgtttacgtttcgtagttatggcgtagatataaaaataggcgtaaaacgtttttggtttcgtgtttcggggtagtttcgcgttcgtacgggttatg

SEQ ID NO: 8288 - DNA, 718 bp, Artificial Sequence
  chemically treated genomic DNA (Homo sapiens) CpG-island No: 8288
cataacccgtacgaacgcgaaactaccccgaaacacgaaaccaaaaacgttttacgcctatttttatatctacgccataactacgaaacgtaaacattataaaacgctttaacgacttatacttattcgccaaccgcccgaattccgcgcgcacacgacatataaaacttaaacccgtaaaaacacaaataacgcccccgacaccatactaatacccgaactataacgaaacatcgccgaaccgccgtaaacgaaaaattataccccaccgaaatatacgccaacaaccactaaaacgaaaatacaccgcaccgcgccgtacgacgaccgtaattcacaaacgcgaacgcgacaaaccgacaacgaatactacctaatactaataaaaacgaaaaaaaaactaccacgccttacctattaacctataacttaaaaaattactataaacgtaccaacgccaaccgccgatataacgctttaccgcaaaacgttattttaactaataaacgtaaattttaatataaaaaaaaaaaaaaaaaaaaaaaaaaaacttattaaatatttactaataacccgcctatcgcgcccgccgctctaacgcttacccgcgataacctactacacgcttcacgattcttataccccatttattcaccacatcgatctcgattctcaaattaaaaaaaaaaaaaaaataaaatcataacgttctaaaacc

SEQ ID NO: 8289 - DNA, 690 bp, Artificial Sequence
  chemically treated genomic DNA (Homo sapiens) CpG-island No: 8289
  misc_feature (29)..(29): n is either a, c, g or t
tcgtcgcggagggtggtatgcgagacgtntttttgttgatttatttacgtgtcgtttgagacggtgagggtggcgtggttattggtcgggatggtgtgggggcgcgcggggacgtcgtgcggttaggcgggggcggggcgcgtagcgttgggggagtaggtggtagatgtgaggtcgcgcgtaggtgttagacgtcgtatttaagggttttcgttggggcgagaagggtaaatggaattttgagtagcgcgacggaaaattggcgaagaaatcgagttgtaattgagtttgttgggtagttaggtgagatcgttgaggtaggtttttcgtattttggtggcgacggtacggaaattttaataaagtggaattggaaaacgtgttgttgtataaattgtcggtaaacgtttgtaattggttgatggtagtatcgttttggtgattatcgttttgatttgacgttggtaaattacggtttggaacgtggtttgaacgacgttattgtgtaattagttatgacgatgtgaaagtttatatttcggtttgggcgagtagattatcggcgtttttcgtagttagattattcgtatcgttcgtgatttgtcgataacgttgataaaacgtacggtcgttcgatgattatcgtcgtgcggggttgaattattggtattatttcgatatgaattatcg

SEQ ID NO: 8290 - DNA, 690 bp, Artificial Sequence
  chemically treated genomic DNA (Homo sapiens) CpG-island No: 8290
  misc_feature (662)..(662): n is either a, c, g or t
cgataattcatatcgaaataataccaataattcaaccccgcacgacgataatcatcgaacgaccgtacgttttatcaacgttatcgacaaatcacgaacgatacgaataatctaactacgaaaaacgccgataatctactcgcccaaaccgaaatataaactttcacatcgtcataactaattacacaataacgtcgttcaaaccacgttccaaaccgtaatttaccaacgtcaaatcaaaacgataatcaccaaaacgatactaccatcaaccaattacaaacgtttaccgacaatttatacaacaacacgttttccaattccactttattaaaatttccgtaccgtcgccaccaaaatacgaaaaacctacctcaacgatctcacctaactacccaacaaactcaattacaactcgatttcttcgccaattttccgtcgcgctactcaaaattccatttacccttctcgccccaacgaaaacccttaaatacgacgtctaacacctacgcgcgacctcacatctaccacctactcccccaacgctacgcgccccgcccccgcctaaccgcacgacgtccccgcgcgcccccacaccatcccgaccaataaccacgccaccctcaccgtctcaaacgacacgtaaataaatcaacaaaaanacgtctcgcataccaccctccgcgacga

SEQ ID NO: 8291 - DNA, 690 bp, Artificial Sequence
  chemically treated genomic DNA (Homo sapiens) CpG-island No: 8291
  misc_feature (662)..(662): n is either a, c, g or t
cgatagtttatatcgaggtgatattagtggtttagtttcgtacgacgataattatcgaacgatcgtgcgttttattagcgttatcggtaaattacgggcgatgcgaataatttggttgcgagaaacgtcggtaatttgttcgtttaggtcggggtataagtttttatatcgttatagttggttgtatagtaacgtcgtttaggttacgttttagatcgtagtttgttagcgttagattaaaacggtggttattagggcggtgttgttattagttagttgtaggcgtttatcggtagtttgtgtagtagtacgttttttagttttattttgttgaagttttcgtgtcgtcgttattaaagtacgggaagtttattttagcgattttatttggttatttagtaggtttagttgtagttcggttttttcgttagtttttcgtcgcgttgtttaagattttatttgtttttttcgttttagcggaagtttttaaatacgacgtttaatatttgcgcgcggttttatatttattatttatttttttagcgttgcgcgtttcgttttcgtttgatcgtacgacgttttcgcgcgtttttatattatttcggttagtgattacgttatttttatcgttttaggcgatacgtgagtggattagtagaggnacgtttcgtatattatttttcgcgacgg

SEQ ID NO: 8292 - DNA, 690 bp, Artificial Sequence
  chemically treated genomic DNA (Homo sapiens) CpG-island No: 8292
  misc_feature (29)..(29): n is either a, c, g or t
ccgtcgcgaaaaataatatacgaaacgtncctctactaatccactcacgtatcgcctaaaacgataaaaataacgtaatcactaaccgaaataatataaaaacgcgcgaaaacgtcgtacgatcaaacgaaaacgaaacgcgcaacgctaaaaaaataaataataaatataaaaccgcgcgcaaatattaaacgtcgtatttaaaaacttccgctaaaacgaaaaaaacaaataaaatcttaaacaacgcgacgaaaaactaacgaaaaaaccgaactacaactaaacctactaaataaccaaataaaatcgctaaaataaacttcccgtactttaataacgacgacacgaaaacttcaacaaaataaaactaaaaaacgtactactacacaaactaccgataaacgcctacaactaactaataacaacaccgccctaataaccaccgttttaatctaacgctaacaaactacgatctaaaacgtaacctaaacgacgttactatacaaccaactataacgatataaaaacttataccccgacctaaacgaacaaattaccgacgtttctcgcaaccaaattattcgcatcgcccgtaatttaccgataacgctaataaaacgcacgatcgttcgataattatcgtcgtacgaaactaaaccactaatatcacctcgatataaactatcg

SEQ ID NO: 8293 - DNA, 522 bp, Artificial Sequence
  chemically treated genomic DNA (Homo sapiens) CpG-island No: 8293
cgaggtagcggggtaaaatcggggtcgttaagttcgaaggaggggttcgagaagtggtcggaaggcgtagggtcggggttagagtttttcgagaggcgggtgttggggtaggtgcgaataggcgggtagagggtttcgcgggagggtttagaagagagggaaatagggtcgaagcggttttcgtcggacgttatcgcggaaagagaaattaaaagtggagttgggggcggggtcggtagggggcggggtttttcgtcgtcgttagtttcgttttcgagtcggtttaaaagattggcgtaggggcgggcgtcgaatagagcgagttgcggtcgtggtagttgtacggtttttggtttcggagtatgcgcgagagtcgtttcggagcgtttcggagtttttcgtcgtttcgttcgcggcgtttcgcgtttcgtcgttaggtgagtcgggttttgggcgaggaggcgggagggaggagggaggggagtttagggtagttaggagtcgggcgagtttcgggggttg

SEQ ID NO: 8294 - DNA, 522 bp, Artificial Sequence
  chemically treated genomic DNA (Homo sapiens) CpG-island No: 8294
caacccccgaaactcgcccgactcctaactaccctaaactcccctccctcctccctcccgcctcctcgcccaaaacccgactcacctaacgacgaaacgcgaaacgccgcgaacgaaacgacgaaaaactccgaaacgctccgaaacgactctcgcgcatactccgaaaccaaaaaccgtacaactaccacgaccgcaactcgctctattcgacgcccgcccctacgccaatcttttaaaccgactcgaaaacgaaactaacgacgacgaaaaaccccgccccctaccgaccccgcccccaactccacttttaatttctctttccgcgataacgtccgacgaaaaccgcttcgaccctatttccctctcttctaaaccctcccgcgaaaccctctacccgcctattcgcacctaccccaacacccgcctctcgaaaaactctaaccccgaccctacgccttccgaccacttctcgaacccctccttcgaacttaacgaccccgattttaccccgctacctcg

SEQ ID NO: 8295 - DNA, 522 bp, Artificial Sequence
  chemically treated genomic DNA (Homo sapiens) CpG-island No: 8295
tagttttcgaggttcgttcgatttttggttgttttggattttttttttttttttttttcgttttttcgtttagggttcggtttatttggcggcggggcgcgggacgtcgcgggcgggacggcggggggtttcggggcgtttcggggcggttttcgcgtatgtttcggggttaggagtcgtgtagttgttacggtcgtagttcgttttgttcggcgttcgtttttgcgttagttttttaaatcggttcggaggcggggttggcgacggcgggaggtttcgttttttgtcggtttcgtttttagttttatttttggttttttttttcgcggtggcgttcggcgaggatcgtttcggttttgttttttttttttttggattttttcgcggggttttttgttcgtttgttcgtatttgttttagtattcgtttttcgaggggttttggtttcgattttgcgtttttcggttatttttcggatttttttttcggatttggcgatttcgattttgtttcgttatttcg

SEQ ID NO: 8296 - DNA, 522 bp, Artificial Sequence
  chemically treated genomic DNA (Homo sapiens) CpG-island No: 8296
cgaaataacgaaacaaaatcgaaatcgccaaatccgaaaaaaaaatccgaaaaataaccgaaaaacgcaaaatcgaaaccaaaacccctcgaaaaacgaatactaaaacaaatacgaacaaacgaacaaaaaaccccgcgaaaaaatccaaaaaaaaaaaaaacaaaaccgaaacgatcctcgccgaacgccaccgcgaaaaaaaaaaccaaaaataaaactaaaaacgaaaccgacaaaaaacgaaacctcccgccgtcgccaaccccgcctccgaaccgatttaaaaaactaacgcaaaaacgaacgccgaacaaaacgaactacgaccgtaacaactacacgactcctaaccccgaaacatacgcgaaaaccgccccgaaacgccccgaaaccccccgccgtcccgcccgcgacgtcccgcgccccgccgccaaataaaccgaaccctaaacgaaaaaacgaaaaaaaaaaaaaaaaaaaatccaaaacaaccaaaaatcgaacgaacctcgaaaacta

SEQ ID NO: 8297 - DNA, 521 bp, Artificial Sequence
  chemically treated genomic DNA (Homo sapiens) CpG-island No: 8297
ggggtcgcggtcgcgatgtttttgattttcgtcggttttatttaggtcgtttttcgcgcgcggggttttcgtagtatagttttttttcggttttagtttaaatcgtttagattaggcgcggattttagtttggttagtaggcggcgggcgcggggcggcgagtcggggtcggacggttggagttagaatcggttgttttttacgtttttttttcggtgttgttcggaggtcggatttcgtttttatcgagtttttattcgtcgggaagagtttcgcggagtatagagtttattttttagttgtgtttattgaggttgaacggattcgcgcggatttggtgtttcgtgttcgttttttagggtcgggttcgtcgggagcgtcgtttttcggagttgttcggtcggcgtatatttgttcggtttcgtagcgttttagtttatttttttgtttttttcgtagcgtattttcggacgttatggtttattttttcggttggttttttttgtaggatggtagtatat

SEQ ID NO: 8298 - DNA, 521 bp, Artificial Sequence
  chemically treated genomic DNA (Homo sapiens) CpG-island No: 8298
atatactaccatcctacaaaaaaaaccaaccgaaaaaataaaccataacgtccgaaaatacgctacgaaaaaaacaaaaaaataaactaaaacgctacgaaaccgaacaaatatacgccgaccgaacaactccgaaaaacgacgctcccgacgaacccgaccctaaaaaacgaacacgaaacaccaaatccgcgcgaatccgttcaacctcaataaacacaactaaaaaataaactctatactccgcgaaactcttcccgacgaataaaaactcgataaaaacgaaatccgacctccgaacaacaccgaaaaaaaaacgtaaaaaacaaccgattctaactccaaccgtccgaccccgactcgccgccccgcgcccgccgcctactaaccaaactaaaatccgcgcctaatctaaacgatttaaactaaaaccgaaaaaaaactatactacgaaaaccccgcgcgcgaaaaacgacctaaataaaaccgacgaaaatcaaaaacatcgcgaccgcgacccc

SEQ ID NO: 8299 - DNA, 521 bp, Artificial Sequence
  chemically treated genomic DNA (Homo sapiens) CpG-island No: 8299
gtgtgttattattttatagaaggggttagtcggaggggtgggttatagcgttcgggggtgcgttgcgggagagataaagaggtgagttggggcgttgcggggtcgggtaggtgtgcgtcggtcggataatttcggagggcggcgttttcggcggattcggttttagggggcgagtacggagtattaagttcgcgcggattcgtttagttttagtggatatagttagaaaatgggttttgtatttcgcggagtttttttcggcgggtgggggttcggtggaggcggagttcggttttcgggtagtatcgagaggggggcgtggagagtagtcggttttggttttagtcgttcggtttcggttcgtcgtttcgcgttcgtcgtttgttggttaggttgggattcgcgtttggtttgggcgatttgggttagggtcggagaaaggttgtgttgcgggagtttcgcgcgcggggggcggtttgggtggggtcggcgagggttaggggtatcgcggtcgcgatttt

SEQ ID NO: 8300 - DNA, 521 bp, Artificial Sequence
  chemically treated genomic DNA (Homo sapiens) CpG-island No: 8300
aaaatcgcgaccgcgatacccctaaccctcgccgaccccacccaaaccgccccccgcgcgcgaaactcccgcaacacaacctttctccgaccctaacccaaatcgcccaaaccaaacgcgaatcccaacctaaccaacaaacgacgaacgcgaaacgacgaaccgaaaccgaacgactaaaaccaaaaccgactactctccacgcccccctctcgatactacccgaaaaccgaactccgcctccaccgaacccccacccgccgaaaaaaactccgcgaaatacaaaacccattttctaactatatccactaaaactaaacgaatccgcgcgaacttaatactccgtactcgccccctaaaaccgaatccgccgaaaacgccgccctccgaaattatccgaccgacgcacacctacccgaccccgcaacgccccaactcacctctttatctctcccgcaacgcacccccgaacgctataacccacccctccgactaaccccttctataaaataataacacac

SEQ ID NO: 8301 - DNA, 615 bp, Artificial Sequence
  chemically treated genomic DNA (Homo sapiens) CpG-island No: 8301
ttcggcggtttcgttttttgacgtcgattattggtcggttttgttagcgcgtttttgattggtggttgagggtcgggtttcgttgttttttaaagttggcgggaaagcggaggcggggcggaagggtgcggcgaggcggaatggcggcggttgcggattcgtttttaggcggtttcgcgggggtgcggttttcgaggtcgtcgttatttaaggtgttggcggagtagttgcggcgcgacgcggagggcggttcgggcgcgtggcggttgttacgggcggcggcgggtcgcgggtcgttggatttggcggtcgtgtggatgtagggtagggtagtgatggcggatcgcggcgaggttcggttgagggattcgagcggggatttttcggttcgcggtttggagcgggtgtcgcgcgggcggttttgtttagttttaggtaatgttcgggttttatcgggcgtttttttttttgttgttcgtcgagaagttgtcgaggttagattcgattttgttgttgatattcgaacgggggcggggcgggtttggttttttttcgggtttttgtttttgcgggttttcgtttgggtatttttgtttcggtttttttttggtgaag

SEQ ID NO: 8302 - DNA, 615 bp, Artificial Sequence
  chemically treated genomic DNA (Homo sapiens) CpG-island No: 8302
cttcaccaaaaaaaaaccgaaacaaaaatacccaaacgaaaacccgcaaaaacaaaaacccgaaaaaaaaccaaacccgccccgcccccgttcgaatatcaacaacaaaatcgaatctaacctcgacaacttctcgacgaacaacaaaaaaaaaaacgcccgataaaacccgaacattacctaaaactaaacaaaaccgcccgcgcgacacccgctccaaaccgcgaaccgaaaaatccccgctcgaatccctcaaccgaacctcgccgcgatccgccatcactaccctaccctacatccacacgaccgccaaatccaacgacccgcgacccgccgccgcccgtaacaaccgccacgcgcccgaaccgccctccgcgtcgcgccgcaactactccgccaacaccttaaataacgacgacctcgaaaaccgcacccccgcgaaaccgcctaaaaacgaatccgcaaccgccgccattccgcctcgccgcacccttccgccccgcctccgctttcccgccaactttaaaaaacaacgaaacccgaccctcaaccaccaatcaaaaacgcgctaacaaaaccgaccaataatcgacgtcaaaaaacgaaaccgccgaa

SEQ ID NO: 8303 - DNA, 615 bp, Artificial Sequence
  chemically treated genomic DNA (Homo sapiens) CpG-island No: 8303
ttttattaaggagggatcggagtaagggtatttaagcggggattcgtaggggtagaggttcggaggagggttagattcgtttcgttttcgttcgagtgttaataataagatcgaatttggtttcggtaatttttcggcgggtagtagggaagagggcgttcggtaaggttcgggtattatttgggattagatagggtcgttcgcgcggtattcgttttaggtcgcggatcgagaagttttcgttcgggttttttagtcgagtttcgtcgcggttcgttattattattttgttttgtatttatacggtcgttaggtttagcggttcgcggttcgtcgtcgttcgtgatagtcgttacgcgttcgggtcgtttttcgcgtcgcgtcgtagttgtttcgttagtattttgagtggcggcgatttcggaagtcgtattttcgcggggtcgtttgagaacgagttcgtagtcgtcgttatttcgtttcgtcgtattttttcgtttcgttttcgttttttcgttaattttgagaagtagcggggttcggtttttagttattaattaggagcgcgttggtagagtcggttaatggtcgacgttagaaggcgggatcgtcggg

SEQ ID NO: 8304 - DNA, 615 bp, Artificial Sequence
  chemically treated genomic DNA (Homo sapiens) CpG-island No: 8304
cccgacgatcccgccttctaacgtcgaccattaaccgactctaccaacgcgctcctaattaataactaaaaaccgaaccccgctacttctcaaaattaacgaaaaaacgaaaacgaaacgaaaaaatacgacgaaacgaaataacgacgactacgaactcgttctcaaacgaccccgcgaaaatacgacttccgaaatcgccgccactcaaaatactaacgaaacaactacgacgcgacgcgaaaaacgacccgaacgcgtaacgactatcacgaacgacgacgaaccgcgaaccgctaaacctaacgaccgtataaatacaaaacaaaataataataacgaaccgcgacgaaactcgactaaaaaacccgaacgaaaacttctcgatccgcgacctaaaacgaataccgcgcgaacgaccctatctaatcccaaataatacccgaaccttaccgaacgccctcttccctactacccgccgaaaaattaccgaaaccaaattcgatcttattattaacactcgaacgaaaacgaaacgaatctaaccctcctccgaacctctacccctacgaatccccgcttaaatacccttactccgatccctccttaataaaa

SEQ ID NO: 8305 - DNA, 568 bp, Artificial Sequence
  chemically treated genomic DNA (Homo sapiens) CpG-island No: 8305
  misc_feature (531)..(531): n is either a, c, g or t
ttcggtagatgtgcgttaaagtttattttcggatgttggtggcgtaaaatttcgttacggatgcgttcgcggtttatattttcgcggatggcgatgaattttattttcggcgtgatgatgttttggcgggcgtagtgtagttgggtgatacggcgttttgttttggcgcgttttggtgttagtacgtcgttaaaacgtagttcgtcgaggttattatttgttagtcgcgttttagtgtaatcggaattgcgtacggtaagtttttcggtatcgtcgcgcgtatcgatttacggttggcgtagttttgttagtttttgttgtacgttaatggtaatttgcggattattatacgggtcggaggtgtcgtagatcggaatcgtttcgtttttttcgtattgcgggtgttttttgttatcgttaattagcgtcgggttaagttggattttacgtattggtacgcgtacgtcggggtgtgtgttagtgatataaatgcggtttgagttaggaaaggcggtgttttttatggtgtanataaaatggtgggtttcgtcgcgttgttttcggaagt

SEQ ID NO: 8306 - DNA, 568 bp, Artificial Sequence
  chemically treated genomic DNA (Homo sapiens) CpG-island No: 8306
  misc_feature (38)..(38): n is either a, c, g or t
acttccgaaaacaacgcgacgaaacccaccattttatntacaccataaaaaacaccgcctttcctaactcaaaccgcatttatatcactaacacacaccccgacgtacgcgtaccaatacgtaaaatccaacttaacccgacgctaattaacgataacaaaaaacacccgcaatacgaaaaaaacgaaacgattccgatctacgacacctccgacccgtataataatccgcaaattaccattaacgtacaacaaaaactaacaaaactacgccaaccgtaaatcgatacgcgcgacgataccgaaaaacttaccgtacgcaattccgattacactaaaacgcgactaacaaataataacctcgacgaactacgttttaacgacgtactaacaccaaaacgcgccaaaacaaaacgccgtatcacccaactacactacgcccgccaaaacatcatcacgccgaaaataaaattcatcgccatccgcgaaaatataaaccgcgaacgcatccgtaacgaaattttacgccaccaacatccgaaaataaactttaacgcacatctaccgaa

SEQ ID NO: 8307 - DNA, 568 bp, Artificial Sequence
  chemically treated genomic DNA (Homo sapiens) CpG-island No: 8307
  misc_feature (38)..(38): n is either a, c, g or t
attttcgggaataacgcgacggggtttattattttatntatattatggaaggtatcgttttttttaatttaaatcgtatttatattattggtatatatttcggcgtgcgcgtgttaatgcgtgagatttagtttagttcgacgttaattggcggtagtaaagaatattcgtagtacgaagaaaacgaagcgatttcggtttacgatattttcggttcgtatggtgattcgtagattgttattaacgtgtagtaagggttggtaaaattacgttagtcgtggatcgatgcgcgcggcgatatcgaagaatttatcgtgcgtagtttcgattatattaaagcgcggttggtagatgatggtttcgacgaattgcgttttagcggcgtattaatattaaaacgcgttaaagtaggacgtcgtgttatttaattgtattacgttcgttagggtattattacgtcggaaatggaatttatcgttattcgcgagaatatgggtcgcgagcgtattcgtagcgaggttttacgttattagtattcgggaatgagttttggcgtatatttgtcgga

SEQ ID NO: 8308 - DNA, 568 bp, Artificial Sequence
  chemically treated genomic DNA (Homo sapiens) CpG-island No: 8308
  misc_feature (531)..(531): n is either a, c, g or t
tccgacaaatatacgccaaaactcattcccgaatactaataacgtaaaacctcgctacgaatacgctcgcgacccatattctcgcgaataacgataaattccatttccgacgtaataataccctaacgaacgtaatacaattaaataacacgacgtcctactttaacgcgttttaatattaatacgccgctaaaacgcaattcgtcgaaaccatcatctaccaaccgcgctttaatataatcgaaactacgcacgataaattcttcgatatcgccgcgcgcatcgatccacgactaacgtaattttaccaacccttactacacgttaataacaatctacgaatcaccatacgaaccgaaaatatcgtaaaccgaaatcgcttcgttttcttcgtactacgaatattctttactaccgccaattaacgtcgaactaaactaaatctcacgcattaacacgcgcacgccgaaatatataccaataatataaatacgatttaaattaaaaaaaacgataccttccataatatanataaaataataaaccccgtcgcgttattcccgaaaat

SEQ ID NO: 8309 - DNA, 552 bp, Artificial Sequence
  chemically treated genomic DNA (Homo sapiens) CpG-island No: 8309
ggacgttttcgcgaatagtagttggttatattttatattgaatttggtcgatatgcggtagttgtagtagtagtatagttaaacgagattggtcgatatcgtcgtcgatggtttgcggtattttatcgcgtagtagcgtttgatgttattttagttttaggcgattttcgttatcggttagcgttagttgatgttttagcgtgtcggtatttatacggatttttatggaggaaagtttaaacgtattttttagtatcgggttttatattagaatatcgtcgtttagattcgtatggtttagttttgacggggtgttttagttattataattcggtgcgcgtacgtcgtggcgatgattatcgtttagtttgtcgttaatttcgataaggaatatcgcgttaagatttttcgttatcgttcgtttacgttttttggtattaagattcggataacgagatagtaatttttggttgtgtacgaagtggatttgatttgatttgtatttttgcgattgaattttattggatttttatttcgtgtcgtaatagtttg

SEQ ID NO: 8310 - DNA, 552 bp, Artificial Sequence
  chemically treated genomic DNA (Homo sapiens) CpG-island No: 8310
caaactattacgacacgaaataaaaatccaataaaattcaatcgcaaaaatacaaatcaaatcaaatccacttcgtacacaaccaaaaattactatctcgttatccgaatcttaataccaaaaaacgtaaacgaacgataacgaaaaatcttaacgcgatattccttatcgaaattaacgacaaactaaacgataatcatcgccacgacgtacgcgcaccgaattataataactaaaacaccccgtcaaaactaaaccatacgaatctaaacgacgatattctaatataaaacccgatactaaaaaatacgtttaaactttcctccataaaaatccgtataaataccgacacgctaaaacatcaactaacgctaaccgataacgaaaatcgcctaaaactaaaataacatcaaacgctactacgcgataaaataccgcaaaccatcgacgacgatatcgaccaatctcgtttaactatactactactacaactaccgcatatcgaccaaattcaatataaaatataaccaactactattcgcgaaaacgtcc

SEQ ID NO: 8311 - DNA, 552 bp, Artificial Sequence
  chemically treated genomic DNA (Homo sapiens) CpG-island No: 8311
taaattgttgcgatacgggatggggatttagtggaatttagtcgtaggaatgtagattaggttagatttatttcgtatatagttaggagttattgtttcgttattcggattttgatgttaaagggcgtgagcgggcgatagcgaaagattttggcgcggtattttttgtcgggattggcggtaagttgagcgatggttatcgttacgacgtgcgcgtatcggattatgatgattggagtatttcgttagagttgggttatgcgggtttgaacggcgatattttggtgtggaattcggtattggaagatgcgtttgagtttttttttatggggattcgtgtagatgtcgatacgttgaagtattaattggcgttgatcggtgacgaagatcgtttggagttggagtggtattaggcgttgttgcgcggtgaaatgtcgtagattatcggcggcggtatcggttagtttcgtttgattatgttgttgttgtaattgtcgtatatcggttaggtttagtgtggagtatggttagttgttgttcgcgagagcgttt

SEQ ID NO: 8312 - DNA, 552 bp, Artificial Sequence
  chemically treated genomic DNA (Homo sapiens) CpG-island No: 8312
aaacgctctcgcgaacaacaactaaccatactccacactaaacctaaccgatatacgacaattacaacaacaacataatcaaacgaaactaaccgataccgccgccgataatctacgacatttcaccgcgcaacaacgcctaataccactccaactccaaacgatcttcgtcaccgatcaacgccaattaatacttcaacgtatcgacatctacacgaatccccataaaaaaaaactcaaacgcatcttccaataccgaattccacaccaaaatatcgccgttcaaacccgcataacccaactctaacgaaatactccaatcatcataatccgatacgcgcacgtcgtaacgataaccatcgctcaacttaccgccaatcccgacaaaaaataccgcgccaaaatctttcgctatcgcccgctcacgccctttaacatcaaaatccgaataacgaaacaataactcctaactatatacgaaataaatctaacctaatctacattcctacgactaaattccactaaatccccatcccgtatcgcaacaattta

SEQ ID NO: 8313 - DNA, 526 bp, Artificial Sequence
  chemically treated genomic DNA (Homo sapiens) CpG-island No: 8313
attcggttatttttcgggttttgttggttggttgcgcggtgatggggattgttaatttgttcggcggatatgttgttattatcggttcgtaattttattacgttttggtcgatggtttttagggtaacggtatttcgtaattgttgtcgtaattggtgttgtcgtgggatttgtttaatttagaatttacgttaatttgggattttattcgtatattgttgtttggcggtatttttaatggtaatgttcggcgtaatcgaatttttgttttgcgtcgtggtgttggatggtatgatcgggacgaaatataaggcgaatagcgaattggttggatagggattggggaatattatcgtttcgttttttggtggtattatcgttatagttgttatcgcgcgttttgtcgttaacgttcgtgtcggggtaacgttttttatttcggcggtgatttattttattttggttatttttgttttgttggtattggtatcgttgtttttttggttgtcgtttttcgttatggtag

SEQ ID NO: 8314 - DNA, 526 bp, Artificial Sequence
  chemically treated genomic DNA (Homo sapiens) CpG-island No: 8314
ctaccataacgaaaaacgacaaccaaaaaaacaacgataccaataccaacaaaacaaaaataaccaaaataaaataaatcaccgccgaaataaaaaacgttaccccgacacgaacgttaacgacaaaacgcgcgataacaactataacgataataccaccaaaaaacgaaacgataatattccccaatccctatccaaccaattcgctattcgccttatatttcgtcccgatcataccatccaacaccacgacgcaaaacaaaaattcgattacgccgaacattaccattaaaaataccgccaaacaacaatatacgaataaaatcccaaattaacgtaaattctaaattaaacaaatcccacgacaacaccaattacgacaacaattacgaaataccgttaccctaaaaaccatcgaccaaaacgtaataaaattacgaaccgataataacaacatatccgccgaacaaattaacaatccccatcaccgcgcaaccaaccaacaaaacccgaaaaataaccgaat

SEQ ID NO: 8315 - DNA, 526 bp, Artificial Sequence
  chemically treated genomic DNA (Homo sapiens) CpG-island No: 8315
ttgttatggcggaaagcggtagttaggagagtagcggtgttagtattagtagggtaagaataattagaatagagtggattatcgtcgagataggggacgttgtttcggtacggacgttagcggtagaacgcgcgatggtagttgtagcggtaatattattaaagaacggagcgataatattttttagtttttgtttaattagttcgttgttcgttttgtgtttcgtttcggttatattatttagtattacggcgtagagtagagattcgattgcgtcgagtattgttattgagaatgtcgttaggtagtagtgtgcgaatagaattttaggttagcgtgaattttgaattaggtagattttacggtagtattagttgcggtagtagttgcggaatatcgttattttgagaattatcggttaggacgtagtggaattgcgaatcgatggtagtaatatgttcgtcgagtaggttaataatttttattatcgcgtaattagttagtaaggttcggaaggtgatcgggt

SEQ ID NO: 8316 - DNA, 526 bp, Artificial Sequence
  chemically treated genomic DNA (Homo sapiens) CpG-island No: 8316
acccgatcaccttccgaaccttactaactaattacgcgataataaaaattattaacctactcgacgaacatattactaccatcgattcgcaattccactacgtcctaaccgataattctcaaaataacgatattccgcaactactaccgcaactaatactaccgtaaaatctacctaattcaaaattcacgctaacctaaaattctattcgcacactactacctaacgacattctcaataacaatactcgacgcaatcgaatctctactctacgccgtaatactaaataatataaccgaaacgaaacacaaaacgaacaacgaactaattaaacaaaaactaaaaaatattatcgctccgttctttaataatattaccgctacaactaccatcgcgcgttctaccgctaacgtccgtaccgaaacaacgtcccctatctcgacgataatccactctattctaattattcttaccctactaatactaacaccgctactctcctaactaccgctttccgccataacaa

SEQ ID NO: 8317 - DNA, 749 bp, Artificial Sequence
  chemically treated genomic DNA (Homo sapiens) CpG-island No: 8317
  misc_feature (269)..(269): n is either a, c, g or t
atgacgattgggtatacggcgattattattgtgaatatttttataggtattagacgagatttgaattttcggtttatgcgttgagtattgttagcgagacgttatggagatttttttttttagttaaatttggttttttcgtgattatacggttttgtcgtgatcgtttcgcgaaggtgtaggtcgtagaagtattattatgggagcgtacgtgataattttttcggtgattcgtaggggaagtttttattattcgtgtggttattagnggtgtattagcgtgttacgtgcgggttttattattcggcgttgttatgtatacggtgagcgttagaattcgaaatcgtagagtaattgtatattattagttagtgtacgattttaattggtaattggggattaggtcggcgtcggtacgtgattttgaattgttcggtagtatgttgtgtgaagttaggttcgattatgtaggcgtgtcgtacgtttatttattttatgtgtcggtggtagcgattagtggggcgttgaagtgaattagttgttttatttcgagtttataggcgtatttgttgaggcggatggagtatggtaattattttgattggtatgtattaacgcgagtgattcgcgggatagtggtatagggtgatcgtgttggtttttttttttgttgtcgtttggcgttaaaaaaggttttttattgatttagtaaagtaggggatacgcgtaggtgtttgtatattatttta

SEQ ID NO: 8318 - DNA, 749 bp, Artificial Sequence
  chemically treated genomic DNA (Homo sapiens) CpG-island No: 8318
  misc_feature (481)..(481): n is either a, c, g or t
taaaataatatacaaacacctacgcgtatcccctactttactaaatcaataaaaaaccttttttaacgccaaacgacaacaaaaaaaaaaaccaacacgatcaccctataccactatcccgcgaatcactcgcgttaatacataccaatcaaaataattaccatactccatccgcctcaacaaatacgcctataaactcgaaataaaacaactaattcacttcaacgccccactaatcgctaccaccgacacataaaataaataaacgtacgacacgcctacataatcgaacctaacttcacacaacatactaccgaacaattcaaaatcacgtaccgacgccgacctaatccccaattaccaattaaaatcgtacactaactaataatatacaattactctacgatttcgaattctaacgctcaccgtatacataacaacgccgaataataaaacccgcacgtaacacgctaatacaccnctaataaccacacgaataataaaaacttcccctacgaatcaccgaaaaaattatcacgtacgctcccataataatacttctacgacctacaccttcgcgaaacgatcacgacaaaaccgtataatcacgaaaaaaccaaatttaactaaaaaaaaaaatctccataacgtctcgctaacaatactcaacgcataaaccgaaaattcaaatctcgtctaatacctataaaaatattcacaataataatcgccgtatacccaatcgtcat

SEQ ID NO: 8319 - DNA, 749 bp, Artificial Sequence
  chemically treated genomic DNA (Homo sapiens) CpG-island No: 8319
  misc_feature (481)..(481): n is either a, c, g or t
tgggataatatataagtatttacgcgtgttttttgttttattgggttaatggaaggttttttttggcgttaggcgataataggaaagaagattaatacgattattttatgttattgtttcgcggattattcgcgttagtatatattaattaaagtggttgttatgttttattcgttttaataagtacgtttatggattcgaggtagagtagttggtttattttagcgttttattggtcgttgttatcgatatatggaatgggtgaacgtacgatacgtttgtatagtcgaatttggttttatataatatgttatcgagtaatttagggttacgtatcggcgtcgatttagtttttagttattagttgaggtcgtgtattagttaatgatgtatagttgttttgcgatttcgggttttaacgtttatcgtgtatatggtagcgtcgaatggtgggattcgtacgtgatacgttggtgtattnttagtagttatacgaatgatggggattttttttgcgaattatcgagggaattattacgtgcgtttttatgatagtatttttgcggtttatattttcgcgggacgattacggtaagatcgtatggttacgaagggattaggtttgattggggaaaggggtttttatagcgtttcgttgatagtgtttaacgtatgggtcgagagtttagatttcgtttagtgtttgtggggatatttatagtgatagtcgtcgtatatttagtcgttat

SEQ ID NO: 8320 - DNA, 749 bp, Artificial Sequence
  chemically treated genomic DNA (Homo sapiens) CpG-island No: 8320
  misc_feature (269)..(269): n is either a, c, g or t
ataacgactaaatatacgacgactatcactataaatatccccacaaacactaaacgaaatctaaactctcgacccatacgttaaacactatcaacgaaacgctataaaaacccctttccccaatcaaacctaatcccttcgtaaccatacgatcttaccgtaatcgtcccgcgaaaatataaaccgcaaaaatactatcataaaaacgcacgtaataattccctcgataattcgcaaaaaaaatccccatcattcgtataactactaanaatacaccaacgtatcacgtacgaatcccaccattcgacgctaccatatacacgataaacgttaaaacccgaaatcgcaaaacaactatacatcattaactaatacacgacctcaactaataactaaaaactaaatcgacgccgatacgtaaccctaaattactcgataacatattatataaaaccaaattcgactatacaaacgtatcgtacgttcacccattccatatatcgataacaacgaccaataaaacgctaaaataaaccaactactctacctcgaatccataaacgtacttattaaaacgaataaaacataacaaccactttaattaatatatactaacgcgaataatccgcgaaacaataacataaaataatcgtattaatcttctttcctattatcgcctaacgccaaaaaaaaccttccattaacccaataaaacaaaaaacacgcgtaaatacttatatattatccca

SEQ ID NO: 8321 - DNA, 625 bp, Artificial Sequence
  chemically treated genomic DNA (Homo sapiens) CpG-island No: 8321
tcggttggcgttgaggggatcgaggaggggtttggggcgaaaggatcgcgagagggcgtttagggcgcggggggcgcggtatttgtaggtcggtaaagttttttaaatcggtttcgttagattcgcgcggtcgtcgttttcgtttcggtcgtcggagttgttgtcgcgtcgcgtttttacgtgattcgcgtacgcgtcgggggcggagtcgttttagattcgtttttatttttcggcgtttttagcgcgtcggttcgtttcgagtgcgcgtgcgtagcggttgtttgggcgatcggggaagcgttgggttgtaaagattagggcgttagcggttggcgaagaaggaaagagggtattttttggttgggttggggtcgtagcgacgttcgtcgcgaatttgggttttttaaagttgcggggcgttcggtgtcgtcgaagtaaatatgtattttgagttttcggagtttgcgataggtggtgtagtagagttggattgcgcgtaggagttcggcgtggaggagtttgcgggtgattacgggagcgtaggtcgagggggttgtaaggaaggtgtcgattgttttttagggagggcggtgggcgaggggtaatacggtaggcgttttag

SEQ ID NO: 8322 - DNA, 625 bp, Artificial Sequence
  chemically treated genomic DNA (Homo sapiens) CpG-island No: 8322
ctaaaacgcctaccgtattacccctcgcccaccgccctccctaaaaaacaatcgacaccttccttacaaccccctcgacctacgctcccgtaatcacccgcaaactcctccacgccgaactcctacgcgcaatccaactctactacaccacctatcgcaaactccgaaaactcaaaatacatatttacttcgacgacaccgaacgccccgcaactttaaaaaacccaaattcgcgacgaacgtcgctacgaccccaacccaaccaaaaaataccctctttccttcttcgccaaccgctaacgccctaatctttacaacccaacgcttccccgatcgcccaaacaaccgctacgcacgcgcactcgaaacgaaccgacgcgctaaaaacgccgaaaaataaaaacgaatctaaaacgactccgcccccgacgcgtacgcgaatcacgtaaaaacgcgacgcgacaacaactccgacgaccgaaacgaaaacgacgaccgcgcgaatctaacgaaaccgatttaaaaaactttaccgacctacaaataccgcgccccccgcgccctaaacgccctctcgcgatcctttcgccccaaacccctcctcgatcccctcaacgccaaccga

SEQ ID NO: 8323 - DNA, 625 bp, Artificial Sequence
  chemically treated genomic DNA (Homo sapiens) CpG-island No: 8323
ttggagcgtttatcgtgttgtttttcgtttatcgttttttttggggggtagtcggtattttttttgtagttttttcggtttgcgttttcgtggttattcgtagatttttttacgtcgggtttttgcgcgtaatttagttttgttgtattatttgtcgtaggtttcgagggtttagggtgtatgtttatttcggcgatatcgaacgtttcgtagttttggggggtttaggttcgcggcggacgtcgttacggttttagtttagttagagagtatttttttttttttttcgttagtcgttggcgttttagtttttatagtttaacgttttttcggtcgtttaggtaatcgttgcgtacgcgtattcgggacggatcggcgcgttggggacgtcggggggtgggggcgggtttgagacggtttcgttttcggcgcgtacgcgggttacgtgagggcgcggcgcggtagtagtttcggcggtcgagacgggggcggcggtcgcgcgggtttggcgggatcggtttggaagattttgtcggtttgtaggtatcgcgtttttcgcgttttgggcgttttttcgcggttttttcgttttagattttttttcggtttttttagcgttagtcgg

SEQ ID NO: 8324 - DNA, 625 bp, Artificial Sequence
  chemically treated genomic DNA (Homo sapiens) CpG-island No: 8324
ccgactaacgctaaaaaaaccgaaaaaaaatctaaaacgaaaaaaccgcgaaaaaacgcccaaaacgcgaaaaacgcgatacctacaaaccgacaaaatcttccaaaccgatcccgccaaacccgcgcgaccgccgcccccgtctcgaccgccgaaactactaccgcgccgcgccctcacgtaacccgcgtacgcgccgaaaacgaaaccgtctcaaacccgcccccaccccccgacgtccccaacgcgccgatccgtcccgaatacgcgtacgcaacgattacctaaacgaccgaaaaaacgttaaactataaaaactaaaacgccaacgactaacgaaaaaaaaaaaaaaatactctctaactaaactaaaaccgtaacgacgtccgccgcgaacctaaaccccccaaaactacgaaacgttcgatatcgccgaaataaacatacaccctaaaccctcgaaacctacgacaaataatacaacaaaactaaattacgcgcaaaaacccgacgtaaaaaaatctacgaataaccacgaaaacgcaaaccgaaaaaactacaaaaaaaataccgactaccccccaaaaaaaacgataaacgaaaaacaacacgataaacgctccaa

SEQ ID NO: 8325 - DNA, 854 bp, Artificial Sequence
  chemically treated genomic DNA (Homo sapiens) CpG-island No: 8325
gcgttcggttttcgggggtggagggtttaggtcgcgttttttagtttcgcggttttaggttttcgttcgttcgaggcggagttcgggaggtcggggcggggtttcgggtcggttatttatttgggttgttagttattttagtttcgcgaatagttggtgtcgttggtgtcgtcgtcgtcgtcgtcgtcgtttagtcgagatttcggggttttgcggtttattatttttttcgatacgatatggttaagcgtcgtcgtttagagaagcgcgagtcgttattcgaatcggtcgtcgttaatatttcgtttcggttcggggttgagaaggaagtcgagaaggaggaggaggaggaggcggcggcgggcgggggaagaggacgatcgtttcgggtttcgtttgagttcgtagtataggacgaggaggcgggagcggcgcggtgagagagaggcggatgaaggggaggcgacgttttttttagggttttgcgcggtttacgtcgtcggggttttcgaggaggaggacgacgaggaataggcggtggcggtagtatttttacgtttatacggttattgttttttcgtttttcggtttcgttcgtcgcgtcgtcgttgtcgtacggtatgttgggagcgagaggcggggtcggtttcgtcgtgtttgcggagagaggcgggttttgtcggcggggcggggtcgatagtaggtcgtttcgttttttacggttttaggtttttggacggcgaagaggtttgggcgtagcggtgacgaattttaagataggggatttttattattgcggttatatattttttttttaaatgtttttcggaaagtatcggagggttaggtagtta

SEQ ID NO: 8326 - DNA, 854 bp, Artificial Sequence
  chemically treated genomic DNA (Homo sapiens) CpG-island No: 8326
taactacctaaccctccgatactttccgaaaaacatttaaaaaaaaaatatataaccgcaataataaaaatcccctatcttaaaattcgtcaccgctacgcccaaacctcttcgccgtccaaaaacctaaaaccgtaaaaaacgaaacgacctactatcgaccccgccccgccgacaaaacccgcctctctccgcaaacacgacgaaaccgaccccgcctctcgctcccaacataccgtacgacaacgacgacgcgacgaacgaaaccgaaaaacgaaaaaacaataaccgtataaacgtaaaaatactaccgccaccgcctattcctcgtcgtcctcctcctcgaaaaccccgacgacgtaaaccgcgcaaaaccctaaaaaaaacgtcgcctccccttcatccgcctctctctcaccgcgccgctcccgcctcctcgtcctatactacgaactcaaacgaaacccgaaacgatcgtcctcttcccccgcccgccgccgcctcctcctcctcctccttctcgacttccttctcaaccccgaaccgaaacgaaatattaacgacgaccgattcgaataacgactcgcgcttctctaaacgacgacgcttaaccatatcgtatcgaaaaaaataataaaccgcaaaaccccgaaatctcgactaaacgacgacgacgacgacgacgacaccaacgacaccaactattcgcgaaactaaaataactaacaacccaaataaataaccgacccgaaaccccgccccgacctcccgaactccgcctcgaacgaacgaaaacctaaaaccgcgaaactaaaaaacgcgacctaaaccctccacccccgaaaaccgaacgc

SEQ ID NO: 8327 - DNA, 854 bp, Artificial Sequence
  chemically treated genomic DNA (Homo sapiens) CpG-island No: 8327
tgattgtttggtttttcggtgtttttcgggaagtatttgggagaaaagtgtgtggtcgtagtagtggagattttttgttttaggattcgttatcgttacgtttagattttttcgtcgtttaagagtttggggtcgtggggggcggggcggtttgttatcggtttcgtttcgtcgataggattcgttttttttcgtaggtacggcggggtcgatttcgtttttcgtttttagtatgtcgtgcgatagcggcggcgcggcgagcggagtcgggaggcggggaagtagtggtcgtgtgagcgtgaggatgttgtcgttatcgtttgtttttcgtcgttttttttttcgggggtttcggcgacgtgggtcgcgtagggttttggaagagacgtcgttttttttttattcgttttttttttatcgcgtcgttttcgttttttcgttttgtgttgcgggtttaggcggaattcggaacggtcgtttttttttttcgttcgtcgtcgtttttttttttttttttttttcggttttttttttagtttcgggtcggagcggggtgttggcggcggtcggttcgggtggcgattcgcgtttttttgggcggcggcgtttggttatatcgtgtcggggaaggtaatgagtcgtagagtttcggggtttcggttgagcggcggcggcggcggcggcggtattaacggtattaattattcgcggagttggaatgattggtaatttaggtgggtgatcggttcgggatttcgtttcgatttttcgggtttcgtttcgggcgggcggaggtttagggtcgcggggttgggaggcgcggtttaggttttttattttcgggagtcgggcgt

SEQ ID NO: 8328 - DNA, 854 bp, Artificial Sequence
  chemically treated genomic DNA (Homo sapiens) CpG-island No: 8328
acgcccgactcccgaaaataaaaaacctaaaccgcgcctcccaaccccgcgaccctaaacctccgcccgcccgaaacgaaacccgaaaaatcgaaacgaaatcccgaaccgatcacccacctaaattaccaatcattccaactccgcgaataattaataccgttaataccgccgccgccgccgccgccgctcaaccgaaaccccgaaactctacgactcattaccttccccgacacgatataaccaaacgccgccgcccaaaaaaacgcgaatcgccacccgaaccgaccgccgccaacaccccgctccgacccgaaactaaaaaaaaaaccgaaaaaaaaaaaaaaaaaaaaacgacgacgaacgaaaaaaaaaaacgaccgttccgaattccgcctaaacccgcaacacaaaacgaaaaaacgaaaacgacgcgataaaaaaaaaacgaataaaaaaaaaacgacgtctcttccaaaaccctacgcgacccacgtcgccgaaacccccgaaaaaaaaaacgacgaaaaacaaacgataacgacaacatcctcacgctcacacgaccactacttccccgcctcccgactccgctcgccgcgccgccgctatcgcacgacatactaaaaacgaaaaacgaaatcgaccccgccgtacctacgaaaaaaaacgaatcctatcgacgaaacgaaaccgataacaaaccgccccgccccccacgaccccaaactcttaaacgacgaaaaaatctaaacgtaacgataacgaatcctaaaacaaaaaatctccactactacgaccacacacttttctcccaaatacttcccgaaaaacaccgaaaaaccaaacaatca

SEQ ID NO: 8329 - DNA, 917 bp, Artificial Sequence
  chemically treated genomic DNA (Homo sapiens) CpG-island No: 8329
tgtagtttcgggtgcgtttgttcgtcgcgttagttcgcgcgcgttttttttcgtttttagcgggttgttcgcggtgtcgatgaagtttacgttgttaggggtaacgttagagcgatttacggtaatgttcgatgatgtcgtgtatcgcgtagttgtgttaatcggttcgttcgttagcgttttcggcgatacgtggtcgaagtaggcgttcggcgagtacgttcgagaagcgcgtatcggtgatgagcgatagtcgttttgtttttatcgagatatgttttagtcgcggaggtgagttggtaggttttttttatgtcggtgttcggacggttcgtcgtcgattattattatgatatcgttttgtataattttttttcgtttgatcgttttgatcgtttgcgttttcgagataaatattcgtattcggtcggtgtggtggtatacgttattttcgtttattatcgacgggtcgatcgtcgtggttttgattatcgaatttttcggcgcgatgttgttcgtcgggaagtagatcgtcgaggttagttttttcgtttttgtttttttcggcggtaggattacgttattcggttttacgtcgttttgttcgcgtaggtattggcggaagcgcgttcggcgttcggacgtttgttattatttaaggttttcgtttatcgtttggtcggttacggttatggcgtttagatgtagtaggtcgaggtcgcgtaggtggagtattattttcggtacgtcgttcgcgaggaaggcgcgtacggtcgggtgatagttcgggtcgttgggtagtacgtttattagacgcggtattttacggttgatgcgcgtttagttttaacgttcgggatcgtgtagttcgtcgcgtggcgatggtcggaatgttagtataattggtggatcgttaa

SEQ ID NO: 8330 - DNA, 917 bp, Artificial Sequence
  chemically treated genomic DNA (Homo sapiens) CpG-island No: 8330
ttaacgatccaccaattatactaacattccgaccatcgccacgcgacgaactacacgatcccgaacgttaaaactaaacgcgcatcaaccgtaaaataccgcgtctaataaacgtactacccaacgacccgaactatcacccgaccgtacgcgccttcctcgcgaacgacgtaccgaaaataatactccacctacgcgacctcgacctactacatctaaacgccataaccgtaaccgaccaaacgataaacgaaaaccttaaataataacaaacgtccgaacgccgaacgcgcttccgccaatacctacgcgaacaaaacgacgtaaaaccgaataacgtaatcctaccgccgaaaaaaacaaaaacgaaaaaactaacctcgacgatctacttcccgacgaacaacatcgcgccgaaaaattcgataatcaaaaccacgacgatcgacccgtcgataataaacgaaaataacgtataccaccacaccgaccgaatacgaatatttatctcgaaaacgcaaacgatcaaaacgatcaaacgaaaaaaaattatacaaaacgatatcataataataatcgacgacgaaccgtccgaacaccgacataaaaaaaacctaccaactcacctccgcgactaaaacatatctcgataaaaacaaaacgactatcgctcatcaccgatacgcgcttctcgaacgtactcgccgaacgcctacttcgaccacgtatcgccgaaaacgctaacgaacgaaccgattaacacaactacgcgatacacgacatcatcgaacattaccgtaaatcgctctaacgttacccctaacaacgtaaacttcatcgacaccgcgaacaacccgctaaaaacgaaaaaaaacgcgcgcgaactaacgcgacgaacaaacgcacccgaaactaca

SEQ ID NO: 8331 - DNA, 917 bp, Artificial Sequence
  chemically treated genomic DNA (Homo sapiens) CpG-island No: 8331
ttggcggtttattaattatgttgatatttcggttatcgttacgcggcgggttgtacgatttcggacgttgagattggacgcgtattaatcgtaaagtgtcgcgtttggtgagcgtgttgtttaacggttcggattattattcgatcgtgcgcgtttttttcgcgggcggcgtgtcggaggtgatgttttatttgcgcgatttcggtttgttgtatttggacgttatgatcgtgatcggttagacggtgggcgagaattttgaatggtggtaggcgttcgagcgtcgggcgcgttttcgttagtgtttgcgcgagtaggacggcgtagagtcggatgacgtgattttgtcgtcggagaaggtaaaagcgaaagggttgatttcgacggtttgtttttcgacgggtaatatcgcgtcggaaggttcggtgattaaggttacggcgatcgattcgtcggtggtgggcgaagatggcgtatattattatatcggtcgggtgcgggtgtttgtttcggaagcgtaggcgattaaggcgattaagcgggaagagattgtgtagggcgatattatggtggtgatcggcggcgggtcgttcggatatcggtatggaagagatttattagtttattttcgcgattaaagtatatttcgatggggataagacggttgtcgtttattatcgatgcgcgtttttcgggcgtgttcgtcgggcgtttgtttcggttacgtgtcgtcggaggcgttggcgggcgggtcgattggtatagttgcgcgatatacgatattatcgagtattgtcgtggatcgttttgacgttatttttggtagcgtgaattttatcggtatcgcggataattcgttgaagacggaagagggcgcgcgcgagttggcgcggcggatagacgtattcgagattgta

SEQ ID NO: 8332 - DNA, 917 bp, Artificial Sequence
  chemically treated genomic DNA (Homo sapiens) CpG-island No: 8332
tacaatctcgaatacgtctatccgccgcgccaactcgcgcgcgccctcttccgtcttcaacgaattatccgcgataccgataaaattcacgctaccaaaaataacgtcaaaacgatccacgacaatactcgataatatcgtatatcgcgcaactataccaatcgacccgcccgccaacgcctccgacgacacgtaaccgaaacaaacgcccgacgaacacgcccgaaaaacgcgcatcgataataaacgacaaccgtcttatccccatcgaaatatactttaatcgcgaaaataaactaataaatctcttccataccgatatccgaacgacccgccgccgatcaccaccataatatcgccctacacaatctcttcccgcttaatcgccttaatcgcctacgcttccgaaacaaacacccgcacccgaccgatataataatatacgccatcttcgcccaccaccgacgaatcgatcgccgtaaccttaatcaccgaaccttccgacgcgatattacccgtcgaaaaacaaaccgtcgaaatcaaccctttcgcttttaccttctccgacgacaaaatcacgtcatccgactctacgccgtcctactcgcgcaaacactaacgaaaacgcgcccgacgctcgaacgcctaccaccattcaaaattctcgcccaccgtctaaccgatcacgatcataacgtccaaatacaacaaaccgaaatcgcgcaaataaaacatcacctccgacacgccgcccgcgaaaaaaacgcgcacgatcgaataataatccgaaccgttaaacaacacgctcaccaaacgcgacactttacgattaatacgcgtccaatctcaacgtccgaaatcgtacaacccgccgcgtaacgataaccgaaatatcaacataattaataaaccgccaa

SEQ ID NO: 8333 - DNA, 723 bp, Artificial Sequence
  chemically treated genomic DNA (Homo sapiens) CpG-island No: 8333
tgcgggacgcggggaggcgggagagatcgagtgggaggtttcgcgaaggagtgggagtgggagtgggagtgtcggcgggagatttgcgggggcgcgttcgggttgacgcgtgcgcgttagtgcgcgtgagtgcgggcgcgcgtcgtcgtttttcgtcggggtcggagtcggttgttatgggaacgcgtcgcggttcgagttaattattttttgtggaaagtgtgcgggaggggcgcgagcgggttggtcgaggaggaggcggcggcgtggagttgttttttgtcggcgggtcgggtcgggtcgagtttcgggcgttgcggcgacgtttggattttgttttcgttaggtcggtgagtggggggttcgggcgggttgggtgcgagcggggcgttgggttttgttcggttcgtcgtttggggcgtcgcgttcgggtcggttttgttttcgggatttttttgttcggattcgttatgggcgcggggagggaaaggttcgggagatttagttttgcgaggttttttttagcgtcgtttagttcgagtcgaggattttgttgggagttgggtataggggcggcgtgttttacgggattcgagtagtttcgggatttcgtttggattttattgaacgagaagagcgtagattttattcgggattgggtttgttaatcggcgtcgtttttttttttttttggcgttttttttatttttagggttttttgga

SEQ ID NO: 8334 - DNA, 723 bp, Artificial Sequence
  chemically treated genomic DNA (Homo sapiens) CpG-island No: 8334
tccaaaaaaccctaaaaataaaaaaaacgccaaaaaaaaaaaaaaacgacgccgattaacaaacccaatcccgaataaaatctacgctcttctcgttcaataaaatccaaacgaaatcccgaaactactcgaatcccgtaaaacacgccgcccctatacccaactcccaacaaaatcctcgactcgaactaaacgacgctaaaaaaaacctcgcaaaactaaatctcccgaacctttccctccccgcgcccataacgaatccgaacaaaaaaatcccgaaaacaaaaccgacccgaacgcgacgccccaaacgacgaaccgaacaaaacccaacgccccgctcgcacccaacccgcccgaaccccccactcaccgacctaacgaaaacaaaatccaaacgtcgccgcaacgcccgaaactcgacccgacccgacccgccgacaaaaaacaactccacgccgccgcctcctcctcgaccaacccgctcgcgcccctcccgcacactttccacaaaaaataattaactcgaaccgcgacgcgttcccataacaaccgactccgaccccgacgaaaaacgacgacgcgcgcccgcactcacgcgcactaacgcgcacgcgtcaacccgaacgcgcccccgcaaatctcccgccgacactcccactcccactcccactccttcgcgaaacctcccactcgatctctcccgcctccccgcgtcccgca

SEQ ID NO: 8335 - DNA, 723 bp, Artificial Sequence
  chemically treated genomic DNA (Homo sapiens) CpG-island No: 8335
tttagggagttttgggggtggggaagacgttaggaaggggagagggcggcgtcgattgataagtttagtttcgggtagggtttgcgtttttttcgtttaataaaatttaaacggggtttcgaggttgttcggatttcgtgggatacgtcgtttttgtgtttagtttttagtaaggttttcgattcgggttgaacggcgttggaggggatttcgtagggttgggtttttcgggttttttttttttcgcgtttatagcgggttcgggtagaggggtttcgagggtagggtcggttcggacgcggcgttttaaacggcgggtcgggtagagtttagcgtttcgttcgtatttagttcgttcgggttttttatttatcggtttggcggaggtaggatttaggcgtcgtcgtagcgttcggggttcggttcggttcggttcgtcggtaggaggtagttttacgtcgtcgtttttttttcggttagttcgttcgcgtttttttcgtatattttttataggaaatgattaattcgggtcgcggcgcgtttttatggtaatcggtttcgatttcggcggggggcggcggcgcgcgttcgtatttacgcgtattggcgcgtacgcgttagttcgggcgcgttttcgtaggtttttcgtcggtatttttatttttatttttattttttcgcggggttttttattcggtttttttcgttttttcgcgtttcgta

SEQ ID NO: 8336 - DNA, 723 bp, Artificial Sequence
  chemically treated genomic DNA (Homo sapiens) CpG-island No: 8336
tacgaaacgcgaaaaaacgaaaaaaaccgaataaaaaaccccgcgaaaaaataaaaataaaaataaaaataccgacgaaaaacctacgaaaacgcgcccgaactaacgcgtacgcgccaatacgcgtaaatacgaacgcgcgccgccgccccccgccgaaatcgaaaccgattaccataaaaacgcgccgcgacccgaattaatcatttcctataaaaaatatacgaaaaaaacgcgaacgaactaaccgaaaaaaaaacgacgacgtaaaactacctcctaccgacgaaccgaaccgaaccgaaccccgaacgctacgacgacgcctaaatcctacctccgccaaaccgataaataaaaaacccgaacgaactaaatacgaacgaaacgctaaactctacccgacccgccgtttaaaacgccgcgtccgaaccgaccctaccctcgaaacccctctacccgaacccgctataaacgcgaaaaaaaaaaaacccgaaaaacccaaccctacgaaatcccctccaacgccgttcaacccgaatcgaaaaccttactaaaaactaaacacaaaaacgacgtatcccacgaaatccgaacaacctcgaaaccccgtttaaattttattaaacgaaaaaaacgcaaaccctacccgaaactaaacttatcaatcgacgccgccctctccccttcctaacgtcttccccacccccaaaactccctaaa

SEQ ID NO: 8337 - DNA, 552 bp, Artificial Sequence
  chemically treated genomic DNA (Homo sapiens) CpG-island No: 8337
  misc_feature (161)..(161): n is either a, c, g or t
  misc_feature (322)..(322): n is either a, c, g or t
cggtatcgtagcgttcgcgattatttcgagttgtagaattttttcgtcgagcgatagttaggtttagatattcgtagatttagaggtgatgggtatcgtagtttcgatattttgtatacgtttacgagggacggtacgaggtgggtaaattgaatattagntcgagtgttttcgtagataagtaacgcgagataaaggttatgcgagagagatagttaggcgcgcgtgtcgttggcgttaggagtggtattcgaatcgaattaatttttttacgttttaattttagagaatgtgttttgaagagatatcgcgatcgattatnatagtttagaatacgtggcgtaatacgacgtttcgaggtgtaggtttttagagcgttttggaagtatttggttgttttttcgtagtattttttttaagtcgtttggcgataatcgaggatagcggaggtaacgcgttgatttttttttaaggtttttgatgattaacgaattttatatggttaattttaagatatttgatatgagttagaggacgtattacggtagatgt

SEQ ID NO: 8338 - DNA, 552 bp, Artificial Sequence
  chemically treated genomic DNA (Homo sapiens) CpG-island No: 8338
  misc_feature (231)..(231): n is either a, c, g or t
  misc_feature (392)..(392): n is either a, c, g or t
acatctaccgtaatacgtcctctaactcatatcaaatatcttaaaattaaccatataaaattcgttaatcatcaaaaaccttaaaaaaaaatcaacgcgttacctccgctatcctcgattatcgccaaacgacttaaaaaaaatactacgaaaaaacaaccaaatacttccaaaacgctctaaaaacctacacctcgaaacgtcgtattacgccacgtattctaaactatnataatcgatcgcgatatctcttcaaaacacattctctaaaattaaaacgtaaaaaaattaattcgattcgaataccactcctaacgccaacgacacgcgcgcctaactatctctctcgcataacctttatctcgcgttacttatctacgaaaacactcganctaatattcaatttacccacctcgtaccgtccctcgtaaacgtatacaaaatatcgaaactacgatacccatcacctctaaatctacgaatatctaaacctaactatcgctcgacgaaaaaattctacaactcgaaataatcgcgaacgctacgataccg

SEQ ID NO: 8339 - DNA, 552 bp, Artificial Sequence
  chemically treated genomic DNA (Homo sapiens) CpG-island No: 8339
  misc_feature (231)..(231): n is either a, c, g or t
  misc_feature (392)..(392): n is either a, c, g or t
gtatttatcgtggtgcgttttttagtttatgttaagtgttttggggttggttatatggggttcgttggttattaagggttttggagagaggttaacgcgttgttttcgttattttcgattgtcgttaaacgatttggggaagatattacgggggggtaattaagtgtttttaggacgttttaggagtttatatttcggaacgtcgtgttgcgttacgtgttttagattgtnatggtcgatcgcggtgtttttttagggtatattttttggagttaaggcgtaggggagttgattcggttcgagtgttatttttagcgttaacgatacgcgcgtttgattgtttttttcgtatggtttttgtttcgcgttgtttgtttacggaggtattcganttgatgtttaatttgtttatttcgtatcgtttttcgtggacgtatgtaaggtgtcgagattgcgatgtttattatttttgggtttacggatgtttaaatttagttgtcgttcggcgagaaggttttatagttcgaggtggtcgcggacgttacgatgtcg

SEQ ID NO: 8340 - DNA, 552 bp, Artificial Sequence
  chemically treated genomic DNA (Homo sapiens) CpG-island No: 8340
  misc_feature (161)..(161): n is either a, c, g or t
  misc_feature (322)..(322): n is either a, c, g or t
cgacatcgtaacgtccgcgaccacctcgaactataaaaccttctcgccgaacgacaactaaatttaaacatccgtaaacccaaaaataataaacatcgcaatctcgacaccttacatacgtccacgaaaaacgatacgaaataaacaaattaaacatcaantcgaatacctccgtaaacaaacaacgcgaaacaaaaaccatacgaaaaaaacaatcaaacgcgcgtatcgttaacgctaaaaataacactcgaaccgaatcaactcccctacgccttaactccaaaaaatataccctaaaaaaacaccgcgatcgaccatnacaatctaaaacacgtaacgcaacacgacgttccgaaatataaactcctaaaacgtcctaaaaacacttaattacccccccgtaatatcttccccaaatcgtttaacgacaatcgaaaataacgaaaacaacgcgttaacctctctccaaaacccttaataaccaacgaaccccatataaccaaccccaaaacacttaacataaactaaaaaacgcaccacgataaatac

SEQ ID NO: 8341 - DNA, 564 bp, Artificial Sequence
  chemically treated genomic DNA (Homo sapiens) CpG-island No: 8341
atatgggtaattcgatgttggaagcggcggcgttgatcgggttggatttgcgtttgttggtttcgaaagtttgttggtcggaagagagtttggtggcggagtgtagcgcgttggcggagaagtacggcgggaaaattattttgacggaagacgtggcggtaggcgttaagggcgcggattttatttatatcgacgtgtgggttcgatgggcgaggttaaagagaagtgggtagagcggattgcgttgttgcgcgggtattaggtgaacgcgtagatatggcgttgatcgataattcgaacgtgaagtttttgtattgtttgtcggcgttttatgacgattagattacgttcggtaagtagatggcgaaggagttcgatttgtacggcgggatggaggtgacggacgaggtgtttgagtcggcggcgagtatcgtgttcgattaggcggaaaatcggatgtatacgattaaggcggtgatgatggtaacgtttggaggagtgattgggttcgttgcgcgttgatgtttttatttcggtttttttttataggggagagggagaaaa

SEQ ID NO: 8342 - DNA, 564 bp, Artificial Sequence
  chemically treated genomic DNA (Homo sapiens) CpG-island No: 8342
ttttctccctctcccctataaaaaaaaaccgaaataaaaacatcaacgcgcaacgaacccaatcactcctccaaacgttaccatcatcaccgccttaatcgtatacatccgattttccgcctaatcgaacacgatactcgccgccgactcaaacacctcgtccgtcacctccatcccgccgtacaaatcgaactccttcgccatctacttaccgaacgtaatctaatcgtcataaaacgccgacaaacaatacaaaaacttcacgttcgaattatcgatcaacgccatatctacgcgttcacctaatacccgcgcaacaacgcaatccgctctacccacttctctttaacctcgcccatcgaacccacacgtcgatataaataaaatccgcgcccttaacgcctaccgccacgtcttccgtcaaaataattttcccgccgtacttctccgccaacgcgctacactccgccaccaaactctcttccgaccaacaaactttcgaaaccaacaaacgcaaatccaacccgatcaacgccgccgcttccaacatcgaattacccatat

SEQ ID NO: 8343 - DNA, 564 bp, Artificial Sequence
  chemically treated genomic DNA (Homo sapiens) CpG-island No: 8343
tttttttttttttttttgtgggagagggtcggggtgagggtattagcgcgtagcggatttaattatttttttaagcgttgttattattatcgttttaatcgtatgtattcggtttttcgtttggtcgaatacgatgttcgtcgtcgatttaaatatttcgttcgttatttttatttcgtcgtgtagatcgaattttttcgttatttgtttgtcgagcgtagtttggtcgttatggaacgtcggtagatagtgtaggaattttacgttcgggttgtcggttagcgttatatttgcgcgtttatttgatattcgcgtagtagcgtaattcgttttgtttatttttttttggtttcgtttatcgaatttatacgtcggtatagataaagttcgcgtttttaacgtttgtcgttacgtttttcgttagagtaattttttcgtcgtgttttttcgttagcgcgttgtatttcgttattaggttttttttcggttagtaggttttcggggttaataggcgtagatttagttcggttagcgtcgtcgtttttagtatcgagttgtttatgt

SEQ ID NO: 8344 - DNA, 564 bp, Artificial Sequence
  chemically treated genomic DNA (Homo sapiens) CpG-island No: 8344
acataaacaactcgatactaaaaacgacgacgctaaccgaactaaatctacgcctattaaccccgaaaacctactaaccgaaaaaaaacctaataacgaaatacaacgcgctaacgaaaaaacacgacgaaaaaattactctaacgaaaaacgtaacgacaaacgttaaaaacgcgaactttatctataccgacgtataaattcgataaacgaaaccaaaaaaaaataaacaaaacgaattacgctactacgcgaatatcaaataaacgcgcaaatataacgctaaccgacaacccgaacgtaaaattcctacactatctaccgacgttccataacgaccaaactacgctcgacaaacaaataacgaaaaaattcgatctacacgacgaaataaaaataacgaacgaaatatttaaatcgacgacgaacatcgtattcgaccaaacgaaaaaccgaatacatacgattaaaacgataataataacaacgcttaaaaaaataattaaatccgctacgcgctaataccctcaccccgaccctctcccacaaaaaaaaaaaaaaaaa

SEQ ID NO: 8345 - DNA, 1026 bp, Artificial Sequence
  chemically treated genomic DNA (Homo sapiens) CpG-island No: 8345
  misc_feature (24)..(24): n is either a, c, g or t
tcggggtacgtattggtgttttantcggcgtggtttgttcggtgtgtttcggcggagtgacgttcggttattcggttaatttttttgttcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtagaagaagttcggtagtaggttattttcggcgggacggaatcgttcgttttttttgatattttgtcgggttatatcgaatatggtcgggataacggtattcgtttgtttgtcgtgtggttgacgtacgattcggaatattcggagaatttatttgtcgcgtcgttggtgcgttatggttggacgttacgcggcgaattggcggtggtgtatgatcgtagtggtaaataggtgcgtagttttatttacgatgataaatatcggggtcggattgtggcgtaacgttatacggggcgggcggaaaattcggtatcgtaataatagtaaacg

SEQ ID NO: 8346 - DNA, 1026 bp, Artificial Sequence
  chemically treated genomic DNA (Homo sapiens) CpG-island No: 8346
  misc_feature (1003)..(1003): n is either a, c, g or t
cgtttactattattacgataccgaattttccgcccgccccgtataacgttacgccacaatccgaccccgatatttatcatcgtaaataaaactacgcacctatttaccactacgatcatacaccaccgccaattcgccgcgtaacgtccaaccataacgcaccaacgacgcgacaaataaattctccgaatattccgaatcgtacgtcaaccacacgacaaacaaacgaataccgttatcccgaccatattcgatataacccgacaaaatatcaaaaaaaacgaacgattccgtcccgccgaaaataacctactaccgaacttcttctacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaacaaaaaaattaaccgaataaccgaacgtcactccgccgaaacacaccgaacaaaccacgccgantaaaacaccaatacgtaccccga

SEQ ID NO: 8347 - DNA, 1026 bp, Artificial Sequence
  chemically treated genomic DNA (Homo sapiens) CpG-island No: 8347
  misc_feature (1003)..(1003): n is either a, c, g or t
cgtttgttgttgttacggtatcggatttttcgttcgtttcgtgtgacgttgcgttataattcggtttcggtatttattatcgtaagtaaagttgcgtatttgtttgttattacggttatatattatcgttagttcgtcgcgtggcgtttagttatagcgtattagcggcgcggtaggtaaatttttcgggtatttcgggtcgtgcgttagttatacggtagatagacggatgtcgttgtttcggttatattcggtgtaattcggtagggtattaggaaaagcggacggtttcgtttcgtcggaaatggtttgttgtcgggttttttttgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgggcgtttttgttcggtaattgttgtaggtgcgggagaggatgaacggtagcgggtcgggtagggcgatgtcggttttatcgggaaggatttttgtatcgagtagggggattgatcggatggtcggacgttatttcgtcggggtatatcgaataggttacgtcggntggggtattaatacgtatttcgg

SEQ ID NO: 8348 - DNA, 1026 bp, Artificial Sequence
  chemically treated genomic DNA (Homo sapiens) CpG-island No: 8348
  misc_feature (24)..(24): n is either a, c, g or t
ccgaaatacgtattaataccccanccgacgtaacctattcgatataccccgacgaaataacgtccgaccatccgatcaatccccctactcgatacaaaaatccttcccgataaaaccgacatcgccctacccgacccgctaccgttcatcctctcccgcacctacaacaattaccgaacaaaaacgcccgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacaaaaaaaacccgacaacaaaccatttccgacgaaacgaaaccgtccgcttttcctaataccctaccgaattacaccgaatataaccgaaacaacgacatccgtctatctaccgtataactaacgcacgacccgaaatacccgaaaaatttacctaccgcgccgctaatacgctataactaaacgccacgcgacgaactaacgataatatataaccgtaataacaaacaaatacgcaactttacttacgataataaataccgaaaccgaattataacgcaacgtcacacgaaacgaacgaaaaatccgataccgtaacaacaacaaacg

SEQ ID NO: 8349 - DNA, 1209 bp, Artificial Sequence
  chemically treated genomic DNA (Homo sapiens) CpG-island No: 8349
  misc_feature (925)..(925): n is either a, c, g or t
gtcggatgtgtggacgattttttgatttgttacgattattatttatatcgcgtcgggtaatatgtatggttagcgtgcgaaatttagcggaaacgttgcgtgtttatattatttttttacgttaggcgtgagtgaatatattattttgatcgtgcggcggattgtgacggtgtcggtttttagtggttgacgcgcgatgtaaaacgcggtgatatttttggttttcggacgcgatgggggaatttatttgcgacgataaagcgaagataaatttttgttgttggcggtaggttgcggcgttacgtcgattagtcgatgcgtcgttggtttgcgaagaatcgtttataggtcgatgtgcggtgatttataacgtgcgtacgtcgtaggatgttattttcgtcgatgagtgcgtaattattcggtaacgttggtggtagaaaataacgttatcgaaggtttatcgttggtcgttttattcgcgaattgttggtaggtgtatttgatttattttacgtatcgtgatgatttgcggttcggtttcgtatatggattgggtgagtaggaagtgaaagcgttcggcgtgacgcgtttttttaaagagaaatttttattttagtagtagaagcggcgattagcggtttgaaatttattaaatgtaatcggtacgagaattttacgtttcggttggtattacgttattggagcgttggaaagtaataacgtttcggttgtcgttgtttgtcgtgcgggtgttgcggttgttgtaagataaaagtggttttcggtgaatatacggtgagcgtataatgacgttgatcgacgtcgaaatcgttgaaggttacgtattggttgtttttgttattggatatacgtaggtttagtttttcgttttagtttgtcgttgagtttttcgacgtcgggattntcgttatcggtaaggttgtataaaggtcggattttgtcggcgtaattataaattggtcgttgggtttatttatgtcggaggcgttttggcgagaaattttattggtgttacgttcgtagacgtcgttagttgagttcgttgaagattgtttggcggattttttgggcgatgagggtcgtagatcgtggtaatggacgttatcggtgatatcgagataagttttatttagtataacggtttaatgcgcgaggtgtagcgcgagaagattttacggatatgtttga

SEQ ID NO: 8350 - DNA, 1209 bp, Artificial Sequence
  chemically treated genomic DNA (Homo sapiens) CpG-island No: 8350
  misc_feature (285)..(285): n is either a, c, g or t
tcaaacatatccgtaaaatcttctcgcgctacacctcgcgcattaaaccgttatactaaataaaacttatctcgatatcaccgataacgtccattaccacgatctacgaccctcatcgcccaaaaaatccgccaaacaatcttcaacgaactcaactaacgacgtctacgaacgtaacaccaataaaatttctcgccaaaacgcctccgacataaataaacccaacgaccaatttataattacgccgacaaaatccgacctttatacaaccttaccgataacganaatcccgacgtcgaaaaactcaacgacaaactaaaacgaaaaactaaacctacgtatatccaataacaaaaacaaccaatacgtaaccttcaacgatttcgacgtcgatcaacgtcattatacgctcaccgtatattcaccgaaaaccacttttatcttacaacaaccgcaacacccgcacgacaaacaacgacaaccgaaacgttattactttccaacgctccaataacgtaataccaaccgaaacgtaaaattctcgtaccgattacatttaataaatttcaaaccgctaatcgccgcttctactactaaaataaaaatttctctttaaaaaaacgcgtcacgccgaacgctttcacttcctactcacccaatccatatacgaaaccgaaccgcaaatcatcacgatacgtaaaataaatcaaatacacctaccaacaattcgcgaataaaacgaccaacgataaaccttcgataacgttattttctaccaccaacgttaccgaataattacgcactcatcgacgaaaataacatcctacgacgtacgcacgttataaatcaccgcacatcgacctataaacgattcttcgcaaaccaacgacgcatcgactaatcgacgtaacgccgcaacctaccgccaacaacaaaaatttatcttcgctttatcgtcgcaaataaattcccccatcgcgtccgaaaaccaaaaatatcaccgcgttttacatcgcgcgtcaaccactaaaaaccgacaccgtcacaatccgccgcacgatcaaaataatatattcactcacgcctaacgtaaaaaaataatataaacacgcaacgtttccgctaaatttcgcacgctaaccatacatattacccgacgcgatataaataataatcgtaacaaatcaaaaaatcgtccacacatccgac

SEQ ID NO: 8351 - DNA, 1209 bp, Artificial Sequence
  chemically treated genomic DNA (Homo sapiens) CpG-island No: 8351
  misc_feature (285)..(285): n is either a, c, g or t
ttaaatatattcgtgaaattttttcgcgttatatttcgcgtattgaatcgttgtattggatgaggtttatttcgatgttatcgatagcgtttattgttacggtttgcgatttttatcgtttaggaaattcgttagataatttttaacgagtttaattgacggcgtttgcgggcgtggtattagtaaagtttttcgttagaacgttttcgatatgaataagtttaacggttagtttgtgattacgtcggtaaagttcggtttttgtatagttttatcggtggcganaatttcggcgtcggaaagtttagcggtaaattggagcgaggggttgggtttgcgtgtgtttaatggtaggagtagttagtacgtaatttttagcgatttcggcgtcggttagcgttattgtgcgtttatcgtatatttatcggaaattatttttgttttatagtagtcgtaatattcgtacggtaggtagcgataatcggaacgttattgttttttagcgttttagtagcgtggtgttaatcggggcgtaaaattttcgtgtcggttgtatttggtgaattttagatcgttggtcgtcgtttttgttattggggtgaagatttttttttaaagaaacgcgttacgtcgagcgtttttattttttgtttatttaatttatatacggagtcgggtcgtaggttattacggtacgtgaagtaagttaggtatatttgttagtagttcgcgagtgagacgattagcgataagttttcggtaacgttattttttgttattagcgttatcggatagttacgtatttatcggcgaaaataatattttgcggcgtacgtacgttgtagattatcgtatatcggtttgtggacggtttttcgtaagttagcgacgtatcgattaatcggcgtgacgtcgtagtttgtcgttagtaataggaatttattttcgttttatcgtcgtaggtaaatttttttatcgcgttcgaaagttagagatattatcgcgttttatatcgcgcgttagttattgggagtcgatatcgttataattcgtcgtacggttagggtgatatatttatttacgtttggcgtggagaaatggtgtaagtacgtagcgttttcgttgagtttcgtacgttgattatgtatattgttcggcgcgatatgggtagtaatcgtggtaaattagggaatcgtttatatattcggt

SEQ ID NO: 8352 - DNA, 1209 bp, Artificial Sequence
  chemically treated genomic DNA (Homo sapiens) CpG-island No: 8352
  misc_feature (925)..(925): n is either a, c, g or t
accgaatatataaacgattccctaatttaccacgattactacccatatcgcgccgaacaatatacataatcaacgtacgaaactcaacgaaaacgctacgtacttacaccatttctccacgccaaacgtaaataaatatatcaccctaaccgtacgacgaattataacgatatcgactcccaataactaacgcgcgatataaaacgcgataatatctctaactttcgaacgcgataaaaaaatttacctacgacgataaaacgaaaataaattcctattactaacgacaaactacgacgtcacgccgattaatcgatacgtcgctaacttacgaaaaaccgtccacaaaccgatatacgataatctacaacgtacgtacgccgcaaaatattattttcgccgataaatacgtaactatccgataacgctaataacaaaaaataacgttaccgaaaacttatcgctaatcgtctcactcgcgaactactaacaaatatacctaacttacttcacgtaccgtaataacctacgacccgactccgtatataaattaaataaacaaaaaataaaaacgctcgacgtaacgcgtttctttaaaaaaaaatcttcaccccaataacaaaaacgacgaccaacgatctaaaattcaccaaatacaaccgacacgaaaattttacgccccgattaacaccacgctactaaaacgctaaaaaacaataacgttccgattatcgctacctaccgtacgaatattacgactactataaaacaaaaataatttccgataaatatacgataaacgcacaataacgctaaccgacgccgaaatcgctaaaaattacgtactaactactcctaccattaaacacacgcaaacccaacccctcgctccaatttaccgctaaactttccgacgccgaaattntcgccaccgataaaactatacaaaaaccgaactttaccgacgtaatcacaaactaaccgttaaacttattcatatcgaaaacgttctaacgaaaaactttactaataccacgcccgcaaacgccgtcaattaaactcgttaaaaattatctaacgaatttcctaaacgataaaaatcgcaaaccgtaacaataaacgctatcgataacatcgaaataaacctcatccaatacaacgattcaatacgcgaaatataacgcgaaaaaatttcacgaatatatttaa

SEQ ID NO: 8353 - DNA, 708 bp, Artificial Sequence
  chemically treated genomic DNA (Homo sapiens) CpG-island No: 8353
cgttggaatagagtgcgtaacggcgcgtattatcgttcgtgatagtggtgatggtaaagtatagacgttggcgcggtagagtatagttcgttgtatatttcggtagattcgttgtaaatatgagtcgtgaagagaagttggatattttgcgtcgcgtcgataaggttttcgcgaagcggataagcgcgtataggaagtgattgttagttttagtgggtttatgaattaattttggttgcggttatcgacggtacgttagcggcggtgttcgttcgttggtgcgttttttcgtgagcgttttcgtcgaagaagatgtaaacgcgaacgcggtgttagtggcggcggcggtcgttttggttatgatttttttttgtcgatttcgacggcgaagttcgtgcggatgtatgggtaaagaagtagtgcgtatggcgttggttaatttttttgtcgttgttgtattacgggtattatgtcggtagtatttggcgtaggttggtcgggcgtgttgtttatgaagcggttggttacggtttggaaggcgattttaatcgtcgtggtatttagtatttagtggataggtcggggagttggtggttttagaattgtgttcgtggttgatgatggtacgatggtcgatcggcgaagatcgggggggatgagagaaagtattttagtagtaaagtgttgatacggttaagtttttaggta

SEQ ID NO: 8354 - DNA, 708 bp, Artificial Sequence
  chemically treated genomic DNA (Homo sapiens) CpG-island No: 8354
tacctaaaaacttaaccgtatcaacactttactactaaaatactttctctcatcccccccgatcttcgccgatcgaccatcgtaccatcatcaaccacgaacacaattctaaaaccaccaactccccgacctatccactaaatactaaataccacgacgattaaaatcgccttccaaaccgtaaccaaccgcttcataaacaacacgcccgaccaacctacgccaaatactaccgacataatacccgtaatacaacaacgacaaaaaaattaaccaacgccatacgcactacttctttacccatacatccgcacgaacttcgccgtcgaaatcgacaaaaaaaaatcataaccaaaacgaccgccgccgccactaacaccgcgttcgcgtttacatcttcttcgacgaaaacgctcacgaaaaaacgcaccaacgaacgaacaccgccgctaacgtaccgtcgataaccgcaaccaaaattaattcataaacccactaaaactaacaatcacttcctatacgcgcttatccgcttcgcgaaaaccttatcgacgcgacgcaaaatatccaacttctcttcacgactcatatttacaacgaatctaccgaaatatacaacgaactatactctaccgcgccaacgtctatactttaccatcaccactatcacgaacgataatacgcgccgttacgcactctattccaacg

SEQ ID NO: 8355 - DNA, 708 bp, Artificial Sequence
  chemically treated genomic DNA (Homo sapiens) CpG-island No: 8355
tatttgaaaatttaatcgtattagtattttattgttggggtatttttttttatttttttcgattttcgtcgatcgattatcgtgttattattaattacggatatagttttgaagttattagtttttcgatttgtttattaaatattgaatgttacggcggttgaagtcgttttttagatcgtgattaatcgttttatgaatagtacgttcggttaatttgcgttaagtattatcggtatggtgttcgtggtgtagtaacggtagaaagattgattagcgttatacgtattgtttttttgtttatgtattcgtacggatttcgtcgtcgagatcggtaaggaagaattataattaaaacgatcgtcgtcgttattggtatcgcgttcgcgtttgtatttttttcgacgagaacgtttacggaaagacgtattagcggacggatatcgtcgttagcgtgtcgtcggtggtcgtaattaaaattaatttatagatttattgaggttggtagttattttttgtacgcgtttgttcgtttcgcgggaattttatcgacgcgacgtaggatatttagtttttttttacggtttatgtttgtagcggatttatcgaggtatataacgggttatgttttatcgcgttagcgtttgtattttattattattattattacggacgatggtgcgcgtcgttgcgtattttgttttagcg

SEQ ID NO: 8356 - DNA, 708 bp, Artificial Sequence
  chemically treated genomic DNA (Homo sapiens) CpG-island No: 8356
cgctaaaacaaaatacgcaacgacgcgcaccatcgtccgtaataataataataataaaatacaaacgctaacgcgataaaacataacccgttatatacctcgataaatccgctacaaacataaaccgtaaaaaaaaactaaatatcctacgtcgcgtcgataaaattcccgcgaaacgaacaaacgcgtacaaaaaataactaccaacctcaataaatctataaattaattttaattacgaccaccgacgacacgctaacgacgatatccgtccgctaatacgtctttccgtaaacgttctcgtcgaaaaaaatacaaacgcgaacgcgataccaataacgacgacgatcgttttaattataattcttccttaccgatctcgacgacgaaatccgtacgaatacataaacaaaaaaacaatacgtataacgctaatcaatctttctaccgttactacaccacgaacaccataccgataatacttaacgcaaattaaccgaacgtactattcataaaacgattaatcacgatctaaaaaacgacttcaaccgccgtaacattcaatatttaataaacaaatcgaaaaactaataacttcaaaactatatccgtaattaataataacacgataatcgatcgacgaaaatcgaaaaaaataaaaaaaaataccccaacaataaaatactaatacgattaaattttcaaata

SEQ ID NO: 8357 - DNA, 656 bp, Artificial Sequence
  chemically treated genomic DNA (Homo sapiens) CpG-island No: 8357
acgtttcgtttcgttttacggtgtagtatagatttcgcggagacgcgagtatggtcggaaattatcgtttttattttttggcgggtttcgaggaaggtcgggaacgggcgggttttgttggtttagagggcgttaggggcgttatcggcggttcgggatttttttcgtcgcgagcgcgggggagtttagttcggtttgtcgggggttgggtgaggttgcggattaggtttttacgttttcgcgttcgttcgcgtttgttttaggtttttatcgcggttttttttgtttcggggtcgttttgttttttatagattttattttcgggggtcgtttttagattttcgttcgtttttttttgattcggtttttgttcgtttcgttttttttttcgggttttttatttttttttcgtcggtttcgatttcgggggcgttcggatttgtttttcgaatatttttagtttcgtttttagtttgcggagaagggtcgaggagataggaggaagagagcgagagtttaggggacgaggaggagttatcgagacgcggagattcgacgacgtcgagggaggtataggtcgggaagcggtagtcgggggcggagcgggggatttgggcgggttttttttcgtttgtttttgtttttttcgtttattt

SEQ ID NO: 8358 - DNA, 656 bp, Artificial Sequence
  chemically treated genomic DNA (Homo sapiens) CpG-island No: 8358
aaataaacgaaaaaaacaaaaacaaacgaaaaaaaacccgcccaaatcccccgctccgcccccgactaccgcttcccgacctatacctccctcgacgtcgtcgaatctccgcgtctcgataactcctcctcgtcccctaaactctcgctctcttcctcctatctcctcgacccttctccgcaaactaaaaacgaaactaaaaatattcgaaaaacaaatccgaacgcccccgaaatcgaaaccgacgaaaaaaaaataaaaaacccgaaaaaaaaaacgaaacgaacaaaaaccgaatcaaaaaaaaacgaacgaaaatctaaaaacgacccccgaaaataaaatctataaaaaacaaaacgaccccgaaacaaaaaaaaccgcgataaaaacctaaaacaaacgcgaacgaacgcgaaaacgtaaaaacctaatccgcaacctcacccaacccccgacaaaccgaactaaactcccccgcgctcgcgacgaaaaaaatcccgaaccgccgataacgcccctaacgccctctaaaccaacaaaacccgcccgttcccgaccttcctcgaaacccgccaaaaaataaaaacgataatttccgaccatactcgcgtctccgcgaaatctatactacaccgtaaaacgaaacgaaacgt

SEQ ID NO: 8359 - DNA, 656 bp, Artificial Sequence
  chemically treated genomic DNA (Homo sapiens) CpG-island No: 8359
gagtgggcgaggagggtaggggtaggcggaggggaattcgtttaggtttttcgtttcgttttcgattgtcgtttttcggtttgtgtttttttcggcgtcgtcgggttttcgcgtttcggtggttttttttcgttttttggattttcgtttttttttttttgttttttcggttttttttcgtaggttgaaggcggagttggagatattcggggagtaggttcgagcgttttcgaggtcggggtcggcgagggagaggtagggagttcgaggagggaggcggggcgggtagggatcgagttaggagagagcgggcgggggtttgggagcggttttcgagagtggggtttgtggggagtagggcggtttcgggatagaggaagtcgcggtggaggtttagggtagacgcgggcggacgcgagagcgtaggaatttggttcgtagttttatttagttttcggtaggtcggattgagttttttcgcgttcgcgacgaggaggatttcgagtcgtcggtggcgtttttgacgttttttaggttagtaggattcgttcgttttcgatttttttcgagattcgttaagaaataaaggcgatgattttcgattatgttcgcgttttcgcggagtttgtgttatatcgtggagcggggcggggcgt

SEQ ID NO: 8360 - DNA, 656 bp, Artificial Sequence
  chemically treated genomic DNA (Homo sapiens) CpG-island No: 8360
acgccccgccccgctccacgatataacacaaactccgcgaaaacgcgaacataatcgaaaatcatcgcctttatttcttaacgaatctcgaaaaaaatcgaaaacgaacgaatcctactaacctaaaaaacgtcaaaaacgccaccgacgactcgaaatcctcctcgtcgcgaacgcgaaaaaactcaatccgacctaccgaaaactaaataaaactacgaaccaaattcctacgctctcgcgtccgcccgcgtctaccctaaacctccaccgcgacttcctctatcccgaaaccgccctactccccacaaaccccactctcgaaaaccgctcccaaacccccgcccgctctctcctaactcgatccctacccgccccgcctccctcctcgaactccctacctctccctcgccgaccccgacctcgaaaacgctcgaacctactccccgaatatctccaactccgccttcaacctacgaaaaaaaaccgaaaaaacaaaaaaaaaaaaacgaaaatccaaaaaacgaaaaaaaaccaccgaaacgcgaaaacccgacgacgccgaaaaaaacacaaaccgaaaaacgacaatcgaaaacgaaacgaaaaacctaaacgaattcccctccgcctacccctaccctcctcgcccactc

SEQ ID NO: 8361 - DNA, 720 bp, Artificial Sequence
  chemically treated genomic DNA (Homo sapiens) CpG-island No: 8361
  misc_feature (586)..(588): n is either a, c, g or t
  misc_feature (597)..(598): n is either a, c, g or t
  misc_feature (608)..(609): n is either a, c, g or t
  misc_feature (614)..(616): n is either a, c, g or t
  misc_feature (619)..(619): n is either a, c, g or t
  misc_feature (623)..(624): n is either a, c, g or t
  misc_feature (629)..(630): n is either a, c, g or t
  misc_feature (633)..(634): n is either a, c, g or t
  misc_feature (639)..(640): n is either a, c, g or t
  misc_feature (647)..(648): n is either a, c, g or t
  misc_feature (659)..(660): n is either a, c, g or t
gaaggcgcgaatttgttttttataggggacgtcgatttcgtttgcgtcgattatgtcgacgacggtcgtcgagcggcgttggattcgaagcgatagagggagtaggagattagtagtggtattattgtggtagtacgtcgtagaggattttttcgagtttgttggtatcggtgggcgaatgttttttatcgggtcgggtttaatcgtttttatcgtttcggacgtagtttggagagtacgtcggtggtgtggataaatagcgttagtacgtcgtacgttagcgaacgggtcgaggtcgacggcgattacgaatagtatggtaagattatttcgttaatggcgcggtaggcgtttattaggcggcgaacggttggtaaatttattacggtattaggttttcggcgtttattaggttaaagggatggagagaattatcgttagcgcggtgttttagacggcgatttgtaggtgacggttatttcggtgaggtaattttgttattggttgaaatcgggcggaagaagtcggcggcgaacgtcgttatgttgtcgtcgtttttgattagttaagcggggttattttcgtnnngttttgttnnacgacgacgnnattannntancggnncgagnntanntaatnnggtttanngtttagaagtnngagattagttgcgtttgggtggggcgatggtgatggtttgtatgtttggtttcgtttgta

SEQ ID NO: 8362 - DNA, 720 bp, Artificial Sequence
  chemically treated genomic DNA (Homo sapiens) CpG-island No: 8362
  misc_feature (61)..(62): n is either a, c, g or t
  misc_feature (73)..(74): n is either a, c, g or t
  misc_feature (81)..(82): n is either a, c, g or t
  misc_feature (87)..(88): n is either a, c, g or t
  misc_feature (91)..(92): n is either a, c, g or t
  misc_feature (97)..(98): n is either a, c, g or t
  misc_feature (102)..(102): n is either a, c, g or t
  misc_feature (105)..(107): n is either a, c, g or t
  misc_feature (112)..(113): n is either a, c, g or t
  misc_feature (123)..(124): n is either a, c, g or t
  misc_feature (133)..(135): n is either a, c, g or t
tacaaacgaaaccaaacatacaaaccatcaccatcgccccacccaaacgcaactaatctcnnacttctaaacnntaaaccnnattanntannctcgnnccgntannntaatnncgtcgtcgtnnaacaaaacnnnacgaaaataaccccgcttaactaatcaaaaacgacgacaacataacgacgttcgccgccgacttcttccgcccgatttcaaccaataacaaaattacctcaccgaaataaccgtcacctacaaatcgccgtctaaaacaccgcgctaacgataattctctccatccctttaacctaataaacgccgaaaacctaataccgtaataaatttaccaaccgttcgccgcctaataaacgcctaccgcgccattaacgaaataatcttaccatactattcgtaatcgccgtcgacctcgacccgttcgctaacgtacgacgtactaacgctatttatccacaccaccgacgtactctccaaactacgtccgaaacgataaaaacgattaaacccgacccgataaaaaacattcgcccaccgataccaacaaactcgaaaaaatcctctacgacgtactaccacaataataccactactaatctcctactccctctatcgcttcgaatccaacgccgctcgacgaccgtcgtcgacataatcgacgcaaacgaaatcgacgtcccctataaaaaacaaattcgcgccttc

SEQ ID NO: 8363 - DNA, 720 bp, Artificial Sequence
  chemically treated genomic DNA (Homo sapiens) CpG-island No: 8363
  misc_feature (61)..(62): n is either a, c, g or t
  misc_feature (73)..(74): n is either a, c, g or t
  misc_feature (81)..(82): n is either a, c, g or t
  misc_feature (87)..(88): n is either a, c, g or t
  misc_feature (91)..(92): n is either a, c, g or t
  misc_feature (97)..(98): n is either a, c, g or t
  misc_feature (102)..(102): n is either a, c, g or t
  misc_feature (105)..(107): n is either a, c, g or t
  misc_feature (112)..(113): n is either a, c, g or t
  misc_feature (123)..(124): n is either a, c, g or t
  misc_feature (133)..(135): n is either a, c, g or t
tatagacggagttaaatatgtaaattattattatcgttttatttaagcgtagttggttttnngtttttgagtnntgggttnngttgnntannttcgnntcgntgnnntggtnncgtcgtcgtnnggtagggtnnngcggaaatggtttcgtttagttgattaaagacggcggtaatatggcgacgttcgtcgtcgatttttttcgttcgattttagttagtggtaggattattttatcgaaatggtcgttatttgtaaatcgtcgtttggggtatcgcgttggcggtggttttttttatttttttggtttgatgagcgtcgaaaatttggtgtcgtggtgggtttattagtcgttcgtcgtttgatggacgtttgtcgcgttattaacgaaatggttttgttatgttgttcgtggtcgtcgtcggtttcggttcgttcgttggcgtgcggcgtgttggcgttgtttatttatattatcggcgtgttttttaagttgcgttcgaagcggtggaagcgattgagttcggttcggtggaaggtattcgtttatcggtgttaataagttcgaagagattttttacggcgtgttgttatagtgatgttattgttgattttttattttttttatcgtttcgaatttaacgtcgttcggcgatcgtcgtcggtatggtcggcgtaggcgggatcggcgttttttgtgggaagtagattcgcgttttt

SEQ ID NO: 8364 - DNA, 720 bp, Artificial Sequence
  chemically treated genomic DNA (Homo sapiens) CpG-island No: 8364
  misc_feature (586)..(588): n is either a, c, g or t
  misc_feature (597)..(598): n is either a, c, g or t
  misc_feature (608)..(609): n is either a, c, g or t
  misc_feature (614)..(616): n is either a, c, g or t
  misc_feature (619)..(619): n is either a, c, g or t
  misc_feature (623)..(624): n is either a, c, g or t
  misc_feature (629)..(630): n is either a, c, g or t
  misc_feature (633)..(634): n is either a, c, g or t
  misc_feature (639)..(640): n is either a, c, g or t
  misc_feature (647)..(648): n is either a, c, g or t
  misc_feature (659)..(660): n is either a, c, g or t
aaaaacgcgaatctacttcccacaaaaaacgccgatcccgcctacgccgaccataccgacgacgatcgccgaacgacgttaaattcgaaacgataaaaaaaataaaaaatcaacaataacatcactataacaacacgccgtaaaaaatctcttcgaacttattaacaccgataaacgaataccttccaccgaaccgaactcaatcgcttccaccgcttcgaacgcaacttaaaaaacacgccgataatataaataaacaacgccaacacgccgcacgccaacgaacgaaccgaaaccgacgacgaccacgaacaacataacaaaaccatttcgttaataacgcgacaaacgtccatcaaacgacgaacgactaataaacccaccacgacaccaaattttcgacgctcatcaaaccaaaaaaataaaaaaaaccaccgccaacgcgataccccaaacgacgatttacaaataacgaccatttcgataaaataatcctaccactaactaaaatcgaacgaaaaaaatcgacgacgaacgtcgccatattaccgccgtctttaatcaactaaacgaaaccatttccgcnnnaccctaccnnacgacgacgnnaccannncancganncgaanntanncaacnnaacccannactcaaaaacnnaaaaccaactacgcttaaataaaacgataataataatttacatatttaactccgtctata

SEQ ID NO: 8365 - DNA, 515 bp, Artificial Sequence
  chemically treated genomic DNA (Homo sapiens) CpG-island No: 8365
gttcgcggttttcgcgcgttcgcggtcgtgtttcgcggtttcggtttcggttttcggcgatacgtattttcgtatatttcgttcgtacgtcgattatcggcgtattacgcgcgttagcgcgtttttggacgtttgcggattttattgggggtttttgagcgtgtacggggcgtacgagcggttgcgcgtcgagttcgtgggtatttttttggtgcgcgatagtcgttagcggaattgttttttcgtttttagcgtgaagatggtttcgggatttacgagtattcgcgtgtatttttaggtcggtcgtttttatttggatgggtagtcgcgagagtttcgattgttttttcgagttgttggagtattacgtggcggggtcgcgtcgtatgttggggggttttcgtgtattagcgtcgcgtgcgggtcgtgtatgagttgtgtcgttagtttattttggttattcggggtttgaagattttggtgtgatacgattttagttttgatttacgattggt

SEQ ID NO: 8366 - DNA, 515 bp, Artificial Sequence
  chemically treated genomic DNA (Homo sapiens) CpG-island No: 8366
accaatcgtaaatcaaaactaaaatcgtatcacaccaaaatcttcaaaccccgaataaccaaaataaactaacgacacaactcatacacgacccgcacgcgacgctaatacacgaaaaccccccaacatacgacgcgaccccgccacgtaatactccaacaactcgaaaaaacaatcgaaactctcgcgactacccatccaaataaaaacgaccgacctaaaaatacacgcgaatactcgtaaatcccgaaaccatcttcacgctaaaaacgaaaaaacaattccgctaacgactatcgcgcaccaaaaaaatacccacgaactcgacgcgcaaccgctcgtacgccccgtacacgctcaaaaacccccaataaaatccgcaaacgtccaaaaacgcgctaacgcgcgtaatacgccgataatcgacgtacgaacgaaatatacgaaaatacgtatcgccgaaaaccgaaaccgaaaccgcgaaacacgaccgcgaacgcgcgaaaaccgcgaac

SEQ ID NO: 8367 - DNA, 515 bp, Artificial Sequence
  chemically treated genomic DNA (Homo sapiens) CpG-island No: 8367
attaatcgtgggttagagttagagtcgtattatattaggatttttaggtttcgggtggttaagatgggttggcggtatagtttatgtacggttcgtacgcggcgttggtgtacgggggttttttagtatgcggcgcggtttcgttacgtagtgttttagtagttcgaagaggtagtcgaagttttcgcggttgtttatttaggtgaaagcggtcggtttgaaagtgtacgcggatgttcgtgggtttcgaggttatttttacgttaagggcgaaaaagtagtttcgttggcggttgtcgcgtattaggaaggtgtttacgggttcggcgcgtagtcgttcgtgcgtttcgtgtacgtttaggggtttttagtagaattcgtaggcgtttaggagcgcgttggcgcgcgtgatgcgtcggtaatcggcgtgcgaacggaatgtgcggaagtgcgtgtcgtcgggggtcggggtcgggatcgcggggtacggtcgcgggcgcgcgggggtcgcgggt

SEQ ID NO: 8368 - DNA, 515 bp, Artificial Sequence
  chemically treated genomic DNA (Homo sapiens) CpG-island No: 8368
acccgcgacccccgcgcgcccgcgaccgtaccccgcgatcccgaccccgacccccgacgacacgcacttccgcacattccgttcgcacgccgattaccgacgcatcacgcgcgccaacgcgctcctaaacgcctacgaattctactaaaaacccctaaacgtacacgaaacgcacgaacgactacgcgccgaacccgtaaacaccttcctaatacgcgacaaccgccaacgaaactactttttcgcccttaacgtaaaaataacctcgaaacccacgaacatccgcgtacactttcaaaccgaccgctttcacctaaataaacaaccgcgaaaacttcgactacctcttcgaactactaaaacactacgtaacgaaaccgcgccgcatactaaaaaacccccgtacaccaacgccgcgtacgaaccgtacataaactataccgccaacccatcttaaccacccgaaacctaaaaatcctaatataatacgactctaactctaacccacgattaat

SEQ ID NO: 8369 - DNA, 767 bp, Artificial Sequence
  chemically treated genomic DNA (Homo sapiens) CpG-island No: 8369
taacgtatgtttagttttgtcgttcgatcgagttttggtttttcgtgcgtattttttcgtagttatttcgcgatataattatacgtagtggtttcgtatggtttaatatttttgttatttgttatcgttcgtaatgttcgcgtcgcgattttcgtcgggtaaggtgggggagagtatagggttaggggttttcgggtcggtttaattttgcgggcgcggtttttttttttatttcgttgttttgtttttttttcgggttttttcgcgagttttcgtaggattttttcggttatgcgtttcgtttaatttttggttttcggtatttcgcgcgttcgcggtacgggttttacgcgttttgtcgattttacgagttgtttatcgttttaacgttatagcgttcgtttcgtttattcggggttttagtttcgattatcgatcggtttcggggggttttaatcgttatcgtatcgggatattattggcgattacgaataacggtcgatgttttttagggttttaggaaaattcgttaatttttcgggttagtcgtcggttatcggcgattcgttttttttatttcgttacgtttttttcgagaatcgaggttatttcgatatattttgcgatcgacgtatcggtttcgatcggcgggttataagagcgcgattacggatattttttaacggaatattttcgcggcggatttttcgtttacgaaagcgttttttatcggcgcgttttttttcgggaggcggtacgcgagtcgt

SEQ ID NO: 8370 - DNA, 767 bp, Artificial Sequence
  chemically treated genomic DNA (Homo sapiens) CpG-island No: 8370
acgactcgcgtaccgcctcccgaaaaaaaacgcgccgataaaaaacgctttcgtaaacgaaaaatccgccgcgaaaatattccgttaaaaaatatccgtaatcgcgctcttataacccgccgatcgaaaccgatacgtcgatcgcaaaatatatcgaaataacctcgattctcgaaaaaaacgtaacgaaataaaaaaaacgaatcgccgataaccgacgactaacccgaaaaattaacgaattttcctaaaaccctaaaaaacatcgaccgttattcgtaatcgccaataatatcccgatacgataacgattaaaaccccccgaaaccgatcgataatcgaaactaaaaccccgaataaacgaaacgaacgctataacgttaaaacgataaacaactcgtaaaatcgacaaaacgcgtaaaacccgtaccgcgaacgcgcgaaataccgaaaaccaaaaattaaacgaaacgcataaccgaaaaaatcctacgaaaactcgcgaaaaaacccgaaaaaaaaacaaaacaacgaaataaaaaaaaaaaccgcgcccgcaaaattaaaccgacccgaaaacccctaaccctatactctcccccaccttacccgacgaaaatcgcgacgcgaacattacgaacgataacaaataacaaaaatattaaaccatacgaaaccactacgtataattatatcgcgaaataactacgaaaaaatacgcacgaaaaaccaaaactcgatcgaacgacaaaactaaacatacgtta

SEQ ID NO: 8371 - DNA, 767 bp, Artificial Sequence
  chemically treated genomic DNA (Homo sapiens) CpG-island No: 8371
gcggttcgcgtgtcgtttttcgggggggggcgcgtcggtgggggacgttttcgtgggcggggaattcgtcgcgggggtgtttcgttgaggggtgttcgtgatcgcgtttttgtggttcgtcggtcggggtcggtgcgtcggtcgtagggtgtgtcgaggtggtttcggttttcggggggggcgtgacggggtgggggggacgggtcgtcgatggtcggcggttggttcgggggattggcgggtttttttggggttttgaggggtatcggtcgttgttcgtagtcgttaatggtgtttcggtgcggtgacgattagggtttttcgggatcgatcggtgatcgggattgaagtttcgggtaggcgaagcgggcgttgtggcgttggagcggtgagtagttcgtgaggtcggtagggcgcgtagggttcgtgtcgcgggcgcgcgagatgtcggaagttagggattgggcggggcgtatggtcgggaaggttttacgagggttcgcggaagggttcgggaaggaagtaaggtagcggggtgaaaggaaggatcgcgttcgtaaagttgagtcggttcggaggtttttggttttatatttttttttattttgttcgacggagatcgcggcgcggatattgcgagcggtgataggtggtaaaggtgttgagttatgcggagttattgcgtgtgattgtgtcgcgggatggttgcgagaggatacgtacggggagttagggttcgatcgagcgatagagttggatatacgttg

SEQ ID NO: 8372 - DNA, 767 bp, Artificial Sequence
  chemically treated genomic DNA (Homo sapiens) CpG-island No: 8372
caacgtatatccaactctatcgctcgatcgaaccctaactccccgtacgtatcctctcgcaaccatcccgcgacacaatcacacgcaataactccgcataactcaacacctttaccacctatcaccgctcgcaatatccgcgccgcgatctccgtcgaacaaaataaaaaaaaatataaaaccaaaaacctccgaaccgactcaactttacgaacgcgatccttcctttcaccccgctaccttacttccttcccgaacccttccgcgaaccctcgtaaaaccttcccgaccatacgccccgcccaatccctaacttccgacatctcgcgcgcccgcgacacgaaccctacgcgccctaccgacctcacgaactactcaccgctccaacgccacaacgcccgcttcgcctacccgaaacttcaatcccgatcaccgatcgatcccgaaaaaccctaatcgtcaccgcaccgaaacaccattaacgactacgaacaacgaccgatacccctcaaaaccccaaaaaaacccgccaatcccccgaaccaaccgccgaccatcgacgacccgtcccccccaccccgtcacgccccccccgaaaaccgaaaccacctcgacacaccctacgaccgacgcaccgaccccgaccgacgaaccacaaaaacgcgatcacgaacacccctcaacgaaacacccccgcgacgaattccccgcccacgaaaacgtcccccaccgacgcgcccccccccgaaaaacgacacgcgaaccgc

SEQ ID NO: 8373 - DNA, 811 bp, Artificial Sequence
  chemically treated genomic DNA (Homo sapiens) CpG-island No: 8373
  misc_feature (5)..(5): n is either a, c, g or t
  misc_feature (14)..(14): n is either a, c, g or t
  misc_feature (17)..(17): n is either a, c, g or t
  misc_feature (30)..(30): n is either a, c, g or t
ttcgncgttttatnttntcgaattaagtgnacgataggagtagttggatattacggttttttatagatcgtgaaacgttttagttaagttttaagttttaggtgatttagggattttcgcgtatcggatcgttggtttggttgcgtatttgttaagaggtttttgtgaaaagtgtaagataagtttttcgttgcgggtcgcgataataggcgtaggttaggtggcgataaggtttatgtttcgtattattgtattcgtaacgatttggaattggtgttgtttgtgatagtcgttttttttaggcgtaggcgttggtagaaaaatcgggaatgtattcgtgtgggacgattcgtaggttatgttgttggcggtgaatttgatgtggttagcgtttgtttatttaatcgtttttattacgaataattttgatggtattggaagcgggttgttatgtgatgtgcgaaaaatcgtcgttatgacgttagaataggcgcgggaaatgtgcgatatcgcgcgtaaatgggtaaggtgttggtttacgatttttattatcgttttgcgttcgatattaatagttgcgtgaataggtgattaacggcgttttgggagagatttacgtattatcgttcgcgttttgcgtcgttgcggcgttttcggttggggtgttttattaataaagaattgtagggtggtggttcgttgatcgatatcggtattatatgttggatgttgcgatgtatgtgttgggtttttcggcggtgaaaacgtgaatgcgtatagtttttaaaagatcggtacgtaaaagagttgt

SEQ ID NO: 8374 - DNA, 811 bp, Artificial Sequence
  chemically treated genomic DNA (Homo sapiens) CpG-island No: 8374
  misc_feature (782)..(782): n is either a, c, g or t
  misc_feature (795)..(795): n is either a, c, g or t
  misc_feature (798)..(798): n is either a, c, g or t
  misc_feature (807)..(807): n is either a, c, g or t
acaactcttttacgtaccgatcttttaaaaactatacgcattcacgttttcaccgccgaaaaacccaacacatacatcgcaacatccaacatataataccgatatcgatcaacgaaccaccaccctacaattctttattaataaaacaccccaaccgaaaacgccgcaacgacgcaaaacgcgaacgataatacgtaaatctctcccaaaacgccgttaatcacctattcacgcaactattaatatcgaacgcaaaacgataataaaaatcgtaaaccaacaccttacccatttacgcgcgatatcgcacatttcccgcgcctattctaacgtcataacgacgatttttcgcacatcacataacaacccgcttccaataccatcaaaattattcgtaataaaaacgattaaataaacaaacgctaaccacatcaaattcaccgccaacaacataacctacgaatcgtcccacacgaatacattcccgatttttctaccaacgcctacgcctaaaaaaaacgactatcacaaacaacaccaattccaaatcgttacgaatacaataatacgaaacataaaccttatcgccacctaacctacgcctattatcgcgacccgcaacgaaaaacttatcttacacttttcacaaaaacctcttaacaaatacgcaaccaaaccaacgatccgatacgcgaaaatccctaaatcacctaaaacttaaaacttaactaaaacgtttcacgatctataaaaaaccgtaatatccaactactcctatcgtncacttaattcganaanataaaacgncgaa

SEQ ID NO: 8375 - DNA, 811 bp, Artificial Sequence
  chemically treated genomic DNA (Homo sapiens) CpG-island No: 8375
  misc_feature (782)..(782): n is either a, c, g or t
  misc_feature (795)..(795): n is either a, c, g or t
  misc_feature (798)..(798): n is either a, c, g or t
  misc_feature (807)..(807): n is either a, c, g or t
atagtttttttgcgtgtcgattttttgaaagttatgcgtatttacgtttttatcgtcggaaagtttagtatatatatcgtagtatttagtatatgatgtcgatgtcgattagcgggttattattttgtagttttttattggtaagatattttagtcgggaacgtcgtagcgacgtagggcgcgggcggtggtacgtaaattttttttaaaacgtcgttggttatttgtttacgtagttgttggtatcgagcgtaaaacgatggtgaaagtcgtaggttagtattttgtttatttgcgcgcggtatcgtatatttttcgcgtttgttttggcgttatggcggcggtttttcgtatattatatggtagttcgtttttagtgttattagggttgttcgtaatgaaaacggttaggtgagtagacgttaattatattaggtttatcgttagtagtatggtttgcggatcgttttatacggatgtattttcgatttttttgttagcgtttgcgtttgggaaaggcggttgttatagatagtattagttttagatcgttgcgggtgtagtagtacgaagtatgaattttatcgttatttggtttgcgtttattatcgcgattcgtagcggagagtttgttttgtattttttataaagattttttagtaggtacgtaattaggttaacgattcggtacgcggggatttttgagttatttggggtttgaagtttggttggggcgttttacggtttgtggggaatcgtggtgtttagttatttttgtcgtntatttagttcggnaangtaaggcgncgag

SEQ ID NO: 8376 - DNA, 811 bp, Artificial Sequence
  chemically treated genomic DNA (Homo sapiens) CpG-island No: 8376
  misc_feature (5)..(5): n is either a, c, g or t
  misc_feature (14)..(14): n is either a, c, g or t
  misc_feature (17)..(17): n is either a, c, g or t
  misc_feature (30)..(30): n is either a, c, g or t
ctcgncgccttacnttnccgaactaaatanacgacaaaaataactaaacaccacgattccccacaaaccgtaaaacgccccaaccaaacttcaaaccccaaataactcaaaaatccccgcgtaccgaatcgttaacctaattacgtacctactaaaaaatctttataaaaaatacaaaacaaactctccgctacgaatcgcgataataaacgcaaaccaaataacgataaaattcatacttcgtactactacacccgcaacgatctaaaactaatactatctataacaaccgcctttcccaaacgcaaacgctaacaaaaaaatcgaaaatacatccgtataaaacgatccgcaaaccatactactaacgataaacctaatataattaacgtctactcacctaaccgttttcattacgaacaaccctaataacactaaaaacgaactaccatataatatacgaaaaaccgccgccataacgccaaaacaaacgcgaaaaatatacgataccgcgcgcaaataaacaaaatactaacctacgactttcaccatcgttttacgctcgataccaacaactacgtaaacaaataaccaacgacgttttaaaaaaaatttacgtaccaccgcccgcgccctacgtcgctacgacgttcccgactaaaatatcttaccaataaaaaactacaaaataataacccgctaatcgacatcgacatcatatactaaatactacgatatatatactaaactttccgacgataaaaacgtaaatacgcataactttcaaaaaatcgacacgcaaaaaaactat

SEQ ID NO: 8377 - DNA, 605 bp, Artificial Sequence
  chemically treated genomic DNA (Homo sapiens) CpG-island No: 8377
aattagttttcggtcgggtaataacgcgcgtcgttttagcgcgtttgtggttgattcgtgttacgatatatggatttcgacgagttttttatcgcgattgacgttaacggtgtcgatcgtttgattagcgtatggcgtagtatacggagtagggggggattgtgattttgattattattagtcgtttaacgttgttgaaagtaaaattcgtcgtattttattgcgtaaacgagggtcgtatgatgttttggcgtatttttcgttttgagttggtgtagcgtttcgttatagcgtcgaaatcgttaattcgttgtggtttttttgattgtaattatttttttttcgtttagtatcggttcggagtcgtaacgttggcgcgtattgtatcgggtattatttgggttgttgcgttgtttttattttgttggcgttggaacgattgtttcgtgacgatttgtaggacggtagtttgaataattgatgttgttgtcgttatttttgttcgtcgttgtgttgggaaggtgatggcgtattggatggtaatcggtttgtcgttatttatttttcgttattggtagtaatgttattgggaatggatgtttatg

SEQ ID NO: 8378 - DNA, 605 bp, Artificial Sequence
  chemically treated genomic DNA (Homo sapiens) CpG-island No: 8378
cataaacatccattcccaataacattactaccaataacgaaaaataaataacgacaaaccgattaccatccaatacgccatcaccttcccaacacaacgacgaacaaaaataacgacaacaacatcaattattcaaactaccgtcctacaaatcgtcacgaaacaatcgttccaacgccaacaaaataaaaacaacgcaacaacccaaataatacccgatacaatacgcgccaacgttacgactccgaaccgatactaaacgaaaaaaaaataattacaatcaaaaaaaccacaacgaattaacgatttcgacgctataacgaaacgctacaccaactcaaaacgaaaaatacgccaaaacatcatacgaccctcgtttacgcaataaaatacgacgaattttactttcaacaacgttaaacgactaataataatcaaaatcacaatccccccctactccgtatactacgccatacgctaatcaaacgatcgacaccgttaacgtcaatcgcgataaaaaactcgtcgaaatccatatatcgtaacacgaatcaaccacaaacgcgctaaaacgacgcgcgttattacccgaccgaaaactaatt

SEQ ID NO: 8379 - DNA, 605 bp, Artificial Sequence
  chemically treated genomic DNA (Homo sapiens) CpG-island No: 8379
tataaatatttatttttagtagtattgttattagtggcgaaggatgagtaacggtagatcggttattatttagtgcgttattatttttttagtataacggcgggtaagggtaacggtaataatattaattgtttaagttgtcgttttgtaaatcgttacggaatagtcgttttagcgttagtaaggtgaaagtagcgtagtaatttagataatgttcggtgtaatacgcgttagcgttgcggtttcggatcgatattgagcggaaaaagggtaattataattagaagaattatagcgggttggcgatttcggcgttatggcgaaacgttatattagtttaagacggaaaatgcgttagaatattatgcggttttcgtttgcgtagtgaaatgcggcgaattttatttttagtaacgttgagcggttggtggtagttagaattataatttttttttgtttcgtatgttgcgttatacgttggttagacgatcgatatcgttaacgttaatcgcggtaaaaggttcgtcgagatttatatatcgtggtacgggttagttatagacgcgttaaagcgacgcgcgttgttgttcggtcgagagttgatt

SEQ ID NO: 8380 - DNA, 605 bp, Artificial Sequence
  chemically treated genomic DNA (Homo sapiens) CpG-island No: 8380
aatcaactctcgaccgaacaacaacgcgcgtcgctttaacgcgtctataactaacccgtaccacgatatataaatctcgacgaaccttttaccgcgattaacgttaacgatatcgatcgtctaaccaacgtataacgcaacatacgaaacaaaaaaaaattataattctaactaccaccaaccgctcaacgttactaaaaataaaattcgccgcatttcactacgcaaacgaaaaccgcataatattctaacgcattttccgtcttaaactaatataacgtttcgccataacgccgaaatcgccaacccgctataattcttctaattataattaccctttttccgctcaatatcgatccgaaaccgcaacgctaacgcgtattacaccgaacattatctaaattactacgctactttcaccttactaacgctaaaacgactattccgtaacgatttacaaaacgacaacttaaacaattaatattattaccgttacccttacccgccgttatactaaaaaaataataacgcactaaataataaccgatctaccgttactcatccttcgccactaataacaatactactaaaaataaatatttata

SEQ ID NO: 8381 - DNA, 506 bp, Artificial Sequence
  chemically treated genomic DNA (Homo sapiens) CpG-island No: 8381
agtcgggcgtttttataatcgattagtaattggcgtcgattttaaataaaacgttacggcgtggataataggggtacgtattgcgtttttcgttgtatttatgatttataggatttgttgtaaattggttttcgtttttattgatgtcgttatgtcgtaatggcgttgtttacgttgacgattcgggtttatatatagaacggggtgtgggggaagtaattttgattatttgtatttatatgatttgcgagtatgtcgtttacgtttggtcggtagtaacgttattcgttatcgttaattgtacgtttggcgaatatttgaattgtattttaatttaggtgcgtacgcgtattgttatgggggggggggggggcggcggggcgggagggttatacgacgattaattgacgtattcggagagtagggggtggacggaatagtgtaaatggatttacggaatatattatatacggaagaataaggaggtttataaaggggttataggt

SEQ ID NO: 8382 - DNA, 506 bp, Artificial Sequence
  chemically treated genomic DNA (Homo sapiens) CpG-island No: 8382
acctataacccctttataaacctccttattcttccgtatataatatattccgtaaatccatttacactattccgtccaccccctactctccgaatacgtcaattaatcgtcgtataaccctcccgccccgccgcccccccccccccccataacaatacgcgtacgcacctaaattaaaatacaattcaaatattcgccaaacgtacaattaacgataacgaataacgttactaccgaccaaacgtaaacgacatactcgcaaatcatataaatacaaataatcaaaattacttcccccacaccccgttctatatataaacccgaatcgtcaacgtaaacaacgccattacgacataacgacatcaataaaaacgaaaaccaatttacaacaaatcctataaatcataaatacaacgaaaaacgcaatacgtacccctattatccacgccgtaacgttttatttaaaatcgacgccaattactaatcgattataaaaacgcccgact

SEQ ID NO: 8383 - DNA, 506 bp, Artificial Sequence
  chemically treated genomic DNA (Homo sapiens) CpG-island No: 8383
gtttataatttttttgtaggtttttttattttttcgtgtgtggtgtgtttcgtgggtttatttatattgtttcgtttattttttatttttcgggtacgttagttggtcgtcgtgtaattttttcgtttcgtcgtttttttttttttttataataatacgcgtgcgtatttgggttagaatatagtttaagtgttcgttaaacgtgtagttggcggtggcgggtaacgttattatcggttaggcgtaggcggtatattcgtagattatgtaagtgtaggtggttagggttgttttttttatatttcgttttatatgtaaattcgggtcgttaacgtaagtaacgttattgcggtatggcgatattagtgggagcgaaggttagtttatagtaaattttgtaagttataggtgtagcgggaagcgtagtacgtatttttattgtttacgtcgtggcgttttatttggggtcggcgttaattattagtcggttgtgggggcgttcggtt

SEQ ID NO: 8384 - DNA, 506 bp, Artificial Sequence
  chemically treated genomic DNA (Homo sapiens) CpG-island No: 8384
aaccgaacgcccccacaaccgactaataattaacgccgaccccaaataaaacgccacgacgtaaacaataaaaatacgtactacgcttcccgctacacctataacttacaaaatttactataaactaaccttcgctcccactaatatcgccataccgcaataacgttacttacgttaacgacccgaatttacatataaaacgaaatataaaaaaaacaaccctaaccacctacacttacataatctacgaatataccgcctacgcctaaccgataataacgttacccgccaccgccaactacacgtttaacgaacacttaaactatattctaacccaaatacgcacgcgtattattataaaaaaaaaaaaaaacgacgaaacgaaaaaattacacgacgaccaactaacgtacccgaaaaataaaaaataaacgaaacaatataaataaacccacgaaacacaccacacacgaaaaaataaaaaaacctacaaaaaaattataaac

SEQ ID NO: 8385 - DNA, 595 bp, Artificial Sequence
  chemically treated genomic DNA (Homo sapiens) CpG-island No: 8385
gcgacggtcgaggatcgggggcggggatattagagattgtgtggacggtagacgacgaataacgggggcggcggggattatatgagacgcgtagtgagcgacggtatggtattgaagattgggtacgggaggtttgtatgagcggtcgtgggagatagacggattgtgtgaatgggtagatagggttgtatggcgatgtgcggtgcgggtacgcggcgattaattaggcgatgcgtttaattttcggcgcggagtataaaggatttagagggtaaaagtagaattggcgacggcgttattacgcgaaatatgtgtggtggatacgtatcgtaaggattagtaaagtattggtaagagggattaaggcggttagtttgtgcgttattgtgttatagttttgttaataattttcgtacgcgtgtcgtcgatgtaacgttgtgtcgtaagcgtttgttaatcgtggtgtgtacgggttaataaatatgggggggggggggggggggggggggcgaaggcgtgtagggaaagggtatgataaaaaaaaaaaaaaaagtagaaaggggggtaacgggagaaaggggggataatttgtagt

SEQ ID NO: 8386 - DNA, 595 bp, Artificial Sequence
  chemically treated genomic DNA (Homo sapiens) CpG-island No: 8386
actacaaattatcccccctttctcccgttacccccctttctacttttttttttttttttatcataccctttccctacacgccttcgcccccccccccccccccccccccccatatttattaacccgtacacaccacgattaacaaacgcttacgacacaacgttacatcgacgacacgcgtacgaaaattattaacaaaactataacacaataacgcacaaactaaccgccttaatccctcttaccaatactttactaatccttacgatacgtatccaccacacatatttcgcgtaataacgccgtcgccaattctacttttaccctctaaatcctttatactccgcgccgaaaattaaacgcatcgcctaattaatcgccgcgtacccgcaccgcacatcgccatacaaccctatctacccattcacacaatccgtctatctcccacgaccgctcatacaaacctcccgtacccaatcttcaataccataccgtcgctcactacgcgtctcatataatccccgccgcccccgttattcgtcgtctaccgtccacacaatctctaatatccccgcccccgatcctcgaccgtcgc

SEQ ID NO: 8387 - DNA, 595 bp, Artificial Sequence
  chemically treated genomic DNA (Homo sapiens) CpG-island No: 8387
attataaattattttttttttttttcgttgtttttttttttatttttttttttttttttgttatgttttttttttgtacgttttcgtttttttttttttttttttttttttatatttgttaattcgtgtatattacggttagtaagcgtttgcggtatagcgttatatcggcggtacgcgtacgggggttattagtaaggttgtaatataatggcgtataggttagtcgttttggttttttttattagtattttattagtttttacggtgcgtgtttattatatatgtttcgcgtaatggcgtcgtcgttagttttatttttgttttttgggttttttgtgtttcgcgtcgggggttgggcgtatcgtttagttggtcgtcgcgtgttcgtatcgtatatcgttatgtagttttatttgtttatttatataattcgtttgttttttacggtcgtttatgtaagtttttcgtgtttagtttttagtgttatatcgtcgtttattacgcgttttatgtaattttcgtcgttttcgttattcgtcgtttatcgtttatataatttttggtgttttcgttttcggttttcggtcgtcgt

SEQ ID NO: 8388 - DNA, 595 bp, Artificial Sequence
  chemically treated genomic DNA (Homo sapiens) CpG-island No: 8388
acgacgaccgaaaaccgaaaacgaaaacaccaaaaattatataaacgataaacgacgaataacgaaaacgacgaaaattacataaaacgcgtaataaacgacgatataacactaaaaactaaacacgaaaaacttacataaacgaccgtaaaaaacaaacgaattatataaataaacaaataaaactacataacgatatacgatacgaacacgcgacgaccaactaaacgatacgcccaacccccgacgcgaaacacaaaaaacccaaaaaacaaaaataaaactaacgacgacgccattacgcgaaacatatataataaacacgcaccgtaaaaactaataaaatactaataaaaaaaaccaaaacgactaacctatacgccattatattacaaccttactaataacccccgtacgcgtaccgccgatataacgctataccgcaaacgcttactaaccgtaatatacacgaattaacaaatataaaaaaaaaaaaaaaaaaaaaaaaacgaaaacgtacaaaaaaaaaacataacaaaaaaaaaaaaaaaaataaaaaaaaaaacaacgaaaaaaaaaaaaaataatttataat

SEQ ID NO: 8389 - DNA, 500 bp, Artificial Sequence
  chemically treated genomic DNA (Homo sapiens) CpG-island No: 8389
tcggttaacggttattgtcgttatacgaatattggtattgtatagtttagttacgtgcgttcgcgatatatatatatatatatatatatatatatatatacgcgcgcgcgcgcgtcgcgttcgcgggttcgcgcgttcgcgagttcgcgcgtttttcgcgcgcgtcgcgcgcgcgcgggtcgtcggcgggcgcgcgggtgcgcgcgcgcgtgttgcgtgcgggcgtagttgacgtaagagatttgatatttagtttttggagggatgacgtattaaggcgttcgtcggcggttcggttatgcgtacgatttagatacggtcgtgacggtgttataattatttaaacgtcgatcgcgggtcgttgacgttttgtcggatatttattttaaagcggttagcggggtttggcgggatttaaaaattttggcgttaattgtcgtacggttagttttatttcggttaacgaaaagtttacgtgtgataatcgaatatgttaagtg

SEQ ID NO: 8390 - DNA, 500 bp, Artificial Sequence
  chemically treated genomic DNA (Homo sapiens) CpG-island No: 8390
cacttaacatattcgattatcacacgtaaacttttcgttaaccgaaataaaactaaccgtacgacaattaacgccaaaatttttaaatcccgccaaaccccgctaaccgctttaaaataaatatccgacaaaacgtcaacgacccgcgatcgacgtttaaataattataacaccgtcacgaccgtatctaaatcgtacgcataaccgaaccgccgacgaacgccttaatacgtcatccctccaaaaactaaatatcaaatctcttacgtcaactacgcccgcacgcaacacgcgcgcgcgcacccgcgcgcccgccgacgacccgcgcgcgcgcgacgcgcgcgaaaaacgcgcgaactcgcgaacgcgcgaacccgcgaacgcgacgcgcgcgcgcgcgtatatatatatatatatatatatatatatatatatcgcgaacgcacgtaactaaactatacaataccaatattcgtataacgacaataaccgttaaccga

SEQ ID NO: 8391 - DNA, 500 bp, Artificial Sequence
  chemically treated genomic DNA (Homo sapiens) CpG-island No: 8391
tatttagtatattcggttgttatacgtaaatttttcgttaatcggagtaaagttggtcgtgcggtaattagcgttaaaatttttgggtttcgttaggtttcgttagtcgttttaaggtgagtgttcggtaaggcgttaacggttcgcggtcggcgtttaggtagttgtagtatcgttacggtcgtgtttgggtcgtgcgtatggtcgagtcgtcggcgggcgttttgatgcgttatttttttaaaggttaggtattaggttttttgcgttagttacgttcgtacgtagtacgcgcgcgcgtattcgcgcgttcgtcggcggttcgcgcgcgcgcggcgcgcgcggggggcgcgcgggttcgcgggcgcgcgggttcgcgggcgcggcgcgcgcgcgcgcgtgtgtgtgtgtgtgtgtgtgtgtgtgtgtgtgtatcgcgggcgtacgtggttaagttatatagtattagtgttcgtgtagcggtagtagtcgttggtcgg

SEQ ID NO: 8392 - DNA, 500 bp, Artificial Sequence
  chemically treated genomic DNA (Homo sapiens) CpG-island No: 8392
ccgaccaacgactactaccgctacacgaacactaatactatataacttaaccacgtacgcccgcgatacacacacacacacacacacacacacacacacacgcgcgcgcgcgcgccgcgcccgcgaacccgcgcgcccgcgaacccgcgcgccccccgcgcgcgccgcgcgcgcgcgaaccgccgacgaacgcgcgaatacgcgcgcgcgtactacgtacgaacgtaactaacgcaaaaaacctaatacctaacctttaaaaaaataacgcatcaaaacgcccgccgacgactcgaccatacgcacgacccaaacacgaccgtaacgatactacaactacctaaacgccgaccgcgaaccgttaacgccttaccgaacactcaccttaaaacgactaacgaaacctaacgaaacccaaaaattttaacgctaattaccgcacgaccaactttactccgattaacgaaaaatttacgtataacaaccgaatatactaaata

SEQ ID NO: 8393 - DNA, 745 bp, Artificial Sequence
  chemically treated genomic DNA (Homo sapiens) CpG-island No: 8393
gaggattttcgatttgcggttttgtttatagtatcgtttatattacgtcggtggaaaacgcgatgggtatttaggtgttagaacgtgcgtagatgattcgcgttattttgttggaggtagaacgtttgtattcgtatttgtttaattttggtttggtttgttattttatcggtttcgatttcggttttatgtagttttttcgcgtgcgtgaaatttttatgaaaatggtagagatttttatcggtgcgcgtaaaatttacggtttgaatttgatcggcgggattcgtcgcgatttgttgaaagacgatatgatttagattcgttagttggtataatagatgcgtcgtgaagtgtacgagttggtggatgtgttgttgagtattattattatggaatagcgtattgtcggtattggtcgtttggattcggaaatcgttcgcgattttagtaacgtcggttcgatgggattcgttagcggttacgttcgtgatattcgcgtcgattattcgtttgtcggttatggtttgttgttaatggaagtttataacgagtagggttgcgacgttatttttcgtttgaaagtgcgtattaacgaagtttatatcgcgtttgatatgatttcggggatgacggtttttttcgttgttcgtaattatggtgtagtagttagttagttatttttttggcgtaagtaatattaggaaggaagttttattgttgtcgtcgtcggagaataggttgtttt

SEQ ID NO: 8394 - DNA, 745 bp, Artificial Sequence
  chemically treated genomic DNA (Homo sapiens) CpG-island No: 8394
aaaacaacctattctccgacgacgacaacaataaaacttccttcctaatattacttacgccaaaaaaataactaactaactactacaccataattacgaacaacgaaaaaaaccgtcatccccgaaatcatatcaaacgcgatataaacttcgttaatacgcactttcaaacgaaaaataacgtcgcaaccctactcgttataaacttccattaacaacaaaccataaccgacaaacgaataatcgacgcgaatatcacgaacgtaaccgctaacgaatcccatcgaaccgacgttactaaaatcgcgaacgatttccgaatccaaacgaccaataccgacaatacgctattccataataataatactcaacaacacatccaccaactcgtacacttcacgacgcatctattataccaactaacgaatctaaatcatatcgtctttcaacaaatcgcgacgaatcccgccgatcaaattcaaaccgtaaattttacgcgcaccgataaaaatctctaccattttcataaaaatttcacgcacgcgaaaaaactacataaaaccgaaatcgaaaccgataaaataacaaaccaaaccaaaattaaacaaatacgaatacaaacgttctacctccaacaaaataacgcgaatcatctacgcacgttctaacacctaaatacccatcgcgttttccaccgacgtaatataaacgatactataaacaaaaccgcaaatcgaaaatcctc

SEQ ID NO: 8395 - DNA, 745 bp, Artificial Sequence
  chemically treated genomic DNA (Homo sapiens) CpG-island No: 8395
ggaataatttgtttttcggcggcgatagtagtaagattttttttttggtattgtttacgttagagaaataattggttggttgttatattatggttgcgggtaacgaaggagatcgttattttcgggattatgttaagcgcggtatagatttcgttgatacgtatttttagacgggaaataacgtcgtagttttgttcgttgtggatttttattggtagtaggttatagtcgataaacgggtgatcggcgcgggtattacgggcgtgatcgttggcgggttttatcgggtcgacgttattgaagtcgcgagcgattttcgggtttagacgattaatgtcgatagtgcgttgttttatgatagtagtgtttagtagtatatttattagttcgtgtattttacgacgtatttgttgtgttagttggcgggtttggattatgtcgttttttagtagatcgcgacgaatttcgtcgattaagtttaggtcgtaggttttacgcgtatcggtaaggatttttgttatttttatggaggttttacgtacgcggaagaattgtataaagtcggagtcgaagtcggtaaagtgataggttaggttaaggttgagtagatgcgagtgtaagcgttttatttttagtagaatggcgcggattatttgcgtacgttttggtatttgaatatttatcgcgttttttatcgacgtggtgtaggcggtgttgtgggtaaagtcgtagatcggggattttt

SEQ ID NO: 8396 - DNA, 745 bp, Artificial Sequence
  chemically treated genomic DNA (Homo sapiens) CpG-island No: 8396
aaaaatccccgatctacgactttacccacaacaccgcctacaccacgtcgataaaaaacgcgataaatattcaaataccaaaacgtacgcaaataatccgcgccattctactaaaaataaaacgcttacactcgcatctactcaaccttaacctaacctatcactttaccgacttcgactccgactttatacaattcttccgcgtacgtaaaacctccataaaaataacaaaaatccttaccgatacgcgtaaaacctacgacctaaacttaatcgacgaaattcgtcgcgatctactaaaaaacgacataatccaaacccgccaactaacacaacaaatacgtcgtaaaatacacgaactaataaatatactactaaacactactatcataaaacaacgcactatcgacattaatcgtctaaacccgaaaatcgctcgcgacttcaataacgtcgacccgataaaacccgccaacgatcacgcccgtaatacccgcgccgatcacccgtttatcgactataacctactaccaataaaaatccacaacgaacaaaactacgacgttatttcccgtctaaaaatacgtatcaacgaaatctataccgcgcttaacataatcccgaaaataacgatctccttcgttacccgcaaccataatataacaaccaaccaattatttctctaacgtaaacaataccaaaaaaaaaatcttactactatcgccgccgaaaaacaaattattcc

SEQ ID NO: 8397 - DNA, 533 bp, Artificial Sequence
  chemically treated genomic DNA (Homo sapiens) CpG-island No: 8397
aatcgtttgtattatcgtgttgtcgtttatcgtttggttgtattatttttttacgatgggtgcgggcgcgaacgtaaacgttttttttggtattattataatgattatcgttatttcgatcggggtgaagatttttaattggttgtttattatgtattaggtcgtatcgtgttttattttgcgatgttgtggattatcggttttatcgttattttttcggtgggcgggatgattggcgtgttgttggtcgtatcgggcgcggatttcgttttgtataatagtttgtttttgattgcgtatttttataacgtgattatcggcggcgtggttttcggttgtttcgtagggatgatttattggtggtttaaagcgttcggttttaaattgaacgaaatttggggtaaacgcgcgttttggttttggattatcggttttttcgttgtttttatgttattgtatgcgttgggttttatgggtatgattcgtcgtttgagttagtagattgattcgtagttttatattatgttgatgat

SEQ ID NO: 8398 - DNA, 533 bp, Artificial Sequence
  chemically treated genomic DNA (Homo sapiens) CpG-island No: 8398
atcatcaacataatataaaactacgaatcaatctactaactcaaacgacgaatcatacccataaaacccaacgcatacaataacataaaaacaacgaaaaaaccgataatccaaaaccaaaacgcgcgtttaccccaaatttcgttcaatttaaaaccgaacgctttaaaccaccaataaatcatccctacgaaacaaccgaaaaccacgccgccgataatcacgttataaaaatacgcaatcaaaaacaaactattatacaaaacgaaatccgcgcccgatacgaccaacaacacgccaatcatcccgcccaccgaaaaaataacgataaaaccgataatccacaacatcgcaaaataaaacacgatacgacctaatacataataaacaaccaattaaaaatcttcaccccgatcgaaataacgataatcattataataataccaaaaaaaacgtttacgttcgcgcccgcacccatcgtaaaaaaataatacaaccaaacgataaacgacaacacgataatacaaacgatt

SEQ ID NO: 8399 - DNA, 533 bp, Artificial Sequence
  chemically treated genomic DNA (Homo sapiens) CpG-island No: 8399
attattagtatggtgtggaattgcgggttaatttgttggtttaaacgacgggttatgtttatgaagtttagcgtatatagtggtataaaggtaacgaagaagtcgatgatttagaattagaacgcgcgtttattttaggtttcgtttagtttgaaatcgaacgttttaggttattagtaggttatttttgcgaagtagtcgaagattacgtcgtcgatgattacgttatggaagtgcgtaattaggaataggttgttatgtagaacgaagttcgcgttcggtacggttagtagtacgttagttatttcgtttatcgagaaggtgacgataaaatcgatggtttatagtatcgtagaatggaatacgatgcggtttgatatatggtgaatagttagttgaagatttttatttcggtcgggatggcgataattattgtggtgatattaaagaaggcgtttacgttcgcgttcgtatttatcgtaaagaagtggtgtagttaaacgatgaacgatagtacggtgatatagacggtt

SEQ ID NO: 8400 - DNA, 533 bp, Artificial Sequence
  chemically treated genomic DNA (Homo sapiens) CpG-island No: 8400
aaccgtctatatcaccgtactatcgttcatcgtttaactacaccacttctttacgataaatacgaacgcgaacgtaaacgccttctttaatatcaccacaataattatcgccatcccgaccgaaataaaaatcttcaactaactattcaccatatatcaaaccgcatcgtattccattctacgatactataaaccatcgattttatcgtcaccttctcgataaacgaaataactaacgtactactaaccgtaccgaacgcgaacttcgttctacataacaacctattcctaattacgcacttccataacgtaatcatcgacgacgtaatcttcgactacttcgcaaaaataacctactaataacctaaaacgttcgatttcaaactaaacgaaacctaaaataaacgcgcgttctaattctaaatcatcgacttcttcgttacctttataccactatatacgctaaacttcataaacataacccgtcgtttaaaccaacaaattaacccgcaattccacaccatactaataat

SEQ ID NO: 8401 - DNA, 651 bp, Artificial Sequence
  chemically treated genomic DNA (Homo sapiens) CpG-island No: 8401
cgtttcgtattcggtaacggttttagatgtttgatgcgacgtttgcgcgttttattaggtttataaattttcgtatttttcgtagatcggataaggcgtttacgtcgtattcggtaacggtatcgattgtttgatgcgacgtttgcgcgttttattaggtttataaattttcgtatttttcgtagggcggataaggcgtttacgtcgtattcggtaatagtgttaattgtttgatgcgacgtttgcgcgttttattaggtttataaattttcgtattattcgtaggtcggataaggcgtttacgtcgtattcggtaacggtgtcgattgtttgatgcgacgtttgcgcgttttattaggtttataaattttcgtatttttcgtaggtcggataaggcgtttacgtcgtattcggtaatggtgtcgattgtttgatgcgacgtttgcgcgttttattaggtttataaatttgtgtcggatcggtaggtcggataaggcgtttatgtcgtattcggtagttttatattagaagaaatatttcgtttcgatacggatttggtttgttcgcggtggtacggttcgacgttgcggtttaattagcgtaattcgaaataagggagttagtgtttattaatacggtaacggaaggtgt

SEQ ID NO: 8402 - DNA, 651 bp, Artificial Sequence
  chemically treated genomic DNA (Homo sapiens) CpG-island No: 8402
acaccttccgttaccgtattaataaacactaactcccttatttcgaattacgctaattaaaccgcaacgtcgaaccgtaccaccgcgaacaaaccaaatccgtatcgaaacgaaatatttcttctaatataaaactaccgaatacgacataaacgccttatccgacctaccgatccgacacaaatttataaacctaataaaacgcgcaaacgtcgcatcaaacaatcgacaccattaccgaatacgacgtaaacgccttatccgacctacgaaaaatacgaaaatttataaacctaataaaacgcgcaaacgtcgcatcaaacaatcgacaccgttaccgaatacgacgtaaacgccttatccgacctacgaataatacgaaaatttataaacctaataaaacgcgcaaacgtcgcatcaaacaattaacactattaccgaatacgacgtaaacgccttatccgccctacgaaaaatacgaaaatttataaacctaataaaacgcgcaaacgtcgcatcaaacaatcgataccgttaccgaatacgacgtaaacgccttatccgatctacgaaaaatacgaaaatttataaacctaataaaacgcgcaaacgtcgcatcaaacatctaaaaccgttaccgaatacgaaacg

SEQ ID NO: 8403 - DNA, 651 bp, Artificial Sequence
  chemically treated genomic DNA (Homo sapiens) CpG-island No: 8403
atatttttcgttatcgtattaatgaatattggtttttttatttcgaattgcgttggttagatcgtaacgtcgaatcgtattatcgcgagtaaattagattcgtatcgggacgaagtattttttttgatgtgaaattgtcggatgcggtataaacgttttattcggtttatcgattcggtataagtttgtaggtttgataagacgcgtaagcgtcgtattaggtagtcggtattattgtcggatgcggcgtaaacgttttattcggtttacggagggtgcgggaatttgtaggtttgataagacgcgtaagcgtcgtattaggtagtcggtatcgttgtcggatgcggcgtaaacgttttattcggtttacggatggtgcgggaatttgtaggtttgataagacgcgtaagcgtcgtattaggtagttggtattgttgtcggatgcggcgtaaacgttttattcgttttacggagggtgcgggaatttgtaggtttgataagacgcgtaagcgtcgtattaggtagtcggtatcgttgtcggatgcggcgtaaacgttttattcggtttacggagggtgcgggaatttgtaggtttgataagacgcgtaagcgtcgtattaggtatttgggatcgttgtcggatgcggggcg

SEQ ID NO: 8404 - DNA, 651 bp, Artificial Sequence
  chemically treated genomic DNA (Homo sapiens) CpG-island No: 8404
cgccccgcatccgacaacgatcccaaatacctaatacgacgcttacgcgtcttatcaaacctacaaattcccgcaccctccgtaaaccgaataaaacgtttacgccgcatccgacaacgataccgactacctaatacgacgcttacgcgtcttatcaaacctacaaattcccgcaccctccgtaaaacgaataaaacgtttacgccgcatccgacaacaataccaactacctaatacgacgcttacgcgtcttatcaaacctacaaattcccgcaccatccgtaaaccgaataaaacgtttacgccgcatccgacaacgataccgactacctaatacgacgcttacgcgtcttatcaaacctacaaattcccgcaccctccgtaaaccgaataaaacgtttacgccgcatccgacaataataccgactacctaatacgacgcttacgcgtcttatcaaacctacaaacttataccgaatcgataaaccgaataaaacgtttataccgcatccgacaatttcacatcaaaaaaaatacttcgtcccgatacgaatctaatttactcgcgataatacgattcgacgttacgatctaaccaacgcaattcgaaataaaaaaaccaatattcattaatacgataacgaaaaatat

SEQ ID NO: 8405 - DNA, 605 bp, Artificial Sequence
  chemically treated genomic DNA (Homo sapiens) CpG-island No: 8405
gtagattcgcgatattttggcgcgttcggcgttttattttatcgtttcgtagtaacgttgggaagaatatttgaagaaagggttaattaattcggatgcgacgtcggaatagacgcgcgtcgcggtgaaagcgatcgatacgtttaacggtaattggcgtttatcgggcggtgcggtgaaatttaatatcgttatattagtcggtgatcgggcgttggtttttcggtaattagatttggtcgtgggatatttggaagtaggcgtttgcgatggcgtatattaattcggatatcgataaagagaatattcgcgcggtttttttttggtagatttagtttggcgatagcgtgcgttcgaaggatgtgggttttgttttcgatttgatagcgtggaattttagtttcgagcgtggtggcgatggcgtgtattggaacgaacgtaatattaaagttagttttgtcgattgatcggtgatggtagtgtataacgttattaagattaaattttagtggtttagatgtttcgatatttggggttattcgattggaggaacgaaacggattataaggaatagcgtgtcgaatagggcgaacgaattagttata

SEQ ID NO: 8406 - DNA, 605 bp, Artificial Sequence
  chemically treated genomic DNA (Homo sapiens) CpG-island No: 8406
tataactaattcgttcgccctattcgacacgctattccttataatccgtttcgttcctccaatcgaataaccccaaatatcgaaacatctaaaccactaaaatttaatcttaataacgttatacactaccatcaccgatcaatcgacaaaactaactttaatattacgttcgttccaatacacgccatcgccaccacgctcgaaactaaaattccacgctatcaaatcgaaaacaaaacccacatccttcgaacgcacgctatcgccaaactaaatctaccaaaaaaaaaccgcgcgaatattctctttatcgatatccgaattaatatacgccatcgcaaacgcctacttccaaatatcccacgaccaaatctaattaccgaaaaaccaacgcccgatcaccgactaatataacgatattaaatttcaccgcaccgcccgataaacgccaattaccgttaaacgtatcgatcgctttcaccgcgacgcgcgtctattccgacgtcgcatccgaattaattaaccctttcttcaaatattcttcccaacgttactacgaaacgataaaataaaacgccgaacgcgccaaaatatcgcgaatctac

SEQ ID NO: 8407 - DNA, 605 bp, Artificial Sequence
  chemically treated genomic DNA (Homo sapiens) CpG-island No: 8407
tgtggttggttcgttcgttttattcggtacgttgttttttgtggttcgtttcgtttttttagtcgggtagttttaggtgtcgggatatttgggttattaaggtttgattttggtgacgttatatattgttattatcgattagtcggtaaggttggttttggtattacgttcgttttagtgtacgttatcgttattacgttcggggttaaggttttacgttattaggtcggggataaagtttatatttttcggacgtacgttatcgttaggttggatttgttaggagaagatcgcgcggatattttttttgtcgatgttcggattgatatgcgttatcgtaaacgtttgtttttaggtattttacggttaggtttgattgtcggagaattagcgttcggttatcgattggtgtaacggtgttaaattttatcgtatcgttcggtgagcgttagttatcgttgagcgtgtcgatcgtttttatcgcgacgcgcgtttgtttcggcgtcgtattcggattggttaattttttttttaggtattttttttagcgttgttgcgaggcggtgagataaaacgtcggacgcgttagaatatcgcggatttgt

SEQ ID NO: 8408 - DNA, 605 bp, Artificial Sequence
  chemically treated genomic DNA (Homo sapiens) CpG-island No: 8408
acaaatccgcgatattctaacgcgtccgacgttttatctcaccgcctcgcaacaacgctaaaaaaaatacctaaaaaaaaaattaaccaatccgaatacgacgccgaaacaaacgcgcgtcgcgataaaaacgatcgacacgctcaacgataactaacgctcaccgaacgatacgataaaatttaacaccgttacaccaatcgataaccgaacgctaattctccgacaatcaaacctaaccgtaaaatacctaaaaacaaacgtttacgataacgcatatcaatccgaacatcgacaaaaaaaatatccgcgcgatcttctcctaacaaatccaacctaacgataacgtacgtccgaaaaatataaactttatccccgacctaataacgtaaaaccttaaccccgaacgtaataacgataacgtacactaaaacgaacgtaataccaaaaccaaccttaccgactaatcgataataacaatatataacgtcaccaaaatcaaaccttaataacccaaatatcccgacacctaaaactacccgactaaaaaaacgaaacgaaccacaaaaaacaacgtaccgaataaaacgaacgaaccaaccaca

SEQ ID NO: 8409 - DNA, 937 bp, Artificial Sequence
  chemically treated genomic DNA (Homo sapiens) CpG-island No: 8409
ttttaattttttttaggtagttttcgtcgtttgcgtttttagtaatttcgattttttaattaacgtataaatttagtatgtttgacgatttttagttatgtaggcgtggtgtacgcggttaatgatgtcggtacggcgggtattaggaatagcgatcgtagttattggcgtgcggtttggcggtagtttatttattatcgaggtatcgagatcggtatacgtagttattgttagcgtgcgggggatcggcgtggcggttatgattaattgatgcggatggaagttttgttgttggttttttttttataatgttagacgttgatgtacgttaaaacgatgttgttcgtcgataattattagcgttaggtcgttaaattgtatttgtttttggaagatggcgtgtgtatcgataattatttgtatttgatcgttggcgatggttttttgttgtgttagtcgtgttttatttttttgtttatcggcgagttagtttatttcgatatcgagcggtgtaaattagttgcggaagttattggcgtgttgttcggcgagtaattcggttggtgttattaatgttatttgtttgtcgtgggtaatcgtacgtaacgcggcgagggcggcgattagcgttttatcggaatttatatcgttttgtattagacgtattatcggtatatttagcgttatatcgcgttcgattttcgttattacgcgtgtttgtgcgttcgttggtttgaacggtaaggcggcgaggagtttattttttagcgtgttattggcgtttagcggttgggtatgaaaacgttgtgtttcggtacgtaaggttaatatgttgaggttgtgcgttagtagtttttttagaattagacgacgttgcgtcggatgttgttcggtttttagatcgttaagttgtagcgtcggtggcgggcggtgtaaa

SEQ ID NO: 8410 - DNA, 937 bp, Artificial Sequence
  chemically treated genomic DNA (Homo sapiens) CpG-island No: 8410
tttacaccgcccgccaccgacgctacaacttaacgatctaaaaaccgaacaacatccgacgcaacgtcgtctaattctaaaaaaactactaacgcacaacctcaacatattaaccttacgtaccgaaacacaacgttttcatacccaaccgctaaacgccaataacacgctaaaaaataaactcctcgccgccttaccgttcaaaccaacgaacgcacaaacacgcgtaataacgaaaatcgaacgcgatataacgctaaatataccgataatacgtctaatacaaaacgatataaattccgataaaacgctaatcgccgccctcgccgcgttacgtacgattacccacgacaaacaaataacattaataacaccaaccgaattactcgccgaacaacacgccaataacttccgcaactaatttacaccgctcgatatcgaaataaactaactcgccgataaacaaaaaaataaaacacgactaacacaacaaaaaaccatcgccaacgatcaaatacaaataattatcgatacacacgccatcttccaaaaacaaatacaatttaacgacctaacgctaataattatcgacgaacaacatcgttttaacgtacatcaacgtctaacattataaaaaaaaaaccaacaacaaaacttccatccgcatcaattaatcataaccgccacgccgatcccccgcacgctaacaataactacgtataccgatctcgatacctcgataataaataaactaccgccaaaccgcacgccaataactacgatcgctattcctaatacccgccgtaccgacatcattaaccgcgtacaccacgcctacataactaaaaatcgtcaaacatactaaatttatacgttaattaaaaaatcgaaattactaaaaacgcaaacgacgaaaactacctaaaaaaaattaaaa

SEQ ID NO: 8411 - DNA, 937 bp, Artificial Sequence
  chemically treated genomic DNA (Homo sapiens) CpG-island No: 8411
tttgtatcgttcgttatcgacgttatagtttagcgatttggagatcgggtagtattcggcgtaacgtcgtttgattttggaagaattgttggcgtataattttagtatgttagttttacgtgtcggagtatagcgtttttatgtttagtcgttgagcgttaatgatacgttgaaaaataaatttttcgtcgttttatcgtttaagttaacgggcgtataggtacgcgtagtggcggagatcgagcgcgatatggcgttggatgtgtcgatgatgcgtttggtgtagggcgatgtaggtttcggtaaaacgttggtcgtcgttttcgtcgcgttgcgtgcgattgtttacggtaaataggtagtattgatggtattaatcgaattattcgtcgagtagtacgttaataattttcgtaattggtttgtatcgttcggtatcgaagtgggttggttcgtcggtaagtagaaaggtaaagtacggttggtatagtaggaagttatcgttagcggttaggtgtagatgattgtcggtatatacgttattttttaggaataggtgtagtttaacggtttggcgttggtgattatcgacgaatagtatcgttttggcgtgtattagcgtttggtattgtgggagaaaggttagtagtagggtttttattcgtattagttgattatgatcgttacgtcgatttttcgtacgttggtaatgattgcgtatgtcgatttcgatatttcggtgatagatgagttgtcgttaggtcgtacgttagtgattacggtcgttatttttgatattcgtcgtatcgatattattgatcgcgtgtattacgtttgtataattgaaggtcgttaggtatattgggtttgtacgttgattgaagagtcggaattgttggaagcgtaggcggcggaagttatttgggaagagttgaaa

SEQ ID NO: 8412 - DNA, 937 bp, Artificial Sequence
  chemically treated genomic DNA (Homo sapiens) CpG-island No: 8412
tttcaactcttcccaaataacttccgccgcctacgcttccaacaattccgactcttcaatcaacgtacaaacccaatatacctaacgaccttcaattatacaaacgtaatacacgcgatcaataatatcgatacgacgaatatcaaaaataacgaccgtaatcactaacgtacgacctaacgacaactcatctatcaccgaaatatcgaaatcgacatacgcaatcattaccaacgtacgaaaaatcgacgtaacgatcataatcaactaatacgaataaaaaccctactactaacctttctcccacaataccaaacgctaatacacgccaaaacgatactattcgtcgataatcaccaacgccaaaccgttaaactacacctattcctaaaaaataacgtatataccgacaatcatctacacctaaccgctaacgataacttcctactataccaaccgtactttacctttctacttaccgacgaaccaacccacttcgataccgaacgatacaaaccaattacgaaaattattaacgtactactcgacgaataattcgattaataccatcaatactacctatttaccgtaaacaatcgcacgcaacgcgacgaaaacgacgaccaacgttttaccgaaacctacatcgccctacaccaaacgcatcatcgacacatccaacgccatatcgcgctcgatctccgccactacgcgtacctatacgcccgttaacttaaacgataaaacgacgaaaaatttatttttcaacgtatcattaacgctcaacgactaaacataaaaacgctatactccgacacgtaaaactaacatactaaaattatacgccaacaattcttccaaaatcaaacgacgttacgccgaatactacccgatctccaaatcgctaaactataacgtcgataacgaacgatacaaa

SEQ ID NO: 8413 - DNA, 640 bp, Artificial Sequence
  chemically treated genomic DNA (Homo sapiens) CpG-island No: 8413
tacgttcggttcggtcgtttcgttttcggtttcgggtagtatcgtcgcgttcgttcgtcgtagttttttttttatttgatgtacgggttggtcgtcgttaggatgtttttttgtatcgggatttttttttcgtcgaggattaggtgcgcgtcgtagaagcgagatttttcgcggaaagagttgagcgttcgtagtagacgcgcggcgtgttgagggttagatacggtattgtttttagttatcgcggcgttcgtttttttgtcgacgggttcggttttcgatatcgttcggtcggatttttcgagcggttcgagttttgcgcgcgcgttcgttcggttcggtttttcgcgttttgagtagaagttggagttttcgggacgtgtttgtgttattcgcggcgcgttgggtcggcgtttttaagaagtcgcgttatgaagttattttttcgcgacgttttcgtatcgtcgtttttcgttttttcgttttcgttgttggagatggttaattagaagtttttttttttcgttcgtttgattagttgcggttgggtgtagcggaaggtgtttacggatgagataggtcgttttcgcgatggagggatgtgcgggcgggttaggatttcgtggttaagtttgtggtt

SEQ ID NO: 8414 - DNA, 640 bp, Artificial Sequence
  chemically treated genomic DNA (Homo sapiens) CpG-island No: 8414
aaccacaaacttaaccacgaaatcctaacccgcccgcacatccctccatcgcgaaaacgacctatctcatccgtaaacaccttccgctacacccaaccgcaactaatcaaacgaacgaaaaaaaaaaacttctaattaaccatctccaacaacgaaaacgaaaaaacgaaaaacgacgatacgaaaacgtcgcgaaaaaataacttcataacgcgacttcttaaaaacgccgacccaacgcgccgcgaataacacaaacacgtcccgaaaactccaacttctactcaaaacgcgaaaaaccgaaccgaacgaacgcgcgcgcaaaactcgaaccgctcgaaaaatccgaccgaacgatatcgaaaaccgaacccgtcgacaaaaaaacgaacgccgcgataactaaaaacaataccgtatctaaccctcaacacgccgcgcgtctactacgaacgctcaactctttccgcgaaaaatctcgcttctacgacgcgcacctaatcctcgacgaaaaaaaaatcccgatacaaaaaaacatcctaacgacgaccaacccgtacatcaaataaaaaaaaaactacgacgaacgaacgcgacgatactacccgaaaccgaaaacgaaacgaccgaaccgaacgta

SEQ ID NO: 8415 - DNA, 640 bp, Artificial Sequence
  chemically treated genomic DNA (Homo sapiens) CpG-island No: 8415
ggttataggtttaattacggaattttagttcgttcgtatatttttttatcgcgggagcgatttattttattcgtagatatttttcgttgtatttagtcgtagttggttaggcgggcggaggaaggaggtttttgattggttatttttagtagcggaggcgagaaggcggggagcgacggtgcgggggcgtcgcggagaaatgattttatgacgcggttttttaaaggcgtcggtttagcgcgtcgcggatagtataggtacgtttcgggggttttagtttttgtttagagcgcggagagtcgggtcgggcgggcgcgcgcgtaggattcgggtcgttcgaggggttcggtcggacggtgtcgggagtcggattcgtcggtagaggagcgggcgtcgcgatggttgagggtagtgtcgtgtttgatttttagtacgtcgcgcgtttgttgcgagcgtttagtttttttcgcgaggagtttcgtttttgcgacgcgtatttggttttcgacggggaggagatttcggtgtagaagaatattttggcggcggttagttcgtatattaggtggggagggggttacggcgggcgggcgcggcggtgttgttcggagtcggaggcggggcggtcgggtcgggcgtg

SEQ ID NO: 8416 - DNA, 640 bp, Artificial Sequence
  chemically treated genomic DNA (Homo sapiens) CpG-island No: 8416
cacgcccgacccgaccgccccgcctccgactccgaacaacaccgccgcgcccgcccgccgtaaccccctccccacctaatatacgaactaaccgccgccaaaatattcttctacaccgaaatctcctccccgtcgaaaaccaaatacgcgtcgcaaaaacgaaactcctcgcgaaaaaaactaaacgctcgcaacaaacgcgcgacgtactaaaaatcaaacacgacactaccctcaaccatcgcgacgcccgctcctctaccgacgaatccgactcccgacaccgtccgaccgaacccctcgaacgacccgaatcctacgcgcgcgcccgcccgacccgactctccgcgctctaaacaaaaactaaaacccccgaaacgtacctatactatccgcgacgcgctaaaccgacgcctttaaaaaaccgcgtcataaaatcatttctccgcgacgcccccgcaccgtcgctccccgccttctcgcctccgctactaaaaataaccaatcaaaaacctccttcctccgcccgcctaaccaactacgactaaatacaacgaaaaatatctacgaataaaataaatcgctcccgcgataaaaaaatatacgaacgaactaaaattccgtaattaaacctataacc

SEQ ID NO: 8417 - DNA, 508 bp, Artificial Sequence
  chemically treated genomic DNA (Homo sapiens) CpG-island No: 8417
agacggcgtttttaacgttcgattcgcgtggtcgtggtagcgttacgcgagttttttaggcgatcgtagggttatagtagtttagtcgtcggtgttttttcggaaattatgattttcggcgcgggtttatggagttatggtttatagggttttgggtcgcgcggggttattttagtcgcggagggcgcgtaggttgtttttcgtttttacgttttcgtttttttgtatttatttgtgttatagttttttgtgttgttgcgacgatttgggtcggagtcgttttttcggcgcgtttcgttgttttcgcggttttagcgcgggcggttagaaatttttttagaagtttcgtttttgtgattttttcgggtcgacgtttagcgagtttagcgtttttagcgcgttcgtcgtcgtcgtgttcgtttttcgttttttcggttttaattatttcggtttatttaagttgggtattaagcggttgttttaagtttttattgtgggcgtgaagaag

SEQ ID NO: 8418 - DNA, 508 bp, Artificial Sequence
  chemically treated genomic DNA (Homo sapiens) CpG-island No: 8418
cttcttcacgcccacaataaaaacttaaaacaaccgcttaatacccaacttaaataaaccgaaataattaaaaccgaaaaaacgaaaaacgaacacgacgacgacgaacgcgctaaaaacgctaaactcgctaaacgtcgacccgaaaaaatcacaaaaacgaaacttctaaaaaaatttctaaccgcccgcgctaaaaccgcgaaaacaacgaaacgcgccgaaaaaacgactccgacccaaatcgtcgcaacaacacaaaaaactataacacaaataaatacaaaaaaacgaaaacgtaaaaacgaaaaacaacctacgcgccctccgcgactaaaataaccccgcgcgacccaaaaccctataaaccataactccataaacccgcgccgaaaatcataatttccgaaaaaacaccgacgactaaactactataaccctacgatcgcctaaaaaactcgcgtaacgctaccacgaccacgcgaatcgaacgttaaaaacgccgtct

SEQ ID NO: 8419 - DNA, 508 bp, Artificial Sequence
  chemically treated genomic DNA (Homo sapiens) CpG-island No: 8419
tttttttacgtttataatgagggtttggggtaatcgtttggtatttagtttgggtgagtcggagtggttggaatcggagaggcgaggggcgggtacggcggcggcgggcgcgttgggagcgttgggttcgttgggcgtcggttcggagggattataggggcgggatttttggagaagtttttggtcgttcgcgttggggtcgcggaggtagcgaggcgcgtcgaggaggcggtttcgatttaggtcgtcgtagtagtataggaagttgtaatataggtaagtgtaggagagcgagagcgtgaaggcgaagagtagtttgcgcgtttttcgcggttgaggtggtttcgcgcggtttaggattttataggttatggttttatgggttcgcgtcgggggttatggttttcgagggggtatcggcggttgagttgttgtggttttgcggtcgtttagagggttcgcgtggcgttgttacggttacgcgggtcgggcgttgggggcgtcgttt

SEQ ID NO: 8420 - DNA, 508 bp, Artificial Sequence
  chemically treated genomic DNA (Homo sapiens) CpG-island No: 8420
aaacgacgcccccaacgcccgacccgcgtaaccgtaacaacgccacgcgaaccctctaaacgaccgcaaaaccacaacaactcaaccgccgataccccctcgaaaaccataacccccgacgcgaacccataaaaccataacctataaaatcctaaaccgcgcgaaaccacctcaaccgcgaaaaacgcgcaaactactcttcgccttcacgctctcgctctcctacacttacctatattacaacttcctatactactacgacgacctaaatcgaaaccgcctcctcgacgcgcctcgctacctccgcgaccccaacgcgaacgaccaaaaacttctccaaaaatcccgcccctataatccctccgaaccgacgcccaacgaacccaacgctcccaacgcgcccgccgccgccgtacccgcccctcgcctctccgattccaaccactccgactcacccaaactaaataccaaacgattaccccaaaccctcattataaacgtaaaaaaa

SEQ ID NO: 8421 - DNA, 535 bp, Artificial Sequence
  chemically treated genomic DNA (Homo sapiens) CpG-island No: 8421
  misc_feature (313)..(314): n is either a, c, g or t
  misc_feature (326)..(326): n is either a, c, g or t
  misc_feature (337)..(337): n is either a, c, g or t
  misc_feature (354)..(354): n is either a, c, g or t
  misc_feature (410)..(410): n is either a, c, g or t
tattagatgtatacgagcgcgtgagagtggattttgtatcggtttttggtagtagattacgggagatttttttcgttagtggattacgtagggcggaggtataaatgcgggtaattacgttttggcgaatgtgttttattagcggcgtatggtaattatttagggagttggacgttaggttaggtttttaaagtttattttcgcgatgacgtttattattatattgacggttaggttatcgttacggaaagcgtgatggaaggaaatcgttatgtcgttttgtaaattagagcgacgaatcgttttttttagnngttggcggtatnaggggttattnttgggcgttcggttaanttttcgggcgttttggtgtatttcggggatttttttatttttagttttcgttaggnttatttcgggttttttacggcgttgtttttcgtggggatattatttttcgggcggtttcgggtataggggtttttttttatttgggggggtaaaaaataaagggggttcgggggggtaaaagtaa

SEQ ID NO: 8422 - DNA, 535 bp, Artificial Sequence
  chemically treated genomic DNA (Homo sapiens) CpG-island No: 8422
  misc_feature (126)..(126): n is either a, c, g or t
  misc_feature (182)..(182): n is either a, c, g or t
  misc_feature (199)..(199): n is either a, c, g or t
  misc_feature (210)..(210): n is either a, c, g or t
  misc_feature (222)..(223): n is either a, c, g or t
ttacttttacccccccgaaccccctttattttttacccccccaaataaaaaaaaacccctatacccgaaaccgcccgaaaaataatatccccacgaaaaacaacgccgtaaaaaacccgaaataancctaacgaaaactaaaaataaaaaaatccccgaaatacaccaaaacgcccgaaaanttaaccgaacgcccaanaataacccctnataccgccaacnnctaaaaaaaacgattcgtcgctctaatttacaaaacgacataacgatttccttccatcacgctttccgtaacgataacctaaccgtcaatataataataaacgtcatcgcgaaaataaactttaaaaacctaacctaacgtccaactccctaaataattaccatacgccgctaataaaacacattcgccaaaacgtaattacccgcatttatacctccgccctacgtaatccactaacgaaaaaaatctcccgtaatctactaccaaaaaccgatacaaaatccactctcacgcgctcgtatacatctaata

SEQ ID NO: 8423 - DNA, 535 bp, Artificial Sequence
  chemically treated genomic DNA (Homo sapiens) CpG-island No: 8423
  misc_feature (126)..(126): n is either a, c, g or t
  misc_feature (182)..(182): n is either a, c, g or t
  misc_feature (199)..(199): n is either a, c, g or t
  misc_feature (210)..(210): n is either a, c, g or t
  misc_feature (222)..(223): n is either a, c, g or t
ttatttttgttttttcgggttttttttgttttttgtttttttaaatgggaaaaaatttttgtgttcggggtcgttcgagaagtaatgtttttacgaagaatagcgtcgtggaaagttcgaggtggntttggcgaggattgagaatgaaggggttttcggggtgtattagggcgttcggaaanttggtcgggcgtttaangataatttttngtgtcgttaatnnttggaagaagcgattcgtcgttttggtttataggacggtatgacggtttttttttattacgtttttcgtggcggtgatttgatcgttaatatggtgatggacgttatcgcgaagatgggttttaaaaatttgatttggcgtttagttttttgagtgattgttatgcgtcgttggtagaatatattcgttagggcgtggttattcgtatttatattttcgttttgcgtggtttattggcggaagagatttttcgtggtttgttgttaagaatcggtgtaagatttatttttacgcgttcgtgtgtatttggta

SEQ ID NO: 8424 - DNA, 535 bp, Artificial Sequence
  chemically treated genomic DNA (Homo sapiens) CpG-island No: 8424
  misc_feature (313)..(314): n is either a, c, g or t
  misc_feature (326)..(326): n is either a, c, g or t
  misc_feature (337)..(337): n is either a, c, g or t
  misc_feature (354)..(354): n is either a, c, g or t
  misc_feature (410)..(410): n is either a, c, g or t
taccaaatacacacgaacgcgtaaaaataaatcttacaccgattcttaacaacaaaccacgaaaaatctcttccgccaataaaccacgcaaaacgaaaatataaatacgaataaccacgccctaacgaatatattctaccaacgacgcataacaatcactcaaaaaactaaacgccaaatcaaatttttaaaacccatcttcgcgataacgtccatcaccatattaacgatcaaatcaccgccacgaaaaacgtaataaaaaaaaaccgtcataccgtcctataaaccaaaacgacgaatcgcttcttccaannattaacgacacnaaaaattatcnttaaacgcccgaccaantttccgaacgccctaatacaccccgaaaaccccttcattctcaatcctcgccaaanccacctcgaactttccacgacgctattcttcgtaaaaacattacttctcgaacgaccccgaacacaaaaattttttcccatttaaaaaaacaaaaaacaaaaaaaacccgaaaaaacaaaaataa

SEQ ID NO: 8425 - DNA, 1094 bp, Artificial Sequence
  chemically treated genomic DNA (Homo sapiens) CpG-island No: 8425
  misc_feature (138)..(138): n is either a, c, g or t
  misc_feature (220)..(221): n is either a, c, g or t
cgataatcggatcgtttattattttgtcgtttagggaaattacgtcgaggttttcgcgagcggcggttttagcggtttttacgacgcggcgggcgtgatttatttttttttgggtcggtgcgtagaggttgtgtagtnagattaatttgacgcgggttgattagcgatttgtcgttaaagtttagttgtttgatgtgggcggttttttgtagaaattcgnngtttcgttgttagcgtcggaatagacggtatcgaacgtttgaatattcgtagagcgcgcggtttgtaaaatggaatagcgtgcgaatagtagtttagtttttttcggggagcgttttgtacgtaggttgcgtatatagttttttgtatcgagggcgatatcgattaaacgttcggaagcgtgagcgatttttattgcgcgggtaatttttagcggagatttaatcgtcgttagtaggtcggtgttgtcgggtttacgattataggttttttcgatacgtaggattttttttttaatatttagaatattttgagcggtatcggttttcggtagacgtataacgttcgtattatcgcgaacgacggtttttaggtcgttaatattttattcggaatttagcgcgttgatacgtataatggttttaatatcgcgatatagcggatgttgtagcgcgtggtaaattatgcggcgggcggtgttttttttacgtaatgttacggagttttcgaggttaaatattagggtattagtcgggtagatgaaggagttgttgattatcgcggtattggtattaggtataaataatatgttgcggcgggtgcgagttttacgttgttgtagcgaagcggaaattattggtaatttttttatggtagagtcgggatatcgttggcgcgtgttagtagggtttttagtcgtgtacgtaaaatgtagtttagtgcgtttttgttatcgatatttagttgtacgtcgcgtacgttgtagcgggcgagaacgtttagaatggtggtgcgaattgtatcgttaaattgttttttaacgttgttattgatttgtaggtcgatattttgcgtatcgagtggggcgatgcgta

SEQ ID NO: 8426 - DNA, 1094 bp, Artificial Sequence
  chemically treated genomic DNA (Homo sapiens) CpG-island No: 8426
  misc_feature (874)..(875): n is either a, c, g or t
  misc_feature (957)..(957): n is either a, c, g or t
tacgcatcgccccactcgatacgcaaaatatcgacctacaaatcaataacaacgttaaaaaacaatttaacgatacaattcgcaccaccattctaaacgttctcgcccgctacaacgtacgcgacgtacaactaaatatcgataacaaaaacgcactaaactacattttacgtacacgactaaaaaccctactaacacgcgccaacgatatcccgactctaccataaaaaaattaccaataatttccgcttcgctacaacaacgtaaaactcgcacccgccgcaacatattatttatacctaataccaataccgcgataatcaacaactccttcatctacccgactaataccctaatatttaacctcgaaaactccgtaacattacgtaaaaaaaacaccgcccgccgcataatttaccacgcgctacaacatccgctatatcgcgatattaaaaccattatacgtatcaacgcgctaaattccgaataaaatattaacgacctaaaaaccgtcgttcgcgataatacgaacgttatacgtctaccgaaaaccgataccgctcaaaatattctaaatattaaaaaaaaaatcctacgtatcgaaaaaacctataatcgtaaacccgacaacaccgacctactaacgacgattaaatctccgctaaaaattacccgcgcaataaaaatcgctcacgcttccgaacgtttaatcgatatcgccctcgatacaaaaaactatatacgcaacctacgtacaaaacgctccccgaaaaaaactaaactactattcgcacgctattccattttacaaaccgcgcgctctacgaatattcaaacgttcgataccgtctattccgacgctaacaacgaaacnncgaatttctacaaaaaaccgcccacatcaaacaactaaactttaacgacaaatcgctaatcaacccgcgtcaaattaatctnactacacaacctctacgcaccgacccaaaaaaaaataaatcacgcccgccgcgtcgtaaaaaccgctaaaaccgccgctcgcgaaaacctcgacgtaatttccctaaacgacaaaataataaacgatccgattatcg

SEQ ID NO: 8427 - DNA, 1094 bp, Artificial Sequence
  chemically treated genomic DNA (Homo sapiens) CpG-island No: 8427
  misc_feature (874)..(875): n is either a, c, g or t
  misc_feature (957)..(957): n is either a, c, g or t
tacgtatcgttttattcgatacgtaggatatcgatttgtaaattaatagtagcgttgagaaatagtttggcgatgtaattcgtattattattttggacgttttcgttcgttataacgtgcgcggcgtatagttgaatgtcgatgataaaggcgtattggattgtattttacgtgtacgattggaagttttgttggtacgcgttagcggtatttcggttttgttatgggaggattgttaatgattttcgtttcgttgtaataacgtaaaattcgtattcgtcgtagtatgttgtttgtgtttggtgttaatgtcgcgatggttagtaatttttttatttattcggttgatgttttgatgtttgatttcgaagatttcgtagtattgcgtgaaaaagatatcgttcgtcgtatggtttattacgcgttgtaatattcgttgtatcgcgatattgaaattattgtgcgtgttaacgcgttggatttcgaatggggtgttaacgatttggaagtcgtcgttcgcggtggtgcggacgttgtgcgtttgtcgaaaatcgatatcgtttaggatgttttggatattgaaaaagagattttgcgtatcgaaaaagtttgtggtcgtgaattcggtagtatcggtttgttggcggcgattgaattttcgttggggattattcgcgtagtggaaatcgtttacgttttcgagcgtttgatcggtatcgttttcggtgtagaagattatgtgcgtaatttgcgtatagaacgtttttcggaaggaattgaattgttgttcgtacgttgttttattttgtaggtcgcgcgttttgcgggtatttaggcgttcgatatcgtttatttcgacgttaataacgaagtnncggatttttgtaagaagtcgtttatattaaatagttgggttttgacggtaaatcgttgattaattcgcgttagattgatttngttgtataatttttacgtatcgatttagaaagaagtggattacgttcgtcgcgtcgtagaagtcgttgaagtcgtcgttcgcgaaggtttcggcgtggtttttttgaacggtaagatggtggacggttcggttatcg

SEQ ID NO: 8428 - DNA, 1094 bp, Artificial Sequence
  chemically treated genomic DNA (Homo sapiens) CpG-island No: 8428
  misc_feature (138)..(138): n is either a, c, g or t
  misc_feature (220)..(221): n is either a, c, g or t
cgataaccgaaccgtccaccatcttaccgttcaaaaaaaccacgccgaaaccttcgcgaacgacgacttcaacgacttctacgacgcgacgaacgtaatccacttctttctaaatcgatacgtaaaaattatacaacnaaatcaatctaacgcgaattaatcaacgatttaccgtcaaaacccaactatttaatataaacgacttcttacaaaaatccgnnacttcgttattaacgtcgaaataaacgatatcgaacgcctaaatacccgcaaaacgcgcgacctacaaaataaaacaacgtacgaacaacaattcaattccttccgaaaaacgttctatacgcaaattacgcacataatcttctacaccgaaaacgataccgatcaaacgctcgaaaacgtaaacgatttccactacgcgaataatccccaacgaaaattcaatcgccgccaacaaaccgatactaccgaattcacgaccacaaactttttcgatacgcaaaatctctttttcaatatccaaaacatcctaaacgatatcgattttcgacaaacgcacaacgtccgcaccaccgcgaacgacgacttccaaatcgttaacaccccattcgaaatccaacgcgttaacacgcacaataatttcaatatcgcgatacaacgaatattacaacgcgtaataaaccatacgacgaacgatatctttttcacgcaatactacgaaatcttcgaaatcaaacatcaaaacatcaaccgaataaataaaaaaattactaaccatcgcgacattaacaccaaacacaaacaacatactacgacgaatacgaattttacgttattacaacgaaacgaaaatcattaacaatcctcccataacaaaaccgaaataccgctaacgcgtaccaacaaaacttccaatcgtacacgtaaaatacaatccaatacgcctttatcatcgacattcaactatacgccgcgcacgttataacgaacgaaaacgtccaaaataataatacgaattacatcgccaaactatttctcaacgctactattaatttacaaatcgatatcctacgtatcgaataaaacgatacgta

SEQ ID NO: 8429 - DNA, 568 bp, Artificial Sequence
  chemically treated genomic DNA (Homo sapiens) CpG-island No: 8429
cggataggtcgttacgtagacgatagttggcgcgttggaaaaagaggtagaaggttgcgtgtttttttgttattttagcgtcgagagtaatttattaggcgtcgtcgtcgattgtatacgcgttcgaattttattattcgtaaggcgcgtggttagcgttgttagtagttgtatatgcgtagtattcgttttattggggggaatcgttagtagtattattaaattaattgttttcgggttattaacgtttttttattgaagcggttcgttgagtgtggcgatcgtaaacgtcgttttttttatcgtagtagttttgttatgcggtatagttaaaattttttatttaaggcggtcgggttaaggtttttacggcgatatattttttttagaaattgtttagtattggaaattttttttagagtagtaagacgttgagttaacgcgtggatggtttttttacggttggtaaagcgcgtatttagatataacgtatcgcggtgggttagagtcgttagatttattatgatttttatttgatcgtttttatagtcgcgttagtgtgttcgat

SEQ ID NO: 8430 - DNA, 568 bp, Artificial Sequence
  chemically treated genomic DNA (Homo sapiens) CpG-island No: 8430
atcgaacacactaacgcgactataaaaacgatcaaataaaaatcataataaatctaacgactctaacccaccgcgatacgttatatctaaatacgcgctttaccaaccgtaaaaaaaccatccacgcgttaactcaacgtcttactactctaaaaaaaatttccaatactaaacaatttctaaaaaaaatatatcgccgtaaaaaccttaacccgaccgccttaaataaaaaattttaactataccgcataacaaaactactacgataaaaaaaacgacgtttacgatcgccacactcaacgaaccgcttcaataaaaaaacgttaataacccgaaaacaattaatttaataatactactaacgattccccccaataaaacgaatactacgcatatacaactactaacaacgctaaccacgcgccttacgaataataaaattcgaacgcgtatacaatcgacgacgacgcctaataaattactctcgacgctaaaataacaaaaaaacacgcaaccttctacctctttttccaacgcgccaactatcgtctacgtaacgacctatccg

SEQ ID NO: 8431 - DNA, 568 bp, Artificial Sequence
  chemically treated genomic DNA (Homo sapiens) CpG-island No: 8431
atcgggtatattggcgcgattataaaaacgattaagtgaggattatgatgaatttgacgattttgatttatcgcgatgcgttgtgtttgaatgcgcgttttattagtcgtgaagaggttatttacgcgttgatttaacgttttgttgttttggggaaaatttttagtattgagtaatttttggaagaagtgtatcgtcgtgaaagttttggttcgatcgttttaggtgaagggttttggttgtgtcgtatggtaaaattgttgcggtaaaagaagcggcgtttgcggtcgttatatttagcgagtcgttttagtgggaaggcgttgatggttcggaagtagttgatttagtggtgttgttggcgattttttttaatgaagcgggtattacgtatatgtaattgttgatagcgttgattacgcgttttgcggatgatgagattcgggcgcgtatatagtcggcgacgacgtttgatgagttgttttcggcgttgggatgatagggaggtacgtaattttttgtttttttttttaacgcgttaattatcgtttgcgtaacggtttgttcg

SEQ ID NO: 8432 - DNA, 568 bp, Artificial Sequence
  chemically treated genomic DNA (Homo sapiens) CpG-island No: 8432
cgaacaaaccgttacgcaaacgataattaacgcgttaaaaaaaaaaacaaaaaattacgtacctccctatcatcccaacgccgaaaacaactcatcaaacgtcgtcgccgactatatacgcgcccgaatctcatcatccgcaaaacgcgtaatcaacgctatcaacaattacatatacgtaatacccgcttcattaaaaaaaatcgccaacaacaccactaaatcaactacttccgaaccatcaacgccttcccactaaaacgactcgctaaatataacgaccgcaaacgccgcttcttttaccgcaacaattttaccatacgacacaaccaaaacccttcacctaaaacgatcgaaccaaaactttcacgacgatacacttcttccaaaaattactcaatactaaaaattttccccaaaacaacaaaacgttaaatcaacgcgtaaataacctcttcacgactaataaaacgcgcattcaaacacaacgcatcgcgataaatcaaaatcgtcaaattcatcataatcctcacttaatcgtttttataatcgcgccaatatacccgat

SEQ ID NO: 8433 - DNA, 752 bp, Artificial Sequence
  chemically treated genomic DNA (Homo sapiens) CpG-island No: 8433
gttaagacgggatttattgattggcgtttagtcgcgcgttagtattcgttgttataacgtattaaatggcgtgtcgttgtttatttttgttttttttgtgttattcggtattggcgtaagcgaacgttttcgtaattttttatcgatagatagttataattgagatagcgcgatttattagtcggttgcggtataattttttacgtagtaagttgcgttagcgtcgtttgtttcgtagcgggtagttgttttcgtgttagttcgtttaggttatcgtcgtagtcgtcgagtattgcgggttgtagatcgacgagggtaatatgtgttggtagatgttcgcggatattcgttagcgttaatatttcggagaaattgttttgatgtaggtttatttttttcgcgttgagataagtcggaatgcgtttttcggtataggttcgtagcgttttaggttttagttcgtagttaatggtatcgagaattaatagatggttggcgttttcgatatattttagtaagtttagtttttgagtatcgttatcgataatttttatatattcgggttagtggtaatgggtatatagtcgtttcgttattcgtacgtcgaagtttttatcggtttatagtaggttgtttagttttatgattattacgcgttgttcgtttatgaacgttttttgttatttattttgttaaatttgtggttacggtagtcgttgattatggtggagattatcgtgtcgtcggatatg

SEQ ID NO: 8434 - DNA, 752 bp, Artificial Sequence
  chemically treated genomic DNA (Homo sapiens) CpG-island No: 8434
catatccgacgacacgataatctccaccataatcaacgactaccgtaaccacaaatttaacaaaataaataacaaaaaacgttcataaacgaacaacgcgtaataatcataaaactaaacaacctactataaaccgataaaaacttcgacgtacgaataacgaaacgactatatacccattaccactaacccgaatatataaaaattatcgataacgatactcaaaaactaaacttactaaaatatatcgaaaacgccaaccatctattaattctcgataccattaactacgaactaaaacctaaaacgctacgaacctataccgaaaaacgcattccgacttatctcaacgcgaaaaaaataaacctacatcaaaacaatttctccgaaatattaacgctaacgaatatccgcgaacatctaccaacacatattaccctcgtcgatctacaacccgcaatactcgacgactacgacgataacctaaacgaactaacacgaaaacaactacccgctacgaaacaaacgacgctaacgcaacttactacgtaaaaaattataccgcaaccgactaataaatcgcgctatctcaattataactatctatcgataaaaaattacgaaaacgttcgcttacgccaataccgaataacacaaaaaaaacaaaaataaacaacgacacgccatttaatacgttataacaacgaatactaacgcgcgactaaacgccaatcaataaatcccgtcttaac

SEQ ID NO: 8435 - DNA, 752 bp, Artificial Sequence
  chemically treated genomic DNA (Homo sapiens) CpG-island No: 8435
tatgttcgacgatacggtgatttttattatggttaacggttatcgtagttataaatttggtaaaataagtaataaggagcgtttatgagcgagtaacgcgtggtggttatggggttgggtaatttgttgtgggtcgatgaaggtttcggcgtgcgggtggcggaacggttgtatgtttattattattggttcgagtatgtggagattgtcgatggcggtatttagggattgaatttgttggggtatgtcgaaagcgttagttatttgttgattttcgatgttattgattacgggttggaatttggaacgttgcgaatttatgtcggagaacgtatttcggtttattttagcgcgaagaaaatgagtttgtattagaatagttttttcgaagtgttggcgttggcggatattcgcggatatttgttagtatatattgttttcgtcggtttgtaattcgtaatgttcgacgattacggcggtagtttgagcgaattggtacgggagtaattgttcgttgcggaataggcggcgttggcgtagtttgttgcgtggggaattgtgtcgtaatcggttaatgaatcgcgttgttttaattatgattgtttgtcgatggaaaattacgaaggcgttcgtttgcgttagtatcggatgatataggaggagtagggatgagtaacgatacgttatttgatgcgttgtggtaacgaatgttggcgcgcggttggacgttagttagtgaatttcgttttgat

SEQ ID NO: 8436 - DNA, 752 bp, Artificial Sequence
  chemically treated genomic DNA (Homo sapiens) CpG-island No: 8436
atcaaaacgaaattcactaactaacgtccaaccgcgcgccaacattcgttaccacaacgcatcaaataacgtatcgttactcatccctactcctcctatatcatccgatactaacgcaaacgaacgccttcgtaattttccatcgacaaacaatcataattaaaacaacgcgattcattaaccgattacgacacaattccccacgcaacaaactacgccaacgccgcctattccgcaacgaacaattactcccgtaccaattcgctcaaactaccgccgtaatcgtcgaacattacgaattacaaaccgacgaaaacaatatatactaacaaatatccgcgaatatccgccaacgccaacacttcgaaaaaactattctaatacaaactcattttcttcgcgctaaaataaaccgaaatacgttctccgacataaattcgcaacgttccaaattccaacccgtaatcaataacatcgaaaatcaacaaataactaacgctttcgacataccccaacaaattcaatccctaaataccgccatcgacaatctccacatactcgaaccaataataataaacatacaaccgttccgccacccgcacgccgaaaccttcatcgacccacaacaaattacccaaccccataaccaccacgcgttactcgctcataaacgctccttattacttattttaccaaatttataactacgataaccgttaaccataataaaaatcaccgtatcgtcgaacata

SEQ ID NO: 8437 - DNA, 1002 bp, Artificial Sequence
  chemically treated genomic DNA (Homo sapiens) CpG-island No: 8437
gacggcgtgatggtatagattcgtgagtatttggcgattttgtagttgatcggtaattcgatgttgatagtggcgttgattaaagtcgatcgcgtggacgaagcgcgtgttgatgaggttgaacgttaggtaaaggaggttttgcgggaatacggttttgttgaggtaaaattgtttattatcgtagtaatcgaaggtcggggaatggatgttttgcgcgagtatttgttttagttgtcggaacgcgagtacgttagttaatatagttttcgtttcgcgattgatcgcgtatttatcgtaaaaggtgtcgggttggtcgttatcggtacggcgttaagcggggaagtgaaggtaggcgatttattttggttgattggtgtaaataaatcgatgcgtgtacgtgcgttgtatgcgtaaaattagttaatagaaatcgttaatgtcgggtagcgtatcgcgtttaatattcgcgggtgatgcggaaaaagagtagattaatcgtggcgattggttgtttgtcgatgtgtcgttagagtcgtttatacgggtgattgtcgagttttaaatttatatatcgttgatttagtggtagtcgttgtatatttattacgtcgttagttacgttacgggacgcgttttattgttggaagataattttgttgaattggttttcgatatttcgttatggttggtagataacgatcgtttggtattgcgcgatatttttgttcgtaatacgttggtcggagcgcgcgtcgtgatgtttaattcgtcgcgtcgcggtaaacgtaagtcggaatatttgtaatggttggcgttttttgtacgggcgtagagcgatgtcgatgcgttatttgtttatttggaacgcggcgcggttaattttgcggatttcgtttgggcgcgttagtttaacggcgaagggatgcgcgaattgttgtaatagtttggttatatttaggttggttatagtttgttgaatgcgtcggttgtcgttcgttg

SEQ ID NO: 8438 - DNA, 1002 bp, Artificial Sequence
  chemically treated genomic DNA (Homo sapiens) CpG-island No: 8438
caacgaacgacaaccgacgcattcaacaaactataaccaacctaaatataaccaaactattacaacaattcgcgcatcccttcgccgttaaactaacgcgcccaaacgaaatccgcaaaattaaccgcgccgcgttccaaataaacaaataacgcatcgacatcgctctacgcccgtacaaaaaacgccaaccattacaaatattccgacttacgtttaccgcgacgcgacgaattaaacatcacgacgcgcgctccgaccaacgtattacgaacaaaaatatcgcgcaataccaaacgatcgttatctaccaaccataacgaaatatcgaaaaccaattcaacaaaattatcttccaacaataaaacgcgtcccgtaacgtaactaacgacgtaataaatatacaacgactaccactaaatcaacgatatataaatttaaaactcgacaatcacccgtataaacgactctaacgacacatcgacaaacaaccaatcgccacgattaatctactctttttccgcatcacccgcgaatattaaacgcgatacgctacccgacattaacgatttctattaactaattttacgcatacaacgcacgtacacgcatcgatttatttacaccaatcaaccaaaataaatcgcctaccttcacttccccgcttaacgccgtaccgataacgaccaacccgacaccttttacgataaatacgcgatcaatcgcgaaacgaaaactatattaactaacgtactcgcgttccgacaactaaaacaaatactcgcgcaaaacatccattccccgaccttcgattactacgataataaacaattttacctcaacaaaaccgtattcccgcaaaacctcctttacctaacgttcaacctcatcaacacgcgcttcgtccacgcgatcgactttaatcaacgccactatcaacatcgaattaccgatcaactacaaaatcgccaaatactcacgaatctataccatcacgccgtc

SEQ ID NO: 8439 - DNA, 1002 bp, Artificial Sequence
  chemically treated genomic DNA (Homo sapiens) CpG-island No: 8439
tagcgggcggtaatcggcgtatttaataagttataattagtttgaatataattaggttgttgtagtaattcgcgtattttttcgtcgttgagttggcgcgtttaggcgaaattcgtaaggttaatcgcgtcgcgttttagatgaatagataacgtatcggtatcgttttgcgttcgtgtaagagacgttagttattgtagatatttcggtttacgtttatcgcgacgcggcgggttaagtattacgacgcgcgtttcggttagcgtgttgcgggtagagatatcgcgtaatattaggcggtcgttatttgttagttataacggggtgtcgaagattagtttagtaaggttattttttagtagtgaaacgcgtttcgtgacgtggttggcggcgtggtgaatatgtagcggttgttattgggttagcggtgtatgggtttgaagttcgataattattcgtgtgaacggttttggcggtatatcggtaagtagttagtcgttacggttaatttgtttttttttcgtattattcgcggatgttaagcgcgatacgttgttcggtattggcggtttttgttggttggttttgcgtatgtagcgtacgtatacgtatcggtttatttatattagttagttagagtgaatcgtttatttttattttttcgtttaacgtcgtatcggtgacgattagttcggtattttttacggtaaatgcgcggttaatcgcgaggcggaaattatgttggttggcgtgttcgcgtttcggtaattgaagtagatgttcgcgtagggtatttatttttcgattttcggttgttgcggtgataaatagttttgttttagtaaaatcgtattttcgtagaattttttttatttggcgtttaattttattaatacgcgtttcgtttacgcgatcggttttggttagcgttattgttagtatcgggttatcggttagttgtaaaatcgttagatgtttacgggtttgtgttattacgtcgtt

SEQ ID NO: 8440 - DNA, 1002 bp, Artificial Sequence
  chemically treated genomic DNA (Homo sapiens) CpG-island No: 8440
aacgacgtaataacacaaacccgtaaacatctaacgattttacaactaaccgataacccgatactaacaataacgctaaccaaaaccgatcgcgtaaacgaaacgcgtattaataaaattaaacgccaaataaaaaaaattctacgaaaatacgattttactaaaacaaaactatttatcaccgcaacaaccgaaaatcgaaaaataaataccctacgcgaacatctacttcaattaccgaaacgcgaacacgccaaccaacataatttccgcctcgcgattaaccgcgcatttaccgtaaaaaataccgaactaatcgtcaccgatacgacgttaaacgaaaaaataaaaataaacgattcactctaactaactaatataaataaaccgatacgtatacgtacgctacatacgcaaaaccaaccaacaaaaaccgccaataccgaacaacgtatcgcgcttaacatccgcgaataatacgaaaaaaaaacaaattaaccgtaacgactaactacttaccgatataccgccaaaaccgttcacacgaataattatcgaacttcaaacccatacaccgctaacccaataacaaccgctacatattcaccacgccgccaaccacgtcacgaaacgcgtttcactactaaaaaataaccttactaaactaatcttcgacaccccgttataactaacaaataacgaccgcctaatattacgcgatatctctacccgcaacacgctaaccgaaacgcgcgtcgtaatacttaacccgccgcgtcgcgataaacgtaaaccgaaatatctacaataactaacgtctcttacacgaacgcaaaacgataccgatacgttatctattcatctaaaacgcgacgcgattaaccttacgaatttcgcctaaacgcgccaactcaacgacgaaaaaatacgcgaattactacaacaacctaattatattcaaactaattataacttattaaatacgccgattaccgcccgcta

SEQ ID NO: 8441 - DNA, 529 bp, Artificial Sequence
  chemically treated genomic DNA (Homo sapiens) CpG-island No: 8441
gcgtagtagtagttcggcgaagtttattaggttcgcgcggttatacgttttttgatacgtttgatatattttttgttaggtttgttttatcggattatcgtagttttgaatatgatgcggacgtaggtttttatttttttggttgttgatgtattatattgtttgtcgcggcggatattgtttttcgtcgaggtttatggttttgattagacgtttaagtaggcgtagttggtttttattgtcgaggatttggaaattttgcggtagattggcgattatatatggttgcgtacgtagataaacggtgcgttagttcgtggaaggtgtcgattaatatcggtttggttcgtgttattagttgttcgatacgatgacgtattttcgtcgacgtttggttggtaaaacgtatcgttataatcgagtatggcgagtagtttttacgtttattaaataggcgatacgatgtatagtacgcgcgtattatacggtcgcgtcgttatatagaagtgttgcgtgggcggtacgttcg

SEQ ID NO: 8442 - DNA, 529 bp, Artificial Sequence
  chemically treated genomic DNA (Homo sapiens) CpG-island No: 8442
cgaacgtaccgcccacgcaacacttctatataacgacgcgaccgtataatacgcgcgtactatacatcgtatcgcctatttaataaacgtaaaaactactcgccatactcgattataacgatacgttttaccaaccaaacgtcgacgaaaatacgtcatcgtatcgaacaactaataacacgaaccaaaccgatattaatcgacaccttccacgaactaacgcaccgtttatctacgtacgcaaccatatataatcgccaatctaccgcaaaatttccaaatcctcgacaataaaaaccaactacgcctacttaaacgtctaatcaaaaccataaacctcgacgaaaaacaatatccgccgcgacaaacaatataatacatcaacaaccaaaaaaataaaaacctacgtccgcatcatattcaaaactacgataatccgataaaacaaacctaacaaaaaatatatcaaacgtatcaaaaaacgtataaccgcgcgaacctaataaacttcgccgaactactactacgc

SEQ ID NO: 8443 - DNA, 529 bp, Artificial Sequence
  chemically treated genomic DNA (Homo sapiens) CpG-island No: 8443
cgaacgtgtcgtttacgtagtatttttgtgtggcggcgcggtcgtgtaatacgcgcgtattgtgtatcgtatcgtttgtttgatgagcgtggaaattgttcgttatattcgattatggcggtacgttttattaattaagcgtcggcggagatgcgttatcgtatcgggtaattgatggtacgagttaggtcggtattggtcggtattttttacgggttggcgtatcgtttgtttgcgtgcgtagttatatgtgatcgttaatttgtcgtaggatttttagattttcgatagtgaagattagttacgtttgtttaagcgtttgattaaagttatgaatttcgacgagaagtagtgttcgtcgcggtaggtaatgtggtatattaatagttagaaagatgaaggtttgcgttcgtattatatttaaagttacggtaattcggtggagtagatttggtagaaggtgtattaggcgtattaggaagcgtgtgatcgcgcgggtttggtggatttcgtcgagttgttgttgcgt

SEQ ID NO: 8444 - DNA, 529 bp, Artificial Sequence
  chemically treated genomic DNA (Homo sapiens) CpG-island No: 8444
acgcaacaacaactcgacgaaatccaccaaacccgcgcgatcacacgcttcctaatacgcctaatacaccttctaccaaatctactccaccgaattaccgtaactttaaatataatacgaacgcaaaccttcatctttctaactattaatataccacattacctaccgcgacgaacactacttctcgtcgaaattcataactttaatcaaacgcttaaacaaacgtaactaatcttcactatcgaaaatctaaaaatcctacgacaaattaacgatcacatataactacgcacgcaaacaaacgatacgccaacccgtaaaaaataccgaccaataccgacctaactcgtaccatcaattacccgatacgataacgcatctccgccgacgcttaattaataaaacgtaccgccataatcgaatataacgaacaatttccacgctcatcaaacaaacgatacgatacacaatacgcgcgtattacacgaccgcgccgccacacaaaaatactacgtaaacgacacgttcg

SEQ ID NO: 8445 - DNA, 605 bp, Artificial Sequence
  chemically treated genomic DNA (Homo sapiens) CpG-island No: 8445
gggtttttggtgtgtatcgttcggtcgttttcgttcgagggtcgcggggtttagagttcggtaggtttaggcggggtaggggatgttcgcggttcggtaggcgtacgtttattttcggtcgcgtaggcgtagtagcgggtcggttttttcgcgtttcgcggcggcggttagtgcgtaggcgcggcggtcgatgcgagtgtgtatgtgcgggtagaagatggcggcggcgggggaagtagcgtgagtagtcggaggatcgcgagttttaatgaaacgggtagttatggttttttatagttcgtaggtagtttcggtttgcgttttcggtcggaaggggttcgagtttcgggcgggcggattcgcggcgggcgggcgttcgcgttttgttcggagcgagcgtgtgggagtggggagggcgttgggatacgttgttcgggtttaggtcggagttattcgcggtttcgcgttcgcgcgtttttttttttgggttatcggaatttttagttcggggaggttaaggcggggcgtcggggtcggttgggaggttttggggcgttaaggttatttttcgggttgaatcgggggattagggttgtgtggggttt

SEQ ID NO: 8446 - DNA, 605 bp, Artificial Sequence
  chemically treated genomic DNA (Homo sapiens) CpG-island No: 8446
aaaccccacacaaccctaatcccccgattcaacccgaaaaataaccttaacgccccaaaacctcccaaccgaccccgacgccccgccttaacctccccgaactaaaaattccgataacccaaaaaaaaaaacgcgcgaacgcgaaaccgcgaataactccgacctaaacccgaacaacgtatcccaacgccctccccactcccacacgctcgctccgaacaaaacgcgaacgcccgcccgccgcgaatccgcccgcccgaaactcgaaccccttccgaccgaaaacgcaaaccgaaactacctacgaactataaaaaaccataactacccgtttcattaaaactcgcgatcctccgactactcacgctacttcccccgccgccgccatcttctacccgcacatacacactcgcatcgaccgccgcgcctacgcactaaccgccgccgcgaaacgcgaaaaaaccgacccgctactacgcctacgcgaccgaaaataaacgtacgcctaccgaaccgcgaacatcccctaccccgcctaaacctaccgaactctaaaccccgcgaccctcgaacgaaaacgaccgaacgatacacaccaaaaaccc

SEQ ID NO: 8447 - DNA, 605 bp, Artificial Sequence
  chemically treated genomic DNA (Homo sapiens) CpG-island No: 8447
gggttttatataattttggtttttcggtttaattcggggagtaattttggcgttttaaggttttttaatcggtttcgacgtttcgttttgattttttcggattaggggtttcggtggtttagggaagaaggcgcgcgggcgcgaagtcgcgggtggtttcggtttaggttcgggtagcgtgttttagcgttttttttatttttatacgttcgtttcgggtagggcgcggacgttcgttcgtcgcgggttcgttcgttcggggttcgggtttttttcggtcgaaggcgtagatcggggttatttgcgggttgtggagggttatggttgttcgttttattgggattcgcgatttttcggttgtttacgttgtttttttcgtcgtcgttattttttgttcgtatatatatattcgtatcggtcgtcgcgtttgcgtattggtcgtcgtcgcggggcgcggggaggtcggttcgttgttgcgtttgcgcggtcgaaggtgggcgtgcgtttgtcgggtcgcggatattttttgtttcgtttggatttgtcggattttgagtttcgcgattttcgggcggaagcggtcgggcggtgtatattaggagttt

SEQ ID NO: 8448 - DNA, 605 bp, Artificial Sequence
  chemically treated genomic DNA (Homo sapiens) CpG-island No: 8448
aaactcctaatatacaccgcccgaccgcttccgcccgaaaatcgcgaaactcaaaatccgacaaatccaaacgaaacaaaaaatatccgcgacccgacaaacgcacgcccaccttcgaccgcgcaaacgcaacaacgaaccgacctccccgcgccccgcgacgacgaccaatacgcaaacgcgacgaccgatacgaatatatatatacgaacaaaaaataacgacgacgaaaaaaacaacgtaaacaaccgaaaaatcgcgaatcccaataaaacgaacaaccataaccctccacaacccgcaaataaccccgatctacgccttcgaccgaaaaaaacccgaaccccgaacgaacgaacccgcgacgaacgaacgtccgcgccctacccgaaacgaacgtataaaaataaaaaaaacgctaaaacacgctacccgaacctaaaccgaaaccacccgcgacttcgcgcccgcgcgccttcttccctaaaccaccgaaacccctaatccgaaaaaatcaaaacgaaacgtcgaaaccgattaaaaaaccttaaaacgccaaaattactccccgaattaaaccgaaaaaccaaaattatataaaaccc

SEQ ID NO: 8449 - DNA, 1299 bp, Artificial Sequence
  chemically treated genomic DNA (Homo sapiens) CpG-island No: 8449
tcgtgaatgtgcgaaatcgtagagcggtggtagtatgacgaacgtgttggttgatagatattagttatattagcgaagggtatcgggtggcggttattataggtatgatgagaaaggtcggttgatcggtgagcgttagacgggtattattcgtagacggaagtattgttttggtagtatgagattagatatcgtataacgcgtaggggttggcgaatcgttgtatatcggatagtttgtcgtcgtggaatggttgatttacggtagcggttatttggtaggtatgaaatcggcgatatatcgttggtggagtatattcgcgatcgtttgtatcgggaacgttgcgtagtttcggtcgttatgaatttattatcgtttatatttttgcgggtagttatagagttagtatttgaatagtttgttgtttgatcgcgatttatttggaacgataacggcgaatttattcgtattagtagttcgcgttagttcggagttatagttatagtattatcggtaggttgatcggcgtttatatatcgtagcgaatttggatattcgtatttcgtatgttatagattcggtagtaatcgtttgttcgattcggagttgtattcggatagtatttttagtatggggcggataatcgtatcgttcgtgacgcgtattatttttatcggtatgacgttacggtaggttgacggagaaaatcgattttatttcggaaggggttatcgtacggatgatgagcgtatttatcggtattattacgatagttagtacggttggtgtattatacgcggatataatatgtagagtcgttggtcgaaagcgttatttttacgattcgttgggtcgtagggtggttaaacgggtgtggtacgtgaacgggatttgacgggttggatgtcgttgttacggaaatcgtaatgatttggtacggttgggacggcgatcgtttgattacgatatagaaagaagaattcgtatttagacgatgtattagtcggggagttttacgttatttatagggttgaaatcgttatcggtgagtaggcgaaaatatagcgttatagttggcggatattttttagtagttcgacggcgaagacggaggtagtgttcgtgtttttatacggtgttaggtgtagatgtttagatcggattggaaagtgaattatcggttgatcgggtgagtgaggaaagtcgtcgcgtgttaatatttgcggtttgacggtggagatagataataattcgatgtttttagaatattaagttatagagggttagtatatttaaaga

SEQ ID NO: 8450 - DNA, 1299 bp, Artificial Sequence
  chemically treated genomic DNA (Homo sapiens) CpG-island No: 8450
tctttaaatatactaaccctctataacttaatattctaaaaacatcgaattattatctatctccaccgtcaaaccgcaaatattaacacgcgacgactttcctcactcacccgatcaaccgataattcactttccaatccgatctaaacatctacacctaacaccgtataaaaacacgaacactacctccgtcttcgccgtcgaactactaaaaaatatccgccaactataacgctatattttcgcctactcaccgataacgatttcaaccctataaataacgtaaaactccccgactaatacatcgtctaaatacgaattcttctttctatatcgtaatcaaacgatcgccgtcccaaccgtaccaaatcattacgatttccgtaacaacgacatccaacccgtcaaatcccgttcacgtaccacacccgtttaaccaccctacgacccaacgaatcgtaaaaataacgctttcgaccaacgactctacatattatatccgcgtataatacaccaaccgtactaactatcgtaataataccgataaatacgctcatcatccgtacgataaccccttccgaaataaaatcgattttctccgtcaacctaccgtaacgtcataccgataaaaataatacgcgtcacgaacgatacgattatccgccccatactaaaaatactatccgaatacaactccgaatcgaacaaacgattactaccgaatctataacatacgaaatacgaatatccaaattcgctacgatatataaacgccgatcaacctaccgataatactataactataactccgaactaacgcgaactactaatacgaataaattcgccgttatcgttccaaataaatcgcgatcaaacaacaaactattcaaatactaactctataactacccgcaaaaatataaacgataataaattcataacgaccgaaactacgcaacgttcccgatacaaacgatcgcgaatatactccaccaacgatatatcgccgatttcatacctaccaaataaccgctaccgtaaatcaaccattccacgacgacaaactatccgatatacaacgattcgccaacccctacgcgttatacgatatctaatctcatactaccaaaacaatacttccgtctacgaataatacccgtctaacgctcaccgatcaaccgacctttctcatcatacctataataaccgccacccgatacccttcgctaatataactaatatctatcaaccaacacgttcgtcatactaccaccgctctacgatttcgcacattcacga

SEQ ID NO: 8451 - DNA, 1299 bp, Artificial Sequence
  chemically treated genomic DNA (Homo sapiens) CpG-island No: 8451
tttttgagtatgttgattttttgtggtttaatattttgggaatatcggattattatttgtttttatcgttaggtcgtagatgttagtacgcggcggttttttttatttattcggttagtcgatgatttattttttagttcggtttgagtatttgtatttagtatcgtgtgggaatacgagtattgttttcgttttcgtcgtcggattgttgaagggtattcgttagttgtggcgttgtgttttcgtttgtttatcggtggcggttttaattttgtgagtggcgtgaagtttttcggttgatatatcgtttggatgcgggtttttttttttgtatcgtggttaggcggtcgtcgttttagtcgtattaggttattgcggttttcgtgatagcgatatttagttcgttaggtttcgtttacgtgttatattcgtttggttattttgcggtttagcgggtcgtaaagatagcgttttcgattagcggttttgtatattgtgttcgcgtgtagtgtattagtcgtgttgattgtcgtaatggtatcggtgggtgcgtttattattcgtgcggtaatttttttcgggatgaggtcggtttttttcgttagtttgtcgtgacgttatatcggtaaagatagtgcgcgttacgggcgatacggttattcgttttatgttgagggtgttgttcgggtgtagtttcgggtcgggtaggcggttattgtcgggtttgtggtatacgggatgcggatatttagattcgttgcggtgtgtgaacgtcggttagtttgtcggtggtgttgtagttgtaatttcgggttggcgcgggttgttgatgcggatgagttcgtcgttgtcgttttaggtgaatcgcggttagatagtaggttgtttaggtgttggttttgtaattgttcgtaggggtataagcggtggtgagtttataacggtcgaagttgcgtagcgttttcggtgtaggcggtcgcgggtgtattttattagcggtgtgtcgtcggttttatgtttgttaggtaatcgttgtcgtaggttagttattttacggcggtaggttgttcggtatatagcggttcgttagtttttgcgcgttgtacgatgtttggttttatgttgttagagtagtgttttcgtttgcgggtgatgttcgtttgacgtttatcggttagtcggttttttttattatatttgtaatgatcgttattcggtgtttttcgttgatatggttgatgtttgttagttagtacgttcgttatattgttatcgttttgcggtttcgtatatttacgg

SEQ ID NO: 8452 - DNA, 1299 bp, Artificial Sequence
  chemically treated genomic DNA (Homo sapiens) CpG-island No: 8452
ccgtaaatatacgaaaccgcaaaacgataacaatataacgaacgtactaactaacaaacatcaaccatatcaacgaaaaacaccgaataacgatcattacaaatataataaaaaaaaccgactaaccgataaacgtcaaacgaacatcacccgcaaacgaaaacactactctaacaacataaaaccaaacatcgtacaacgcgcaaaaactaacgaaccgctatataccgaacaacctaccgccgtaaaataactaacctacgacaacgattacctaacaaacataaaaccgacgacacaccgctaataaaatacacccgcgaccgcctacaccgaaaacgctacgcaacttcgaccgttataaactcaccaccgcttatacccctacgaacaattacaaaaccaacacctaaacaacctactatctaaccgcgattcacctaaaacgacaacgacgaactcatccgcatcaacaacccgcgccaacccgaaattacaactacaacaccaccgacaaactaaccgacgttcacacaccgcaacgaatctaaatatccgcatcccgtataccacaaacccgacaataaccgcctacccgacccgaaactacacccgaacaacaccctcaacataaaacgaataaccgtatcgcccgtaacgcgcactatctttaccgatataacgtcacgacaaactaacgaaaaaaaccgacctcatcccgaaaaaaattaccgcacgaataataaacgcacccaccgataccattacgacaatcaacacgactaatacactacacgcgaacacaatatacaaaaccgctaatcgaaaacgctatctttacgacccgctaaaccgcaaaataaccaaacgaatataacacgtaaacgaaacctaacgaactaaatatcgctatcacgaaaaccgcaataacctaatacgactaaaacgacgaccgcctaaccacgatacaaaaaaaaaaacccgcatccaaacgatatatcaaccgaaaaacttcacgccactcacaaaattaaaaccgccaccgataaacaaacgaaaacacaacgccacaactaacgaatacccttcaacaatccgacgacgaaaacgaaaacaatactcgtattcccacacgatactaaatacaaatactcaaaccgaactaaaaaataaatcatcgactaaccgaataaataaaaaaaaccgccgcgtactaacatctacgacctaacgataaaaacaaataataatccgatattcccaaaatattaaaccacaaaaaatcaacatactcaaaaa

SEQ ID NO: 8453 - DNA, 579 bp, Artificial Sequence
  chemically treated genomic DNA (Homo sapiens) CpG-island No: 8453
cggacgtggggttttcgggaagggatagcgtagttggttaagttggggttcgaatttcgcggttaggagtggggatgtttaggattcgggtttgcgtgaggagaggtttcgcgcgttttttacgattcggttggggaggtttcgtagaagggattttcgtttcgttttttatattatttttcgatattaagttcgagtcgtttttttagtattttttagtcgtgtcgcggtttattattttattcgtttcgggttaatcgggttattatttttagtatagatttcgcgggagtagaggaagagggagaggtttcgttatcggaagtaataagatagagtgggggaagcgtgtttcggtttcgtgattatagaggagaggtcgttttttttttataattttttttaatttcgcgattttttcgttgtttagagcggttatttttagtcggaggaagtgggcgtatgcgtaatatcgtcggtttcgtttttttttttttatttagagatcgagtattcgggttcggtagttatagtttaaggggtgacgggtgtgtgttagttttcgttttttttgggcgg

SEQ ID NO: 8454 - DNA, 579 bp, Artificial Sequence
  chemically treated genomic DNA (Homo sapiens) CpG-island No: 8454
ccgcccaaaaaaaacgaaaactaacacacacccgtcaccccttaaactataactaccgaacccgaatactcgatctctaaataaaaaaaaaaaaacgaaaccgacgatattacgcatacgcccacttcctccgactaaaaataaccgctctaaacaacgaaaaaatcgcgaaattaaaaaaaattataaaaaaaaaacgacctctcctctataatcacgaaaccgaaacacgcttcccccactctatcttattacttccgataacgaaacctctccctcttcctctactcccgcgaaatctatactaaaaataataacccgattaacccgaaacgaataaaataataaaccgcgacacgactaaaaaatactaaaaaaacgactcgaacttaatatcgaaaaataatataaaaaacgaaacgaaaatcccttctacgaaacctccccaaccgaatcgtaaaaaacgcgcgaaacctctcctcacgcaaacccgaatcctaaacatccccactcctaaccgcgaaattcgaaccccaacttaaccaactacgctatcccttcccgaaaaccccacgtccg

SEQ ID NO: 8455 - DNA, 579 bp, Artificial Sequence
  chemically treated genomic DNA (Homo sapiens) CpG-island No: 8455
tcgtttaggaggagcggaaattgatatatattcgttattttttgggttgtgattgtcgagttcgggtattcggtttttgggtgaagaggaaggggcgggatcggcggtattacgtatgcgtttatttttttcggttgggagtggtcgttttaggtagcggggaggtcgcggggttgaggggggttgtgaaaggagagcggttttttttttatggttacggggtcggggtacgttttttttattttgttttgttattttcggtagcgaagtttttttttttttttttgttttcgcggggtttgtgttgagaataatggttcggttggttcgggacgagtggaatggtaagtcgcgatacggttggggggtgttgagggggcgattcgggtttgatatcggggagtgatgtggaagacggagcgggaattttttttgcggagtttttttagtcgggtcgtaggaggcgcgcggggtttttttttacgtaggttcgagttttgagtatttttatttttggtcgcggggttcggattttagtttggttaattgcgttattttttttcgagagttttacgttcg

SEQ ID NO: 8456 - DNA, 579 bp, Artificial Sequence
  chemically treated genomic DNA (Homo sapiens) CpG-island No: 8456
cgaacgtaaaactctcgaaaaaaaataacgcaattaaccaaactaaaatccgaaccccgcgaccaaaaataaaaatactcaaaactcgaacctacgtaaaaaaaaaccccgcgcgcctcctacgacccgactaaaaaaactccgcaaaaaaaattcccgctccgtcttccacatcactccccgatatcaaacccgaatcgccccctcaacaccccccaaccgtatcgcgacttaccattccactcgtcccgaaccaaccgaaccattattctcaacacaaaccccgcgaaaacaaaaaaaaaaaaaaaaacttcgctaccgaaaataacaaaacaaaataaaaaaaacgtaccccgaccccgtaaccataaaaaaaaaaccgctctcctttcacaacccccctcaaccccgcgacctccccgctacctaaaacgaccactcccaaccgaaaaaaataaacgcatacgtaataccgccgatcccgccccttcctcttcacccaaaaaccgaatacccgaactcgacaatcacaacccaaaaaataacgaatatatatcaatttccgctcctcctaaacga

SEQ ID NO: 8457 - DNA, 541 bp, Artificial Sequence
  chemically treated genomic DNA (Homo sapiens) CpG-island No: 8457
  misc_feature (398)..(398): n is either a, c, g or t
  misc_feature (465)..(465): n is either a, c, g or t
  misc_feature (515)..(515): n is either a, c, g or t
tcgtttagcgtttgaattatagtggtgaaggtaacgaatcggtcgagcggatgatgaaggattattttcgcgttatacgtcgcgttagtgaatttaattagatgttgttgtaattgttcgatgaagttattttcgtttttttcgtcgacgaaaaattacgtttaatcgacgatgagttttagttacgcggtacgttaatcgatttgcgtgatgaaatattatttatgcgttagtcggaagttattttgcgtatgttttatattatggtgtataatagtgcgattatcggtatttattttattacgttgcgttagttacgttatgttcgtcgttatttgtaataatcgttgtgtaatatttcggaagtacgaaaattgtttttgagtattttgcgttanttcggagcggtgcggcgtcggttattgttaatgtatcggtataacgtgttcggcgcgtatatgtcgnaatggtttatatcgtcgggtaaatttagttgatttgtttacgttatacgngggtgagatataattcgagggagtat

SEQ ID NO: 8458 - DNA, 541 bp, Artificial Sequence
  chemically treated genomic DNA (Homo sapiens) CpG-island No: 8458
  misc_feature (27)..(27): n is either a, c, g or t
  misc_feature (77)..(77): n is either a, c, g or t
  misc_feature (144)..(144): n is either a, c, g or t
atactccctcgaattatatctcacccncgtataacgtaaacaaatcaactaaatttacccgacgatataaaccattncgacatatacgcgccgaacacgttataccgatacattaacaataaccgacgccgcaccgctccgaantaacgcaaaatactcaaaaacaattttcgtacttccgaaatattacacaacgattattacaaataacgacgaacataacgtaactaacgcaacgtaataaaataaataccgataatcgcactattatacaccataatataaaacatacgcaaaataacttccgactaacgcataaataatatttcatcacgcaaatcgattaacgtaccgcgtaactaaaactcatcgtcgattaaacgtaatttttcgtcgacgaaaaaaacgaaaataacttcatcgaacaattacaacaacatctaattaaattcactaacgcgacgtataacgcgaaaataatccttcatcatccgctcgaccgattcgttaccttcaccactataattcaaacgctaaacga

SEQ ID NO: 8459 - DNA, 541 bp, Artificial Sequence
  chemically treated genomic DNA (Homo sapiens) CpG-island No: 8459
  misc_feature (27)..(27): n is either a, c, g or t
  misc_feature (77)..(77): n is either a, c, g or t
  misc_feature (144)..(144): n is either a, c, g or t
atattttttcggattgtattttatttncgtgtagcgtgaatagattaattgaatttgttcgacgatatggattattncggtatatacgcgtcgagtacgttatgtcgatgtattggtaatagtcggcgtcgtatcgtttcgggntgacgtagaatgtttaaaaatagttttcgtgttttcggaatattatatagcggttgttgtagatggcgacgggtatggcgtaattggcgtagcgtggtggagtaaatgtcggtgatcgtattgttgtgtattatggtgtagaatatacgtaagatggttttcggttggcgtataaatagtgttttattacgtaggtcgattagcgtatcgcgtagttgaaatttatcgtcgattggacgtggtttttcgtcggcgggaagggcgaggatggttttatcgaatagttgtagtagtatttggttgagtttattgacgcggcgtgtaacgcggaagtaattttttattattcgttcgatcggttcgttatttttattattgtaatttagacgttgggcga

SEQ ID NO: 8460 - DNA, 541 bp, Artificial Sequence
  chemically treated genomic DNA (Homo sapiens) CpG-island No: 8460
  misc_feature (398)..(398): n is either a, c, g or t
  misc_feature (465)..(465): n is either a, c, g or t
  misc_feature (515)..(515): n is either a, c, g or t
tcgcccaacgtctaaattacaataataaaaataacgaaccgatcgaacgaataataaaaaattacttccgcgttacacgccgcgtcaataaactcaaccaaatactactacaactattcgataaaaccatcctcgcccttcccgccgacgaaaaaccacgtccaatcgacgataaatttcaactacgcgatacgctaatcgacctacgtaataaaacactatttatacgccaaccgaaaaccatcttacgtatattctacaccataatacacaacaatacgatcaccgacatttactccaccacgctacgccaattacgccatacccgtcgccatctacaacaaccgctatataatattccgaaaacacgaaaactatttttaaacattctacgtcancccgaaacgatacgacgccgactattaccaatacatcgacataacgtactcgacgcgtatataccgnaataatccatatcgtcgaacaaattcaattaatctattcacgctacacgnaaataaaatacaatccgaaaaaatat

SEQ ID NO: 8461 - DNA, 516 bp, Artificial Sequence
  chemically treated genomic DNA (Homo sapiens) CpG-island No: 8461
atcggtacgattttttcggtgggtaaaatattcgacgaaggggtttcgcggcgcgagtaggaggtcgcgttgggagagggcgtcgggtgcggagttcgcgagttttcggtaagtcgtcgtcgttttggggttatttgatttcgtttttgaacgcggggttttagaggcgagttttgggtttatatagtaaaatgtggttcgttagaaagcgtttttttttatcgcgtttagaataagaagcggcgttgtttggcgagttttcgttcggttttttcgttttgtttagagtattagcgcgtagttcgcgttcgttattatttttaatatagataaagttttcgcgagatggagcggcggtgtataaaatttatttcgatcggatttgggatgcgtcgtatttttagtagggttaagttttacgagaagaaattaggattttcgagttatagttatagatatttacgcgttttttaagtcggtgattgtattaggtgtttattcggttttgagtttgga

SEQ ID NO: 8462 - DNA, 516 bp, Artificial Sequence
  chemically treated genomic DNA (Homo sapiens) CpG-island No: 8462
tccaaactcaaaaccgaataaacacctaatacaatcaccgacttaaaaaacgcgtaaatatctataactataactcgaaaatcctaatttcttctcgtaaaacttaaccctactaaaaatacgacgcatcccaaatccgatcgaaataaattttatacaccgccgctccatctcgcgaaaactttatctatattaaaaataataacgaacgcgaactacgcgctaatactctaaacaaaacgaaaaaaccgaacgaaaactcgccaaacaacgccgcttcttattctaaacgcgataaaaaaaaacgctttctaacgaaccacattttactatataaacccaaaactcgcctctaaaaccccgcgttcaaaaacgaaatcaaataaccccaaaacgacgacgacttaccgaaaactcgcgaactccgcacccgacgccctctcccaacgcgacctcctactcgcgccgcgaaaccccttcgtcgaatattttacccaccgaaaaaatcgtaccgat

SEQ ID NO: 8463 - DNA, 516 bp, Artificial Sequence
  chemically treated genomic DNA (Homo sapiens) CpG-island No: 8463
tttaggtttagaatcgggtgggtatttggtgtagttatcggtttaggggacgcgtgggtgtttatggttgtgattcgggggttttggttttttttcgtggaatttaattttattaggggtgcggcgtattttagattcgatcggagtgggttttgtatatcgtcgttttatttcgcgggggttttgtttgtgttgggggtggtggcgggcgcgggttgcgcgttggtgttttgggtagggcggggaggtcgggcgaggattcgttaggtagcgtcgttttttgttttgggcgcggtgaggaaggacgttttttaacgggttatattttgttgtgtagatttaaaattcgtttttgaggtttcgcgtttaggagcggggttaggtggttttagggcggcggcggtttgtcggagattcgcgagtttcgtattcgacgtttttttttaacgcggttttttgttcgcgtcgcggaattttttcgtcgggtgttttatttatcggaggggtcgtgtcggt

SEQ ID NO: 8464 - DNA, 516 bp, Artificial Sequence
  chemically treated genomic DNA (Homo sapiens) CpG-island No: 8464
accgacacgacccctccgataaataaaacacccgacgaaaaaattccgcgacgcgaacaaaaaaccgcgttaaaaaaaaacgtcgaatacgaaactcgcgaatctccgacaaaccgccgccgccctaaaaccacctaaccccgctcctaaacgcgaaacctcaaaaacgaattttaaatctacacaacaaaatataacccgttaaaaaacgtccttcctcaccgcgcccaaaacaaaaaacgacgctacctaacgaatcctcgcccgacctccccgccctacccaaaacaccaacgcgcaacccgcgcccgccaccacccccaacacaaacaaaacccccgcgaaataaaacgacgatatacaaaacccactccgatcgaatctaaaatacgccgcacccctaataaaattaaattccacgaaaaaaaaccaaaacccccgaatcacaaccataaacacccacgcgtcccctaaaccgataactacaccaaatacccacccgattctaaacctaaa

SEQ ID NO: 8465 - DNA, 737 bp, Artificial Sequence
  chemically treated genomic DNA (Homo sapiens) CpG-island No: 8465
tttcgcgcgttgaatggaagaaatttcgttcgggtatttcggaaggaaagtttcgagtttattcgttttggagtcgatattaatcgttaggggttttttaggttcgtttcgggaaatggtttttttaggcgagtgcgaggcgggtttttcggtttcgatgtagcgtattaatgtcggtaaggcggggattaggtttaggggatttcggtcgtttcgaggtcgcggagattttaaggttacggaaggattcgcgttttcgtagttcgtacgtcgggaagcgtgtagagttttcggcggggtttcgagttcgttggttagagcgtggagcggcggggtgggagggacgtggtttttagagcgcggggttatcgtagggtttttgattgggagggagggaagggtcggttcgacggggttttagtagtttttcgcgcgtagtcgttcggtttttttttcgtttagttgggagtcgttagttttgggcgttcgaagatagcgggtgttcggggtagtttttaggggtgcgggcgagggcgtagggcggtttagatagttttcgcgtggaaggcgttcgtttagattcgcgacgtttcggatttttaggttttcgtatttcgtgttcgaggtttcgggacgcgtaggatagtggagtcgtggtcgtcgtttgtttttattattttgcgttcgggagcgggggcggggcgtcgtcggggacgtgcgacgaggagttcgacgcg

SEQ ID NO: 8466 - DNA, 737 bp, Artificial Sequence
  chemically treated genomic DNA (Homo sapiens) CpG-island No: 8466
cgcgtcgaactcctcgtcgcacgtccccgacgacgccccgcccccgctcccgaacgcaaaataataaaaacaaacgacgaccacgactccactatcctacgcgtcccgaaacctcgaacacgaaatacgaaaacctaaaaatccgaaacgtcgcgaatctaaacgaacgccttccacgcgaaaactatctaaaccgccctacgccctcgcccgcacccctaaaaactaccccgaacacccgctatcttcgaacgcccaaaactaacgactcccaactaaacgaaaaaaaaaccgaacgactacgcgcgaaaaactactaaaaccccgtcgaaccgacccttccctccctcccaatcaaaaaccctacgataaccccgcgctctaaaaaccacgtccctcccaccccgccgctccacgctctaaccaacgaactcgaaaccccgccgaaaactctacacgcttcccgacgtacgaactacgaaaacgcgaatccttccgtaaccttaaaatctccgcgacctcgaaacgaccgaaatcccctaaacctaatccccgccttaccgacattaatacgctacatcgaaaccgaaaaacccgcctcgcactcgcctaaaaaaaccatttcccgaaacgaacctaaaaaacccctaacgattaatatcgactccaaaacgaataaactcgaaactttccttccgaaatacccgaacgaaatttcttccattcaacgcgcgaaa

SEQ ID NO: 8467 - DNA, 737 bp, Artificial Sequence
  chemically treated genomic DNA (Homo sapiens) CpG-island No: 8467
cgcgtcgggtttttcgtcgtacgttttcggcggcgtttcgttttcgttttcggacgtaagatggtgggagtaagcggcggttacggttttattgttttgcgcgtttcggagtttcggatacggggtgcgggggtttgggggttcgagacgtcgcggatttagacgggcgttttttacgcgggaattgtttgggtcgttttgcgttttcgttcgtatttttgggggttgtttcgggtattcgttattttcggacgtttagggttggcggtttttagttggacggggagggagtcgagcggttgcgcgcggggaattgttgggatttcgtcgggtcgattttttttttttttttaattaggggttttacggtggtttcgcgttttggggattacgttttttttatttcgtcgttttacgttttgattagcgggttcgggatttcgtcgaggattttgtacgtttttcggcgtgcgggttgcggagacgcgggttttttcgtggttttggggttttcgcgatttcgaggcgatcgaggttttttaggtttagttttcgttttgtcggtattagtgcgttgtatcggaatcgaggggttcgtttcgtattcgtttaagaaaattatttttcgggacgggtttggaaagtttttggcggttggtatcggttttagggcgaatggattcgaggtttttttttcgagatgttcgggcgggattttttttatttagcgcgcggag

SEQ ID NO: 8468 - DNA, 737 bp, Artificial Sequence
  chemically treated genomic DNA (Homo sapiens) CpG-island No: 8468
ctccgcgcgctaaataaaaaaaatcccgcccgaacatctcgaaaaaaaaacctcgaatccattcgccctaaaaccgataccaaccgccaaaaactttccaaacccgtcccgaaaaataattttcttaaacgaatacgaaacgaacccctcgattccgatacaacgcactaataccgacaaaacgaaaactaaacctaaaaaacctcgatcgcctcgaaatcgcgaaaaccccaaaaccacgaaaaaacccgcgtctccgcaacccgcacgccgaaaaacgtacaaaatcctcgacgaaatcccgaacccgctaatcaaaacgtaaaacgacgaaataaaaaaaacgtaatccccaaaacgcgaaaccaccgtaaaacccctaattaaaaaaaaaaaaaaaatcgacccgacgaaatcccaacaattccccgcgcgcaaccgctcgactccctccccgtccaactaaaaaccgccaaccctaaacgtccgaaaataacgaatacccgaaacaacccccaaaaatacgaacgaaaacgcaaaacgacccaaacaattcccgcgtaaaaaacgcccgtctaaatccgcgacgtctcgaacccccaaacccccgcaccccgtatccgaaactccgaaacgcgcaaaacaataaaaccgtaaccgccgcttactcccaccatcttacgtccgaaaacgaaaacgaaacgccgccgaaaacgtacgacgaaaaacccgacgcg

SEQ ID NO: 8469 - DNA, 743 bp, Artificial Sequence
  chemically treated genomic DNA (Homo sapiens) CpG-island No: 8469
ggtttcgatcgaggatttggagatttcggggttttcggtcgtttgttttatagtttacgaggcggatcgatttgcggggtgaggatcgggagcgtatggtagtttcggtttcggttttttggcgtttttttagtacgcggtgaatgtttgagaggatagaggttcgcggttttttttatttttcggtagcgatcgtaaagttcgggagttgagttcgcggcgtgaagcggcgaggttagtagcgagggggtagggtcggcgttggcggttacggagtttggcgtcgttgggttcggaatttagggacgcgagttagcgttgggagttggggagagacggttttgttattcggtttaggtagtgggcgttcgtttcgttttagcgtttacgcgatttcggtttcgaggttttttcgagcgtagcgttcggaagcgtcgtcgttaagcgtttgcgtttgcgtttgcgttgattttagttcggattcggttcgaggcgcgtagttcggagggggcggggtcgagttcgagggaaggtagtgcgtatgcgcggggcgagtcggtcggtattgttatagtgagcggtcgcgagatcggtttttgttcgtagggtcgggtagtggtttttcggggatagcgtgtgaggattcgggcgcgaaggacggggttagatttattaggtgtttattttttttacggttacgattttggtttagaattgtttttttcgggttttagtttttttat

SEQ ID NO: 8470 - DNA, 743 bp, Artificial Sequence
  chemically treated genomic DNA (Homo sapiens) CpG-island No: 8470
ataaaaaaactaaaacccgaaaaaaacaattctaaaccaaaatcgtaaccgtaaaaaaaataaacacctaataaatctaaccccgtccttcgcgcccgaatcctcacacgctatccccgaaaaaccactacccgaccctacgaacaaaaaccgatctcgcgaccgctcactataacaataccgaccgactcgccccgcgcatacgcactaccttccctcgaactcgaccccgccccctccgaactacgcgcctcgaaccgaatccgaactaaaatcaacgcaaacgcaaacgcaaacgcttaacgacgacgcttccgaacgctacgctcgaaaaaacctcgaaaccgaaatcgcgtaaacgctaaaacgaaacgaacgcccactacctaaaccgaataacaaaaccgtctctccccaactcccaacgctaactcgcgtccctaaattccgaacccaacgacgccaaactccgtaaccgccaacgccgaccctaccccctcgctactaacctcgccgcttcacgccgcgaactcaactcccgaactttacgatcgctaccgaaaaataaaaaaaaccgcgaacctctatcctctcaaacattcaccgcgtactaaaaaaacgccaaaaaaccgaaaccgaaactaccatacgctcccgatcctcaccccgcaaatcgatccgcctcgtaaactataaaacaaacgaccgaaaaccccgaaatctccaaatcctcgatcgaaacc

SEQ ID NO: 8471 - DNA, 743 bp, Artificial Sequence
  chemically treated genomic DNA (Homo sapiens) CpG-island No: 8471
gtggggaaattgaggttcggggagggtagttttggattagggtcgtgatcgtggggaaagtgggtatttggtgaatttgatttcgtttttcgcgttcgaatttttatacgttgttttcgaggggttattattcgattttgcggatagggatcgatttcgcggtcgtttattgtgatagtgtcggtcggttcgtttcgcgtatgcgtattgttttttttcgggttcggtttcgtttttttcgggttgcgcgtttcggatcgagttcggattggggttagcgtaggcgtagacgtagacgtttagcggcggcgttttcgaacgttgcgttcgggagagtttcggggtcggagtcgcgtgggcgttggggcggggcgggcgtttattgtttgagtcggatggtagagtcgtttttttttagtttttagcgttggttcgcgtttttgggtttcgagtttagcgacgttaagtttcgtggtcgttagcgtcggttttgttttttcgttgttgatttcgtcgttttacgtcgcggatttagttttcgggttttgcggtcgttgtcgggggatggggagggtcgcgaatttttgtttttttaggtatttatcgcgtgttgggagggcgttaggaggtcgaggtcggggttgttatgcgttttcggtttttatttcgtaggtcggttcgtttcgtgggttgtggggtagacgatcggaagtttcgagatttttagattttcgatcgggatt

SEQ ID NO: 8472 - DNA, 743 bp, Artificial Sequence
  chemically treated genomic DNA (Homo sapiens) CpG-island No: 8472
aatcccgatcgaaaatctaaaaatctcgaaacttccgatcgtctaccccacaacccacgaaacgaaccgacctacgaaataaaaaccgaaaacgcataacaaccccgacctcgacctcctaacgccctcccaacacgcgataaatacctaaaaaaacaaaaattcgcgaccctccccatcccccgacaacgaccgcaaaacccgaaaactaaatccgcgacgtaaaacgacgaaatcaacaacgaaaaaacaaaaccgacgctaacgaccacgaaacttaacgtcgctaaactcgaaacccaaaaacgcgaaccaacgctaaaaactaaaaaaaaacgactctaccatccgactcaaacaataaacgcccgccccgccccaacgcccacgcgactccgaccccgaaactctcccgaacgcaacgttcgaaaacgccgccgctaaacgtctacgtctacgcctacgctaaccccaatccgaactcgatccgaaacgcgcaacccgaaaaaaacgaaaccgaacccgaaaaaaaacaatacgcatacgcgaaacgaaccgaccgacactatcacaataaacgaccgcgaaatcgatccctatccgcaaaatcgaataataacccctcgaaaacaacgtataaaaattcgaacgcgaaaaacgaaatcaaattcaccaaatacccactttccccacgatcacgaccctaatccaaaactaccctccccgaacctcaatttccccac

SEQ ID NO: 8473 - DNA, 587 bp, Artificial Sequence
  chemically treated genomic DNA (Homo sapiens) CpG-island No: 8473
attatagttttcgcgaggtcgcgcgtagaggttcgtttattttagagggttgtagagttacgtttaggtttcgttagtaaatagcgttcgggtcgggcgggcgagcgagcggtagttaacgtgtttcgggtcgcggcgttttatcggtcgcgcgggtttttcggggttcgtttatttttaatatttatacggagtacgttttcgatttcgttgtagtttcgttttgtaaatacgtatagtttcggtttttcgtttttatttcgcgtcgggagtcgcggtatggttgtatgtagtcgttttagttatatttttacgcgcgtttcgggtttttagattttttggatggggacgattttagatttcgaggaaggaaggagaggaaggaagcgtcgtaggagggggaaagaggaagcgcgggggggaaggttattagtataagtatggtcgggattgttgtagaattacgtgggtttgtttgtaatttaaaacgtcgcgattcgttcgtattgtagcggataaaaagtggtcgggttatttggggtttttatgttttaaggaaggagggttttaggggcggcgtaggttta

SEQ ID NO: 8474 - DNA, 587 bp, Artificial Sequence
  chemically treated genomic DNA (Homo sapiens) CpG-island No: 8474
taaacctacgccgcccctaaaaccctccttccttaaaacataaaaaccccaaataacccgaccactttttatccgctacaatacgaacgaatcgcgacgttttaaattacaaacaaacccacgtaattctacaacaatcccgaccatacttatactaataaccttcccccccgcgcttcctctttccccctcctacgacgcttccttcctctccttccttcctcgaaatctaaaatcgtccccatccaaaaaatctaaaaacccgaaacgcgcgtaaaaatataactaaaacgactacatacaaccataccgcgactcccgacgcgaaataaaaacgaaaaaccgaaactatacgtatttacaaaacgaaactacaacgaaatcgaaaacgtactccgtataaatattaaaaataaacgaaccccgaaaaacccgcgcgaccgataaaacgccgcgacccgaaacacgttaactaccgctcgctcgcccgcccgacccgaacgctatttactaacgaaacctaaacgtaactctacaaccctctaaaataaacgaacctctacgcgcgacctcgcgaaaactataat

SEQ ID NO: 8475 - DNA, 587 bp, Artificial Sequence
  chemically treated genomic DNA (Homo sapiens) CpG-island No: 8475
tgggtttgcgtcgtttttgggattttttttttttggagtatgggggttttaagtggttcggttattttttgttcgttgtagtgcgggcgagtcgcgacgttttaaattgtaaatagatttacgtggttttgtagtagtttcggttatgtttgtgttggtggttttttttttcgcgtttttttttttttttttttgcggcgtttttttttttttttttttttttcgggatttgaggtcgtttttatttaaggggtttgggggttcggggcgcgcgtgggggtgtagttagggcggttatatgtagttatgtcgcggttttcggcgcggggtgggggcggggagtcgggattgtgcgtgtttgtagagcggggttgtagcggggtcgggggcgtgtttcgtgtgggtgttgggggtgggcggatttcgaggggttcgcgcggtcggtggggcgtcgcggttcggggtacgttggttgtcgttcgttcgttcgttcggttcgggcgttgtttattagcgaggtttggacgtgattttgtagttttttggagtaggcggatttttgcgcgcggtttcgcgggagttgtagt

SEQ ID NO: 8476 - DNA, 587 bp, Artificial Sequence
  chemically treated genomic DNA (Homo sapiens) CpG-island No: 8476
actacaactcccgcgaaaccgcgcgcaaaaatccgcctactccaaaaaactacaaaatcacgtccaaacctcgctaataaacaacgcccgaaccgaacgaacgaacgaacgacaaccaacgtaccccgaaccgcgacgccccaccgaccgcgcgaacccctcgaaatccgcccacccccaacacccacacgaaacacgcccccgaccccgctacaaccccgctctacaaacacgcacaatcccgactccccgcccccaccccgcgccgaaaaccgcgacataactacatataaccgccctaactacacccccacgcgcgccccgaacccccaaaccccttaaataaaaacgacctcaaatcccgaaaaaaaaaaaaaaaaaaaaaaacgccgcaaaaaaaaaaaaaaaaaaacgcgaaaaaaaaaaccaccaacacaaacataaccgaaactactacaaaaccacgtaaatctatttacaatttaaaacgtcgcgactcgcccgcactacaacgaacaaaaaataaccgaaccacttaaaacccccatactccaaaaaaaaaaaatcccaaaaacgacgcaaaccca

SEQ ID NO: 8477 - DNA, 574 bp, Artificial Sequence
  chemically treated genomic DNA (Homo sapiens) CpG-island No: 8477
agcgcggtcgtattttttcggtcggttgcgtgttgagtattagtattaggtaggttgggtggtagtgtagttggagaaagtggtagaggagtcggttcgcgtcgagttcgcgggcgtatattattagttcgttagtgtcgagtagttttagtattagttgtcgttcgtattttagtagcggcgttatggtaattcgtcgagtcggttgttttgattttatggaagttttttcgggtcgtagtcgaacgtagtcgaaggaagtcgatttttagtggagagtaggtcgaatttaatcgaagagagtcgagttcgagaggacggtagttagtcgaacgtagtcgaggagagttgagattgagatgatcgtgggtcgaacgtagtcgaagaggagtcgaggttacgataggcgcgtttttagaaagtcgaagagagtcgagtttgagaaggtaagcgttggtcgaatttagtcgaagaagagtcgagtggagtcgaagatttatggagttatttgtaggggttggcgttttttgtcggtgtagtttgtagatattaggttttatttacgttttttttg

SEQ ID NO: 8478 - DNA, 574 bp, Artificial Sequence
  chemically treated genomic DNA (Homo sapiens) CpG-island No: 8478
caaaaaaaacgtaaataaaacctaatatctacaaactacaccgacaaaaaacgccaacccctacaaataactccataaatcttcgactccactcgactcttcttcgactaaattcgaccaacgcttaccttctcaaactcgactctcttcgactttctaaaaacgcgcctatcgtaacctcgactcctcttcgactacgttcgacccacgatcatctcaatctcaactctcctcgactacgttcgactaactaccgtcctctcgaactcgactctcttcgattaaattcgacctactctccactaaaaatcgacttccttcgactacgttcgactacgacccgaaaaaacttccataaaatcaaaacaaccgactcgacgaattaccataacgccgctactaaaatacgaacgacaactaatactaaaactactcgacactaacgaactaataatatacgcccgcgaactcgacgcgaaccgactcctctaccactttctccaactacactaccacccaacctacctaatactaatactcaacacgcaaccgaccgaaaaaatacgaccgcgct

SEQ ID NO: 8479 - DNA, 574 bp, Artificial Sequence
  chemically treated genomic DNA (Homo sapiens) CpG-island No: 8479
taaaagagacgtgaatggagtttgatatttgtaagttatatcgatagggggcgttagtttttataggtgattttatgaattttcggttttattcggttttttttcggttgagttcggttaacgtttgtttttttaggttcggtttttttcggttttttgagagcgcgtttgtcgtggtttcggttttttttcggttgcgttcggtttacgattattttagttttagtttttttcggttacgttcggttggttgtcgttttttcggattcggtttttttcggttgagttcggtttattttttattaggagtcggtttttttcggttgcgttcggttgcgattcggaagagtttttatggagttagggtagtcggttcgacggattgttatggcgtcgttgttggagtacgagcgatagttggtgttggaattgttcgatattgacgggttagtagtgtgcgttcgcgggttcggcgcggatcggtttttttattattttttttagttgtattgttatttagtttgtttggtgttggtgtttaatacgtagtcggtcgaggaggtgcggtcgcgtt

SEQ ID NO: 8480 - DNA, 574 bp, Artificial Sequence
  chemically treated genomic DNA (Homo sapiens) CpG-island No: 8480
aacgcgaccgcacctcctcgaccgactacgtattaaacaccaacaccaaacaaactaaataacaatacaactaaaaaaaataataaaaaaaccgatccgcgccgaacccgcgaacgcacactactaacccgtcaatatcgaacaattccaacaccaactatcgctcgtactccaacaacgacgccataacaatccgtcgaaccgactaccctaactccataaaaactcttccgaatcgcaaccgaacgcaaccgaaaaaaaccgactcctaataaaaaataaaccgaactcaaccgaaaaaaaccgaatccgaaaaaacgacaaccaaccgaacgtaaccgaaaaaaactaaaactaaaataatcgtaaaccgaacgcaaccgaaaaaaaaccgaaaccacgacaaacgcgctctcaaaaaaccgaaaaaaaccgaacctaaaaaaacaaacgttaaccgaactcaaccgaaaaaaaaccgaataaaaccgaaaattcataaaatcacctataaaaactaacgccccctatcgatataacttacaaatatcaaactccattcacgtctctttta

SEQ ID NO: 8481 - DNA, 758 bp, Artificial Sequence
  chemically treated genomic DNA (Homo sapiens) CpG-island No: 8481
ggggagcgcggaggggggggggggcgggaagagagaggagagagagggacgagtaagtagagcgagcgtacgaataggggataggcggtagcggggaggagattggatgaatgaatatgtgagagaggggggggcgtgagtgtggtggatggggagtggcgagacggtgtagagagtcgagtgaaggtgagagtggtggagtgatgttagttaaagagggggaggtaggatgtgagcggatagtagttgggagaggagagtaggagtagtcgtagcgttgcgggttttgtagggagtgcggagacgagtggaggtagagtgtagggggacgacgggcgttatgacgtcgtagggaggggttgagagtaggatgcgtagcgtgcgagttgagacgtaagcggagagagaggatagttaggatttgatggataggagtgagatagagtagaattggggagtgtgtcgagtaggagtgaacgatgaggggttgcgggcgagatagcgagagcgacgcgagcgatcgatagtagcgagtagtgagttcgttgtagttgcgatagtagtagtagaatgcgagtgagacgattgcggagcggaggttagtgaggtacggacgtgaagtggagataatggaagcgataggatagaggtacgtagtgtggagtagagaagaaagcgagcgaatatttatgaagagtagagcgagagattcgagagattagagtggtagagatagagtaggataaacgagtttaacg

SEQ ID NO: 8482 - DNA, 758 bp, Artificial Sequence
  chemically treated genomic DNA (Homo sapiens) CpG-island No: 8482
cgttaaactcgtttatcctactctatctctaccactctaatctctcgaatctctcgctctactcttcataaatattcgctcgctttcttctctactccacactacgtacctctatcctatcgcttccattatctccacttcacgtccgtacctcactaacctccgctccgcaatcgtctcactcgcattctactactactatcgcaactacaacgaactcactactcgctactatcgatcgctcgcgtcgctctcgctatctcgcccgcaacccctcatcgttcactcctactcgacacactccccaattctactctatctcactcctatccatcaaatcctaactatcctctctctccgcttacgtctcaactcgcacgctacgcatcctactctcaacccctccctacgacgtcataacgcccgtcgtccccctacactctacctccactcgtctccgcactccctacaaaacccgcaacgctacgactactcctactctcctctcccaactactatccgctcacatcctacctccccctctttaactaacatcactccaccactctcaccttcactcgactctctacaccgtctcgccactccccatccaccacactcacgcccccccctctctcacatattcattcatccaatctcctccccgctaccgcctatcccctattcgtacgctcgctctacttactcgtccctctctctcctctctcttcccgcccccccccccctccgcgctcccc

SEQ ID NO: 8483 - DNA, 758 bp, Artificial Sequence
  chemically treated genomic DNA (Homo sapiens) CpG-island No: 8483
cgttggattcgtttgttttgttttatttttgttattttgatttttcgagtttttcgttttattttttatgagtattcgttcgtttttttttttgttttatattgcgtgtttttgttttgtcgtttttattatttttattttacgttcgtattttattgattttcgtttcgtagtcgttttattcgtattttgttgttattatcgtagttgtagcgggtttattgttcgttgttgtcgatcgttcgcgtcgttttcgttgtttcgttcgtagttttttatcgtttatttttgttcgatatattttttagttttattttattttatttttatttattagattttagttgtttttttttttcgtttgcgttttagttcgtacgttgcgtattttatttttaatttttttttacgacgttatgacgttcgtcgtttttttatattttatttttattcgttttcgtattttttgtagagttcgtaacgttacgattatttttattttttttttttagttattattcgtttatattttgtttttttttttttaattagtattattttattatttttatttttattcgattttttatatcgtttcgttattttttatttattatatttacgttttttttttttttatatatttatttatttagtttttttttcgttgtcgtttgttttttgttcgtgcgttcgttttatttattcgtttttttttttttttttttttttcgttttttttttttttcgcgtttttt

SEQ ID NO: 8484 - DNA, 758 bp, Artificial Sequence
  chemically treated genomic DNA (Homo sapiens) CpG-island No: 8484
aaaaaacgcgaaaaaaaaaaaaaacgaaaaaaaaaaaaaaaaaaaaaaacgaataaataaaacgaacgcacgaacaaaaaacaaacgacaacgaaaaaaaaactaaataaataaatatataaaaaaaaaaaaaacgtaaatataataaataaaaaataacgaaacgatataaaaaatcgaataaaaataaaaataataaaataatactaattaaaaaaaaaaaaacaaaatataaacgaataataactaaaaaaaaaaaataaaaataatcgtaacgttacgaactctacaaaaaatacgaaaacgaataaaaataaaatataaaaaaacgacgaacgtcataacgtcgtaaaaaaaaattaaaaataaaatacgcaacgtacgaactaaaacgcaaacgaaaaaaaaaaacaactaaaatctaataaataaaaataaaataaaataaaactaaaaaatatatcgaacaaaaataaacgataaaaaactacgaacgaaacaacgaaaacgacgcgaacgatcgacaacaacgaacaataaacccgctacaactacgataataacaacaaaatacgaataaaacgactacgaaacgaaaatcaataaaatacgaacgtaaaataaaaataataaaaacgacaaaacaaaaacacgcaatataaaacaaaaaaaaaaacgaacgaatactcataaaaaataaaacgaaaaactcgaaaaatcaaaataacaaaaataaaacaaaacaaacgaatccaacg

SEQ ID NO: 8485 - DNA, 838 bp, Artificial Sequence
  chemically treated genomic DNA (Homo sapiens) CpG-island No: 8485
  misc_feature (292)..(292): n is either a, c, g or t
  misc_feature (463)..(463): n is either a, c, g or t
  misc_feature (564)..(564): n is either a, c, g or t
agagagcgattgaggatgagtcgatgcgcggtcgaatagatcggagttgaattagaagagtaattagacgaagcgtgtagatgcgcgagagttagatagtagagttatgcgagtagaagagcgcgagagtagttgagacgcgtaagcgagataatcgagtagcgagcgatagtaggagcgtgagaaggagagtattagataagcgacgatcggacgattaggttgacgttagtagtatttaagtacgagagcgtagatgacgaaatgtcgagcgtatgagtagacgttacgngtaagtatatagtatggatagagtacgcgaagtagagtagtgagtcgagtattgagagatgagatcgtagttatacgtatagtaggcgagcgagcgagagcgagcgtgtgtaggtagaggtagcgagggttagtaattgcggtatgagtggaagtgtcgttatgagatatngcgcgagttggcgcgttagcgcggtggtgggcggtcgagagacgtgagcgagtagagatataggatgagcgttgtagagcgttgagaacgcggagttgagnagagttgtgaacgttaggtaggagcgcgttcggtaggagaatagagagtgagtaagtttgagagtagtagcgtcgtagtatagtggcggtaggagcgtagttgtgagtatgataggtacgtatgagagttgtggacgtattgagaggagtgtagatgtagtggcgtacggagacgagagacgaagggagcgaatacgagaggagttgaatgtagtacgaagattgattagacggtcggatagtgagtagcggttgttgacgtagttagtagatt

SEQ ID NO: 8486 - DNA, 838 bp, Artificial Sequence
  chemically treated genomic DNA (Homo sapiens) CpG-island No: 8486
  misc_feature (275)..(275): n is either a, c, g or t
  misc_feature (376)..(376): n is either a, c, g or t
  misc_feature (547)..(547): n is either a, c, g or t
aatctactaactacgtcaacaaccgctactcactatccgaccgtctaatcaatcttcgtactacattcaactcctctcgtattcgctcccttcgtctctcgtctccgtacgccactacatctacactcctctcaatacgtccacaactctcatacgtacctatcatactcacaactacgctcctaccgccactatactacgacgctactactctcaaacttactcactctctattctcctaccgaacgcgctcctacctaacgttcacaactctnctcaactccgcgttctcaacgctctacaacgctcatcctatatctctactcgctcacgtctctcgaccgcccaccaccgcgctaacgcgccaactcgcgcnatatctcataacgacacttccactcataccgcaattactaaccctcgctacctctacctacacacgctcgctctcgctcgctcgcctactatacgtataactacgatctcatctctcaatactcgactcactactctacttcgcgtactctatccatactatatacttacncgtaacgtctactcatacgctcgacatttcgtcatctacgctctcgtacttaaatactactaacgtcaacctaatcgtccgatcgtcgcttatctaatactctccttctcacgctcctactatcgctcgctactcgattatctcgcttacgcgtctcaactactctcgcgctcttctactcgcataactctactatctaactctcgcgcatctacacgcttcgtctaattactcttctaattcaactccgatctattcgaccgcgcatcgactcatcctcaatcgctctct

SEQ ID NO: 8487 - DNA, 838 bp, Artificial Sequence
  chemically treated genomic DNA (Homo sapiens) CpG-island No: 8487
  misc_feature (275)..(275): n is either a, c, g or t
  misc_feature (376)..(376): n is either a, c, g or t
  misc_feature (547)..(547): n is either a, c, g or t
agtttgttagttgcgttagtagtcgttatttattattcgatcgtttagttagttttcgtattatatttagtttttttcgtgttcgtttttttcgtttttcgttttcgtacgttattgtatttgtattttttttagtacgtttatagtttttatgcgtgtttgttatgtttatagttacgtttttatcgttattatgttgcggcgttgttatttttagatttatttattttttgtttttttgtcgagcgcgtttttgtttggcgtttatagttttntttagtttcgcgtttttagcgttttatagcgtttattttgtatttttgttcgtttacgtttttcgatcgtttattatcgcgttgacgcgttaattcgcgtngtattttataacgatatttttatttatgtcgtagttgttagttttcgttgtttttatttgtatacgttcgttttcgttcgttcgtttgttgtacgtatgattgcggttttattttttagtgttcggtttattgttttgtttcgcgtattttgtttatgttgtgtgtttgtncgtagcgtttgtttatgcgttcgatatttcgttatttgcgttttcgtgtttgagtattgttagcgttagtttggtcgttcgatcgtcgtttatttaatatttttttttttacgtttttgttgtcgttcgttattcgattatttcgtttgcgcgttttagttgttttcgcgtttttttgttcgtatgattttattgtttgattttcgcgtatttgtacgtttcgtttggttatttttttggtttagtttcgatttgttcgatcgcgtatcggtttatttttagtcgtttttt

SEQ ID NO: 8488 - DNA, 838 bp, Artificial Sequence
  chemically treated genomic DNA (Homo sapiens) CpG-island No: 8488
  misc_feature (292)..(292): n is either a, c, g or t
  misc_feature (463)..(463): n is either a, c, g or t
  misc_feature (564)..(564): n is either a, c, g or t
aaaaaacgactaaaaataaaccgatacgcgatcgaacaaatcgaaactaaaccaaaaaaataaccaaacgaaacgtacaaatacgcgaaaatcaaacaataaaatcatacgaacaaaaaaacgcgaaaacaactaaaacgcgcaaacgaaataatcgaataacgaacgacaacaaaaacgtaaaaaaaaaaatattaaataaacgacgatcgaacgaccaaactaacgctaacaatactcaaacacgaaaacgcaaataacgaaatatcgaacgcataaacaaacgctacgnacaaacacacaacataaacaaaatacgcgaaacaaaacaataaaccgaacactaaaaaataaaaccgcaatcatacgtacaacaaacgaacgaacgaaaacgaacgtatacaaataaaaacaacgaaaactaacaactacgacataaataaaaatatcgttataaaatacnacgcgaattaacgcgtcaacgcgataataaacgatcgaaaaacgtaaacgaacaaaaatacaaaataaacgctataaaacgctaaaaacgcgaaactaaanaaaactataaacgccaaacaaaaacgcgctcgacaaaaaaacaaaaaataaataaatctaaaaataacaacgccgcaacataataacgataaaaacgtaactataaacataacaaacacgcataaaaactataaacgtactaaaaaaaatacaaatacaataacgtacgaaaacgaaaaacgaaaaaaacgaacacgaaaaaaactaaatataatacgaaaactaactaaacgatcgaataataaataacgactactaacgcaactaacaaact

SEQ ID NO: 8489 - DNA, 918 bp, Artificial Sequence
  chemically treated genomic DNA (Homo sapiens) CpG-island No: 8489
tcgatagtcgagagattagtaggaggacgcgggcgggggtcgttttcgtcgttacggggtgttttttttttttcgtataagttcggttatttggtttttttttcggtttcggtcgttttaggtacgcgggcgtagtttttagcgggcgcggggagggtgttatgtcgttggcgtcgttattagtcggtttcgttgtattttattggggttttggcgttcgcggtttcgtattttgttgtagggttcggcgcgggcgtttgtttgtttttattgttcgcgtcgggaaagttaagtttgttcgcggggaagggatcgttgggttagggttcggtagggttatttcggttaaggttaggattcgaggagaggttgggacgtcgaggttcgtggtcggggtttacggtggggatcggagtgattcggttggtacgcggggcgttacgtagaagcgttcgggtcgagttcgtagttcgcgttcggtttcgaaattttgtaggcgtcgtttttgggtttaggatttcgagcggtttcggcggagttaggcgagcgcggtttttcggttcgggttcggtgtttttggtttcgggttggggcgtcgggtaggtatttttagtatttttttttcgcggttttgcggggaaatttgcgttttttcgttgtagtttaaagggttcgttgcgtttcgtttggttttggttttttcggggttcgtcgtatgtgaggttggggaggaaggaattagggtacgattcgattttaggtagtttgcggcgttgtttgtgcgtagtcggtcgcggtttagagtgagcggttcggggtattcgtttgaacgtgtttaggggtttgagggttaatgaacggagcgtcgttgagggttatataggttggatttagtgttttatttatgttcgttttagt

SEQ ID NO: 8490 - DNA, 918 bp, Artificial Sequence
  chemically treated genomic DNA (Homo sapiens) CpG-island No: 8490
actaaaacgaacataaataaaacactaaatccaacctatataaccctcaacgacgctccgttcattaaccctcaaacccctaaacacgttcaaacgaataccccgaaccgctcactctaaaccgcgaccgactacgcacaaacaacgccgcaaactacctaaaatcgaatcgtaccctaattccttcctccccaacctcacatacgacgaaccccgaaaaaaccaaaaccaaacgaaacgcaacgaaccctttaaactacaacgaaaaaacgcaaatttccccgcaaaaccgcgaaaaaaaaatactaaaaatacctacccgacgccccaacccgaaaccaaaaacaccgaacccgaaccgaaaaaccgcgctcgcctaactccgccgaaaccgctcgaaatcctaaacccaaaaacgacgcctacaaaatttcgaaaccgaacgcgaactacgaactcgacccgaacgcttctacgtaacgccccgcgtaccaaccgaatcactccgatccccaccgtaaaccccgaccacgaacctcgacgtcccaacctctcctcgaatcctaaccttaaccgaaataaccctaccgaaccctaacccaacgatcccttccccgcgaacaaacttaactttcccgacgcgaacaataaaaacaaacaaacgcccgcgccgaaccctacaacaaaatacgaaaccgcgaacgccaaaaccccaataaaatacaacgaaaccgactaataacgacgccaacgacataacaccctccccgcgcccgctaaaaactacgcccgcgtacctaaaacgaccgaaaccgaaaaaaaaaccaaataaccgaacttatacgaaaaaaaaaaaacaccccgtaacgacgaaaacgacccccgcccgcgtcctcctactaatctctcgactatcga

SEQ ID NO: 8491 - DNA, 918 bp, Artificial Sequence
  chemically treated genomic DNA (Homo sapiens) CpG-island No: 8491
gttggggcgggtataggtgagatattgggtttagtttatgtagtttttaacgacgtttcgtttattggtttttaaatttttagatacgtttaagcgggtatttcgggtcgtttattttggatcgcggtcggttacgtataagtagcgtcgtaggttgtttggagtcgggtcgtgttttgatttttttttttttagttttatatgcggcggatttcggggaagttagggttaggcgaagcgtagcgggttttttgggttgtagcgaggagacgtaagttttttcgtaaagtcgcggggaggaggtgttgagaatgtttgttcggcgttttaattcggagttaagggtatcgggttcgggtcgaggggtcgcgttcgtttggtttcgtcggggtcgttcggggttttgaatttaagaacggcgtttgtaggatttcggagtcgggcgcgagttgcgggttcggttcgagcgtttttgcgtggcgtttcgcgtgttaatcgggttatttcggtttttatcgtagatttcggttacgagtttcggcgttttagttttttttcgagttttggttttggtcggggtagttttgtcgagttttggtttagcggtttttttttcgcgggtaaatttggttttttcggcgcgggtagtaaggataagtaagcgttcgcgtcgggttttgtagtaagatgcggggtcgcgggcgttaggattttagtggggtgtagcgggatcggttggtggcggcgttagcgatatggtatttttttcgcgttcgttgggagttgcgttcgcgtatttgagacggtcggggtcgaggggaagattaggtggtcggatttgtgcgggagggagggagtatttcgtggcggcggaggcgattttcgttcgcgtttttttgttggtttttcggttgtcgg

SEQ ID NO: 8492 - DNA, 918 bp, Artificial Sequence
  chemically treated genomic DNA (Homo sapiens) CpG-island No: 8492
ccgacaaccgaaaaaccaacaaaaaaacgcgaacgaaaatcgcctccgccgccacgaaatactccctccctcccgcacaaatccgaccacctaatcttcccctcgaccccgaccgtctcaaatacgcgaacgcaactcccaacgaacgcgaaaaaaataccatatcgctaacgccgccaccaaccgatcccgctacaccccactaaaatcctaacgcccgcgaccccgcatcttactacaaaacccgacgcgaacgcttacttatccttactacccgcgccgaaaaaaccaaatttacccgcgaaaaaaaaaccgctaaaccaaaactcgacaaaactaccccgaccaaaaccaaaactcgaaaaaaaactaaaacgccgaaactcgtaaccgaaatctacgataaaaaccgaaataacccgattaacacgcgaaacgccacgcaaaaacgctcgaaccgaacccgcaactcgcgcccgactccgaaatcctacaaacgccgttcttaaattcaaaaccccgaacgaccccgacgaaaccaaacgaacgcgacccctcgacccgaacccgatacccttaactccgaattaaaacgccgaacaaacattctcaacacctcctccccgcgactttacgaaaaaacttacgtctcctcgctacaacccaaaaaacccgctacgcttcgcctaaccctaacttccccgaaatccgccgcatataaaactaaaaaaaaaaaaatcaaaacacgacccgactccaaacaacctacgacgctacttatacgtaaccgaccgcgatccaaaataaacgacccgaaatacccgcttaaacgtatctaaaaatttaaaaaccaataaacgaaacgtcgttaaaaactacataaactaaacccaatatctcacctatacccgccccaac

SEQ ID NO: 8493 - DNA, 725 bp, Artificial Sequence
  chemically treated genomic DNA (Homo sapiens) CpG-island No: 8493
gcgagtcgcgcgggggtagggtcgcgtgttgatggggtgggtggcggcggggtgggtttaatgttacgttttggcgttcgtcgttcgtgtttttttttttagtcggttttcgtaaaatgttagttattgattttggaaaacggggtcggagaaggttggttttttttgcggtcgggtttttttttcgttcgggagtttggcggttttaatatcgcggttagtgcggggtaagttttagattcggtcggtaaggatgtaggggtagggagtaaggttcggttgcgagtgcgcgcgtagttttttttttgagcgtttttcgtagcgcgcggggaggcgggagttgcggggtcggagggcgggggttaaaaatattcggtagcggcggcggcggcgcggatattgttggggtatgttgggttgtggggttgcgggggatgcgggtcggggaggtcgggtcgggcggggtcgggtttcgttgatcgttatgttgattttttttttcgtgtcggggggttttttttggttattcgtaggtaagtgttcgttttgttcgcgttcgcggatttttatttttcgtaggttatgaggttttcgttcgaggtggaggtgttatattttcgcggtcgtcgagtttttattttttgttgttgagttgtttcgttaaggtttttagggtcgtttaagtatatttttcgtttttagttttcgcgggtttcgggtcgggt

SEQ ID NO: 8494 - DNA, 725 bp, Artificial Sequence
  chemically treated genomic DNA (Homo sapiens) CpG-island No: 8494
acccgacccgaaacccgcgaaaactaaaaacgaaaaatatacttaaacgaccctaaaaaccttaacgaaacaactcaacaacaaaaaataaaaactcgacgaccgcgaaaatataacacctccacctcgaacgaaaacctcataacctacgaaaaataaaaatccgcgaacgcgaacaaaacgaacacttacctacgaataaccaaaaaaaaccccccgacacgaaaaaaaaaatcaacataacgatcaacgaaacccgaccccgcccgacccgacctccccgacccgcatcccccgcaaccccacaacccaacataccccaacaatatccgcgccgccgccgccgctaccgaatatttttaacccccgccctccgaccccgcaactcccgcctccccgcgcgctacgaaaaacgctcaaaaaaaaaactacgcgcgcactcgcaaccgaaccttactccctacccctacatccttaccgaccgaatctaaaacttaccccgcactaaccgcgatattaaaaccgccaaactcccgaacgaaaaaaaaacccgaccgcaaaaaaaaccaaccttctccgaccccgttttccaaaatcaataactaacattttacgaaaaccgactaaaaaaaaaaacacgaacgacgaacgccaaaacgtaacattaaacccaccccgccgccacccaccccatcaacacgcgaccctacccccgcgcgactcgc

SEQ ID NO: 8495 - DNA, 725 bp, Artificial Sequence
  chemically treated genomic DNA (Homo sapiens) CpG-island No: 8495
attcggttcggagttcgcgagaattgggggcggagggtgtatttaggcggttttggggattttgacgggatagtttagtagtaggggatgggggttcggcggtcgcggagatgtaatatttttatttcgggcgaagattttatagtttgcgggagatgggagttcgcggacgcggataggacgggtatttatttacgaatagttagagggagtttttcgatacgaggaagaaggttagtatggcggttagcggggttcggtttcgttcggttcggttttttcgattcgtatttttcgtagttttatagtttaatatgttttagtagtattcgcgtcgtcgtcgtcgttgtcgggtatttttagttttcgtttttcggtttcgtaattttcgttttttcgcgcgttgcggaaaacgtttaaggggaaggttgcgcgcgtattcgtaatcgagttttattttttgtttttgtatttttgtcggtcgggtttggggtttgtttcgtattgatcgcggtgttggaatcgttaagttttcgggcgggggaggggttcggtcgtagagagaattagtttttttcggtttcgttttttaaagttagtaattggtattttgcggaaatcggttggaagggggagtacgggcgacgagcgttagagcgtgatattgagtttatttcgtcgttatttattttattaatacgcgattttgttttcgcgcgattcgt

SEQ ID NO: 8496 - DNA, 725 bp, Artificial Sequence
  chemically treated genomic DNA (Homo sapiens) CpG-island No: 8496
acgaatcgcgcgaaaacaaaatcgcgtattaataaaataaataacgacgaaataaactcaatatcacgctctaacgctcgtcgcccgtactcccccttccaaccgatttccgcaaaataccaattactaactttaaaaaacgaaaccgaaaaaaactaattctctctacgaccgaacccctcccccgcccgaaaacttaacgattccaacaccgcgatcaatacgaaacaaaccccaaacccgaccgacaaaaatacaaaaacaaaaaataaaactcgattacgaatacgcgcgcaaccttccccttaaacgttttccgcaacgcgcgaaaaaacgaaaattacgaaaccgaaaaacgaaaactaaaaatacccgacaacgacgacgacgacgcgaatactactaaaacatattaaactataaaactacgaaaaatacgaatcgaaaaaaccgaaccgaacgaaaccgaaccccgctaaccgccatactaaccttcttcctcgtatcgaaaaactccctctaactattcgtaaataaatacccgtcctatccgcgtccgcgaactcccatctcccgcaaactataaaatcttcgcccgaaataaaaatattacatctccgcgaccgccgaacccccatcccctactactaaactatcccgtcaaaatccccaaaaccgcctaaatacaccctccgcccccaattctcgcgaactccgaaccgaat

SEQ ID NO: 8497 - DNA, 610 bp, Artificial Sequence
  chemically treated genomic DNA (Homo sapiens) CpG-island No: 8497
  misc_feature (89)..(89): n is either a, c, g or t
  misc_feature (111)..(111): n is either a, c, g or t
tcggtacgtaatatatattacgttcgatcgattaaaatagcgatttattatagattaagagtttattatatagttttaatttatatttngatattgtatattttttcgganatatttttttcgatttttaagacggcgttcgttttattttggcgagtttaacggttttgattatgaagcggtttttaacgttatcgtcgataaattgattgcgatgggcgttggcgagcgtaaagtgaattatcgtttgcgcgattggggtgtttttcgttagcgttattggggcgcgtcgatttcgatggtgacgttggaagacggtatcgtaatgtcgatttcggacgattagttgtcggtgattttgtcggaagatgtggtaatggacggtattattagttcgattaaagtagattcggagtgggcgaaaattatcgttaacggtatgttagtattgcgtgaaatcgatattttcgatatttttatggagtttttttggtattatgcgcgttatatttgttcgtagtataaagaaggtatgttggatttcgaagcggttaattattggttgtcggtggatatttatattggtggtattgaatacgttattatgtat

SEQ ID NO: 8498 - DNA, 610 bp, Artificial Sequence
  chemically treated genomic DNA (Homo sapiens) CpG-island No: 8498
  misc_feature (500)..(500): n is either a, c, g or t
  misc_feature (522)..(522): n is either a, c, g or t
atacataataacgtattcaataccaccaatataaatatccaccgacaaccaataattaaccgcttcgaaatccaacataccttctttatactacgaacaaatataacgcgcataataccaaaaaaactccataaaaatatcgaaaatatcgatttcacgcaatactaacataccgttaacgataattttcgcccactccgaatctactttaatcgaactaataataccgtccattaccacatcttccgacaaaatcaccgacaactaatcgtccgaaatcgacattacgataccgtcttccaacgtcaccatcgaaatcgacgcgccccaataacgctaacgaaaaacaccccaatcgcgcaaacgataattcactttacgctcgccaacgcccatcgcaatcaatttatcgacgataacgttaaaaaccgcttcataatcaaaaccgttaaactcgccaaaataaaacgaacgccgtcttaaaaatcgaaaaaaatatntccgaaaaaatatacaatatcnaaatataaattaaaactatataataaactcttaatctataataaatcgctattttaatcgatcgaacgtaatatatattacgtaccga

SEQ ID NO: 8499 - DNA, 610 bp, Artificial Sequence
  chemically treated genomic DNA (Homo sapiens) CpG-island No: 8499
  misc_feature (500)..(500): n is either a, c, g or t
  misc_feature (522)..(522): n is either a, c, g or t
gtgtataatggcgtgtttaatattattaatgtagatatttatcggtagttagtagttagtcgtttcggaatttagtatattttttttgtattgcgggtaagtgtagcgcgtatagtattaggaggattttataaaggtgtcgaaagtgtcggttttacgtagtgttggtatatcgttaacggtagttttcgtttatttcggatttgttttaatcgggttggtaatgtcgtttattattatatttttcggtaggattatcggtagttggtcgttcggggtcggtattacggtatcgttttttagcgttattatcggaatcggcgcgttttagtaacgttgacgggaaatattttagtcgcgtaggcggtagtttattttacgttcgttaacgtttatcgtagttagtttatcggcgatggcgttgaaggtcgttttatggttaagatcgttgaattcgttagagtgaggcgggcgtcgttttgggggtcggaggaggtgtnttcggaagagtgtgtagtgttngagtgtgagttggggttgtgtggtgagtttttagtttgtggtagatcgttgttttggtcggtcgagcgtggtgtgtgttgcgtgtcgg

SEQ ID NO: 8500 - DNA, 610 bp, Artificial Sequence
  chemically treated genomic DNA (Homo sapiens) CpG-island No: 8500
  misc_feature (89)..(89): n is either a, c, g or t
  misc_feature (111)..(111): n is either a, c, g or t
ccgacacgcaacacacaccacgctcgaccgaccaaaacaacgatctaccacaaactaaaaactcaccacacaaccccaactcacactcnaacactacacactcttccgaanacacctcctccgacccccaaaacgacgcccgcctcactctaacgaattcaacgatcttaaccataaaacgaccttcaacgccatcgccgataaactaactacgataaacgttaacgaacgtaaaataaactaccgcctacgcgactaaaatatttcccgtcaacgttactaaaacgcgccgattccgataataacgctaaaaaacgataccgtaataccgaccccgaacgaccaactaccgataatcctaccgaaaaatataataataaacgacattaccaacccgattaaaacaaatccgaaataaacgaaaactaccgttaacgatataccaacactacgtaaaaccgacactttcgacacctttataaaatcctcctaatactatacgcgctacacttacccgcaatacaaaaaaaatatactaaattccgaaacgactaactactaactaccgataaatatctacattaataatattaaacacgccattatacac

SEQ ID NO: 8501 - DNA, 577 bp, Artificial Sequence
  chemically treated genomic DNA (Homo sapiens) CpG-island No: 8501
ttaacgttttatcgtttattcgtaggtttatcgtcgcgtttatttttttttattcgttcgttgcgtggtttcgtaggttgtcgttagtttattatcgtcgtgttttatgtttcgtaataatatcgatttattatttatttcgatagtatattttattagcgtttatatcgtattaatttgtcgtcgattttttttttttattcgttcgtatttattagtatattttcgttttatatcgtcgtagtaattagcgttatacgtatacgtttattaatttttacggagttttgtattagtttttttttatacgttattatttttattttattatttttttagtatatttattttttcgtcgacgttcgacgtattacgtttatttagatatagtaatataatatattatagtagttaatttatatttttataacgagttatacgcgattattattaattcgacgcgataatttttatattacgtatacgtttttttaagtatttatttaatatatttaattagacgattagatattatataatataagaatatatttatataatttattttagtagataa

SEQ ID NO: 8502 - DNA, 577 bp, Artificial Sequence
  chemically treated genomic DNA (Homo sapiens) CpG-island No: 8502
ttatctactaaaataaattatataaatatattcttatattatataatatctaatcgtctaattaaatatattaaataaatacttaaaaaaacgtatacgtaatataaaaattatcgcgtcgaattaataataatcgcgtataactcgttataaaaatataaattaactactataatatattatattactatatctaaataaacgtaatacgtcgaacgtcgacgaaaaaataaatatactaaaaaaataataaaataaaaataataacgtataaaaaaaaactaatacaaaactccgtaaaaattaataaacgtatacgtataacgctaattactacgacgatataaaacgaaaatatactaataaatacgaacgaataaaaaaaaaaaatcgacgacaaattaatacgatataaacgctaataaaatatactatcgaaataaataataaatcgatattattacgaaacataaaacacgacgataataaactaacgacaacctacgaaaccacgcaacgaacgaataaaaaaaaataaacgcgacgataaacctacgaataaacgataaaacgttaa

SEQ ID NO: 8503 - DNA, 577 bp, Artificial Sequence
  chemically treated genomic DNA (Homo sapiens) CpG-island No: 8503
ttatttgttgaagtagattgtgtaaatgtgtttttgtgttgtgtggtgtttggtcgtttggttgggtgtgttgggtgggtgtttgggggggcgtgtgcgtagtgtggaggttgtcgcgtcgggttggtggtagtcgcgtgtggttcgttgtggggatgtgggttggttgttgtggtgtgttgtgttgttgtgtttgggtgggcgtggtgcgtcgggcgtcggcggggaggtgggtgtgttgaggaggtggtgggatgggggtggtggcgtgtgggggggggttggtataggatttcgtgggggttggtgggcgtgtgcgtgtggcgttggttgttgcggcggtgtggagcgggagtgtattggtgagtgcggacgagtggggaggagaggtcggcggtaggttggtgcggtatgagcgttggtggagtgtgttgtcggggtaagtgatgagtcggtgttgttgcgaggtatggggtacggcggtggtgagttggcggtagtttgcggggttacgtagcgagcgggtggggaggggtgggcgcggcggtgagtttgcgggtgggcggtggggcgttga

SEQ ID NO: 8504 - DNA, 577 bp, Artificial Sequence
  chemically treated genomic DNA (Homo sapiens) CpG-island No: 8504
tcaacgccccaccgcccacccgcaaactcaccgccgcgcccacccctccccacccgctcgctacgtaaccccgcaaactaccgccaactcaccaccgccgtaccccatacctcgcaacaacaccgactcatcacttaccccgacaacacactccaccaacgctcataccgcaccaacctaccgccgacctctcctccccactcgtccgcactcaccaatacactcccgctccacaccgccgcaacaaccaacgccacacgcacacgcccaccaacccccacgaaatcctataccaacccccccccacacgccaccacccccatcccaccacctcctcaacacacccacctccccgccgacgcccgacgcaccacgcccacccaaacacaacaacacaacacaccacaacaaccaacccacatccccacaacgaaccacacgcgactaccaccaacccgacgcgacaacctccacactacgcacacgcccccccaaacacccacccaacacacccaaccaaacgaccaaacaccacacaacacaaaaacacatttacacaatctacttcaacaaataa

SEQ ID NO: 8505 - DNA, 842 bp, Artificial Sequence
  chemically treated genomic DNA (Homo sapiens) CpG-island No: 8505
  misc_feature (380)..(380): n is either a, c, g or t
tttcggtcgttagcgggtaaaggtttgagcgtcgtagttttagtcgttggagttgattagttttttttttttttttaacgtgttacgtatcgcgttatcgaaagcgattagtcgttgtgggatgagtgtacgtagcgcggtattattcgttagtagatcgtgttttagtttttgaattaacgttttggcggtggtgggcggtacggaagtaattatattgagaaattatatcgaaatttagcgggtggggagggggatggggattaattagcggcgtttatcgtttatcgttataaaatgttttaattgttgttgataattgagtatttttggttcggcggtttcgaagatgcggtgttcgttggtcggatgatttaatnacgtaattagatagtgtagtaagttttttagcgtaatgggcgtggtgcgtgaacgaatttagcgcggaggcgttaagattggtaggttgtagattatatcgcgtatgatttcgaacgtcgcggaatttgcgttaacgataatttcggttcgtagttcggttatcggttacgttggcgtagattttattattttcgtttttatgttgcgtatttcggtatgtatgtataacgttgaagagattaaagtgtatcgtttttttgtttgggttgcgtacggtatggatattgaaggttaggattatcgcgtttgttagaattacggttcgttgtataagcgttaatatattattttttgatgtgatgttcggtcgtttcggttatcgggtttgaataagtaagagtggttagtcggataagtaatgttattcggttatattgtaggagcgattatgaaataagaag

SEQ ID NO: 8506 - DNA, 842 bp, Artificial Sequence
  chemically treated genomic DNA (Homo sapiens) CpG-island No: 8506
  misc_feature (463)..(463): n is either a, c, g or t
cttcttatttcataatcgctcctacaatataaccgaataacattacttatccgactaaccactcttacttattcaaacccgataaccgaaacgaccgaacatcacatcaaaaaataatatattaacgcttatacaacgaaccgtaattctaacaaacgcgataatcctaaccttcaatatccataccgtacgcaacccaaacaaaaaaacgatacactttaatctcttcaacgttatacatacataccgaaatacgcaacataaaaacgaaaataataaaatctacgccaacgtaaccgataaccgaactacgaaccgaaattatcgttaacgcaaattccgcgacgttcgaaatcatacgcgatataatctacaacctaccaatcttaacgcctccgcgctaaattcgttcacgcaccacgcccattacgctaaaaaacttactacactatctaattacgtnattaaatcatccgaccaacgaacaccgcatcttcgaaaccgccgaaccaaaaatactcaattatcaacaacaattaaaacattttataacgataaacgataaacgccgctaattaatccccatccccctccccacccgctaaatttcgatataatttctcaatataattacttccgtaccgcccaccaccgccaaaacgttaattcaaaaactaaaacacgatctactaacgaataataccgcgctacgtacactcatcccacaacgactaatcgctttcgataacgcgatacgtaacacgttaaaaaaaaaaaaaaaactaatcaactccaacgactaaaactacgacgctcaaacctttacccgctaacgaccgaaa

SEQ ID NO: 8507 - DNA, 842 bp, Artificial Sequence
  chemically treated genomic DNA (Homo sapiens) CpG-island No: 8507
  misc_feature (463)..(463): n is either a, c, g or t
ttttttgttttataatcgtttttgtaatatagtcggataatattgtttattcggttaattatttttgtttgtttaggttcggtagtcggagcgatcgggtattatattagggagtaatgtattaacgtttgtataacggatcgtagttttggtaagcgcggtaattttggtttttaatatttatgtcgtgcgtagtttaggtagaaggacgatatattttggtttttttaacgttgtgtatatatatcgggatacgtagtatggaggcgagagtgataaagtttgcgttaacgtggtcgatggtcgaattgcgggtcggaattatcgttggcgtaggtttcgcggcgttcgaagttatgcgcgatatggtttataatttgttagttttaacgttttcgcgttgggttcgtttacgtattacgtttattgcgttggaaaatttgttgtattatttggttgcgtngttagattattcggttagcgaatatcgtattttcgaagtcgtcggattagaggtgtttagttattagtaatagttggaatattttatggcggtgagcggtaagcgtcgttggttgatttttatttttttttttattcgttggatttcggtgtggttttttaatgtgattattttcgtatcgtttattatcgttagggcgttgatttaggggttgaaatacgatttgttggcggatgatatcgcgttacgtgtatttattttataacggttgatcgttttcgatgacgcggtacgtagtacgttgaaagaggaggaaaaattggttaattttagcgattggggttacgacgtttaggtttttgttcgttggcgatcggag

SEQ ID NO: 8508 - DNA, 842 bp, Artificial Sequence
  chemically treated genomic DNA (Homo sapiens) CpG-island No: 8508
  misc_feature (380)..(380): n is either a, c, g or t
ctccgatcgccaacgaacaaaaacctaaacgtcgtaaccccaatcgctaaaattaaccaatttttcctcctctttcaacgtactacgtaccgcgtcatcgaaaacgatcaaccgttataaaataaatacacgtaacgcgatatcatccgccaacaaatcgtatttcaacccctaaatcaacgccctaacgataataaacgatacgaaaataatcacattaaaaaaccacaccgaaatccaacgaataaaaaaaaaaataaaaatcaaccaacgacgcttaccgctcaccgccataaaatattccaactattactaataactaaacacctctaatccgacgacttcgaaaatacgatattcgctaaccgaataatctaacnacgcaaccaaataatacaacaaattttccaacgcaataaacgtaatacgtaaacgaacccaacgcgaaaacgttaaaactaacaaattataaaccatatcgcgcataacttcgaacgccgcgaaacctacgccaacgataattccgacccgcaattcgaccatcgaccacgttaacgcaaactttatcactctcgcctccatactacgtatcccgatatatatacacaacgttaaaaaaaccaaaatatatcgtccttctacctaaactacgcacgacataaatattaaaaaccaaaattaccgcgcttaccaaaactacgatccgttatacaaacgttaatacattactccctaatataatacccgatcgctccgactaccgaacctaaacaaacaaaaataattaaccgaataaacaatattatccgactatattacaaaaacgattataaaacaaaaaa

SEQ ID NO: 8509 - DNA, 836 bp, Artificial Sequence
  chemically treated genomic DNA (Homo sapiens) CpG-island No: 8509
  misc_feature (228)..(228): n is either a, c, g or t
acgtttcgtttatatcgtagggtagtgcgtcgttgtaatttttataatcgtattatacggtttatattatttttatttttggttttatcggtaggtcgaaaggggtaatggtcgggtagacggttatcgttaatcgtttgttttggatgtaaaattattattcgtttataggcgaagatgtcgttgtttaaaaaacgcgtgtagtttgatgtttcgcgtggggggttnttggtcgggaacgatgcgtttagattttatttaggtttgtcgtcgtttgtatggggttattggggcgcggtgattgaatgtcgataatcgattattgtggatcgagataacgcgagagtacgttgaattgttaggtaaaatcggacgtaggatggaaataaaatagcgtcgggttattatttttacgtaacggtagaatggtttcgaattttatacgtcgggtgttgttttttttagtattaataatcgttgttagttgggcgatagttgacgcgattattatttgtttcggcgttatttggcgggtaatttgtcgatttaattgcgttgttagttttattgttagtagcgaatgatcgttaagcgcgaagaaattagtatcggtattttgtacgttatattttagtaacgacgagaatgtcgcggcgataatcgttttattgttcgttttcggcgtacgttttggcgtttgtgtttttagtttaggtaacggtaaggttttgcgatttagtttgtcgttggcgttaagtggtaattgtggaagttgtagtagaattatcggtattatatgtggtggtaatgttttacgaagttgcggtaaatcgtat

SEQ ID NO: 8510 - DNA, 836 bp, Artificial Sequence
  chemically treated genomic DNA (Homo sapiens) CpG-island No: 8510
  misc_feature (609)..(609): n is either a, c, g or t
atacgatttaccgcaacttcgtaaaacattaccaccacatataataccgataattctactacaacttccacaattaccacttaacgccaacgacaaactaaatcgcaaaaccttaccgttacctaaactaaaaacacaaacgccaaaacgtacgccgaaaacgaacaataaaacgattatcgccgcgacattctcgtcgttactaaaatataacgtacaaaataccgatactaatttcttcgcgcttaacgatcattcgctactaacaataaaactaacaacgcaattaaatcgacaaattacccgccaaataacgccgaaacaaataataatcgcgtcaactatcgcccaactaacaacgattattaatactaaaaaaaacaacacccgacgtataaaattcgaaaccattctaccgttacgtaaaaataataacccgacgctattttatttccatcctacgtccgattttacctaacaattcaacgtactctcgcgttatctcgatccacaataatcgattatcgacattcaatcaccgcgccccaataaccccatacaaacgacgacaaacctaaataaaatctaaacgcatcgttcccgaccaanaaccccccacgcgaaacatcaaactacacgcgttttttaaacaacgacatcttcgcctataaacgaataataattttacatccaaaacaaacgattaacgataaccgtctacccgaccattacccctttcgacctaccgataaaaccaaaaataaaaataatataaaccgtataatacgattataaaaattacaacgacgcactaccctacgatataaacgaaacgt

SEQ ID NO: 8511 - DNA, 836 bp, Artificial Sequence
  chemically treated genomic DNA (Homo sapiens) CpG-island No: 8511
  misc_feature (609)..(609): n is either a, c, g or t
atacgatttatcgtagtttcgtgaaatattgttattatatatggtatcggtggttttgttgtaatttttatagttattatttagcgttaacggtaagttggatcgtaaagttttatcgttgtttgaattgaaggtataagcgttagggcgtgcgtcgaaagcgggtagtgaaacgattatcgtcgcggtattttcgtcgttgttggggtgtgacgtgtaggatgtcgatgttgattttttcgcgtttggcggttattcgttattggtaatgaaattggtagcgtagttaagtcggtaggttgttcgttaggtgacgtcggggtaagtgatggtcgcgttaattgtcgtttaattggtaacgattattgatgttgaagaagatagtattcggcgtatgggattcgaaattattttgtcgttgcgtgaaggtaatggttcgacgttgttttgtttttattttgcgttcggttttgtttggtagtttagcgtgttttcgcgttatttcgatttataatggtcgattatcggtatttagttatcgcgttttaatggttttatgtagacggcggtaaatttggatgaagtttgagcgtatcgttttcggttagnaattttttacgcgggatattaaattgtacgcgttttttgggtaacgatattttcgtttgtaagcggataatgattttgtatttaaagtaggcggttgacgatagtcgtttgttcgattattatttttttcggtttgtcggtggagttagaggtaaagatgatataagtcgtgtgatgcggttgtgaaagttgtagcggcgtattgttttgcggtgtaagcggggcgt

SEQ ID NO: 8512 - DNA, 836 bp, Artificial Sequence
  chemically treated genomic DNA (Homo sapiens) CpG-island No: 8512
  misc_feature (228)..(228): n is either a, c, g or t
acgccccgcttacaccgcaaaacaatacgccgctacaactttcacaaccgcatcacacgacttatatcatctttacctctaactccaccgacaaaccgaaaaaaataataatcgaacaaacgactatcgtcaaccgcctactttaaatacaaaatcattatccgcttacaaacgaaaatatcgttacccaaaaaacgcgtacaatttaatatcccgcgtaaaaaattnctaaccgaaaacgatacgctcaaacttcatccaaatttaccgccgtctacataaaaccattaaaacgcgataactaaataccgataatcgaccattataaatcgaaataacgcgaaaacacgctaaactaccaaacaaaaccgaacgcaaaataaaaacaaaacaacgtcgaaccattaccttcacgcaacgacaaaataatttcgaatcccatacgccgaatactatcttcttcaacatcaataatcgttaccaattaaacgacaattaacgcgaccatcacttaccccgacgtcacctaacgaacaacctaccgacttaactacgctaccaatttcattaccaataacgaataaccgccaaacgcgaaaaaatcaacatcgacatcctacacgtcacaccccaacaacgacgaaaataccgcgacgataatcgtttcactacccgctttcgacgcacgccctaacgcttataccttcaattcaaacaacgataaaactttacgatccaacttaccgttaacgctaaataataactataaaaattacaacaaaaccaccgataccatatataataacaatatttcacgaaactacgataaatcgtat

SEQ ID NO: 8513 - DNA, 501 bp, Artificial Sequence
  chemically treated genomic DNA (Homo sapiens) CpG-island No: 8513
ggttaatattagtagtttttgtcgtttcgtttatttgtatatggtaggtttcgtttttagcgtttagtttcgttatatcgtttattattagtacgcggtagttcggtattttagttagtatttggattgttgtagttattgaatcgatattggcgttgtaggagtcgtcgagtagtaattggttttttgttagttggatggggaatagacggtttggaatagtttttagatttgttagtttcgttttgatagtattaagcgttgcgtttacggatatggagagcgtagcggttgttagcgtattcgtaatattgtgacgtttcggtaacggtagtagaatatcgacgttatcggttggggtttgtagggtaaatttcgtatcgtgcgaggttatatggatattggtggcggtgaaatcgttgttggcggtattgggtgagaaacgttatattttgcgtgagttaattacgttttgttagtttagttagtcgttgtttagta

SEQ ID NO: 8514 - DNA, 501 bp, Artificial Sequence
  chemically treated genomic DNA (Homo sapiens) CpG-island No: 8514
tactaaacaacgactaactaaactaacaaaacgtaattaactcacgcaaaatataacgtttctcacccaataccgccaacaacgatttcaccgccaccaatatccatataacctcgcacgatacgaaatttaccctacaaaccccaaccgataacgtcgatattctactaccgttaccgaaacgtcacaatattacgaatacgctaacaaccgctacgctctccatatccgtaaacgcaacgcttaatactatcaaaacgaaactaacaaatctaaaaactattccaaaccgtctattccccatccaactaacaaaaaaccaattactactcgacgactcctacaacgccaatatcgattcaataactacaacaatccaaatactaactaaaataccgaactaccgcgtactaataataaacgatataacgaaactaaacgctaaaaacgaaacctaccatatacaaataaacgaaacgacaaaaactactaatattaacc

SEQ ID NO: 8515 - DNA, 501 bp, Artificial Sequence
  chemically treated genomic DNA (Homo sapiens) CpG-island No: 8515
tgttaaataacgattggttgaattggtagagcgtaattggtttacgtaaagtgtggcgttttttatttaatgtcgttaatagcgattttatcgttattaatatttatgtgatttcgtacggtacggaatttattttataaattttaatcggtagcgtcgatgttttgttgtcgttgtcggggcgttataatattgcgaatgcgttggtagtcgttgcgttttttatgttcgtgggcgtaacgtttgatgttattaaagcggggttggtaaatttgaaagttgttttaggtcgtttgttttttatttaattggtagaaaattagttgttgttcgacgatttttataacgttaatgtcggtttaatgattgtagtagtttaggtattggttgaaatgtcgggttatcgcgtgttggtggtgggcgatatggcggaattgggcgttgaaagcgaagtttgttatgtataggtgggcgaggcggtaaaagttgttggtattgatt

SEQ ID NO: 8516 - DNA, 501 bp, Artificial Sequence
  chemically treated genomic DNA (Homo sapiens) CpG-island No: 8516
aatcaataccaacaacttttaccgcctcgcccacctatacataacaaacttcgctttcaacgcccaattccgccatatcgcccaccaccaacacgcgataacccgacatttcaaccaatacctaaactactacaatcattaaaccgacattaacgttataaaaatcgtcgaacaacaactaattttctaccaattaaataaaaaacaaacgacctaaaacaactttcaaatttaccaaccccgctttaataacatcaaacgttacgcccacgaacataaaaaacgcaacgactaccaacgcattcgcaatattataacgccccgacaacgacaacaaaacatcgacgctaccgattaaaatttataaaataaattccgtaccgtacgaaatcacataaatattaataacgataaaatcgctattaacgacattaaataaaaaacgccacactttacgtaaaccaattacgctctaccaattcaaccaatcgttatttaaca

SEQ ID NO: 8517 - DNA, 702 bp, Artificial Sequence
  chemically treated genomic DNA (Homo sapiens) CpG-island No: 8517
cgaggatgtcgtcgttgtcgggttcgcggtcgttgtaggtgttttcggtttttgagattagtatcgttttttttcgggttggcggtttcggtttaggtcgcgtatttgttgttgcggttttttcgtcgtcgcgtcggagtttcgcgatgtgttcgcgtttttcgggtagagggttcgtgtcgcgggacgtacggtgggttcgagggggaaaggggtcgcgtggggtttgaggtcgggtttcgggttagttcgggtatagcgtcgagcgtttttcgcgggtcgggagagggggcggtttttcgcgtatttttacggttttattttcgttttcggcggtattttagttttcgtgttcggttcgaggtttgcgagggtcgtttatttggttttgcggcgggtttaggggaggggtttgaggttatcgtagggtttcgcgtcggggcgtaggatgttttgtttcgtttcgttgcgtcgcgttcggtttcgtttcggtttcgttgtttcgttcgtcgcggtttcgtttttatttagcgttcgttttttcgtcgtagcggttgttatataaagggtaggaaatggttgcggcgagggtttttttacgtttttcgttgtatcgtcggcgtatttaggatttgtttttcggtttcggaggatcgtttagtttttaggttttttgttttgggggcgggaaagggagggaag

SEQ ID NO: 8518 - DNA, 702 bp, Artificial Sequence
  chemically treated genomic DNA (Homo sapiens) CpG-island No: 8518
cttccctccctttcccgcccccaaaacaaaaaacctaaaaactaaacgatcctccgaaaccgaaaaacaaatcctaaatacgccgacgatacaacgaaaaacgtaaaaaaaccctcgccgcaaccatttcctaccctttatataacaaccgctacgacgaaaaaacgaacgctaaataaaaacgaaaccgcgacgaacgaaacaacgaaaccgaaacgaaaccgaacgcgacgcaacgaaacgaaacaaaacatcctacgccccgacgcgaaaccctacgataacctcaaacccctcccctaaacccgccgcaaaaccaaataaacgaccctcgcaaacctcgaaccgaacacgaaaactaaaataccgccgaaaacgaaaataaaaccgtaaaaatacgcgaaaaaccgccccctctcccgacccgcgaaaaacgctcgacgctatacccgaactaacccgaaacccgacctcaaaccccacgcgacccctttccccctcgaacccaccgtacgtcccgcgacacgaaccctctacccgaaaaacgcgaacacatcgcgaaactccgacgcgacgacgaaaaaaccgcaacaacaaatacgcgacctaaaccgaaaccgccaacccgaaaaaaaacgatactaatctcaaaaaccgaaaacacctacaacgaccgcgaacccgacaacgacgacatcctcg

SEQ ID NO: 8519 - DNA, 702 bp, Artificial Sequence
  chemically treated genomic DNA (Homo sapiens) CpG-island No: 8519
tttttttttttttttcgtttttagggtaggaagtttgggggttgagcggtttttcgaaatcgagaggtaggttttgggtgcgtcggcggtatagcggagagcgtggagagattttcgtcgtagttattttttgttttttgtgtgatagtcgttgcggcgaaggggcgggcgttgggtgggggcggagtcgcggcgggcggagtagcggggtcggggcggggtcgagcgcggcgtagcggagcggggtagagtattttgcgtttcggcgcggggttttgcggtagttttaggttttttttttggattcgtcgtagagttaggtaagcggttttcgtaggtttcgggtcgggtacggggattaggatgtcgtcggggacggggatgaggtcgtgaggatgcgcgaagggtcgttttttttttcggttcgcggggggcgttcggcgttgtgttcgggttagttcgaggttcggttttaggttttacgcggtttttttttttttcggatttatcgtgcgtttcgcggtacggattttttgttcgggaggcgcgggtatatcgcggagtttcggcgcggcggcgggggagtcgtagtagtaggtgcgcggtttgggtcggagtcgttagttcgggaggaggcggtgttaattttagggatcggagatatttgtagcggtcgcgagttcggtagcggcgatattttcg

SEQ ID NO: 8520 - DNA, 702 bp, Artificial Sequence
  chemically treated genomic DNA (Homo sapiens) CpG-island No: 8520
cgaaaatatcgccgctaccgaactcgcgaccgctacaaatatctccgatccctaaaattaacaccgcctcctcccgaactaacgactccgacccaaaccgcgcacctactactacgactcccccgccgccgcgccgaaactccgcgatatacccgcgcctcccgaacaaaaaatccgtaccgcgaaacgcacgataaatccgaaaaaaaaaaaaaccgcgtaaaacctaaaaccgaacctcgaactaacccgaacacaacgccgaacgccccccgcgaaccgaaaaaaaaaacgacccttcgcgcatcctcacgacctcatccccgtccccgacgacatcctaatccccgtacccgacccgaaacctacgaaaaccgcttacctaactctacgacgaatccaaaaaaaaaacctaaaactaccgcaaaaccccgcgccgaaacgcaaaatactctaccccgctccgctacgccgcgctcgaccccgccccgaccccgctactccgcccgccgcgactccgcccccacccaacgcccgccccttcgccgcaacgactatcacacaaaaaacaaaaaataactacgacgaaaatctctccacgctctccgctataccgccgacgcacccaaaacctacctctcgatttcgaaaaaccgctcaacccccaaacttcctaccctaaaaacgaaaaaaaaaaaaaaa

SEQ ID NO: 8521 - DNA, 547 bp, Artificial Sequence
  chemically treated genomic DNA (Homo sapiens) CpG-island No: 8521
tcgttcgcggattttcgggtttttcgcggagggagaggaggggtcgcgagtgtagcggcgacgggaggggatttggttgttttggtttagcgggtttttagttagcggatagggttcgggtatttcgaggcggtttgtcggcgcgtgtcggcgtttcggttattcgttatttgtttcgggcgcgggttaggtcgtcgggcgttttgagtgtcgtatcgcggggtttgggcgcgtgtcggggcgtattggggttttcgcgtggaagttcgtcggtttttcggttgtttcggattttgtttgtattaggaatttcgaaatttcgttagcgttttgtttgatagagagaaattcgatcgcgttttgatttaggtttaattttcgcgatttttcgcgtatagtcggtttgttagggttcggcgtttttgggcgttgtttagtaaggtattgtgttcgagggttttaggggcgttgggaggtgcgcgggtcgtttgggtttgtcggtttttttcgcggggtgcggtttgttatttttatttttatttttatt

SEQ ID NO: 8522 - DNA, 547 bp, Artificial Sequence
  chemically treated genomic DNA (Homo sapiens) CpG-island No: 8522
aataaaaataaaaataaaaataacaaaccgcaccccgcgaaaaaaaccgacaaacccaaacgacccgcgcacctcccaacgcccctaaaaccctcgaacacaataccttactaaacaacgcccaaaaacgccgaaccctaacaaaccgactatacgcgaaaaatcgcgaaaattaaacctaaatcaaaacgcgatcgaatttctctctatcaaacaaaacgctaacgaaatttcgaaattcctaatacaaacaaaatccgaaacaaccgaaaaaccgacgaacttccacgcgaaaaccccaatacgccccgacacgcgcccaaaccccgcgatacgacactcaaaacgcccgacgacctaacccgcgcccgaaacaaataacgaataaccgaaacgccgacacgcgccgacaaaccgcctcgaaatacccgaaccctatccgctaactaaaaacccgctaaaccaaaacaaccaaatcccctcccgtcgccgctacactcgcgacccctcctctccctccgcgaaaaacccgaaaatccgcgaacga

SEQ ID NO: 8523 - DNA, 547 bp, Artificial Sequence
  chemically treated genomic DNA (Homo sapiens) CpG-island No: 8523
gataggggtaggggtgagggtggtaagtcgtatttcgcggaggaagtcggtaggtttagacggttcgcgtattttttagcgtttttggggttttcgagtataatgttttgttgagtagcgtttaggaacgtcgggttttggtaggtcggttgtgcgcgggagatcgcggagattgggtttgagttagggcgcgatcgggtttttttttgttaggtagagcgttggcgagatttcgagatttttgatataggtaaggttcgaggtagtcggggaatcggcgggtttttacgcgggggttttagtgcgtttcgatacgcgtttaggtttcgcggtgcggtatttagggcgttcggcggtttggttcgcgttcggggtagataacgagtaatcggagcgtcggtacgcgtcggtaggtcgtttcggagtgttcgggttttgttcgttggttgggggttcgttggattagggtagttaggttttttttcgtcgtcgttatattcgcgatttttttttttttttcgcgagaaattcgaggattcgcggacga

SEQ ID NO: 8524 - DNA, 547 bp, Artificial Sequence
  chemically treated genomic DNA (Homo sapiens) CpG-island No: 8524
tcgtccgcgaatcctcgaatttctcgcgaaaaaaaaaaaaaaatcgcgaatataacgacgacgaaaaaaaacctaactaccctaatccaacgaacccccaaccaacgaacaaaacccgaacactccgaaacgacctaccgacgcgtaccgacgctccgattactcgttatctaccccgaacgcgaaccaaaccgccgaacgccctaaataccgcaccgcgaaacctaaacgcgtatcgaaacgcactaaaacccccgcgtaaaaacccgccgattccccgactacctcgaaccttacctatatcaaaaatctcgaaatctcgccaacgctctacctaacaaaaaaaaacccgatcgcgccctaactcaaacccaatctccgcgatctcccgcgcacaaccgacctaccaaaacccgacgttcctaaacgctactcaacaaaacattatactcgaaaaccccaaaaacgctaaaaaatacgcgaaccgtctaaacctaccgacttcctccgcgaaatacgacttaccaccctcacccctacccctatc

SEQ ID NO: 8525 - DNA, 596 bp, Artificial Sequence
  chemically treated genomic DNA (Homo sapiens) CpG-island No: 8525
  misc_feature (33)..(33): n is either a, c, g or t
  misc_feature (194)..(194): n is either a, c, g or t
  misc_feature (319)..(319): n is either a, c, g or t
  misc_feature (338)..(338): n is either a, c, g or t
  misc_feature (355)..(355): n is either a, c, g or t
  misc_feature (369)..(369): n is either a, c, g or t
  misc_feature (376)..(376): n is either a, c, g or t
  misc_feature (432)..(432): n is either a, c, g or t
gtattcgacgattcggttcgcgagattttcggncgtgacgtcgggtaggatcgggtcgattggtaatgggggaggttttttatcgcgattggattggatattcggcgggggttttggagaaaggaagggtcggtcggcgggcgttttatagtcggaaggggcgagttcgtaaatagggtttatttttaggtcgnttttttggtaggtatttgtatagtcgcgttatttttatatatttgtttaggtttagcggcgttattttaagaataataagtcgcggtaatagcggcggcggcggttgtagtagcggcggcggtangcggcggaggtcgaagttnggaattttttttgcgtntacgttcggttcgntgagtgngcgtttgcgtagcgtcgttaaagcgcgattcgttttttttcgttacgtcggtacgnttcggcgttttttttggttgaatttcgattgtaggttttaagagagttcgtttcggtttatttcgcgaaatttgttgggattcgtagtcgtttgtcgcgggggtgttgggatgtgtagttttttgttgtggatagttatttttttttttttttttcgttttttt

SEQ ID NO: 8526 - DNA, 596 bp, Artificial Sequence
  chemically treated genomic DNA (Homo sapiens) CpG-island No: 8526
  misc_feature (165)..(165): n is either a, c, g or t
  misc_feature (221)..(221): n is either a, c, g or t
  misc_feature (228)..(228): n is either a, c, g or t
  misc_feature (242)..(242): n is either a, c, g or t
  misc_feature (259)..(259): n is either a, c, g or t
  misc_feature (278)..(278): n is either a, c, g or t
  misc_feature (403)..(403): n is either a, c, g or t
  misc_feature (564)..(564): n is either a, c, g or t
aaaaaaacgaaaaaaaaaaaaaaaaataactatccacaacaaaaaactacacatcccaacacccccgcgacaaacgactacgaatcccaacaaatttcgcgaaataaaccgaaacgaactctcttaaaacctacaatcgaaattcaaccaaaaaaaacgccgaancgtaccgacgtaacgaaaaaaaacgaatcgcgctttaacgacgctacgcaaacgcncactcancgaaccgaacgtanacgcaaaaaaaattccnaacttcgacctccgccgcntaccgccgccgctactacaaccgccgccgccgctattaccgcgacttattattcttaaaataacgccgctaaacctaaacaaatatataaaaataacgcgactatacaaatacctaccaaaaaancgacctaaaaataaaccctatttacgaactcgccccttccgactataaaacgcccgccgaccgacccttcctttctccaaaacccccgccgaatatccaatccaatcgcgataaaaaacctcccccattaccaatcgacccgatcctacccgacgtcacgnccgaaaatctcgcgaaccgaatcgtcgaatac

SEQ ID NO: 8527 - DNA, 596 bp, Artificial Sequence
  chemically treated genomic DNA (Homo sapiens) CpG-island No: 8527
  misc_feature (165)..(165): n is either a, c, g or t
  misc_feature (221)..(221): n is either a, c, g or t
  misc_feature (228)..(228): n is either a, c, g or t
  misc_feature (242)..(242): n is either a, c, g or t
  misc_feature (259)..(259): n is either a, c, g or t
  misc_feature (278)..(278): n is either a, c, g or t
  misc_feature (403)..(403): n is either a, c, g or t
  misc_feature (564)..(564): n is either a, c, g or t
ggaggaacgggaggaaaagagaggggtggttgtttataatagaaaattatatattttagtattttcgcggtagacgattacgggttttagtaggtttcgcggggtggatcgaagcgggtttttttggggtttgtagtcggggtttagttagagggggcgtcgggncgtatcgacgtagcggggagaaacgggtcgcgttttaacggcgttgcgtaggcgtntatttancgggtcggacgtgnacgtagggaaagttttnggtttcggttttcgtcgtntgtcgtcgtcgttgttatagtcgtcgtcgtcgttgttgtcgcggtttgttatttttaaaatggcgtcgttagatttggataagtatgtggaaatagcgcggttgtgtaagtatttgttagagaancgatttgaaggtgagttttatttgcgggttcgtttttttcggttgtggggcgttcgtcggtcggttttttttttttttaggattttcgtcgggtatttagtttagtcgcggtggagggttttttttattgttagtcgattcggttttattcggcgttacgntcgagggtttcgcgagtcgagtcgtcgaatgt

SEQ ID NO: 8528 - DNA, 596 bp, Artificial Sequence
  chemically treated genomic DNA (Homo sapiens) CpG-island No: 8528
  misc_feature (33)..(33): n is either a, c, g or t
  misc_feature (194)..(194): n is either a, c, g or t
  misc_feature (319)..(319): n is either a, c, g or t
  misc_feature (338)..(338): n is either a, c, g or t
  misc_feature (355)..(355): n is either a, c, g or t
  misc_feature (369)..(369): n is either a, c, g or t
  misc_feature (376)..(376): n is either a, c, g or t
  misc_feature (432)..(432): n is either a, c, g or t
acattcgacgactcgactcgcgaaaccctcgancgtaacgccgaataaaaccgaatcgactaacaataaaaaaaaccctccaccgcgactaaactaaatacccgacgaaaatcctaaaaaaaaaaaaaaccgaccgacgaacgccccacaaccgaaaaaaacgaacccgcaaataaaactcaccttcaaatcgnttctctaacaaatacttacacaaccgcgctatttccacatacttatccaaatctaacgacgccattttaaaaataacaaaccgcgacaacaacgacgacgacgactataacaacgacgacgacanacgacgaaaaccgaaaccnaaaactttccctacgtncacgtccgacccgntaaatanacgcctacgcaacgccgttaaaacgcgacccgtttctccccgctacgtcgatacgncccgacgccccctctaactaaaccccgactacaaaccccaaaaaaacccgcttcgatccaccccgcgaaacctactaaaacccgtaatcgtctaccgcgaaaatactaaaatatataattttctattataaacaaccacccctctcttttcctcccgttcctcc

SEQ ID NO: 8529 - DNA, 620 bp, Artificial Sequence
  chemically treated genomic DNA (Homo sapiens) CpG-island No: 8529
ttacgtcgtattcggtatttagtgtttgatgcgacgtttgcgcgttttattaggtttataattagtgcgggtttggtaggttggataaggcgtttacgtcgtattcggtaaatattgcgagagtagattatttcgttttaatcgttttattttttaataattttcgtatttataatcgattcgggtttaacgtcgttagcgtattggtatttatcggaatcggttcgtcgtttatttgcgtcgttagaatttcggtatatagcggggtagaatataaatcgcgagaatttaaagtcgtaaatataaagagatcgttaaaaatcggcgcgtttatcgttttatttttttgttcgttaacgacgtatattttacgagtgttgttttataatcgggaatattgtttattattggtagatgatcgcgggtggtataacgtatatcgtagcgcgtttttttattattgatattaattttttttgtttattgtgtttgcgggaaataattaattaatcgttggcgattttgttgttgatcgtttttattgtacgtcgtattatgtgtcgcgatgataattggtattaatgacggtgattttttgagagtttaatagttaggtatgt

SEQ ID NO: 8530 - DNA, 620 bp, Artificial Sequence
  chemically treated genomic DNA (Homo sapiens) CpG-island No: 8530
acatacctaactattaaactctcaaaaaatcaccgtcattaataccaattatcatcgcgacacataatacgacgtacaataaaaacgatcaacaacaaaatcgccaacgattaattaattatttcccgcaaacacaataaacaaaaaaaattaatatcaataataaaaaaacgcgctacgatatacgttataccacccgcgatcatctaccaataataaacaatattcccgattataaaacaacactcgtaaaatatacgtcgttaacgaacaaaaaaataaaacgataaacgcgccgatttttaacgatctctttatatttacgactttaaattctcgcgatttatattctaccccgctatataccgaaattctaacgacgcaaataaacgacgaaccgattccgataaataccaatacgctaacgacgttaaacccgaatcgattataaatacgaaaattattaaaaaataaaacgattaaaacgaaataatctactctcgcaatatttaccgaatacgacgtaaacgccttatccaacctaccaaacccgcactaattataaacctaataaaacgcgcaaacgtcgcatcaaacactaaataccgaatacgacgtaa

SEQ ID NO: 8531 - DNA, 620 bp, Artificial Sequence
  chemically treated genomic DNA (Homo sapiens) CpG-island No: 8531
gtatgtttaattattagatttttagaggattatcgttattggtgttagttattatcgcggtatatgatacggcgtatagtgaggacgattagtagtagaatcgttagcggttgattgattgtttttcgtaggtatagtgggtaaaagaggttgatgttagtgataaagaggcgcgttgcggtgtgcgttgtgttattcgcgattatttgttaatggtaggtaatgttttcgattatgaggtaatattcgtggaatatgcgtcgttggcggatagaaagatgaggcggtaagcgcgtcggtttttgacgatttttttatgtttgcggttttaggttttcgcggtttgtgttttgtttcgttgtgtgtcgagattttggcggcgtagatgagcgacgaatcgatttcgatggatgttagtacgttggcggcgttaaattcgaatcggttatgggtgcggaaattgttgaagggtaaagcggttaaggcggggtaatttgttttcgtagtgtttgtcggatgcggcgtgaacgttttatttagtttattaaattcgtattgattgtaggtttgataagacgcgtaagcgtcgtattaggtattgaatgtcggatgcggcgtga

SEQ ID NO: 8532 - DNA, 620 bp, Artificial Sequence
  chemically treated genomic DNA (Homo sapiens) CpG-island No: 8532
tcacgccgcatccgacattcaatacctaatacgacgcttacgcgtcttatcaaacctacaatcaatacgaatttaataaactaaataaaacgttcacgccgcatccgacaaacactacgaaaacaaattaccccgccttaaccgctttacccttcaacaatttccgcacccataaccgattcgaatttaacgccgccaacgtactaacatccatcgaaatcgattcgtcgctcatctacgccgccaaaatctcgacacacaacgaaacaaaacacaaaccgcgaaaacctaaaaccgcaaacataaaaaaatcgtcaaaaaccgacgcgcttaccgcctcatctttctatccgccaacgacgcatattccacgaatattacctcataatcgaaaacattacctaccattaacaaataatcgcgaataacacaacgcacaccgcaacgcgcctctttatcactaacatcaacctcttttacccactatacctacgaaaaacaatcaatcaaccgctaacgattctactactaatcgtcctcactatacgccgtatcatataccgcgataataactaacaccaataacgataatcctctaaaaatctaataattaaacatac

SEQ ID NO: 8533 - DNA, 572 bp, Artificial Sequence
  chemically treated genomic DNA (Homo sapiens) CpG-island No: 8533
gatcgcggcgttcgatatcggtcgttcgtattaggtttttgtcgggtttagtttttttgtttgttcgcgggggttcggaggattcggtttagcgtttatacgcggcgtttcgcgtttcgggtttttggttttagaagattggtcgcgcgcggacggtagttcgggatttataaggattttaggtgtttgagttgttgtagttgtgcgcgtcgtgtcgtcgaagtttttgttttcgacgtcgttgtagtttttgtttcggcggtttacgcggtcgtcgcgcgttcgtagtttttacgttttcgcgtttaggtcgggacgatatgttagttttacgtagcgtcgttcgggtaattttcgcggcgcggtttcggcggcggcggcggcggcggcggtagttaagagagtatttttatcgcgcggcggtcgcggggtcgtagcgtttattttcgtcgtcgttttttaatttatttcggcggtttcgaagttttagtttcggttattcgatttaattttgcgtttattgattttattgataaaaatggcgatgtttagtttatgtataatattattcg

SEQ ID NO: 8534 - DNA, 572 bp, Artificial Sequence
  chemically treated genomic DNA (Homo sapiens) CpG-island No: 8534
cgaataatattatacataaactaaacatcgccatttttatcaataaaatcaataaacgcaaaattaaatcgaataaccgaaactaaaacttcgaaaccgccgaaataaattaaaaaacgacgacgaaaataaacgctacgaccccgcgaccgccgcgcgataaaaatactctcttaactaccgccgccgccgccgccgccgccgaaaccgcgccgcgaaaattacccgaacgacgctacgtaaaactaacatatcgtcccgacctaaacgcgaaaacgtaaaaactacgaacgcgcgacgaccgcgtaaaccgccgaaacaaaaactacaacgacgtcgaaaacaaaaacttcgacgacacgacgcgcacaactacaacaactcaaacacctaaaatccttataaatcccgaactaccgtccgcgcgcgaccaatcttctaaaaccaaaaacccgaaacgcgaaacgccgcgtataaacgctaaaccgaatcctccgaacccccgcgaacaaacaaaaaaactaaacccgacaaaaacctaatacgaacgaccgatatcgaacgccgcgatc

SEQ ID NO: 8535 - DNA, 572 bp, Artificial Sequence
  chemically treated genomic DNA (Homo sapiens) CpG-island No: 8535
cgggtgatgttatatataggttgaatatcgttatttttattaatgaaattaatgggcgtaaaattggatcgggtggtcgaggttgagatttcggggtcgtcggggtgagttggggggcggcggcgggagtgggcgttgcgatttcgcgatcgtcgcgcgatggaagtgtttttttggttgtcgtcgtcgtcgtcgtcgtcgtcggagtcgcgtcgcgggggttgttcgagcggcgttgcgtggggttgatatgtcgtttcggtttgggcgcgaggacgtgggggttgcgggcgcgcggcggtcgcgtgagtcgtcggagtaggagttgtagcgacgtcgggagtagaagtttcggcgatacgacgcgtatagttgtagtagtttaagtatttggagtttttgtgagtttcgagttgtcgttcgcgcgcggttagttttttgaagttaggggttcggggcgcgggacgtcgcgtgtgggcgttaggtcgggtttttcgagttttcgcgagtaggtaggggggttgggttcggtaggagtttggtgcgggcgatcgatgtcgggcgtcgcggtt

SEQ ID NO: 8536 - DNA, 572 bp, Artificial Sequence
  chemically treated genomic DNA (Homo sapiens) CpG-island No: 8536
aaccgcgacgcccgacatcgatcgcccgcaccaaactcctaccgaacccaacccccctacctactcgcgaaaactcgaaaaacccgacctaacgcccacacgcgacgtcccgcgccccgaacccctaacttcaaaaaactaaccgcgcgcgaacgacaactcgaaactcacaaaaactccaaatacttaaactactacaactatacgcgtcgtatcgccgaaacttctactcccgacgtcgctacaactcctactccgacgactcacgcgaccgccgcgcgcccgcaacccccacgtcctcgcgcccaaaccgaaacgacatatcaaccccacgcaacgccgctcgaacaacccccgcgacgcgactccgacgacgacgacgacgacgacgacaaccaaaaaaacacttccatcgcgcgacgatcgcgaaatcgcaacgcccactcccgccgccgccccccaactcaccccgacgaccccgaaatctcaacctcgaccacccgatccaattttacgcccattaatttcattaataaaaataacgatattcaacctatatataacatcacccg

SEQ ID NO: 8537 - DNA, 586 bp, Artificial Sequence
  chemically treated genomic DNA (Homo sapiens) CpG-island No: 8537
cgtgggggcggattgcgcggggcggggcgtcgttgcgcggggcggggcgtcgcgggttcgttcgtgatgttttgggatttcgcgttttcgagattcgtagtttacgcgagttgtttgttttttttttgtttggacgcgtatgagggtttcgtttatggatcgcgcggtcgtggcgagggtgggcgcggtagcgagcgttacgtggtgcgttttggtggcgggggtggtgttggtttagtatatatttattttgaagaggaagacggggcggaagattaagattatcgagatggtgagtgtggaggttcggcgcgtttagagtacgcgaagagtcggttgggtcgttcgttggtttcggtagtttgtattgggtcgttgttcggtcgcgacggggagttgtcggtatcgtttgtaaagttgggatttcgttagttcggggattcgtattttgggaggatcgggttcgtttttcgatgcgagttaattttcgcgggtttttggtgattaaagggttgggttttttcggtttgtaagttttttggtttgtttcgtaagttttttggttagggtttttcggtttttaaag

SEQ ID NO: 8538 - DNA, 586 bp, Artificial Sequence
  chemically treated genomic DNA (Homo sapiens) CpG-island No: 8538
ctttaaaaaccgaaaaaccctaaccaaaaaacttacgaaacaaaccaaaaaacttacaaaccgaaaaaacccaaccctttaatcaccaaaaacccgcgaaaattaactcgcatcgaaaaacgaacccgatcctcccaaaatacgaatccccgaactaacgaaatcccaactttacaaacgataccgacaactccccgtcgcgaccgaacaacgacccaatacaaactaccgaaaccaacgaacgacccaaccgactcttcgcgtactctaaacgcgccgaacctccacactcaccatctcgataatcttaatcttccgccccgtcttcctcttcaaaataaatatatactaaaccaacaccacccccgccaccaaaacgcaccacgtaacgctcgctaccgcgcccaccctcgccacgaccgcgcgatccataaacgaaaccctcatacgcgtccaaacaaaaaaaaaacaaacaactcgcgtaaactacgaatctcgaaaacgcgaaatcccaaaacatcacgaacgaacccgcgacgccccgccccgcgcaacgacgccccgccccgcgcaatccgcccccacg

SEQ ID NO: 8539 - DNA, 586 bp, Artificial Sequence
  chemically treated genomic DNA (Homo sapiens) CpG-island No: 8539
ttttaaaaatcgaaaaattttaattaaaagatttacggggtaagttaaagggtttgtaagtcgggggaatttaattttttggttattaaaagttcgcggaagttggttcgtatcgggaggcgggttcggtttttttaaagtgcgggttttcgagttagcgaaattttagttttataggcgatgtcggtagtttttcgtcgcgatcgaatagcggtttagtataggttgtcgaggttagcggacggtttagtcggtttttcgcgtgttttgggcgcgtcgagtttttatatttattatttcgatgattttggtttttcgtttcgtttttttttttaaggtgaatatgtattgagttagtattattttcgttattagggcgtattacgtggcgttcgttatcgcgtttattttcgttacggtcgcgcggtttatggacggggtttttatgcgcgtttaagtaggaaaaaaataggtagttcgcgtagattgcgagtttcggaagcgcgggattttagagtattacggacgagttcgcgacgtttcgtttcgcgtagcgacgtttcgtttcgcgtagttcgtttttacg

SEQ ID NO: 8540 - DNA, 586 bp, Artificial Sequence
  chemically treated genomic DNA (Homo sapiens) CpG-island No: 8540
cgtaaaaacgaactacgcgaaacgaaacgtcgctacgcgaaacgaaacgtcgcgaactcgtccgtaatactctaaaatcccgcgcttccgaaactcgcaatctacgcgaactacctatttttttcctacttaaacgcgcataaaaaccccgtccataaaccgcgcgaccgtaacgaaaataaacgcgataacgaacgccacgtaatacgccctaataacgaaaataatactaactcaatacatattcaccttaaaaaaaaaaacgaaacgaaaaaccaaaatcatcgaaataataaatataaaaactcgacgcgcccaaaacacgcgaaaaaccgactaaaccgtccgctaacctcgacaacctatactaaaccgctattcgatcgcgacgaaaaactaccgacatcgcctataaaactaaaatttcgctaactcgaaaacccgcactttaaaaaaaccgaacccgcctcccgatacgaaccaacttccgcgaacttttaataaccaaaaaattaaattcccccgacttacaaaccctttaacttaccccgtaaatcttttaattaaaatttttcgatttttaaaa

SEQ ID NO: 8541 - DNA, 556 bp, Artificial Sequence
  chemically treated genomic DNA (Homo sapiens) CpG-island No: 8541
  misc_feature (324)..(324): n is either a, c, g or t
  misc_feature (398)..(398): n is either a, c, g or t
tcgtacgcgatttggttgggtatttcgttattgcggtacgtttatcgtaatcgttttgcgttgcggtgaggattgcgttatcgttacgaggtacgattagagagacgattttatcgtttttatttaagcgaatatcgcgaatatcggtggtgttgtagtttatcgtacggatagaagattttttaaagcgtattattttatttttagcggagaatagtattatttcgttttcgtcgttggttaggttaacgtcgattagtttatcgtcgttaattagtttgatcgttattttatcggcggtattagacggtttgattcggtgangatagttttttttacgggtacgtagcggtcgttatgaagatttttacgttttttttaaattcggttattggtangattttagtgatacgttcgttttgtttagcggtataggttacgatcgacgatcgcgcgtttaacgatgtttcggtattgataattttatcgatagagcgataacgttcgagaatataaatatggtttgagttttcgtattagtagtcggtcgataagt

SEQ ID NO: 8542 - DNA, 556 bp, Artificial Sequence
  chemically treated genomic DNA (Homo sapiens) CpG-island No: 8542
  misc_feature (159)..(159): n is either a, c, g or t
  misc_feature (233)..(233): n is either a, c, g or t
acttatcgaccgactactaatacgaaaactcaaaccatatttatattctcgaacgttatcgctctatcgataaaattatcaataccgaaacatcgttaaacgcgcgatcgtcgatcgtaacctataccgctaaacaaaacgaacgtatcactaaaatcntaccaataaccgaatttaaaaaaaacgtaaaaatcttcataacgaccgctacgtacccgtaaaaaaaactatcntcaccgaatcaaaccgtctaataccgccgataaaataacgatcaaactaattaacgacgataaactaatcgacgttaacctaaccaacgacgaaaacgaaataatactattctccgctaaaaataaaataatacgctttaaaaaatcttctatccgtacgataaactacaacaccaccgatattcgcgatattcgcttaaataaaaacgataaaatcgtctctctaatcgtacctcgtaacgataacgcaatcctcaccgcaacgcaaaacgattacgataaacgtaccgcaataacgaaatacccaaccaaatcgcgtacga

SEQ ID NO: 8543 - DNA, 556 bp, Artificial Sequence
  chemically treated genomic DNA (Homo sapiens) CpG-island No: 8543
  misc_feature (159)..(159): n is either a, c, g or t
  misc_feature (233)..(233): n is either a, c, g or t
gtttatcgatcgattgttggtgcgaaaatttaggttatatttgtgttttcgagcgttgtcgttttatcgatgaagttattagtgtcgaagtatcgttgggcgcgcggtcgtcgatcgtaatttgtgtcgttgagtaagacgaacgtattattgggattntgttagtgatcgagtttgaagaaggcgtgaaagtttttatggcgatcgttacgtattcgtgaagaaaattgttnttatcgagttaaatcgtttggtatcgtcggtaaagtggcgattaaattggttgacggcgatgagttgatcggcgttgatttgattagcggcgaagacgaagtaatgttgtttttcgttgaaggtaaagtggtgcgttttaaagagttttttgttcgtgcgatgggttgtaatattatcggtgttcgcggtattcgtttaggtgaaggcgataaagtcgtttttttgatcgtgtttcgtggcgatggcgtaatttttatcgtaacgtaaaacggttacggtaaacgtatcgtagtggcggaatatttaattaagtcgcgtgcga

SEQ ID NO: 8544 - DNA, 556 bp, Artificial Sequence
  chemically treated genomic DNA (Homo sapiens) CpG-island No: 8544
  misc_feature (324)..(324): n is either a, c, g or t
  misc_feature (398)..(398): n is either a, c, g or t
tcgcacgcgacttaattaaatattccgccactacgatacgtttaccgtaaccgttttacgttacgataaaaattacgccatcgccacgaaacacgatcaaaaaaacgactttatcgccttcacctaaacgaataccgcgaacaccgataatattacaacccatcgcacgaacaaaaaactctttaaaacgcaccactttaccttcaacgaaaaacaacattacttcgtcttcgccgctaatcaaatcaacgccgatcaactcatcgccgtcaaccaatttaatcgccactttaccgacgataccaaacgatttaactcgataanaacaattttcttcacgaatacgtaacgatcgccataaaaactttcacgccttcttcaaactcgatcactaacanaatcccaataatacgttcgtcttactcaacgacacaaattacgatcgacgaccgcgcgcccaacgatacttcgacactaataacttcatcgataaaacgacaacgctcgaaaacacaaatataacctaaattttcgcaccaacaatcgatcgataaac

SEQ ID NO: 8545 - DNA, 807 bp, Artificial Sequence
  chemically treated genomic DNA (Homo sapiens) CpG-island No: 8545
tttcgcgtaatacggtgttttttcgttattttttttcggcgggatttttcgggtgtgcgcgaatatggagttttttttgttgtttttttttggcgcgtgtttagttatttcgaaattgtacgtttattttacgtaggcgcggatggttatgtagcgtagttgttagtagcgggttaatatcggtaaaatagatcgggtcggcgggttggtggtgataatattcgtttacgtcgttagatagcgtaatgatttcgggcgtaatatttgcgggtagtaaatcggtttgtattaatgtttgcgcgagcggtgagagcgtttcgttaattatttcgataattagttttgttattcgtcgggttatttgtattagttgcgcgtcggttagcgaacgggcgtcggtgtttgtatcgaagtatttatttataattatttgtttcggtttatgagcgtaaattacgcgttcgtggttgtcggtttttagtaggcgattatcgacgttgaggtaggtagtgtcgttgattttttcggtatcgaatagggcgtagttcgcggtgttatcgtcgatgtcgatatttagtattcgatatagtcgttgtttagaaagggtttgtgtttcggtttcgtgatcggcgattacggattcgacgtgtagttcggcgttggtaacgataaaatcgtttagcgattgagagagcgttattatcgtcgggcgagtattgcgggttttcgcgtttttataggtgatgatgatggtattagaattaacgtttttcggtttaatattcgtagtatgatattgttcgagta

SEQ ID NO: 8546 - DNA, 807 bp, Artificial Sequence
  chemically treated genomic DNA (Homo sapiens) CpG-island No: 8546
tactcgaacaatatcatactacgaatattaaaccgaaaaacgttaattctaataccatcatcatcacctataaaaacgcgaaaacccgcaatactcgcccgacgataataacgctctctcaatcgctaaacgattttatcgttaccaacgccgaactacacgtcgaatccgtaatcgccgatcacgaaaccgaaacacaaaccctttctaaacaacgactatatcgaatactaaatatcgacatcgacgataacaccgcgaactacgccctattcgataccgaaaaaatcaacgacactacctacctcaacgtcgataatcgcctactaaaaaccgacaaccacgaacgcgtaatttacgctcataaaccgaaacaaataattataaataaatacttcgatacaaacaccgacgcccgttcgctaaccgacgcgcaactaatacaaataacccgacgaataacaaaactaattatcgaaataattaacgaaacgctctcaccgctcgcgcaaacattaatacaaaccgatttactacccgcaaatattacgcccgaaatcattacgctatctaacgacgtaaacgaatattatcaccaccaacccgccgacccgatctattttaccgatattaacccgctactaacaactacgctacataaccatccgcgcctacgtaaaataaacgtacaatttcgaaataactaaacacgcgccaaaaaaaaacaacaaaaaaaactccatattcgcgcacacccgaaaaatcccgccgaaaaaaaataacgaaaaaacaccgtattacgcgaaa

SEQ ID NO: 8547 - DNA, 807 bp, Artificial Sequence
  chemically treated genomic DNA (Homo sapiens) CpG-island No: 8547
tattcgagtaatattatgttgcgggtattgagtcggaaagcgttgattttggtgttattattattatttgtgaaagcgcgaaaattcgtaatgttcgttcggcggtgatggcgtttttttagtcgttgggcgattttgtcgttgttagcgtcgggttgtacgtcgaattcgtgatcgtcggttacggagtcggggtataaattttttttgaataacggttgtgtcgggtattgaatatcgatatcggcggtggtatcgcgaattacgttttgttcgatgtcggaaaaattagcggtattgtttgttttaacgtcggtggtcgtttgttggaaatcgatagttacgggcgcgtggtttacgtttataaatcggggtagatgattgtggatgagtgtttcggtgtaggtatcgacgttcgttcgttgatcggcgcgtagttggtgtaggtgattcggcggatggtagaattgattgtcgaagtgattgacggaacgtttttatcgttcgcgtaggtattgatgtaaatcggtttgttgttcgtaggtgttacgttcgaaattattacgttgtttggcggcgtgggcgaatgttattattattagttcgtcgattcgatttgttttgtcgatattggttcgttgttggtaattgcgttgtatgattattcgcgtttgcgtgagatgaacgtatagtttcgaagtggttaaatacgcgttaaaaagaggtaataaaagagattttatattcgcgtatattcgaaggatttcgtcgggaaaaagtgacgagaaaatatcgtgttacgcggga

SEQ ID NO: 8548 - DNA, 807 bp, Artificial Sequence
  chemically treated genomic DNA (Homo sapiens) CpG-island No: 8548
tcccgcgtaacacgatattttctcgtcactttttcccgacgaaatccttcgaatatacgcgaatataaaatctcttttattacctctttttaacgcgtatttaaccacttcgaaactatacgttcatctcacgcaaacgcgaataatcatacaacgcaattaccaacaacgaaccaatatcgacaaaacaaatcgaatcgacgaactaataataataacattcgcccacgccgccaaacaacgtaataatttcgaacgtaacacctacgaacaacaaaccgatttacatcaatacctacgcgaacgataaaaacgttccgtcaatcacttcgacaatcaattctaccatccgccgaatcacctacaccaactacgcgccgatcaacgaacgaacgtcgatacctacaccgaaacactcatccacaatcatctaccccgatttataaacgtaaaccacgcgcccgtaactatcgatttccaacaaacgaccaccgacgttaaaacaaacaataccgctaatttttccgacatcgaacaaaacgtaattcgcgataccaccgccgatatcgatattcaatacccgacacaaccgttattcaaaaaaaatttataccccgactccgtaaccgacgatcacgaattcgacgtacaacccgacgctaacaacgacaaaatcgcccaacgactaaaaaaacgccatcaccgccgaacgaacattacgaattttcgcgctttcacaaataataataataacaccaaaatcaacgctttccgactcaatacccgcaacataatattactcgaata

SEQ ID NO: 8549 - DNA, 659 bp, Artificial Sequence
  chemically treated genomic DNA (Homo sapiens) CpG-island No: 8549
  misc_feature (419)..(419): n is either a, c, g or t
cgggtattttcgttgttttttcgtatcgtttggaatatcggacggtttttgttacgtatggtttgaatatggcgtttaatattggttttcgtttcgttattaattattggatcgatatcggtggttaggcgattcggattatttattcggtattcggttattgcgtcgcgtatattttttaacgtgtggtcggtaattttattttgtaggtatagtacgcgtacgtcgaataacgttgattcgtattgtcgaacgtcgaggttagtatatttacgacgatttgttcggttagtgttgaagaatcgataattatcgcgtttatgtcgtcggttttagcgatgagcggaatagggcgattttgagcgtttaggcggttggcgatattgcgttgtagtaacgtagcgatttcggttgaattngtaaatattatttcgcgtacgcgattattattcgttatttgcgcgtttacgggttttttatcggatttcgtagtatatattatatatttttcgggggaaatatttttttataaaaaaagcgattttttgcgcgggtattatcggcggttgtttttttcggttttttaattagtttttattttgcgttaatttagggggcgattattcggttaaaaaaaatagcgggaggttttatggatt

SEQ ID NO: 8550 - DNA, 659 bp, Artificial Sequence
  chemically treated genomic DNA (Homo sapiens) CpG-island No: 8550
  misc_feature (241)..(241): n is either a, c, g or t
aatccataaaacctcccgctattttttttaaccgaataatcgccccctaaattaacgcaaaataaaaactaattaaaaaaccgaaaaaaacaaccgccgataatacccgcgcaaaaaatcgctttttttataaaaaaatatttcccccgaaaaatatataatatatactacgaaatccgataaaaaacccgtaaacgcgcaaataacgaataataatcgcgtacgcgaaataatatttacnaattcaaccgaaatcgctacgttactacaacgcaatatcgccaaccgcctaaacgctcaaaatcgccctattccgctcatcgctaaaaccgacgacataaacgcgataattatcgattcttcaacactaaccgaacaaatcgtcgtaaatatactaacctcgacgttcgacaatacgaatcaacgttattcgacgtacgcgtactatacctacaaaataaaattaccgaccacacgttaaaaaatatacgcgacgcaataaccgaataccgaataaataatccgaatcgcctaaccaccgatatcgatccaataattaataacgaaacgaaaaccaatattaaacgccatattcaaaccatacgtaacaaaaaccgtccgatattccaaacgatacgaaaaaacaacgaaaatacccg

SEQ ID NO: 8551 - DNA, 659 bp, Artificial Sequence
  chemically treated genomic DNA (Homo sapiens) CpG-island No: 8551
  misc_feature (241)..(241): n is either a, c, g or t
agtttatggaatttttcgttgttttttttggtcgggtagtcgttttttgaattggcgtaagataaaagttggttgaaaaatcggaagaaataatcgtcgataatgttcgcgtaaggggtcgttttttttgtggaagggtgtttttttcgaggggtgtgtaatatgtgttgcgaggttcggtgaaaaattcgtgggcgcgtaagtgacgggtgatgatcgcgtgcgcggggtgatgtttatnggtttaatcgaagtcgttacgttattgtagcgtaatatcgttagtcgtttggacgtttagggtcgttttatttcgtttatcgttgaaatcggcggtatgaacgcgatgattgtcgattttttagtattgatcgaataggtcgtcgtggatgtattggtttcggcgttcgatagtgcgggttagcgttgttcggcgtgcgcgtgttgtgtttgtaagatgagattgtcgattatacgttgaaaaatgtgcgcggcgtaatggtcgaatgtcggatgggtaattcgggtcgtttgattatcgatatcggtttagtgattgatagcgaagcgaaagttaatattgagcgttatatttagattatgcgtagtaaaggtcgttcggtgttttaggcggtgcgggaaaatagcgaagatgttcg

SEQ ID NO: 8552 - DNA, 659 bp, Artificial Sequence
  chemically treated genomic DNA (Homo sapiens) CpG-island No: 8552
  misc_feature (419)..(419): n is either a, c, g or t
cgaacatcttcgctattttcccgcaccgcctaaaacaccgaacgacctttactacgcataatctaaatataacgctcaatattaactttcgcttcgctatcaatcactaaaccgatatcgataatcaaacgacccgaattacccatccgacattcgaccattacgccgcgcacatttttcaacgtataatcgacaatctcatcttacaaacacaacacgcgcacgccgaacaacgctaacccgcactatcgaacgccgaaaccaatacatccacgacgacctattcgatcaatactaaaaaatcgacaatcatcgcgttcataccgccgatttcaacgataaacgaaataaaacgaccctaaacgtccaaacgactaacgatattacgctacaataacgtaacgacttcgattaaaccnataaacatcaccccgcgcacgcgatcatcacccgtcacttacgcgcccacgaatttttcaccgaacctcgcaacacatattacacacccctcgaaaaaaacacccttccacaaaaaaaacgaccccttacgcgaacattatcgacgattatttcttccgatttttcaaccaacttttatcttacgccaattcaaaaaacgactacccgaccaaaaaaaacaacgaaaaattccataaact

SEQ ID NO: 8553 - DNA, 1736 bp, Artificial Sequence
  chemically treated genomic DNA (Homo sapiens) CpG-island No: 8553
cgaaattggatgaaggttatcggttggtcgtattttagtaagcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtcgggcgttattttcggttggtattgattacgtaggcgtagcgggtagaagaagttcggtagtaggttattttcggcgggacggaatcgttcgttttttttgatattttgtcgggtatatcgaatatggtcgggataacggtattcgtttgtttgtcgtgtgttgacgtacgattcggaatattcggagaatttatttgtcgcgtcgttggtgcgttatggttggacgtttcgcggcgaattggcggcggtgtatgatcgtagtaatatataggtgcgtagttttatttacgatgataaatatcggggtcggatggtggcgtatcgttatacgggtcgatcggaaatttgttatcgttacgatagcgacgggcgggtgatagaatagttaaattcggtaggtttaagttatacgtattagtatgagaaggatcgtattattattatcgatagtttggatcgtcgtgaagtgttgtatacgtaggcgaagcgggttgaagcgggtggtgaaaaaggaatacgcggacggtagcgttacgtagagttagtttgacgtcgtgggtaggtttagggtatagacggatgtcgtagtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaattcgttatgattatgatcgttttcggtagatgacggcggtgtatcgcgagaagggttgagttagtatcgcgtatacgatagtcgttgatagttaattgtcgtaaagatacgtaggtttatgaacgtcgtatgaatataatatcgcgggtggatttgacgtcggtattttttcggacggtagtagaaacggatttagtacgatgtttgggaaaagtcgttcgtattagtaaggcgggtttaatcgttattatgaatacgatgttgttcgaaggttaatggtttgatttatgaaatacgtagtatattatttttcggtattatgatttgatcggttgtataggaatcggtttgaaagtcgggataaggtattattaagatttgtcgtaaattattcgtacgaggtttaagtcggttatttttggtttttgcgaataatcgttttaagtcgatttttagggtgtatttaacggtggtcgttttttatatggtggtttaagaatttttaatttcgaaggatcggttgggtgtttaa

SEQ ID NO: 8554 - DNA, 1736 bp, Artificial Sequence
  chemically treated genomic DNA (Homo sapiens) CpG-island No: 8554
ttaaacacccaaccgatccttcgaaattaaaaattcttaaaccaccatataaaaaacgaccaccgttaaatacaccctaaaaatcgacttaaaacgattattcgcaaaaaccaaaaataaccgacttaaacctcgtacgaataatttacgacaaatcttaataataccttatcccgactttcaaaccgattcctatacaaccgatcaaatcataataccgaaaaataatatactacgtatttcataaatcaaaccattaaccttcgaacaacatcgtattcataataacgattaaacccgccttactaatacgaacgacttttcccaaacatcgtactaaatccgtttctactaccgtccgaaaaaataccgacgtcaaatccacccgcgatattatattcatacgacgttcataaacctacgtatctttacgacaattaactatcaacgactatcgtatacgcgatactaactcaacccttctcgcgatacaccgccgtcatctaccgaaaacgatcataatcataacgaattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctactacgacatccgtctataccctaaacctacccacgacgtcaaactaactctacgtaacgctaccgtccgcgtattcctttttcaccacccgcttcaacccgcttcgcctacgtatacaacacttcacgacgatccaaactatcgataataataatacgatccttctcatactaatacgtataacttaaacctaccgaatttaactattctatcacccgcccgtcgctatcgtaacgataacaaatttccgatcgacccgtataacgatacgccaccatccgaccccgatatttatcatcgtaaataaaactacgcacctatatattactacgatcatacaccgccgccaattcgccgcgaaacgtccaaccataacgcaccaacgacgcgacaaataaattctccgaatattccgaatcgtacgtcaacacacgacaaacaaacgaataccgttatcccgaccatattcgatatacccgacaaaatatcaaaaaaaacgaacgattccgtcccgccgaaaataacctactaccgaacttcttctacccgctacgcctacgtaatcaataccaaccgaaaataacgcccgacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcttactaaaatacgaccaaccgataaccttcatccaatttcg

SEQ ID NO: 8555 - DNA, 1736 bp, Artificial Sequence
  chemically treated genomic DNA (Homo sapiens) CpG-island No: 8555
ttaaatatttaatcggtttttcggaattggagatttttaaattattatgtgggaaacggttatcgttgggtatattttaaaggtcggtttaaggcggttgttcgtaaaggttaagggtgatcgatttaaatttcgtgcgaatagtttgcggtaagttttggtaatattttgtttcggtttttaagtcggtttttgtatagtcggttaggttatggtatcgaaaggtggtgtgttgcgtgttttatgggttaggttattgattttcgggtagtatcgtatttataatggcggttaagttcgttttgttggtacggacggttttttttaagtatcgtattgggttcgtttttgttgtcgttcggggaaatatcggcgttaagtttattcgcgatgttgtatttatacggcgtttatgggtttgcgtgtttttacggtaattaattgttaacggttgtcgtatgcgcggtattgatttagtttttttcgcggtgtatcgtcgttatttgtcgaaagcggttatggttataacgggttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgttgcggtattcgtttgtgttttgagtttgtttacggcgttaaattgattttgcgtgacgttgtcgttcgcgtgttttttttttattattcgttttagttcgtttcgtttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaatagattttcggtcggttcgtgtgacggtgcgttattattcggtttcggtatttattatcgtaagtaaagttgcgtatttgtgtattgttgcggttatatatcgtcgttagttcgtcgcggggcgtttagttatagcgtattagcggcgcggtaggtaaatttttcgggtatttcgggtcgtgcgttagtatacggtagatagacggatgtcgttgtttcggttatattcggtgtattcggtagggtattaggaaaagcggacggtttcgtttcgtcggaaatggtttgttgtcgggttttttttgttcgttgcgtttgcgtggttagtattagtcggaagtgacgttcggtattattcgttacgtcggtgatttcgtcgttgaatttatcggcggtttcgcggtggaacgtttgtatgcgttcgaagcggtttattagttcggttagtattcggtacggcggtagcggcgtaggtagtattttattcgttttcggtattcgtttatattagtcgagtagttattacggtttttgcggattgtttgtcgttagataacgatgcggatttaagcggagttttttcggtagcgtttgttagagtgcggttagtcggtgatttttatttagtttcg

SEQ ID NO: 8556 - DNA, 1736 bp, Artificial Sequence
  chemically treated genomic DNA (Homo sapiens) CpG-island No: 8556
cgaaactaaataaaaatcaccgactaaccgcactctaacaaacgctaccgaaaaaactccgcttaaatccgcatcgttatctaacgacaaacaatccgcaaaaaccgtaataactactcgactaatataaacgaataccgaaaacgaataaaatactacctacgccgctaccgccgtaccgaatactaaccgaactaataaaccgcttcgaacgcatacaaacgttccaccgcgaaaccgccgataaattcaacgacgaaatcaccgacgtaacgaataataccgaacgtcacttccgactaatactaaccacgcaaacgcaacgaacaaaaaaaacccgacaacaaaccatttccgacgaaacgaaaccgtccgcttttcctaataccctaccgaatacaccgaatataaccgaaacaacgacatccgtctatctaccgtatactaacgcacgacccgaaatacccgaaaaatttacctaccgcgccgctaatacgctataactaaacgccccgcgacgaactaacgacgatatataaccgcaacaatacacaaatacgcaactttacttacgataataaataccgaaaccgaataataacgcaccgtcacacgaaccgaccgaaaatctattaccgttacgacaacgacgaacgaataacaaaacaactaaacccgacaaacttaaactacacgtatcaatataaaaaaaaccgcatcaccatcaccgacaacctaaaccgccgtaaaatactacacacgcaaacgaaacgaactaaaacgaataataaaaaaaaaacacgcgaacgacaacgtcacgcaaaatcaatttaacgccgtaaacaaactcaaaacacaaacgaataccgcaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacccgttataaccataaccgctttcgacaaataacgacgatacaccgcgaaaaaaactaaatcaataccgcgcatacgacaaccgttaacaattaattaccgtaaaaacacgcaaacccataaacgccgtataaatacaacatcgcgaataaacttaacgccgatatttccccgaacgacaacaaaaacgaacccaatacgatacttaaaaaaaaccgtccgtaccaacaaaacgaacttaaccgccattataaatacgatactacccgaaaatcaataacctaacccataaaacacgcaacacaccacctttcgataccataacctaaccgactatacaaaaaccgacttaaaaaccgaaacaaaatattaccaaaacttaccgcaaactattcgcacgaaatttaaatcgatcacccttaacctttacgaacaaccgccttaaaccgacctttaaaatatacccaacgataaccgtttcccacataataatttaaaaatctccaattccgaaaaaccgattaaatatttaa

SEQ ID NO: 8557 - DNA, 517 bp, Artificial Sequence
  chemically treated genomic DNA (Homo sapiens) CpG-island No: 8557
  misc_feature (353)..(353): n is either a, c, g or t
gatggggtattcggcgtattgtttatgtgtagcgattgtattagtgtaaacgtttgggcgtatattaggaagtaaaatgtttgtttaacgtcgataaagtgacgtgacggtggtaggatgatatgtggatcggtagcgacgatgtcgtttttttcgcggcgatggcgattatacgtattgtttggttgttacggcgaagtttagttagtagattaagattatattgacgggtgtaagggtggttggagataaatattattattagcgtttcgttatcgattagcgattttggtttatgacggaattcggttggagaattataaaaggtcgttagtttatttcgcgttagtttnagtattttttagcgcgattcgcgtgttggttaatttgggggttataggtaaattttaggtagaaaaaattttcgtcggtgcggatagtacgttgttgataaattgcgttttatgttgtcggatgcggcgtaaacgtttattcggtttataaaaatgtgtaaatt

SEQ ID NO: 8558 - DNA, 517 bp, Artificial Sequence
  chemically treated genomic DNA (Homo sapiens) CpG-island No: 8558
  misc_feature (165)..(165): n is either a, c, g or t
aatttacacatttttataaaccgaataaacgtttacgccgcatccgacaacataaaacgcaatttatcaacaacgtactatccgcaccgacgaaaattttttctacctaaaatttacctataacccccaaattaaccaacacgcgaatcgcgctaaaaaatactnaaactaacgcgaaataaactaacgaccttttataattctccaaccgaattccgtcataaaccaaaatcgctaatcgataacgaaacgctaataataatatttatctccaaccacccttacacccgtcaatataatcttaatctactaactaaacttcgccgtaacaaccaaacaatacgtataatcgccatcgccgcgaaaaaaacgacatcgtcgctaccgatccacatatcatcctaccaccgtcacgtcactttatcgacgttaaacaaacattttacttcctaatatacgcccaaacgtttacactaatacaatcgctacacataaacaatacgccgaataccccatc

SEQ ID NO: 8559 - DNA, 517 bp, Artificial Sequence
  chemically treated genomic DNA (Homo sapiens) CpG-island No: 8559
  misc_feature (165)..(165): n is either a, c, g or t
aatttgtatatttttgtaggtcggataagcgtttacgtcgtattcggtaatataaagcgtaatttgttagtaacgtgttattcgtatcggcggggattttttttgtttggaatttatttgtaatttttaaattaattagtacgcgagtcgcgttgaaaagtgttnggattgacgcggggtaaattggcggttttttatgattttttaatcggatttcgttatggattaaaatcgttggtcgatgacgaaacgttggtggtggtatttgtttttagttatttttatattcgttagtatgattttgatttgttggttgaatttcgtcgtgataattaggtaatgcgtgtaatcgttatcgtcgcggaaagagcgatatcgtcgttgtcggtttatatattattttgttatcgttacgttattttatcgacgttgagtaggtattttgttttttgatgtacgtttagacgtttgtattgatgtagtcgttgtatatgggtaatacgtcggatattttatt

SEQ ID NO: 8560 - DNA, 517 bp, Artificial Sequence
  chemically treated genomic DNA (Homo sapiens) CpG-island No: 8560
  misc_feature (353)..(353): n is either a, c, g or t
aataaaatatccgacgtattacccatatacaacgactacatcaatacaaacgtctaaacgtacatcaaaaaacaaaatacctactcaacgtcgataaaataacgtaacgataacaaaataatatataaaccgacaacgacgatatcgctctttccgcgacgataacgattacacgcattacctaattatcacgacgaaattcaaccaacaaatcaaaatcatactaacgaatataaaaataactaaaaacaaataccaccaccaacgtttcgtcatcgaccaacgattttaatccataacgaaatccgattaaaaaatcataaaaaaccgccaatttaccccgcgtcaatccnaacacttttcaacgcgactcgcgtactaattaatttaaaaattacaaataaattccaaacaaaaaaaatccccgccgatacgaataacacgttactaacaaattacgctttatattaccgaatacgacgtaaacgcttatccgacctacaaaaatatacaaatt

SEQ ID NO: 8561 - DNA, 503 bp, Artificial Sequence
  chemically treated genomic DNA (Homo sapiens) CpG-island No: 8561
cggttatcgttgatggcggtattcgttttttcggcgatatcgttaaagttatcgtcgttggcgtaacgcggtgatggtaggttttatgttggcgggtattgaagaattttcgggtgaaatcgaattttattagggtcgtttttataaattttatcgtggtatgggttttttgggcgcgatgtttaaaggtttttttgatcgttatttttagagcgataacgttgtcgataaattggtgtcggaaggtatcgaaggtcgcgtatttataaaggtcgtttgaaagagattatttattagtagatgggcggtttgcgtttttgtatgggtttgatcggttgtggtattatcgacgaattgcgtattaaagcggagtttgtacgtattagcggtgcgggtatttaggaaagttacgtttacgacgtgattattattaaagagttttcgaattatcgtttgggtttttgatttttttcgttcgattttatgtcgggcgatttatatta

SEQ ID NO: 8562 - DNA, 503 bp, Artificial Sequence
  chemically treated genomic DNA (Homo sapiens) CpG-island No: 8562
taatataaatcgcccgacataaaatcgaacgaaaaaaatcaaaaacccaaacgataattcgaaaactctttaataataatcacgtcgtaaacgtaactttcctaaatacccgcaccgctaatacgtacaaactccgctttaatacgcaattcgtcgataataccacaaccgatcaaacccatacaaaaacgcaaaccgcccatctactaataaataatctctttcaaacgacctttataaatacgcgaccttcgataccttccgacaccaatttatcgacaacgttatcgctctaaaaataacgatcaaaaaaacctttaaacatcgcgcccaaaaaacccataccacgataaaatttataaaaacgaccctaataaaattcgatttcacccgaaaattcttcaatacccgccaacataaaacctaccatcaccgcgttacgccaacgacgataactttaacgatatcgccgaaaaaacgaataccgccatcaacgataaccg

SEQ ID NO: 8563 - DNA, 503 bp, Artificial Sequence
  chemically treated genomic DNA (Homo sapiens) CpG-island No: 8563
taatataaatcgttcgatatgaagtcgggcgaagagaattaggagtttagacggtagttcggggattttttagtaatggttacgtcgtgaacgtggtttttttgaatgttcgtatcgttgatacgtataaatttcgttttagtacgtagttcgtcgatagtattatagtcggttagatttatataggagcgtaggtcgtttatttgttggtgaatgattttttttaggcgatttttataggtacgcgattttcgatatttttcggtattagtttgtcggtagcgttatcgttttggaaataacggttagaggaatttttggatatcgcgtttagggaatttatattacggtaagatttgtaagaacggttttggtagagttcgattttattcggagattttttagtattcgttagtatggaatttattattatcgcgttgcgttagcggcgatagttttggcgatgtcgtcggagaagcgaatatcgttattagcgataatcg

SEQ ID NO: 8564 - DNA, 503 bp, Artificial Sequence
  chemically treated genomic DNA (Homo sapiens) CpG-island No: 8564
cgattatcgctaataacgatattcgcttctccgacgacatcgccaaaactatcgccgctaacgcaacgcgataataataaattccatactaacgaatactaaaaaatctccgaataaaatcgaactctaccaaaaccgttcttacaaatcttaccgtaatataaattccctaaacgcgatatccaaaaattcctctaaccgttatttccaaaacgataacgctaccgacaaactaataccgaaaaatatcgaaaatcgcgtacctataaaaatcgcctaaaaaaaatcattcaccaacaaataaacgacctacgctcctatataaatctaaccgactataatactatcgacgaactacgtactaaaacgaaatttatacgtatcaacgatacgaacattcaaaaaaaccacgttcacgacgtaaccattactaaaaaatccccgaactaccgtctaaactcctaattctcttcgcccgacttcatatcgaacgatttatatta

SEQ ID NO: 8565 - DNA, 931 bp, Artificial Sequence
  chemically treated genomic DNA (Homo sapiens) CpG-island No: 8565
cgtttatggtcgtagttgttgggcggtgtgatgttgacgttgttgttatttcgttcgttaattttgatggggtttgatgatggcgtggcgcgtaatttcgggttggttttgttttttgcgcgtttggtagcgttgtcgttggcgattgttattagtgcgttgttggtgaacgttgtggggattatcggttttatcgggttgttcgcgtcgttgttggtaaaaatgttgggggcgcggcgtttgttgttacgattgatgttggcgtcgttgattgtgcgttgattttttggtttttcgattaaattattttttggttgattcgcgtgtggatggaagtgtttatcggttcggttattgcgttgatcggtgcgtcgttgttattgtggttgttgtcgcgtttacgtagtattagcgcgtcggatatgaaggttaacgatcgtgtcgcggtgaacgttaatatgtgttggcgttatgtttcgcgggcggcgtgttgttgttgatggttgtggtggtggcgttgtcgtttggtcgtgatgcgtacggttggacgtgggcgagcggggcgttgttcgaggatttaatgttttggcgttggtcgcgaattatggcggcgttgtttgcgggcgttatgttggcggtggcgggttgtattatttagcgattgatcggaaattcgatggtaagttcggaagtgttggggattagtttcggcgcggcgtttggcgtggtgttgatgttgtttttggtgtcgggtaatgtttttggttggttgttatttgcgtggtagtttcggcgcggcggtgacgttgttgattattatgatcgtcgtcggtcgcggtggattttttttatatcgtatgttattggcggggatggcgttaagtatcgcgattagtaattaacgtgtagtattttttgatagtataatttt

SEQ ID NO: 8566 - DNA, 931 bp, Artificial Sequence
  chemically treated genomic DNA (Homo sapiens) CpG-island No: 8566
aaaattatactatcaaaaaatactacacgttaattactaatcgcgatacttaacgccatccccgccaataacatacgatataaaaaaaatccaccgcgaccgacgacgatcataataatcaacaacgtcaccgccgcgccgaaactaccacgcaaataacaaccaaccaaaaacattacccgacaccaaaaacaacatcaacaccacgccaaacgccgcgccgaaactaatccccaacacttccgaacttaccatcgaatttccgatcaatcgctaaataatacaacccgccaccgccaacataacgcccgcaaacaacgccgccataattcgcgaccaacgccaaaacattaaatcctcgaacaacgccccgctcgcccacgtccaaccgtacgcatcacgaccaaacgacaacgccaccaccacaaccatcaacaacaacacgccgcccgcgaaacataacgccaacacatattaacgttcaccgcgacacgatcgttaaccttcatatccgacgcgctaatactacgtaaacgcgacaacaaccacaataacaacgacgcaccgatcaacgcaataaccgaaccgataaacacttccatccacacgcgaatcaaccaaaaaataatttaatcgaaaaaccaaaaaatcaacgcacaatcaacgacgccaacatcaatcgtaacaacaaacgccgcgcccccaacatttttaccaacaacgacgcgaacaacccgataaaaccgataatccccacaacgttcaccaacaacgcactaataacaatcgccaacgacaacgctaccaaacgcgcaaaaaacaaaaccaacccgaaattacgcgccacgccatcatcaaaccccatcaaaattaacgaacgaaataacaacaacgtcaacatcacaccgcccaacaactacgaccataaacg

SEQ ID NO: 8567 - DNA, 931 bp, Artificial Sequence
  chemically treated genomic DNA (Homo sapiens) CpG-island No: 8567
aggattatattattaagagatgttatacgttaattgttgatcgcggtgtttaacgttattttcgttagtaatatacggtgtggggaaaatttatcgcggtcggcggcgattataatgattaatagcgttatcgtcgcgtcgagattgttacgtaggtaatagttagttaaaggtattattcggtattagaaatagtattaatattacgttaaacgtcgcgtcggagttaatttttagtattttcgggtttgttatcgggttttcggttagtcgttgaataatatagttcgttatcgttagtatgacgttcgtaaatagcgtcgttataattcgcggttagcgttagggtattaaattttcgagtaacgtttcgttcgtttacgtttagtcgtgcgtattacgattaaacgatagcgttattattatagttattaatagtagtacgtcgttcgcgaggtataacgttagtatatgttggcgtttatcgcgatacgatcgttgatttttatattcggcgcgttaatgttgcgtaaacgcggtaatagttatagtagtagcggcgtatcgattaacgtagtgatcgaatcggtggatatttttatttatacgcgagttagttagaggatgatttgatcggaaagttagaggattagcgtataattaacgacgttagtattagtcgtggtagtagacgtcgcgtttttagtatttttgttagtagcggcgcgaataattcgataaagtcgataatttttatagcgtttattagtagcgtattgatgataatcgttagcgatagcgttgttagacgcgtaagagataaggttagttcgagattgcgcgttacgttattattaagttttattagggttaacggacgaagtagtagtaacgttagtattatatcgtttagtagttgcggttataaacg

SEQ ID NO: 8568 - DNA, 931 bp, Artificial Sequence
  chemically treated genomic DNA (Homo sapiens) CpG-island No: 8568
cgtttataaccgcaactactaaacgatataatactaacgttactactacttcgtccgttaaccctaataaaacttaataataacgtaacgcgcaatctcgaactaaccttatctcttacgcgtctaacaacgctatcgctaacgattatcatcaatacgctactaataaacgctataaaaattatcgactttatcgaattattcgcgccgctactaacaaaaatactaaaaacgcgacgtctactaccacgactaatactaacgtcgttaattatacgctaatcctctaactttccgatcaaatcatcctctaactaactcgcgtataaataaaaatatccaccgattcgatcactacgttaatcgatacgccgctactactataactattaccgcgtttacgcaacattaacgcgccgaatataaaaatcaacgatcgtatcgcgataaacgccaacatatactaacgttatacctcgcgaacgacgtactactattaataactataataataacgctatcgtttaatcgtaatacgcacgactaaacgtaaacgaacgaaacgttactcgaaaatttaataccctaacgctaaccgcgaattataacgacgctatttacgaacgtcatactaacgataacgaactatattattcaacgactaaccgaaaacccgataacaaacccgaaaatactaaaaattaactccgacgcgacgtttaacgtaatattaatactatttctaataccgaataatacctttaactaactattacctacgtaacaatctcgacgcgacgataacgctattaatcattataatcgccgccgaccgcgataaattttccccacaccgtatattactaacgaaaataacgttaaacaccgcgatcaacaattaacgtataacatctcttaataatataatcct

SEQ ID NO: 8569 - DNA, 570 bp, Artificial Sequence
  chemically treated genomic DNA (Homo sapiens) CpG-island No: 8569
attcgcgatatttgttcgcgtttgggttggaggggtatttggttatcgtatttgaattttattttcgcgaaggcgattcgaatgattttgtcgatatttttacgttgttttagcggtttggtagtaaaagtgtttgattcgtaggtgttggtcgatttcgattatgttgttagttgggttttacgtaacggcggcgatttttattcgttaatgtttatcgatttgttcgggttgtcgtatattttgttgtattcgttataatttatagtaaagttttatttgttggtacgtaaatttaggtataagtgtttaattatcgaatatttgtgtatttaacgatttaagttcggtttcgtgtacgaatggcgtattgtaaaattgcggtattggtgttttttcgtgtcgaatatgtacgtcgcggttgggtatagtagtattatattcggcgcgttgcgtatatgataatttgcgttagtttaaattgttggggtcggatgtatgtttttattttatttacgttcgttttttggcggatgagttgtttaaggggttgattaagtattatgatgg

SEQ ID NO: 8570 - DNA, 570 bp, Artificial Sequence
  chemically treated genomic DNA (Homo sapiens) CpG-island No: 8570
ccatcataatacttaatcaaccccttaaacaactcatccgccaaaaaacgaacgtaaataaaataaaaacatacatccgaccccaacaatttaaactaacgcaaattatcatatacgcaacgcgccgaatataatactactatacccaaccgcgacgtacatattcgacacgaaaaaacaccaataccgcaattttacaatacgccattcgtacacgaaaccgaacttaaatcgttaaatacacaaatattcgataattaaacacttatacctaaatttacgtaccaacaaataaaactttactataaattataacgaatacaacaaaatatacgacaacccgaacaaatcgataaacattaacgaataaaaatcgccgccgttacgtaaaacccaactaacaacataatcgaaatcgaccaacacctacgaatcaaacacttttactaccaaaccgctaaaacaacgtaaaaatatcgacaaaatcattcgaatcgccttcgcgaaaataaaattcaaatacgataaccaaatacccctccaacccaaacgcgaacaaatatcgcgaat

SEQ ID NO: 8571 - DNA, 570 bp, Artificial Sequence
  chemically treated genomic DNA (Homo sapiens) CpG-island No: 8571
ttattatggtgtttgattagttttttagatagtttattcgttagaggacgaacgtagatggagtaaaagtatatattcggttttagtagtttgaattgacgtaggttgttatgtacgtaacgcgtcgaatgtggtattgttgtatttagtcgcgacgtgtatattcggtacgaaggaatattagtatcgtagttttgtaatgcgttattcgtgtacgagatcgggtttagatcgttgggtatataggtgttcggtaattgagtatttgtgtttgagtttgcgtattagtagatggggttttattgtggattatggcggatatagtagggtatacggtagttcgagtagatcggtgagtattaacgagtgaagatcgtcgtcgttgcgtgaagtttaattggtaatatgatcgagatcggttagtatttgcgagttaggtatttttgttattagatcgttaaggtaacgtggggatatcggtaaaattattcggatcgttttcgcggaagtaaagtttaggtgcgatagttagatatttttttagtttagacgcggataaatgtcgcggat

SEQ ID NO: 8572 - DNA, 570 bp, Artificial Sequence
  chemically treated genomic DNA (Homo sapiens) CpG-island No: 8572
atccgcgacatttatccgcgtctaaactaaaaaaatatctaactatcgcacctaaactttacttccgcgaaaacgatccgaataattttaccgatatccccacgttaccttaacgatctaataacaaaaatacctaactcgcaaatactaaccgatctcgatcatattaccaattaaacttcacgcaacgacgacgatcttcactcgttaatactcaccgatctactcgaactaccgtataccctactatatccgccataatccacaataaaaccccatctactaatacgcaaactcaaacacaaatactcaattaccgaacacctatatacccaacgatctaaacccgatctcgtacacgaataacgcattacaaaactacgatactaatattccttcgtaccgaatatacacgtcgcgactaaatacaacaataccacattcgacgcgttacgtacataacaacctacgtcaattcaaactactaaaaccgaatatatacttttactccatctacgttcgtcctctaacgaataaactatctaaaaaactaatcaaacaccataataa

SEQ ID NO: 8573 - DNA, 699 bp, Artificial Sequence
  chemically treated genomic DNA (Homo sapiens) CpG-island No: 8573
tcgttagtaggatcgttagattcgggaaggttacgatttattaggcgttttgcgcgaattgtaatacgtcggagagtatggtgttttatttaggcgttggcggttgtgtttttatgtcgaggaaattaagagtagttatatcgagaatggcgttagagaaatcgagcgacgtttgaataattagcggcgtaaggtagttcgggaagatgttaataaatatttgacgtatcgttcggtattcgtacgcgagacgcggtgacgtaatcgcggttaaattttatagtacggcgcgcgtaagtcgtgggtatgtgcggattaaatcgcgcgattcgtattagtattcggcgattttgtttaattatatgtcgtacgagtaggattggtaggagtttcgtgttggtaattcgtattattcgcgagattatgtattaattcgcgttggattagtatcgtggtcgcgaaattagtttcggtgtcgaatgttagacggatgaatagttcgatgagttcgtgcgtaattacgtcgaaatcgttttttattcgtgcggtatttgtaaaatgggttacgacgagatgttcgtggttgacggcgaaggtcgcgtatacgggttagaaggtttgcgtgtggtggatgcgtcgattatgtcgtagattattatcgggaatttgaacgttacgataattatgattggcgagaaa

SEQ ID NO: 8574 - DNA, 699 bp, Artificial Sequence
  chemically treated genomic DNA (Homo sapiens) CpG-island No: 8574
tttctcgccaatcataattatcgtaacgttcaaattcccgataataatctacgacataatcgacgcatccaccacacgcaaaccttctaacccgtatacgcgaccttcgccgtcaaccacgaacatctcgtcgtaacccattttacaaataccgcacgaataaaaaacgatttcgacgtaattacgcacgaactcatcgaactattcatccgtctaacattcgacaccgaaactaatttcgcgaccacgatactaatccaacgcgaattaatacataatctcgcgaataatacgaattaccaacacgaaactcctaccaatcctactcgtacgacatataattaaacaaaatcgccgaatactaatacgaatcgcgcgatttaatccgcacatacccacgacttacgcgcgccgtactataaaatttaaccgcgattacgtcaccgcgtctcgcgtacgaataccgaacgatacgtcaaatatttattaacatcttcccgaactaccttacgccgctaattattcaaacgtcgctcgatttctctaacgccattctcgatataactactcttaatttcctcgacataaaaacacaaccgccaacgcctaaataaaacaccatactctccgacgtattacaattcgcgcaaaacgcctaataaatcgtaaccttcccgaatctaacgatcctactaacga

SEQ ID NO: 8575 - DNA, 699 bp, Artificial Sequence
  chemically treated genomic DNA (Homo sapiens) CpG-island No: 8575
tttttcgttaattataattgtcgtggcgtttaaattttcggtgataatttgcggtataatcgacgtatttattatacgtaggttttttaattcgtgtacgcggttttcgtcgttaattacggatatttcgtcgtaatttattttgtaggtatcgtacggatggaaggcggtttcggcgtggttacgtacgaatttatcgagttgtttattcgtttggtattcgatatcggggttgatttcgcggttacgatattgatttagcgcgggttgatgtatgatttcgcgggtgatgcgaattgttaatacggaatttttgttagttttgttcgtgcgatatgtagttaaatagaatcgtcggatgttggtgcgggtcgcgcgatttaattcgtatatgtttacggtttgcgcgcgtcgtgttgtgaagtttaatcgcgattacgttatcgcgtttcgcgtgcgggtgtcgggcgatgcgttagatgtttattaatattttttcgaattgttttgcgtcgttgattgtttaggcgtcgttcggtttttttaacgttattttcgatatggttgtttttggttttttcggtatgggggtatagtcgttaacgtttgagtggggtattatgtttttcgacgtgttgtagttcgcgtaaagcgtttggtgggtcgtgattttttcgggtttggcgattttgttgacgg

SEQ ID NO: 8576 - DNA, 699 bp, Artificial Sequence
  chemically treated genomic DNA (Homo sapiens) CpG-island No: 8576
ccgtcaacaaaatcgccaaacccgaaaaaatcacgacccaccaaacgctttacgcgaactacaacacgtcgaaaaacataataccccactcaaacgttaacgactatacccccataccgaaaaaaccaaaaacaaccatatcgaaaataacgttaaaaaaaccgaacgacgcctaaacaatcaacgacgcaaaacaattcgaaaaaatattaataaacatctaacgcatcgcccgacacccgcacgcgaaacgcgataacgtaatcgcgattaaacttcacaacacgacgcgcgcaaaccgtaaacatatacgaattaaatcgcgcgacccgcaccaacatccgacgattctatttaactacatatcgcacgaacaaaactaacaaaaattccgtattaacaattcgcatcacccgcgaaatcatacatcaacccgcgctaaatcaatatcgtaaccgcgaaatcaaccccgatatcgaataccaaacgaataaacaactcgataaattcgtacgtaaccacgccgaaaccgccttccatccgtacgatacctacaaaataaattacgacgaaatatccgtaattaacgacgaaaaccgcgtacacgaattaaaaaacctacgtataataaatacgtcgattataccgcaaattatcaccgaaaatttaaacgccacgacaattataattaacgaaaaa

SEQ ID NO: 8577 - DNA, 781 bp, Artificial Sequence
  chemically treated genomic DNA (Homo sapiens) CpG-island No: 8577
tcgcgttttttttcgatgtgtttttattcgatacgttttattttgaaagtaatttcgttattgcgttggtagttagtcgtaatattttcgtcgtcgtatttagttatgtttttggtgaagtgttgcgttagattaaattattgatgcgttttgatgcgcgtttggtgtgggcgattaaagggttggaagcggaaatcggacgtttgttataggacgtggcgcgtgatgttttaggcgattaaatttcgttggcggttatttttggtttaacgtttgcgaaagaattggcggtaggtttatcgatagttatttcgttggtttcgatcgattagatttttgtcgatgatttttagtagttgttgtattgcggtaaaagttttcgcgtttatagtaattcggattttattggcgtgtagtttggcggcgcggtgaaaaacgttattgttattggtgcggggatgttcgacggtatcggttttggtgcgaatgcgcgtacggcgttgattattcgtgggttggttgaaatgtcgcgttttggtgcggcgttgggtgtcgattttgttatttttatgggtatggcggggtttggcgatttggtgtttatttgtatcgataattagtcgcgtaatcgtcgttttggtatgatgttcggttagggtatggatgtataaagcgcgtaggagaagattggttaggtggtggaaggttatcgtaatacgaaagaagttcgcgaattggcgtatcgtttcggcgttgaaatgttaataatcgaggaaattta

SEQ ID NO: 8578 - DNA, 781 bp, Artificial Sequence
  chemically treated genomic DNA (Homo sapiens) CpG-island No: 8578
taaatttcctcgattattaacatttcaacgccgaaacgatacgccaattcgcgaacttctttcgtattacgataaccttccaccacctaaccaatcttctcctacgcgctttatacatccataccctaaccgaacatcataccaaaacgacgattacgcgactaattatcgatacaaataaacaccaaatcgccaaaccccgccatacccataaaaataacaaaatcgacacccaacgccgcaccaaaacgcgacatttcaaccaacccacgaataatcaacgccgtacgcgcattcgcaccaaaaccgataccgtcgaacatccccgcaccaataacaataacgtttttcaccgcgccgccaaactacacgccaataaaatccgaattactataaacgcgaaaacttttaccgcaatacaacaactactaaaaatcatcgacaaaaatctaatcgatcgaaaccaacgaaataactatcgataaacctaccgccaattctttcgcaaacgttaaaccaaaaataaccgccaacgaaatttaatcgcctaaaacatcacgcgccacgtcctataacaaacgtccgatttccgcttccaaccctttaatcgcccacaccaaacgcgcatcaaaacgcatcaataatttaatctaacgcaacacttcaccaaaaacataactaaatacgacgacgaaaatattacgactaactaccaacgcaataacgaaattactttcaaaataaaacgtatcgaataaaaacacatcgaaaaaaaacgcga

SEQ ID NO: 8579 - DNA, 781 bp, Artificial Sequence
  chemically treated genomic DNA (Homo sapiens) CpG-island No: 8579
taaattttttcggttattggtattttaacgtcgaagcgatgcgttagttcgcggatttttttcgtattgcggtagttttttattatttgattaatttttttttgcgcgttttgtatatttatgttttgatcgagtattatgttaaaacggcggttacgcgattggttgtcggtataggtaagtattagatcgttaagtttcgttatgtttataaaggtggtagggtcggtatttagcgtcgtattaagacgcgatattttagttagtttacgggtgattagcgtcgtacgcgtattcgtattaaaatcgatatcgtcggatattttcgtattaatggtaataacgttttttatcgcgtcgttaagttgtacgttaatgaaattcggattgttgtaaacgcggaaatttttgtcgtagtgtagtagttgttggagattatcggtaaaggtttgatcggtcgaggttagcgaaatagttgtcggtaaatttgtcgttagttttttcgtaaacgttgggttagagataatcgttagcggaatttgatcgtttaaggtattacgcgttacgttttgtaatagacgttcggttttcgtttttagttttttggtcgtttatattagacgcgtattaggacgtattagtggtttaatttggcgtagtattttattaaagatatggttgggtacgacgacgagaatattacggttggttgttagcgtagtggcgagattgtttttaagatggagcgtatcgggtaaaggtatatcggggagaaacgcgg

SEQ ID NO: 8580 - DNA, 781 bp, Artificial Sequence
  chemically treated genomic DNA (Homo sapiens) CpG-island No: 8580
ccgcgtttctccccgatatacctttacccgatacgctccatcttaaaaacaatctcgccactacgctaacaaccaaccgtaatattctcgtcgtcgtacccaaccatatctttaataaaatactacgccaaattaaaccactaatacgtcctaatacgcgtctaatataaacgaccaaaaaactaaaaacgaaaaccgaacgtctattacaaaacgtaacgcgtaataccttaaacgatcaaattccgctaacgattatctctaacccaacgtttacgaaaaaactaacgacaaatttaccgacaactatttcgctaacctcgaccgatcaaacctttaccgataatctccaacaactactacactacgacaaaaatttccgcgtttacaacaatccgaatttcattaacgtacaacttaacgacgcgataaaaaacgttattaccattaatacgaaaatatccgacgatatcgattttaatacgaatacgcgtacgacgctaatcacccgtaaactaactaaaatatcgcgtcttaatacgacgctaaataccgaccctaccacctttataaacataacgaaacttaacgatctaatacttacctataccgacaaccaatcgcgtaaccgccgttttaacataatactcgatcaaaacataaatatacaaaacgcgcaaaaaaaaattaatcaaataataaaaaactaccgcaatacgaaaaaaatccgcgaactaacgcatcgcttcgacgttaaaataccaataaccgaaaaaattta

SEQ ID NO: 8581 - DNA, 532 bp, Artificial Sequence
  chemically treated genomic DNA (Homo sapiens) CpG-island No: 8581
gtttgcgggttgaattcgtacgcgggttgaagcggttatatcggtacggaagatatagatattattatttcggtgtttaatgagttgcgggcgtagcggatgaaatttaacggagcgttgtttgtcgataatttgtattagtcgaaatattttgatgacgtcgacgtcgtgttggcgatgtagtacgattagggttttttcgtgttagaatatttaggtttcgggcgcggtataacgtcgaagaagcggttttggtagcgcgcgaatttattgcgtaagggttataaattgtgttggttaaatatttggcgcgagttggttatagtcgtgatcgttttgaaatgttgttggttatcgtcgatgaagtttggtatattagtcgttcgttggtggattttggtatgcgttatcggtaggtgttggtgatgtgacgagcggtttattgttggtgaaattgttttagggggtaacgttgtaggaggcgttggaatatgtgatcgttgtagtttacgaaattatggtgattattaaa

SEQ ID NO: 8582 - DNA, 532 bp, Artificial Sequence
  chemically treated genomic DNA (Homo sapiens) CpG-island No: 8582
tttaataatcaccataatttcgtaaactacaacgatcacatattccaacgcctcctacaacgttaccccctaaaacaatttcaccaacaataaaccgctcgtcacatcaccaacacctaccgataacgcataccaaaatccaccaacgaacgactaatataccaaacttcatcgacgataaccaacaacatttcaaaacgatcacgactataaccaactcgcgccaaatatttaaccaacacaatttataacccttacgcaataaattcgcgcgctaccaaaaccgcttcttcgacgttataccgcgcccgaaacctaaatattctaacacgaaaaaaccctaatcgtactacatcgccaacacgacgtcgacgtcatcaaaatatttcgactaatacaaattatcgacaaacaacgctccgttaaatttcatccgctacgcccgcaactcattaaacaccgaaataataatatctatatcttccgtaccgatataaccgcttcaacccgcgtacgaattcaacccgcaaac

SEQ ID NO: 8583 - DNA, 532 bp, Artificial Sequence
  chemically treated genomic DNA (Homo sapiens) CpG-island No: 8583
tttggtggttattatgatttcgtagattgtagcggttatatgttttagcgttttttgtagcgttgttttttgaagtagttttattagtagtaaatcgttcgttatattattaatatttatcggtggcgtatattaaaatttattagcggacggttgatatgttaggttttatcggcggtgattagtagtattttaaaacggttacggttgtagttagttcgcgttaggtgtttaattaatataatttgtggtttttgcgtaatgagttcgcgcgttgttagaatcgttttttcgacgttatatcgcgttcgaagtttgggtattttagtacgggaagattttgatcgtgttatatcgttagtacggcgtcggcgttattaagatatttcggttgatataggttatcggtaggtagcgtttcgttgagttttattcgttgcgttcgtagtttattgagtatcggaataatggtgtttatgtttttcgtatcgatatgatcgttttagttcgcgtgcggatttagttcgtagat

SEQ ID NO: 8584 - DNA, 532 bp, Artificial Sequence
  chemically treated genomic DNA (Homo sapiens) CpG-island No: 8584
atctacgaactaaatccgcacgcgaactaaaacgatcatatcgatacgaaaaacataaacaccattattccgatactcaataaactacgaacgcaacgaataaaactcaacgaaacgctacctaccgataacctatatcaaccgaaatatcttaataacgccgacgccgtactaacgatataacacgatcaaaatcttcccgtactaaaatacccaaacttcgaacgcgatataacgtcgaaaaaacgattctaacaacgcgcgaactcattacgcaaaaaccacaaattatattaattaaacacctaacgcgaactaactacaaccgtaaccgttttaaaatactactaatcaccgccgataaaacctaacatatcaaccgtccgctaataaattttaatatacgccaccgataaatattaataatataacgaacgatttactactaataaaactacttcaaaaaacaacgctacaaaaaacgctaaaacatataaccgctacaatctacgaaatcataataaccaccaaa

SEQ ID NO: 8585 - DNA, 648 bp, Artificial Sequence
  chemically treated genomic DNA (Homo sapiens) CpG-island No: 8585
tgacggcgaaaggggaagaagtggatcgtatcgtaggtttggagattggcgttgacgattatattttaaaatcgtttaattcgcgtgaattgttggttcgtattcgtgcggtgttgcgtcgttaggcgaacgaattgttaggcgtatcgttataggaagaggcggtaattgttttcggtaagtttaaatttaatttcggtacgcgcgaaatgtttcgcgaagacgagtcgatgtcgtttattagcggtgagtttgcggtattgaaggtattggttagttattcgcgtgagtcgttttttcgcgataagttgatgaattttgttcgtggtcgtgaatatttcgtaatggaacgttttatcgacgtgtagatttcgcgtttgcgtcgtatggtggaagaagatttagcgtattcgcgttatatttagatcgtttggggtttgggttacgtttttgtatcggacggttttaaagtatgaggcgattgcgtttttcgttacgaagtttatttgttcgtacgttattgtttatcgttattttgttgttcgttagtttggtgacgatttatttggtggtgttgaatttcgcgattttgtcgagtttttagtagtttaataaagttttcgcgtacgaagtgcgtatgttgatgat

SEQ ID NO: 8586 - DNA, 648 bp, Artificial Sequence
  chemically treated genomic DNA (Homo sapiens) CpG-island No: 8586
atcatcaacatacgcacttcgtacgcgaaaactttattaaactactaaaaactcgacaaaatcgcgaaattcaacaccaccaaataaatcgtcaccaaactaacgaacaacaaaataacgataaacaataacgtacgaacaaataaacttcgtaacgaaaaacgcaatcgcctcatactttaaaaccgtccgatacaaaaacgtaacccaaaccccaaacgatctaaatataacgcgaatacgctaaatcttcttccaccatacgacgcaaacgcgaaatctacacgtcgataaaacgttccattacgaaatattcacgaccacgaacaaaattcatcaacttatcgcgaaaaaacgactcacgcgaataactaaccaataccttcaataccgcaaactcaccgctaataaacgacatcgactcgtcttcgcgaaacatttcgcgcgtaccgaaattaaatttaaacttaccgaaaacaattaccgcctcttcctataacgatacgcctaacaattcgttcgcctaacgacgcaacaccgcacgaatacgaaccaacaattcacgcgaattaaacgattttaaaatataatcgtcaacgccaatctccaaacctacgatacgatccacttcttcccctttcgccgtca

SEQ ID NO: 8587 - DNA, 648 bp, Artificial Sequence
  chemically treated genomic DNA (Homo sapiens) CpG-island No: 8587
gttattaatatacgtatttcgtacgcgaggattttattaaattgttggaggttcggtaaaatcgcgaagtttagtattattagataagtcgttattaggttggcgaatagtaaggtgacgatgagtaataacgtacgggtaaatgaatttcgtggcgagaagcgtaatcgttttatgttttagagtcgttcggtataaagacgtagtttagattttagacggtttgaatgtaacgcggatgcgttggatttttttttattatgcggcgtagacgcgaaatttgtacgtcgatggagcgttttattgcggaatatttacgattacgggtaaggtttattagtttatcgcgggagagcggtttacgcggatggttgattagtgtttttagtatcgtaaatttatcgttggtgagcggtatcggttcgttttcgcggaatatttcgcgcgtatcgaggttaagtttgaatttatcgaaagtaattatcgtttttttttgtgacggtgcgtttggtagttcgttcgtttgacgacgtagtatcgtacggatacgggttagtagtttacgcgggttaaacggttttggaatgtagtcgttagcgttaatttttaggtttacgatacggtttatttttttttttttcgtcgtta

SEQ ID NO: 8588 - DNA, 648 bp, Artificial Sequence
  chemically treated genomic DNA (Homo sapiens) CpG-island No: 8588
taacgacgaaaaaaaaaaaaataaaccgtatcgtaaacctaaaaattaacgctaacgactacattccaaaaccgtttaacccgcgtaaactactaacccgtatccgtacgatactacgtcgtcaaacgaacgaactaccaaacgcaccgtcacaaaaaaaaacgataattactttcgataaattcaaacttaacctcgatacgcgcgaaatattccgcgaaaacgaaccgataccgctcaccaacgataaatttacgatactaaaaacactaatcaaccatccgcgtaaaccgctctcccgcgataaactaataaaccttacccgtaatcgtaaatattccgcaataaaacgctccatcgacgtacaaatttcgcgtctacgccgcataataaaaaaaaatccaacgcatccgcgttacattcaaaccgtctaaaatctaaactacgtctttataccgaacgactctaaaacataaaacgattacgcttctcgccacgaaattcatttacccgtacgttattactcatcgtcaccttactattcgccaacctaataacgacttatctaataatactaaacttcgcgattttaccgaacctccaacaatttaataaaatcctcgcgtacgaaatacgtatattaataac

SEQ ID NO: 8589 - DNA, 962 bp, Artificial Sequence
  chemically treated genomic DNA (Homo sapiens) CpG-island No: 8589
  misc_feature (794)..(794): n is either a, c, g or t
  misc_feature (833)..(833): n is either a, c, g or t
agtgggtagatttggttatcgcgttagcgtaaagtggtggaaattcgtaaaattatcgtcggttgggtgagttagtttttgcgcgttatttcgcgtattttagtattggaagtggtgatgtagtcgttgttcgatatcggcgtttcgcgtgaagtttgcgtcgttaaagtcgcgcgtttttttattcgtttgaacgtgtcggaacgtttgtggtatttggtattatcgatatttttcggtggcgaatagtagcgcgttaatatcgttcgcggttttatcgtcgattattttattttgttgtttgacgaatttatcgtttcgttggacgttaaaaatagcgtcgcggtggtggaattgattcgcgaattaaaattcgtggcgtagtatcgtaggtattttttatgacgaagttgtacgtaatgacgtcgtcgatcgtttgtatttaatgggagtttttttatgattattaataacgttaagttggtgttggaaaacgaggtggtaagcggttcgttggaggtgtagaacggcgaaattcgcgtttttgtcgaaagttagagtcgtttgtcggatgcgatggacggcgaaggcggttggttgttgtcggggttgattgagttgtatatcgataatttggataaattttttatttcgcgttcgaaagttgattggtttgtttattcggcgatgagtagttacgacgcgttgattgtggcgaacggtatttatatcggtaattggatgtcgtgggtaatttggcgacgtgcgtcgatcggcgggcgatttcggttggnagaaatttgggagaaagatggattttaacgtttattcgnaagaagatcgtaagaaaacggcgggcgtttaaatcgggggttcgaagtaaatcgtttttgtaatttttgggtttgtcggaaatttgtcggtaattaaaaaattaaggtttgttcggtttggtttgaaaa

SEQ ID NO: 8590 - DNA, 962 bp, Artificial Sequence
  chemically treated genomic DNA (Homo sapiens) CpG-island No: 8590
  misc_feature (130)..(130): n is either a, c, g or t
  misc_feature (169)..(169): n is either a, c, g or t
ttttcaaaccaaaccgaacaaaccttaattttttaattaccgacaaatttccgacaaacccaaaaattacaaaaacgatttacttcgaacccccgatttaaacgcccgccgttttcttacgatcttcttncgaataaacgttaaaatccatctttctcccaaatttctnccaaccgaaatcgcccgccgatcgacgcacgtcgccaaattacccacgacatccaattaccgatataaataccgttcgccacaatcaacgcgtcgtaactactcatcgccgaataaacaaaccaatcaactttcgaacgcgaaataaaaaatttatccaaattatcgatatacaactcaatcaaccccgacaacaaccaaccgccttcgccgtccatcgcatccgacaaacgactctaactttcgacaaaaacgcgaatttcgccgttctacacctccaacgaaccgcttaccacctcgttttccaacaccaacttaacgttattaataatcataaaaaaactcccattaaatacaaacgatcgacgacgtcattacgtacaacttcgtcataaaaaatacctacgatactacgccacgaattttaattcgcgaatcaattccaccaccgcgacgctatttttaacgtccaacgaaacgataaattcgtcaaacaacaaaataaaataatcgacgataaaaccgcgaacgatattaacgcgctactattcgccaccgaaaaatatcgataataccaaataccacaaacgttccgacacgttcaaacgaataaaaaaacgcgcgactttaacgacgcaaacttcacgcgaaacgccgatatcgaacaacgactacatcaccacttccaatactaaaatacgcgaaataacgcgcaaaaactaactcacccaaccgacgataattttacgaatttccaccactttacgctaacgcgataaccaaatctacccact

SEQ ID NO: 8591 - DNA, 962 bp, Artificial Sequence
  chemically treated genomic DNA (Homo sapiens) CpG-island No: 8591
  misc_feature (130)..(130): n is either a, c, g or t
  misc_feature (169)..(169): n is either a, c, g or t
tttttaaattaagtcgggtaaattttggttttttaattgtcggtaaattttcggtaggtttaaagattgtaagaacggtttgtttcgggttttcggtttgaacgttcgtcgtttttttgcggtttttttncgaatgggcgttggaatttattttttttttagatttttnttagtcggaatcgttcgtcggtcggcgtacgtcgttaaattgtttacggtatttagttatcggtgtgaatgtcgttcgttataattagcgcgtcgtggttgtttatcgtcgagtgggtaggttagttaattttcgggcgcggggtgaagaatttatttagattatcggtatgtagtttaattagtttcggtagtagttagtcgttttcgtcgtttatcgtattcggtaggcggttttggttttcggtaaaggcgcggatttcgtcgttttgtatttttagcgaatcgtttattatttcgttttttagtattagtttaacgttattgataattatgaagaggtttttattgggtgtaggcggtcggcgacgttattacgtatagtttcgttatggaagatgtttacgatgttgcgttacgggttttggttcgcgaattagttttattatcgcggcgttgtttttggcgtttagcgaggcggtaggttcgttaagtagtagaatggggtagtcgacgataaagtcgcgggcgatgttgacgcgttgttgttcgttatcggaaaatgtcgatggtgttaggtgttataggcgtttcggtacgtttaggcgggtgagaagacgcgcggttttagcggcgtaggttttacgcggaacgtcggtatcgagtagcggttgtattattatttttagtgttgagatacgcgggatgacgcgtagaaattggtttatttagtcgacggtggttttgcggatttttattattttgcgttggcgcggtgattaggtttatttatt

SEQ ID NO: 8592 - DNA, 962 bp, Artificial Sequence
  chemically treated genomic DNA (Homo sapiens) CpG-island No: 8592
  misc_feature (794)..(794): n is either a, c, g or t
  misc_feature (833)..(833): n is either a, c, g or t
aataaataaacctaatcaccgcgccaacgcaaaataataaaaatccgcaaaaccaccgtcgactaaataaaccaatttctacgcgtcatcccgcgtatctcaacactaaaaataataatacaaccgctactcgataccgacgttccgcgtaaaacctacgccgctaaaaccgcgcgtcttctcacccgcctaaacgtaccgaaacgcctataacacctaacaccatcgacattttccgataacgaacaacaacgcgtcaacatcgcccgcgactttatcgtcgactaccccattctactacttaacgaacctaccgcctcgctaaacgccaaaaacaacgccgcgataataaaactaattcgcgaaccaaaacccgtaacgcaacatcgtaaacatcttccataacgaaactatacgtaataacgtcgccgaccgcctacacccaataaaaacctcttcataattatcaataacgttaaactaatactaaaaaacgaaataataaacgattcgctaaaaatacaaaacgacgaaatccgcgcctttaccgaaaaccaaaaccgcctaccgaatacgataaacgacgaaaacgactaactactaccgaaactaattaaactacataccgataatctaaataaattcttcaccccgcgcccgaaaattaactaacctacccactcgacgataaacaaccacgacgcgctaattataacgaacgacattcacaccgataactaaataccgtaaacaatttaacgacgtacgccgaccgacgaacgattccgactaanaaaaatctaaaaaaaaaataaattccaacgcccattcgnaaaaaaaccgcaaaaaaacgacgaacgttcaaaccgaaaacccgaaacaaaccgttcttacaatctttaaacctaccgaaaatttaccgacaattaaaaaaccaaaatttacccgacttaatttaaaaa

SEQ ID NO: 8593 - DNA, 543 bp, Artificial Sequence
  chemically treated genomic DNA (Homo sapiens) CpG-island No: 8593
tatcggtaacgatgatcgattggcgttttgttgtttatgaaatgcgtttgtttaaatcgttagaagagattgtcgtatttcgtcgcgcgggagaaattatcgttatggtatatatacgggcgatggaaaaatgtcgttcgggaatgttcgagtattatttggaaggcgaaatttattacgaatttaatcgttacggtgcgcgttattcgttttataatattattgtcggtagcggtgaaaacggtattattttgtattatatcgaaaacgagtgtgaaatgcgcgacggcgatttggtgttgattgacgcgggttgtgaatataaaggttacgttggcgatattattcgtattttttcggttaacggtaaatttatttaggtttagcgtgaaatttacgatattgtgttggagtttttcgaaattagtttgcgtttgtatcgttcgggaatttttattttggaagttattggtgaagtggtgcgtattatggttagcggtttggtaaaattcggtattttgaaaggtgatgttgatgaattga

SEQ ID NO: 8594 - DNA, 543 bp, Artificial Sequence
  chemically treated genomic DNA (Homo sapiens) CpG-island No: 8594
tcaattcatcaacatcacctttcaaaataccgaattttaccaaaccgctaaccataatacgcaccacttcaccaataacttccaaaataaaaattcccgaacgatacaaacgcaaactaatttcgaaaaactccaacacaatatcgtaaatttcacgctaaacctaaataaatttaccgttaaccgaaaaaatacgaataatatcgccaacgtaacctttatattcacaacccgcgtcaatcaacaccaaatcgccgtcgcgcatttcacactcgttttcgatataatacaaaataataccgttttcaccgctaccgacaataatattataaaacgaataacgcgcaccgtaacgattaaattcgtaataaatttcgccttccaaataatactcgaacattcccgaacgacatttttccatcgcccgtatatataccataacgataatttctcccgcgcgacgaaatacgacaatctcttctaacgatttaaacaaacgcatttcataaacaacaaaacgccaatcgatcatcgttaccgata

SEQ ID NO: 8595 - DNA, 543 bp, Artificial Sequence
  chemically treated genomic DNA (Homo sapiens) CpG-island No: 8595
ttagtttattaatattattttttaggatgtcgagttttattaggtcgttaattatgatgcgtattattttattagtgatttttagaatggaagttttcggacgatataggcgtaggttggtttcgagagattttagtataatgtcgtagattttacgttgggtttgggtgaatttgtcgttgatcgggaaggtgcgggtaatatcgttagcgtaatttttgtatttataattcgcgttaattaatattaggtcgtcgtcgcgtattttatattcgttttcggtgtagtgtagaatgatgtcgtttttatcgttgtcgataatggtgttataggacggatagcgcgtatcgtggcggttaaattcgtggtgaatttcgttttttagatggtattcgaatattttcggacggtatttttttatcgttcgtgtatgtgttatggcggtgatttttttcgcgcggcggagtacggtaattttttttggcgatttgaataggcgtattttatgaataataggacgttagtcgattatcgttgtcggtg

SEQ ID NO: 8596 - DNA, 543 bp, Artificial Sequence
  chemically treated genomic DNA (Homo sapiens) CpG-island No: 8596
caccgacaacgataatcgactaacgtcctattattcataaaatacgcctattcaaatcgccaaaaaaaattaccgtactccgccgcgcgaaaaaaatcaccgccataacacatacacgaacgataaaaaaataccgtccgaaaatattcgaataccatctaaaaaacgaaattcaccacgaatttaaccgccacgatacgcgctatccgtcctataacaccattatcgacaacgataaaaacgacatcattctacactacaccgaaaacgaatataaaatacgcgacgacgacctaatattaattaacgcgaattataaatacaaaaattacgctaacgatattacccgcaccttcccgatcaacgacaaattcacccaaacccaacgtaaaatctacgacattatactaaaatctctcgaaaccaacctacgcctatatcgtccgaaaacttccattctaaaaatcactaataaaataatacgcatcataattaacgacctaataaaactcgacatcctaaaaaataatattaataaactaa

SEQ ID NO: 8597 - DNA, 687 bp, Artificial Sequence
  chemically treated genomic DNA (Homo sapiens) CpG-island No: 8597
  misc_feature (263)..(263): n is either a, c, g or t
gttgtatagttaggagttgttcgattcgttacgggcgatgttggcgaaaatttttgttgcgttaacgttcggtaaattgaaatatagttttttttgtaatagcggtatcgagttcgttgaagtagcgttgaagttggcgaaagtttatagttagtcgcgcggttaggtttatttttattagtaatagcggcgcgttttacggtaaattatttggcgcgttgtcggttacggcgaaattcgattttcgtaaatcgtttatgttngtattgtcgggttacgttatgtgtcgtttggtaatatcgaagtatgcgtacggttttttttataggattcggtatcggcgttcggttatatttttacgtacgtttttgttttcggtcgaaataggtagtagttttcggtgacgtttatcggtgatgtacgtattatatgcggtattacgagattaataaagttaatcgggtcgtagggttacgtcggtagatgttatggcgatagttagtaataaagtttagaatcgggtatggggtatcgatatatcgagcgtggtggcgtacgtatcgtcgagtgtaaggaggtcgagatcgcggtaaaaatttaggtttagcggtagaaataaaattattagcgggatggtaatttttataaagttttagttacggttttataagttgtcggttagttata

SEQ ID NO: 8598 - DNA, 687 bp, Artificial Sequence
  chemically treated genomic DNA (Homo sapiens) CpG-island No: 8598
  misc_feature (425)..(425): n is either a, c, g or t
tataactaaccgacaacttataaaaccgtaactaaaactttataaaaattaccatcccgctaataattttatttctaccgctaaacctaaatttttaccgcgatctcgacctccttacactcgacgatacgtacgccaccacgctcgatatatcgataccccatacccgattctaaactttattactaactatcgccataacatctaccgacgtaaccctacgacccgattaactttattaatctcgtaataccgcatataatacgtacatcaccgataaacgtcaccgaaaactactacctatttcgaccgaaaacaaaaacgtacgtaaaaatataaccgaacgccgataccgaatcctataaaaaaaaccgtacgcatacttcgatattaccaaacgacacataacgtaacccgacaatacnaacataaacgatttacgaaaatcgaatttcgccgtaaccgacaacgcgccaaataatttaccgtaaaacgcgccgctattactaataaaaataaacctaaccgcgcgactaactataaactttcgccaacttcaacgctacttcaacgaactcgataccgctattacaaaaaaaactatatttcaatttaccgaacgttaacgcaacaaaaattttcgccaacatcgcccgtaacgaatcgaacaactcctaactatacaac

SEQ ID NO: 8599 - DNA, 687 bp, Artificial Sequence
  chemically treated genomic DNA (Homo sapiens) CpG-island No: 8599
  misc_feature (425)..(425): n is either a, c, g or t
tgtggttgatcggtagtttatggggtcgtgattggagttttgtgaagattgttatttcgttgatgattttatttttgtcgttgagtttgagtttttgtcgcgatttcgatttttttgtattcggcgatgcgtgcgttattacgttcggtgtgtcggtgttttatattcgattttgggttttgttattagttgtcgttatgatatttatcggcgtggttttgcggttcgattagttttattggtttcgtggtgtcgtatatgatgcgtatattatcggtggacgttatcggagattgttgtttgtttcggtcggggataggggcgtgcgtgggagtatgatcgagcgtcggtatcggattttgtggaaagagtcgtgcgtatgtttcgatattgttaaacggtatatgacgtagttcggtagtatnggtataaacggtttgcggaagtcggatttcgtcgtggtcgatagcgcgttaagtgatttatcgtggaacgcgtcgttgttgttaataaaagtaaatttggtcgcgcggttgattgtaagttttcgttagttttagcgttgttttaacggattcggtgtcgttattatagaagaagttgtattttagtttatcgggcgttagcgtagtaagggttttcgttaatatcgttcgtaacggatcgagtagtttttggttgtgtagt

SEQ ID NO: 8600 - DNA, 687 bp, Artificial Sequence
  chemically treated genomic DNA (Homo sapiens) CpG-island No: 8600
  misc_feature (263)..(263): n is either a, c, g or t
actacacaaccaaaaactactcgatccgttacgaacgatattaacgaaaacccttactacgctaacgcccgataaactaaaatacaacttcttctataataacgacaccgaatccgttaaaacaacgctaaaactaacgaaaacttacaatcaaccgcgcgaccaaatttacttttattaacaacaacgacgcgttccacgataaatcacttaacgcgctatcgaccacgacgaaatccgacttccgcaaaccgtttataccnatactaccgaactacgtcatataccgtttaacaatatcgaaacatacgcacgactctttccacaaaatccgataccgacgctcgatcatactcccacgcacgcccctatccccgaccgaaacaaacaacaatctccgataacgtccaccgataatatacgcatcatatacgacaccacgaaaccaataaaactaatcgaaccgcaaaaccacgccgataaatatcataacgacaactaataacaaaacccaaaatcgaatataaaacaccgacacaccgaacgtaataacgcacgcatcgccgaatacaaaaaaatcgaaatcgcgacaaaaactcaaactcaacgacaaaaataaaatcatcaacgaaataacaatcttcacaaaactccaatcacgaccccataaactaccgatcaaccaca

SEQ ID NO: 8601 - DNA, 884 bp, Artificial Sequence
  chemically treated genomic DNA (Homo sapiens) CpG-island No: 8601
gcggtaatgcgatgattagtcgtggtagaggatttttaagtatggcgatatgacgtatatggcggtagtattgtttagggtttagtcggggttgcgtattgcgtgtttttatcggcgtggttgttcggtgtgtttcggcggagtgacgttcggttattcggttaattttttgttcggtgtaaaggtttttttcggtgaaatcgatatcgttttgttcggttcgttgtcgtttattttttttcgtatttatagtagttatcggataaaaacgttcgcgtcggtggggagtttcggtttcggttggaaaatgtttgcggatattcgtttatagttgcgcgataatatattgatatttagtgataacggcggtagaagtttgtattttgagtatttgtttttcggtgaggacggttatagtcgtagcgagttattgtggttggtgcgcggcggcgtggcgaaattggatgaaggttatcggttggtcgtattttggtatgcgttgtcggaagaatttcgtttaagttcgtatcgttatttggcgataaatagttcgtatgggtcgtggtggttgttcggttggtgtgagcgggtgtcggaagcggatgaggtgttgtttgcgtcgttgtcgtcgtatcgggtattgatcgggttggtggattttttcgggcgatatagacgttttaacgcgaacgtcggtgaatttacggcgaattacggcgtgacgatgtgttggcgtatttcggttgtattatattagttagggtagagattcgtatagtatttcgcggacgacgtcgtttttatatttcggtaacgatatgcggaacgtaacgaagaaaaaatgcgtttgttgtaaacgttgatcgaagaagagtggttagata

SEQ ID NO: 8602 - DNA, 884 bp, Artificial Sequence
  chemically treated genomic DNA (Homo sapiens) CpG-island No: 8602
tatctaaccactcttcttcgatcaacgtttacaacaaacgcattttttcttcgttacgttccgcatatcgttaccgaaatataaaaacgacgtcgtccgcgaaatactatacgaatctctaccctaactaatataatacaaccgaaatacgccaacacatcgtcacgccgtaattcgccgtaaattcaccgacgttcgcgttaaaacgtctatatcgcccgaaaaaatccaccaacccgatcaatacccgatacgacgacaacgacgcaaacaacacctcatccgcttccgacacccgctcacaccaaccgaacaaccaccacgacccatacgaactatttatcgccaaataacgatacgaacttaaacgaaattcttccgacaacgcataccaaaatacgaccaaccgataaccttcatccaatttcgccacgccgccgcgcaccaaccacaataactcgctacgactataaccgtcctcaccgaaaaacaaatactcaaaatacaaacttctaccgccgttatcactaaatatcaatatattatcgcgcaactataaacgaatatccgcaaacattttccaaccgaaaccgaaactccccaccgacgcgaacgtttttatccgataactactataaatacgaaaaaaaataaacgacaacgaaccgaacaaaacgatatcgatttcaccgaaaaaaacctttacaccgaacaaaaaattaaccgaataaccgaacgtcactccgccgaaacacaccgaacaaccacgccgataaaaacacgcaatacgcaaccccgactaaaccctaaacaatactaccgccatatacgtcatatcgccatacttaaaaatcctctaccacgactaatcatcgcattaccgc

SEQ ID NO: 8603 - DNA, 884 bp, Artificial Sequence
  chemically treated genomic DNA (Homo sapiens) CpG-island No: 8603
tgtttggttattttttttcgattagcgtttgtagtaaacgtatttttttttcgttgcgtttcgtatatcgttatcggagtatagaagcgacgtcgttcgcggaatgttgtgcgggtttttgttttggttggtgtagtatagtcgaagtacgttagtatatcgttacgtcgtgattcgtcgtgaatttatcggcgttcgcgttgaaacgtttgtgtcgttcgaaggggtttattagttcggttagtattcggtacggcggtagcggcgtaggtagtattttattcgttttcggtattcgtttatattaatcgagtagttattacggtttatgcggattgtttgtcgttagataacgatgcggatttaagcggagttttttcggtagcgtatgttagagtgcggttagtcggtgatttttatttagtttcgttacgtcgtcgcgtattagttatagtgattcgttgcggttgtaatcgtttttatcgggaaataggtgtttaaaatataggtttttgtcgtcgttattattgagtattagtgtgttatcgcgtagttgtaagcggatattcgtaggtattttttagtcggggtcgaggttttttatcggcgcgagcgtttttgttcggtaattgttgtaggtgcgggagaggatgaacggtagcgggtcgggtagggcgatgtcggttttatcgggaaggatttttgtatcgagtaggggattgatcggatggtcggacgttatttcgtcggggtatatcgaatagttacgtcggtgggggtacgtaatgcgtagtttcggttgaattttgaataatgttatcgttatatgcgttatgtcgttatgtttggggattttttgttacggttggttatcgtattgtcgt

SEQ ID NO: 8604 - DNA, 884 bp, Artificial Sequence
  chemically treated genomic DNA (Homo sapiens) CpG-island No: 8604
acgacaatacgataaccaaccgtaacaaaaaatccccaaacataacgacataacgcatataacgataacattattcaaaattcaaccgaaactacgcattacgtacccccaccgacgtaactattcgatataccccgacgaaataacgtccgaccatccgatcaatcccctactcgatacaaaaatccttcccgataaaaccgacatcgccctacccgacccgctaccgttcatcctctcccgcacctacaacaattaccgaacaaaaacgctcgcgccgataaaaaacctcgaccccgactaaaaaatacctacgaatatccgcttacaactacgcgataacacactaatactcaataataacgacgacaaaaacctatattttaaacacctatttcccgataaaaacgattacaaccgcaacgaatcactataactaatacgcgacgacgtaacgaaactaaataaaaatcaccgactaaccgcactctaacatacgctaccgaaaaaactccgcttaaatccgcatcgttatctaacgacaaacaatccgcataaaccgtaataactactcgattaatataaacgaataccgaaaacgaataaaatactacctacgccgctaccgccgtaccgaatactaaccgaactaataaaccccttcgaacgacacaaacgtttcaacgcgaacgccgataaattcacgacgaatcacgacgtaacgatatactaacgtacttcgactatactacaccaaccaaaacaaaaacccgcacaacattccgcgaacgacgtcgcttctatactccgataacgatatacgaaacgcaacgaaaaaaaaatacgtttactacaaacgctaatcgaaaaaaaataaccaaaca

SEQ ID NO: 8605 - DNA, 524 bp, Artificial Sequence
  chemically treated genomic DNA (Homo sapiens) CpG-island No: 8605
tttcggcgtgaatatttgcgcgaaggttagattaaatggtgtcgttgaatttgttagttttatatttggtataatttcggtaattacgttggtggagacgatataaattatcgtcgtatttaacgtatcgtcgagtatcgcgattggtatattacgtttcgggttttttattatattagtattcgtatacgtagattttagattaagaaaagtttatagcgttatagcgatggaagaatttatcgtattgaagaacggtgtatgatgcggattttaggaattaacgtatagcgtcgggttaaattagaattagttaataatgtatagatcgacgatcggaataatgattttttatacggtaatgttattgatttgttcggtaatgcgcgtattatttaagtagttacgggtataattatagtattcgatggtcgtagataatttgtattggcgataattcgcgtcgagtagtcggttcgtaataatttatttatttattaaataggtatggattatatttataa

SEQ ID NO: 8606 - DNA, 524 bp, Artificial Sequence
  chemically treated genomic DNA (Homo sapiens) CpG-island No: 8606
ttataaatataatccatacctatttaataaataaataaattattacgaaccgactactcgacgcgaattatcgccaatacaaattatctacgaccatcgaatactataattatacccgtaactacttaaataatacgcgcattaccgaacaaatcaataacattaccgtataaaaaatcattattccgatcgtcgatctatacattattaactaattctaatttaacccgacgctatacgttaattcctaaaatccgcatcatacaccgttcttcaatacgataaattcttccatcgctataacgctataaacttttcttaatctaaaatctacgtatacgaatactaatataataaaaaacccgaaacgtaatataccaatcgcgatactcgacgatacgttaaatacgacgataatttatatcgtctccaccaacgtaattaccgaaattataccaaatataaaactaacaaattcaacgacaccatttaatctaaccttcgcgcaaatattcacgccgaaa

SEQ ID NO: 8607 - DNA, 524 bp, Artificial Sequence
  chemically treated genomic DNA (Homo sapiens) CpG-island No: 8607
ttgtggatatggtttatgtttatttgataagtgaataagttgttacggatcgattgttcggcgcgagttgtcgttagtgtagattgtttgcgattatcgggtgttgtgattgtattcgtggttatttgggtggtgcgcgtattatcgggtaaattagtagtattatcgtgtggggggttattatttcggtcgtcggtttgtgtattattggttggttttggtttagttcgacgttgtacgttgatttttggaattcgtattatgtatcgttttttagtgcggtaggtttttttatcgttatgacgttgtgggttttttttggtttggagtttgcgtgtgcgaatattgatgtagtggaaaattcggaacgtaatgtgttaatcgcggtattcggcggtacgttaggtgcggcggtgatttatatcgtttttattaacgtgattgtcgggattgtgttaaatatggagttggtaaatttaacggtattatttggtttggttttcgcgtagatgtttacgtcggaa

SEQ ID NO: 8608 - DNA, 524 bp, Artificial Sequence
  chemically treated genomic DNA (Homo sapiens) CpG-island No: 8608
ttccgacgtaaacatctacgcgaaaaccaaaccaaataataccgttaaatttaccaactccatatttaacacaatcccgacaatcacgttaataaaaacgatataaatcaccgccgcacctaacgtaccgccgaataccgcgattaacacattacgttccgaattttccactacatcaatattcgcacacgcaaactccaaaccaaaaaaaacccacaacgtcataacgataaaaaaacctaccgcactaaaaaacgatacataatacgaattccaaaaatcaacgtacaacgtcgaactaaaccaaaaccaaccaataatacacaaaccgacgaccgaaataataaccccccacacgataatactactaatttacccgataatacgcgcaccacccaaataaccacgaatacaatcacaacacccgataatcgcaaacaatctacactaacgacaactcgcgccgaacaatcgatccgtaacaacttattcacttatcaaataaacataaaccatatccacaa

SEQ ID NO: 8609 - DNA, 1140 bp, Artificial Sequence
  chemically treated genomic DNA (Homo sapiens) CpG-island No: 8609
ttttcgtcggtggggtttttaagtattagttttaggcgtatcgtttttttcggcggtcgcggcggttgtttagttcgggaagtcgattttcgcggcgggggcggttgtaagggtagcggcgggaacggcggcggcggttcgggtcgcgggggttttcgttgtagcgatatgggcggttcggcgcggttgatttcgcgttgggggagcggtttttttcgcgacgggggttgcgcgttcgagcggggggtaggttttcgcggggtcggcggtttcgttcgggtcggttcgcggtacggttgcggttttagtcgggggggttcgcgggggtattcgggtttacgttcgggtttcgggtattcggtttcgcgtcgtcgtatcggtgataagttaatgaacgttattttgcgcggtttcgttatttttattgttttggtttttcgtttttgttcgagtcggcgttcgtttttacggcgcgttgcgtgtttgttcgtttttttttttgttttttgtcgttttttttttttttattatttttagtcgttttcgtcggcgttacggtgagtgcggatcgtgttttttttttcgttattacgttttgatgggttttatcgttatcgttagggtcgtcgcggtcgttatgttggattttttatataaatagaagtaggtcgttgagcgggcgtatgcgtatagaggagacgttcgcgtttattgtcgtggttgttgtttagttttttttttttttttttaatagtttggagtttagataggtcggcggaagtgacgatatggttcggtttgttttcgtggaaacggagacgtcgtttgtatttttttttaaagggagggttttggggtttttcgagtagtttattattcgtattcggaaattagaggcgttttaggagtttttcggggttagtatcgggatgggattgagatcgatttagttattggcgtcgggtttttcgtgttgggtttaagggaattggggttgttagttgattatttaaggcggattttgggtaagggtagagagacgcgttagtcgttgtgtttgttcgttttgtgttttcgtagttttaagtatcgagggaaaaaaggaagtgtttagttttagttagattagttttagcggtt

SEQ ID NO: 8610 - DNA, 1140 bp, Artificial Sequence
  chemically treated genomic DNA (Homo sapiens) CpG-island No: 8610
aaccgctaaaactaatctaactaaaactaaacacttccttttttccctcgatacttaaaactacgaaaacacaaaacgaacaaacacaacgactaacgcgtctctctacccttacccaaaatccgccttaaataatcaactaacaaccccaattcccttaaacccaacacgaaaaacccgacgccaataactaaatcgatctcaatcccatcccgatactaaccccgaaaaactcctaaaacgcctctaatttccgaatacgaataataaactactcgaaaaaccccaaaaccctccctttaaaaaaaaatacaaacgacgtctccgtttccacgaaaacaaaccgaaccatatcgtcacttccgccgacctatctaaactccaaactattaaaaaaaaaaaaaaaaaactaaacaacaaccacgacaataaacgcgaacgtctcctctatacgcatacgcccgctcaacgacctacttctatttatataaaaaatccaacataacgaccgcgacgaccctaacgataacgataaaacccatcaaaacgtaataacgaaaaaaaaaacacgatccgcactcaccgtaacgccgacgaaaacgactaaaaataataaaaaaaaaaaaaacgacaaaaaacaaaaaaaaaaacgaacaaacacgcaacgcgccgtaaaaacgaacgccgactcgaacaaaaacgaaaaaccaaaacaataaaaataacgaaaccgcgcaaaataacgttcattaacttatcaccgatacgacgacgcgaaaccgaatacccgaaacccgaacgtaaacccgaatacccccgcgaacccccccgactaaaaccgcaaccgtaccgcgaaccgacccgaacgaaaccgccgaccccgcgaaaacctaccccccgctcgaacgcgcaacccccgtcgcgaaaaaaaccgctcccccaacgcgaaatcaaccgcgccgaaccgcccatatcgctacaacgaaaacccccgcgacccgaaccgccgccgccgttcccgccgctacccttacaaccgcccccgccgcgaaaatcgacttcccgaactaaacaaccgccgcgaccgccgaaaaaaacgatacgcctaaaactaatacttaaaaaccccaccgacgaaaa

SEQ ID NO: 8611 - DNA, 1140 bp, Artificial Sequence
  chemically treated genomic DNA (Homo sapiens) CpG-island No: 8611
agtcgttggggttagtttggttgaagttgggtatttttttttttttttcgatatttaaggttacggggatatagggcgggtaggtataacggttggcgcgtttttttatttttgtttagagttcgttttgaataattagttaataattttaatttttttgaatttagtacgggagattcggcgttaatggttaggtcggttttagttttatttcgatgttagtttcgggaagtttttggagcgtttttggttttcgggtgcgaatagtaaattgttcgggaaattttagaattttttttttgaggaagggtgtagacggcgttttcgtttttacggaaataggtcgagttatgtcgttattttcgtcgatttgtttggattttagattgttgggaggaaaagaggaaaattgagtaatagttacgatagtggacgcgagcgttttttttgtgcgtatgcgttcgtttagcggtttgtttttatttatgtgggggatttaatatggcggtcgcggcgattttggcgatggcggtgaagtttattagaacgtagtagcggggaaggggatacggttcgtatttatcgtggcgtcggcggagacggttgagggtggtggagggaagaaaagcgatagagagtaagaggaagggcgggtaggtacgtagcgcgtcgtagaagcgagcgtcggttcgagtaaaagcggagggttagaatagtggggatggcggagtcgcgtagagtagcgtttattagtttgttatcggtgcggcggcgcgaggtcgagtattcggggttcgagcgtgagttcgagtattttcgcgagttttttcggttggagtcgtagtcgtatcgcgagtcggttcgggcggagtcgtcggtttcgcgggagtttgtttttcgttcggacgcgtagttttcgtcgcgggagaagtcgtttttttagcgcgaggttagtcgcgtcgagtcgtttatgtcgttgtagcgggagttttcgcggttcgagtcgtcgtcgtcgttttcgtcgttgtttttgtagtcgttttcgtcgcgggagtcggtttttcgggttgagtagtcgtcgcggtcgtcgagggagacggtgcgtttggagttggtgtttaaggattttatcgacgagag

SEQ ID NO: 8612 - DNA, 1140 bp, Artificial Sequence
  chemically treated genomic DNA (Homo sapiens) CpG-island No: 8612
ctctcgtcgataaaatccttaaacaccaactccaaacgcaccgtctccctcgacgaccgcgacgactactcaacccgaaaaaccgactcccgcgacgaaaacgactacaaaaacaacgacgaaaacgacgacgacgactcgaaccgcgaaaactcccgctacaacgacataaacgactcgacgcgactaacctcgcgctaaaaaaacgacttctcccgcgacgaaaactacgcgtccgaacgaaaaacaaactcccgcgaaaccgacgactccgcccgaaccgactcgcgatacgactacgactccaaccgaaaaaactcgcgaaaatactcgaactcacgctcgaaccccgaatactcgacctcgcgccgccgcaccgataacaaactaataaacgctactctacgcgactccgccatccccactattctaaccctccgcttttactcgaaccgacgctcgcttctacgacgcgctacgtacctacccgcccttcctcttactctctatcgcttttcttccctccaccaccctcaaccgtctccgccgacgccacgataaatacgaaccgtatccccttccccgctactacgttctaataaacttcaccgccatcgccaaaatcgccgcgaccgccatattaaatcccccacataaataaaaacaaaccgctaaacgaacgcatacgcacaaaaaaaacgctcgcgtccactatcgtaactattactcaattttcctcttttcctcccaacaatctaaaatccaaacaaatcgacgaaaataacgacataactcgacctatttccgtaaaaacgaaaacgccgtctacacccttcctcaaaaaaaaaattctaaaatttcccgaacaatttactattcgcacccgaaaaccaaaaacgctccaaaaacttcccgaaactaacatcgaaataaaactaaaaccgacctaaccattaacgccgaatctcccgtactaaattcaaaaaaattaaaattattaactaattattcaaaacgaactctaaacaaaaataaaaaaacgcgccaaccgttatacctacccgccctatatccccgtaaccttaaatatcgaaaaaaaaaaaaaaatacccaacttcaaccaaactaaccccaacgact

SEQ ID NO: 8613 - DNA, 603 bp, Artificial Sequence
  chemically treated genomic DNA (Homo sapiens) CpG-island No: 8613
  misc_feature (9)..(9): n is either a, c, g or t
tttataggngttcgttaggtgttgttcgacggtattgaagcgatagttatgttgatattttggttatcgtcgattataataaggcgttggcgatgggcggtattttcggtggcgaatattttggcgtgaatgacgaaatataaaacgtgttgttggaatgcgcgttttttagttcgttgtttattatcggtcgtgttcgtcgttatggtttgtatatcgatgcgttttatcgttatgagcgtggcgttgattcggtattgtagtataaagcgatggaacgtgcgattcgtttgttgatcgatatttgcggtggtgaggttggttcggtaattgatattattaacgaagtaacgttgtcgaagcgtgtaattattattttacgtcgtagtaaattggatcgtttgatcggttattatattgcggatgagtaggtaattgatattttgcgtcgtttcggttgcgaagtgatcgaagtaaagacgaatggtaggtagttgcgtcgagttggcgtttcgatatggagattgaagaagatttggttgaagaagtcgcgcgtgtatacggttataataatatttcggatgagtcggtataggtaagttt

SEQ ID NO: 8614 - DNA, 603 bp, Artificial Sequence
  chemically treated genomic DNA (Homo sapiens) CpG-island No: 8614
  misc_feature (595)..(595): n is either a, c, g or t
aaacttacctataccgactcatccgaaatattattataaccgtatacacgcgcgacttcttcaaccaaatcttcttcaatctccatatcgaaacgccaactcgacgcaactacctaccattcgtctttacttcgatcacttcgcaaccgaaacgacgcaaaatatcaattacctactcatccgcaatataataaccgatcaaacgatccaatttactacgacgtaaaataataattacacgcttcgacaacgttacttcgttaataatatcaattaccgaaccaacctcaccaccgcaaatatcgatcaacaaacgaatcgcacgttccatcgctttatactacaataccgaatcaacgccacgctcataacgataaaacgcatcgatatacaaaccataacgacgaacacgaccgataataaacaacgaactaaaaaacgcgcattccaacaacacgttttatatttcgtcattcacgccaaaatattcgccaccgaaaataccgcccatcgccaacgccttattataatcgacgataaccaaaatatcaacataactatcgcttcaataccgtcgaacaacacctaacgaacncctataaa

SEQ ID NO: 8615 - DNA, 603 bp, Artificial Sequence
  chemically treated genomic DNA (Homo sapiens) CpG-island No: 8615
  misc_feature (595)..(595): n is either a, c, g or t
aggtttgtttgtatcggtttattcgggatgttgttgtagtcgtatatacgcgcgatttttttaattagattttttttaatttttatatcgaaacgttagttcggcgtaattgtttgttattcgtttttgtttcggttatttcgtagtcgagacgacgtagaatgttagttatttgtttattcgtaatatgatggtcgattaggcgatttagtttgttacgacgtagagtgatggttgtacgtttcggtagcgttgtttcgttggtgatattaattatcgggttagttttattatcgtagatgtcgattagtagacgggtcgtacgttttatcgttttgtgttgtagtgtcggattaacgttacgtttataacggtgagacgtatcggtatgtaggttatgacgacgagtacgatcggtgatagatagcgggttaaagaacgcgtattttagtagtacgttttgtgtttcgttatttacgttagagtgttcgttatcgaagatgtcgtttatcgttagcgttttgttgtggtcggcgatgattagagtgttagtataattgtcgttttagtatcgtcgagtagtatttagcgagtntttgtgga

SEQ ID NO: 8616 - DNA, 603 bp, Artificial Sequence
  chemically treated genomic DNA (Homo sapiens) CpG-island No: 8616
  misc_feature (9)..(9): n is either a, c, g or t
tccacaaanactcgctaaatactactcgacgatactaaaacgacaattatactaacactctaatcatcgccgaccacaacaaaacgctaacgataaacgacatcttcgataacgaacactctaacgtaaataacgaaacacaaaacgtactactaaaatacgcgttctttaacccgctatctatcaccgatcgtactcgtcgtcataacctacataccgatacgtctcaccgttataaacgtaacgttaatccgacactacaacacaaaacgataaaacgtacgacccgtctactaatcgacatctacgataataaaactaacccgataattaatatcaccaacgaaacaacgctaccgaaacgtacaaccatcactctacgtcgtaacaaactaaatcgcctaatcgaccatcatattacgaataaacaaataactaacattctacgtcgtctcgactacgaaataaccgaaacaaaaacgaataacaaacaattacgccgaactaacgtttcgatataaaaattaaaaaaaatctaattaaaaaaatcgcgcgtatatacgactacaacaacatcccgaataaaccgatacaaacaaacct

SEQ ID NO: 8617 - DNA, 539 bp, Artificial Sequence
  chemically treated genomic DNA (Homo sapiens) CpG-island No: 8617
ttattgcgagtaagtcggttgtgtaaaaggaattagtatatgtttaaggcgaaggagcgttttagtcgagttatttgtttttgcggaatgtcgatggggcggtgagcgttagggttgaggaatttaaagatttcggttaagtttttttttttttcgatcgtgatttcgttatattggcgtagaaatgtaattatcgagttttagtttgtcgggttgtatgtggcgatatttggatgttgttgtgttacgttagcggcgatatttatagttagggtttcgagagcgattcgcgtattcgttaaagttgcgttgtagttcggaggattggtacggaaagttttagtcgaattattgattttgtcgatgatggttttatattgcggcggagcgattgacggagggttcgtacgagattattttttatgggggtcgtatcggcgatggatggatcggtttgtagtagttttttgtcgtggattatatatttatttagtaataggtattgcgagaggttatgtaagcgtttatcgaatacgttg

SEQ ID NO: 8618 - DNA, 539 bp, Artificial Sequence
  chemically treated genomic DNA (Homo sapiens) CpG-island No: 8618
caacgtattcgataaacgcttacataacctctcgcaatacctattactaaataaatatataatccacgacaaaaaactactacaaaccgatccatccatcgccgatacgacccccataaaaaataatctcgtacgaaccctccgtcaatcgctccgccgcaatataaaaccatcatcgacaaaatcaataattcgactaaaactttccgtaccaatcctccgaactacaacgcaactttaacgaatacgcgaatcgctctcgaaaccctaactataaatatcgccgctaacgtaacacaacaacatccaaatatcgccacatacaacccgacaaactaaaactcgataattacatttctacgccaatataacgaaatcacgatcgaaaaaaaaaaaaacttaaccgaaatctttaaattcctcaaccctaacgctcaccgccccatcgacattccgcaaaaacaaataactcgactaaaacgctccttcgccttaaacatatactaattccttttacacaaccgacttactcgcaataa

SEQ ID NO: 8619 - DNA, 539 bp, Artificial Sequence
  chemically treated genomic DNA (Homo sapiens) CpG-island No: 8619
taacgtattcgatgagcgtttgtatgatttttcgtagtgtttgttgttggatgggtatatggtttacgataagaaattgttgtaagtcgatttatttatcgtcgatgcggtttttatggaggatgatttcgtgcgagtttttcgttaatcgtttcgtcgtagtatgaggttattatcgataagattaatgattcggttgaagtttttcgtgttagtttttcggattataacgtagttttaacgaatgcgcgggtcgttttcgaaattttggttgtggatgtcgtcgttggcgtggtatagtagtatttaggtgtcgttatatataattcgataagttggggttcggtgattgtatttttacgttagtgtggcgaaattacggtcgaagaggagaaaggtttggtcggggtttttggattttttagttttggcgtttatcgttttatcggtatttcgtaagagtaaatggttcggttgggacgttttttcgttttgaatatgtgttggttttttttgtataatcggtttgttcgtagtgg

SEQ ID NO: 8620 - DNA, 539 bp, Artificial Sequence
  chemically treated genomic DNA (Homo sapiens) CpG-island No: 8620
ccactacgaacaaaccgattatacaaaaaaaaccaacacatattcaaaacgaaaaaacgtcccaaccgaaccatttactcttacgaaataccgataaaacgataaacgccaaaactaaaaaatccaaaaaccccgaccaaacctttctcctcttcgaccgtaatttcgccacactaacgtaaaaatacaatcaccgaaccccaacttatcgaattatatataacgacacctaaatactactataccacgccaacgacgacatccacaaccaaaatttcgaaaacgacccgcgcattcgttaaaactacgttataatccgaaaaactaacacgaaaaacttcaaccgaatcattaatcttatcgataataacctcatactacgacgaaacgattaacgaaaaactcgcacgaaatcatcctccataaaaaccgcatcgacgataaataaatcgacttacaacaatttcttatcgtaaaccatatacccatccaacaacaaacactacgaaaaatcatacaaacgctcatcgaatacgtta

SEQ ID NO: 8621 - DNA, 764 bp, Artificial Sequence
  chemically treated genomic DNA (Homo sapiens) CpG-island No: 8621
  misc_feature (249)..(249): n is either a, c, g or t
  misc_feature (417)..(417): n is either a, c, g or t
  misc_feature (636)..(636): n is either a, c, g or t
attcgtttagttatttattatttttttcgtttttatttcgttttgtttttattattttttatatcgtttcgtttatttatattttcgttatttgtttttttttatttattacgtgtatattttcgttatacgtatttcgtatttttattgtcgtattgtttttatttacgtgtattcgttttttattaagtttttatttagtttatttttcgtttttttttattgttacgtattgtttattttttgttnttttatttatttagtttatttatataatgcgattttattatttcgcgtgtgtattttgttttttttcgtatatttttttattattttttatttttttcgcgtattatgtatttcgttatttatattttatatttacgtatttagtattttatatacgatgttgtttgncgtatattttatcgttttattttattatattagtttcgcgttattcgtattttttatttatcgttttcgtatatttttattatttgtttgttattatttttacgtgttattgttcgtcgtttttatttttgtatattttatttatttttcgttttagtattttttttttacgcgttacgtgtttatacgtattcgcgtttttcgtttattttttcgtantatcgtttttatagttatatatatttgtagcgtttttttagtatatttcgcgattattcgtattatattttttttattatttttttatttatttattatattttttattatttgttttatatttttta

SEQ ID NO: 8622 - DNA, 764 bp, Artificial Sequence
  chemically treated genomic DNA (Homo sapiens) CpG-island No: 8622
  misc_feature (129)..(129): n is either a, c, g or t
  misc_feature (348)..(348): n is either a, c, g or t
  misc_feature (516)..(516): n is either a, c, g or t
taaaaaatataaaacaaataataaaaaatataataaataaataaaaaaataataaaaaaaatataatacgaataatcgcgaaatatactaaaaaaacgctacaaatatatataactataaaaacgatantacgaaaaaataaacgaaaaacgcgaatacgtataaacacgtaacgcgtaaaaaaaaaatactaaaacgaaaaataaataaaatatacaaaaataaaaacgacgaacaataacacgtaaaaataataacaaacaaataataaaaatatacgaaaacgataaataaaaaatacgaataacgcgaaactaatataataaaataaaacgataaaatatacgncaaacaacatcgtatataaaatactaaatacgtaaatataaaatataaataacgaaatacataatacgcgaaaaaaataaaaaataataaaaaaatatacgaaaaaaaacaaaatacacacgcgaaataataaaatcgcattatataaataaactaaataaataaaanaacaaaaaataaacaatacgtaacaataaaaaaaaacgaaaaataaactaaataaaaacttaataaaaaacgaatacacgtaaataaaaacaatacgacaataaaaatacgaaatacgtataacgaaaatatacacgtaataaataaaaaaaaacaaataacgaaaatataaataaacgaaacgatataaaaaataataaaaacaaaacgaaataaaaacgaaaaaaataataaataactaaacgaat

SEQ ID NO: 8623 - DNA, 764 bp, Artificial Sequence
  chemically treated genomic DNA (Homo sapiens) CpG-island No: 8623
  misc_feature (129)..(129): n is either a, c, g or t
  misc_feature (348)..(348): n is either a, c, g or t
  misc_feature (516)..(516): n is either a, c, g or t
tgagagatgtgagatagatagtagagagtgtggtgagtgagtgagagagtgatgagagagatgtagtgcgagtgatcgcgagatgtgttgaggagacgttgtaggtgtgtgtagttgtgggagcggtgntacgagagagtgggcgagagacgcgagtgcgtgtgagtacgtagcgcgtgaggagagagtattgagacgagagatgagtggggtgtgtagaagtgagagcgacgaatagtgatacgtgaggatggtagtagataggtagtagagatgtacgaggacgatgagtggaggatgcgagtgacgcgaggttagtgtagtagagtgagacgatagagtgtgcgntagatagtatcgtgtgtggagtgttggatgcgtggatgtggagtgtggatggcgagatgtatggtgcgcggagagggtggaaggtggtgagagagtgtgcgagagagagtagagtgtatacgcgagatggtggggtcgtattgtgtaggtgagttgagtgggtgaggnagtagagagtagataatgcgtgatagtgaggagagacggaggatagattagatgagagtttagtaggggacgagtgtacgtggatgagagtagtgcgatagtgagagtgcggagtgcgtgtagcgagagtgtgtacgtggtgagtggagagaggtagatggcgagggtataggtgagcgaggcgatgtgagagatgatgaagatagaacggagtagagacggaggaggtagtgagtgattaggcggat

SEQ ID NO: 8624 - DNA, 764 bp, Artificial Sequence
  chemically treated genomic DNA (Homo sapiens) CpG-island No: 8624
  misc_feature (249)..(249): n is either a, c, g or t
  misc_feature (417)..(417): n is either a, c, g or t
  misc_feature (636)..(636): n is either a, c, g or t
atccgcctaatcactcactacctcctccgtctctactccgttctatcttcatcatctctcacatcgcctcgctcacctataccctcgccatctacctctctccactcaccacgtacacactctcgctacacgcactccgcactctcactatcgcactactctcatccacgtacactcgtcccctactaaactctcatctaatctatcctccgtctctcctcactatcacgcattatctactctctactncctcacccactcaactcacctacacaatacgaccccaccatctcgcgtatacactctactctctctcgcacactctctcaccaccttccaccctctccgcgcaccatacatctcgccatccacactccacatccacgcatccaacactccacacacgatactatctancgcacactctatcgtctcactctactacactaacctcgcgtcactcgcatcctccactcatcgtcctcgtacatctctactacctatctactaccatcctcacgtatcactattcgtcgctctcacttctacacaccccactcatctctcgtctcaatactctctcctcacgcgctacgtactcacacgcactcgcgtctctcgcccactctctcgtancaccgctcccacaactacacacacctacaacgtctcctcaacacatctcgcgatcactcgcactacatctctctcatcactctctcactcactcaccacactctctactatctatctcacatctctca

SEQ ID NO: 8625 - DNA, 523 bp, Artificial Sequence
  chemically treated genomic DNA (Homo sapiens) CpG-island No: 8625
tcgtgttagtagtattcgattttcgtttttatagagcgcgtttttttagttcgcgtatacgttatcgtgtcgtatgtatgtgtgtttttacgagcgatagtagatcgcgttttatgcgtatagagtttcgttttttacgtgtatagagcgagtagcgttcgtattatttatcgtttttgcgataatgtttagtgcgttacgatatcgtagattgtttgtatttagtttttacgtttgtcgtttattcggttttattggagttttattttacgttagattgtttgttgttttgtgttagtttttcgtttatttgggttcggaacgttgtatcgtttcgagttgttttttttttataattttatcgatcgtttttgtatgttttattaggtgtacgggtatcggagatttttatttttttcgtggggggggggttaaaaaaaaaaaacgttttttttttttcgcgagcgtcgtattaaagttattcggatgtgttaatagttgatcgtatgtattagtcgtagag

SEQ ID NO: 8626 - DNA, 523 bp, Artificial Sequence
  chemically treated genomic DNA (Homo sapiens) CpG-island No: 8626
ctctacgactaatacatacgatcaactattaacacatccgaataactttaatacgacgctcgcgaaaaaaaaaaaacgttttttttttttaaccccccccccacgaaaaaaataaaaatctccgatacccgtacacctaataaaacatacaaaaacgatcgataaaattataaaaaaaaaacaactcgaaacgatacaacgttccgaacccaaataaacgaaaaactaacacaaaacaacaaacaatctaacgtaaaataaaactccaataaaaccgaataaacgacaaacgtaaaaactaaatacaaacaatctacgatatcgtaacgcactaaacattatcgcaaaaacgataaataatacgaacgctactcgctctatacacgtaaaaaacgaaactctatacgcataaaacgcgatctactatcgctcgtaaaaacacacatacatacgacacgataacgtatacgcgaactaaaaaaacgcgctctataaaaacgaaaatcgaatactactaacacga

SEQ ID NO: 8627 - DNA, 523 bp, Artificial Sequence
  chemically treated genomic DNA (Homo sapiens) CpG-island No: 8627
ttttgcgattgatgtatgcgattaattgttgatatattcgggtggttttggtacggcgttcgcgggaaaaaaaaaacgttttttttttttggttttttttttacgaggggggtggaagttttcgatgttcgtgtatttagtgaagtatgtaggaacggtcggtagggttgtgaaaaaagaataattcggggcgatgtaacgtttcgagtttaagtggacgagagattgatataaagtagtaggtagtttagcgtgagatggaattttagtggaatcgagtggacgataggcgtgagagttgagtataggtagtttgcggtgtcgtgacgtattagatattatcgtagagacgatgaatgatgcgggcgttgttcgttttgtatacgtagagagcggagttttgtgcgtatagagcgcgatttattatcgttcgtagaggtatatatatatgcgatacgatgacgtgtgcgcgagttgagagagcgcgttttgtagagacggaggtcggatgttgttagtacga

SEQ ID NO: 8628 - DNA, 523 bp, Artificial Sequence
  chemically treated genomic DNA (Homo sapiens) CpG-island No: 8628
tcgtactaacaacatccgacctccgtctctacaaaacgcgctctctcaactcgcgcacacgtcatcgtatcgcatatatatatacctctacgaacgataataaatcgcgctctatacgcacaaaactccgctctctacgtatacaaaacgaacaacgcccgcatcattcatcgtctctacgataatatctaatacgtcacgacaccgcaaactacctatactcaactctcacgcctatcgtccactcgattccactaaaattccatctcacgctaaactacctactactttatatcaatctctcgtccacttaaactcgaaacgttacatcgccccgaattattcttttttcacaaccctaccgaccgttcctacatacttcactaaatacacgaacatcgaaaacttccacccccctcgtaaaaaaaaaaccaaaaaaaaaaaacgttttttttttcccgcgaacgccgtaccaaaaccacccgaatatatcaacaattaatcgcatacatcaatcgcaaaa

SEQ ID NO: 8629 - DNA, 821 bp, Artificial Sequence
  chemically treated genomic DNA (Homo sapiens) CpG-island No: 8629
  misc_feature (660)..(660): n is either a, c, g or t
ttgagcgggtaatcgttataaaggagattgtaggttattttagaaggattttcggcggtgttttacggtaattttgcggaaaacggttgtatcgtgaaaacggtaggcgtcgatgatagtatttttaaatttatcggttcggcgaaagtgtacgaaagttaggacgatgcggtagaagcgattttcggcggtaaagttgtcgtcggagatgtggtagtaattcgttatgaaggttcgaaaggcggttcggggatgtaggaaatgttttatttaattagttttttgaaattaatgggtttcggtaaagtttgtgcgttgattatcgacggtcgtttttttggtggtatttttggtttttttatcggttacgttttatcggaagcggtaagcggcggtagtattggtttgattgaagatggtgatttgatcgttatcgatatttcgaatcgtggtatttagttataggtaagcgatgtcgaattggcggcgcgtcgtgaagcgtaggacgttcgaggtgataaagtttggacgtcgaaaaatcgtgaacgttaggttttttttgttttgcgtgtttatgttagtttggtaattagcgtcgataaaggcgcggtgcgtgataaatcgaaattggggggttaataatggttgattcgtaatttnttgttcggtgtttcggaaggtgtcgaataattaagagtagtgttgcgcgcgtcggtttacgaggcggcgtaggttaacgcgttataaaaaattggaaaattgtcgtcgcgttttgataacgttatttttgtggagcggcgagattcgtagttagtgtaata

SEQ ID NO: 8630 - DNA, 821 bp, Artificial Sequence
  chemically treated genomic DNA (Homo sapiens) CpG-island No: 8630
  misc_feature (162)..(162): n is either a, c, g or t
tattacactaactacgaatctcgccgctccacaaaaataacgttatcaaaacgcgacgacaattttccaattttttataacgcgttaacctacgccgcctcgtaaaccgacgcgcgcaacactactcttaattattcgacaccttccgaaacaccgaacaanaaattacgaatcaaccattattaaccccccaatttcgatttatcacgcaccgcgcctttatcgacgctaattaccaaactaacataaacacgcaaaacaaaaaaaacctaacgttcacgatttttcgacgtccaaactttatcacctcgaacgtcctacgcttcacgacgcgccgccaattcgacatcgcttacctataactaaataccacgattcgaaatatcgataacgatcaaatcaccatcttcaatcaaaccaatactaccgccgcttaccgcttccgataaaacgtaaccgataaaaaaaccaaaaataccaccaaaaaaacgaccgtcgataatcaacgcacaaactttaccgaaacccattaatttcaaaaaactaattaaataaaacatttcctacatccccgaaccgcctttcgaaccttcataacgaattactaccacatctccgacgacaactttaccgccgaaaatcgcttctaccgcatcgtcctaactttcgtacactttcgccgaaccgataaatttaaaaatactatcatcgacgcctaccgttttcacgatacaaccgttttccgcaaaattaccgtaaaacaccgccgaaaatccttctaaaataacctacaatctcctttataacgattacccgctcaa

SEQ ID NO: 8631 - DNA, 821 bp, Artificial Sequence
  chemically treated genomic DNA (Homo sapiens) CpG-island No: 8631
  misc_feature (162)..(162): n is either a, c, g or t
tgttgtattggttgcgaatttcgtcgttttataagaatgacgttattaagacgcgacgatagttttttaattttttgtagcgcgttaatttgcgtcgtttcgtaaatcggcgcgcgtagtattgtttttaattattcggtatttttcggagtatcggatagngggttgcgagttagttattattaattttttagtttcgatttattacgtatcgcgtttttgtcggcgttggttgttaggttggtataagtacgtagggtaaaggagatttgacgtttacgatttttcggcgtttaggttttgttatttcgagcgttttgcgttttacgacgcgtcgttagttcggtatcgtttatttgtaattgaatgttacggttcgggatgtcgatagcgattaggttattatttttaattaggttaatgttgtcgtcgtttgtcgttttcggtgagacgtggtcgatggaaagattagaggtgttattagagaaacgatcgtcggtgattagcgtataggttttgtcgagatttattgattttaggaagttggttgggtagagtattttttgtattttcggatcgtttttcgggtttttatagcgaattattattatattttcggcgataattttatcgtcgagaatcgtttttatcgtatcgttttggttttcgtatattttcgtcgggtcggtgaatttgaggatgttgttatcgacgtttgtcgtttttacgatgtagtcgtttttcgtaaagttatcgtagagtatcgtcggggatttttttagagtgatttgtagttttttttataacggttattcgtttag

SEQ ID NO: 8632 - DNA, 821 bp, Artificial Sequence
  chemically treated genomic DNA (Homo sapiens) CpG-island No: 8632
  misc_feature (660)..(660): n is either a, c, g or t
ctaaacgaataaccgttataaaaaaaactacaaatcactctaaaaaaatccccgacgatactctacgataactttacgaaaaacgactacatcgtaaaaacgacaaacgtcgataacaacatcctcaaattcaccgacccgacgaaaatatacgaaaaccaaaacgatacgataaaaacgattctcgacgataaaattatcgccgaaaatataataataattcgctataaaaacccgaaaaacgatccgaaaatacaaaaaatactctacccaaccaacttcctaaaatcaataaatctcgacaaaacctatacgctaatcaccgacgatcgtttctctaataacacctctaatctttccatcgaccacgtctcaccgaaaacgacaaacgacgacaacattaacctaattaaaaataataacctaatcgctatcgacatcccgaaccgtaacattcaattacaaataaacgataccgaactaacgacgcgtcgtaaaacgcaaaacgctcgaaataacaaaacctaaacgccgaaaaatcgtaaacgtcaaatctcctttaccctacgtacttataccaacctaacaaccaacgccgacaaaaacgcgatacgtaataaatcgaaactaaaaaattaataataactaactcgcaacccnctatccgatactccgaaaaataccgaataattaaaaacaatactacgcgcgccgatttacgaaacgacgcaaattaacgcgctacaaaaaattaaaaaactatcgtcgcgtcttaataacgtcattcttataaaacgacgaaattcgcaaccaatacaaca

SEQ ID NO: 8633 - DNA, 725 bp, Artificial Sequence
  chemically treated genomic DNA (Homo sapiens) CpG-island No: 8633
tttttcgtattcgtagttttttatttttatttcgttgttttatcgtatttttcgtcgagcgatttcgtatcgttttcgttgcgttatatttttgtgattttgtttttttattttttacgttcgttttagtttcgtgtgttttagagtcgcgtaggtttacgttttgtgttttttacgcgttttcgttttttcgtacgtgtatttttcgtatattcgcgcgttatatcgcgattttttttgtcggcgttatttattagatttatatatttgattgattttcgcgtatttattttttttttgtttgacgtttttattttttagtgttcgtttcgttgatttatttcgattttttacgcgcgtttattttttcgtttagttttggtatttattacgcgcgttttattcgttatttattcgttttattttttttacgcgtatttttgttcgtcgtttttattttcgtttcgtgttttatcgcgtggttttttatttattatttttattcgttttattttttttttcgatcgtttttcggtatcgtttttttttgtgtgtttttttttgttttttttcgtcgttttttttttcgttagtttttcgcgtgttttttttattgtgcgtttatttttcggtcgttttttttttttcgttttatgtatttatttaggttgattttagaggattcgtaattttttgttattttaaggcgtgaaggtaaagggttt

SEQ ID NO: 8634 - DNA, 725 bp, Artificial Sequence
  chemically treated genomic DNA (Homo sapiens) CpG-island No: 8634
aaaccctttaccttcacgccttaaaataacaaaaaattacgaatcctctaaaatcaacctaaataaatacataaaacgaaaaaaaaaaaacgaccgaaaaataaacgcacaataaaaaaaacacgcgaaaaactaacgaaaaaaaaaacgacgaaaaaaaacaaaaaaaaacacacaaaaaaaaacgataccgaaaaacgatcgaaaaaaaaaataaaacgaataaaaataataaataaaaaaccacgcgataaaacacgaaacgaaaataaaaacgacgaacaaaaatacgcgtaaaaaaaataaaacgaataaataacgaataaaacgcgcgtaataaataccaaaactaaacgaaaaaataaacgcgcgtaaaaaatcgaaataaatcaacgaaacgaacactaaaaaataaaaacgtcaaacaaaaaaaaaataaatacgcgaaaatcaatcaaatatataaatctaataaataacgccgacaaaaaaaatcgcgatataacgcgcgaatatacgaaaaatacacgtacgaaaaaacgaaaacgcgtaaaaaacacaaaacgtaaacctacgcgactctaaaacacacgaaactaaaacgaacgtaaaaaataaaaaaacaaaatcacaaaaatataacgcaacgaaaacgatacgaaatcgctcgacgaaaaatacgataaaacaacgaaataaaaataaaaaactacgaatacgaaaaa

SEQ ID NO: 8635 - DNA, 725 bp, Artificial Sequence
  chemically treated genomic DNA (Homo sapiens) CpG-island No: 8635
gaattttttgtttttacgttttggaatggtagaaggttgcggattttttagagttagtttggatggatgtataaagcggaggggagaaggcgatcggagagtgggcgtatagtgagggagatacgcgggaagttagcggagagaaaagcgacgaggaaaggtagaggaggatatatagaaaagggcggtgtcgaagggcgatcggagagaggggtggagcgggtgaggatggtggatgaggagttacgcggtgagatacggagcgggagtggaggcggcgagtagaagtgcgcgtgaaggagatgggacgagtgggtggcgagtgaggcgcgcgtgatgggtgttaaggttgaacggggaggtgagcgcgcgtgagaggtcgaggtgagttagcgaggcggatattggagaatggagacgttagatagaagaagagtggatgcgcgaggattagttaagtgtgtgagtttaatgaatgacgtcgatagaagaggtcgcggtgtgacgcgcgagtgtgcgaagagtgtacgtgcggagaggcgggaacgcgtgagagatatagagcgtgagtttgcgcgattttggagtatacggagttagagcgggcgtggaaggtggagaggtagagttatagaagtgtgacgtagcggagacggtgcgaaatcgttcggcgaaaagtgcggtggagtagcgagatgaaggtgagagattgcgagtgcgaaggg

SEQ ID NO: 8636 - DNA, 725 bp, Artificial Sequence
  chemically treated genomic DNA (Homo sapiens) CpG-island No: 8636
cccttcgcactcgcaatctctcaccttcatctcgctactccaccgcacttttcgccgaacgatttcgcaccgtctccgctacgtcacacttctataactctacctctccaccttccacgcccgctctaactccgtatactccaaaatcgcgcaaactcacgctctatatctctcacgcgttcccgcctctccgcacgtacactcttcgcacactcgcgcgtcacaccgcgacctcttctatcgacgtcattcattaaactcacacacttaactaatcctcgcgcatccactcttcttctatctaacgtctccattctccaatatccgcctcgctaactcacctcgacctctcacgcgcgctcacctccccgttcaaccttaacacccatcacgcgcgcctcactcgccacccactcgtcccatctccttcacgcgcacttctactcgccgcctccactcccgctccgtatctcaccgcgtaactcctcatccaccatcctcacccgctccacccctctctccgatcgcccttcgacaccgcccttttctatatatcctcctctacctttcctcgtcgcttttctctccgctaacttcccgcgtatctccctcactatacgcccactctccgatcgccttctcccctccgctttatacatccatccaaactaactctaaaaaatccgcaaccttctaccattccaaaacgtaaaaacaaaaaattc

SEQ ID NO: 8637 - DNA, 732 bp, Artificial Sequence
  chemically treated genomic DNA (Homo sapiens) CpG-island No: 8637
  misc_feature (590)..(590): n is either a, c, g or t
  misc_feature (644)..(644): n is either a, c, g or t
  misc_feature (705)..(705): n is either a, c, g or t
gacgcgttagtcgtattcgatattcgaattacgaggcgaaaaatgattaacgtataaaacgttagtaaaatttttattttgtattagtaaaacggcgtgcgtttgttcgtttttaatcgcgtttcgtttatcgttaacgcgggcgaatgcgtggtgttttacggttatttcggtagcggtaaattaattttgttacgttcgttgtacgttaattatttgttcgacgaaggttaaatttagattaaatacggtgacgagtgggtagatttggttatcgcgttagcgcgtaaagtggtggaaattcgtaaaattatcgtcggttgggtgagttagtttttgcgcgttatttcgcgtattttagtattggaagtggtgatgtagtcgttgttcgatatcggcgtttcgcgtgaagtttgcgtcgttaaagtcgcgcgtttttttattcgtttgaacgtgtcggaacgtttgtggtatttggtattatcgatatttttcggtggcgaatagtagcgcgttaatatcgttcgcggttttatcgtcgattattttattttgttgtttgacgaatttatcgtttcgttggacgttanaaatagcgtcgcggtggtggaattgattcgcgacgtaaaattcgtggcgtatantcgtaggtattttttatgacgaattgtacgtaatgacgtcgtcgatcgttgtaattatggnagttttttatgatattataacgtaagt

SEQ ID NO: 8638 - DNA, 732 bp, Artificial Sequence
  chemically treated genomic DNA (Homo sapiens) CpG-island No: 8638
  misc_feature (28)..(28): n is either a, c, g or t
  misc_feature (89)..(89): n is either a, c, g or t
  misc_feature (143)..(143): n is either a, c, g or t
acttacgttataatatcataaaaaactnccataattacaacgatcgacgacgtcattacgtacaattcgtcataaaaaatacctacgantatacgccacgaattttacgtcgcgaatcaattccaccaccgcgacgctatttntaacgtccaacgaaacgataaattcgtcaaacaacaaaataaaataatcgacgataaaaccgcgaacgatattaacgcgctactattcgccaccgaaaaatatcgataataccaaataccacaaacgttccgacacgttcaaacgaataaaaaaacgcgcgactttaacgacgcaaacttcacgcgaaacgccgatatcgaacaacgactacatcaccacttccaatactaaaatacgcgaaataacgcgcaaaaactaactcacccaaccgacgataattttacgaatttccaccactttacgcgctaacgcgataaccaaatctacccactcgtcaccgtatttaatctaaatttaaccttcgtcgaacaaataattaacgtacaacgaacgtaacaaaattaatttaccgctaccgaaataaccgtaaaacaccacgcattcgcccgcgttaacgataaacgaaacgcgattaaaaacgaacaaacgcacgccgttttactaatacaaaataaaaattttactaacgttttatacgttaatcatttttcgcctcgtaattcgaatatcgaatacgactaacgcgtc

SEQ ID NO: 8639 - DNA, 732 bp, Artificial Sequence
  chemically treated genomic DNA (Homo sapiens) CpG-island No: 8639
  misc_feature (28)..(28): n is either a, c, g or t
  misc_feature (89)..(89): n is either a, c, g or t
  misc_feature (143)..(143): n is either a, c, g or t
gtttacgttatgatattatgaagagttnttatggttgtagcggtcggcgacgttattacgtatagttcgttatggaagatgtttacgantgtgcgttacgggttttgcgtcgcgaattagttttattatcgcggcgttgtttntggcgtttagcgaggcggtaggttcgttaagtagtagaatggggtagtcgacgataaagtcgcgggcgatgttgacgcgttgttgttcgttatcggaaaatgtcgatggtgttaggtgttataggcgtttcggtacgtttaggcgggtgagaagacgcgcggttttagcggcgtaggttttacgcggaacgtcggtatcgagtagcggttgtattattatttttagtgttgagatacgcgggatgacgcgtagaaattggtttatttagtcgacggtggttttgcggatttttattattttgcgcgttggcgcggtgattaggtttatttattcgttatcgtgtttgatttggatttgattttcgtcgggtagatagttggcgtatagcgagcgtagtagagttgatttgtcgttgtcggaatggtcgtggagtattacgtattcgttcgcgttgacggtgagcgaggcgcgattgaggacgggtaggcgtacgtcgttttgttggtgtaggatgaaggttttattgacgttttgtacgttaattatttttcgtttcgtggttcgggtgtcggatgcggttgacgcgtt

SEQ ID NO: 8640 - DNA, 732 bp, Artificial Sequence
  chemically treated genomic DNA (Homo sapiens) CpG-island No: 8640
  misc_feature (590)..(590): n is either a, c, g or t
  misc_feature (644)..(644): n is either a, c, g or t
  misc_feature (705)..(705): n is either a, c, g or t
aacgcgtcaaccgcatccgacacccgaaccacgaaacgaaaaataattaacgtacaaaacgtcaataaaaccttcatcctacaccaacaaaacgacgtacgcctacccgtcctcaatcgcgcctcgctcaccgtcaacgcgaacgaatacgtaatactccacgaccattccgacaacgacaaatcaactctactacgctcgctatacgccaactatctacccgacgaaaatcaaatccaaatcaaacacgataacgaataaataaacctaatcaccgcgccaacgcgcaaaataataaaaatccgcaaaaccaccgtcgactaaataaaccaatttctacgcgtcatcccgcgtatctcaacactaaaaataataatacaaccgctactcgataccgacgttccgcgtaaaacctacgccgctaaaaccgcgcgtcttctcacccgcctaaacgtaccgaaacgcctataacacctaacaccatcgacattttccgataacgaacaacaacgcgtcaacatcgcccgcgactttatcgtcgactaccccattctactacttaacgaacctaccgcctcgctaaacgccanaaacaacgccgcgataataaaactaattcgcgacgcaaaacccgtaacgcacantcgtaaacatcttccataacgaactatacgtaataacgtcgccgaccgctacaaccataanaactcttcataatatcataacgtaaac

SEQ ID NO: 8641 - DNA, 571 bp, Artificial Sequence
  chemically treated genomic DNA (Homo sapiens) CpG-island No: 8641
acgttacgggttgtattattagttagattggcgacgtattcgcggggggtttgtaaaaaaggagtattttttagtagtaattcgtaattaggattatttcgtacggcgacgttatttcgatttatagtatacgacgtcgcgtttatatttgtatttttcgagtattgatggattcgtattttaaagatggtcgtttaatggattatgttagtgcggtcgtggttatttattcgtttaagtagtacgttaattattttagcgttagtagtacggaacgatatttttatatcggcgatacgagtggattcgtagttatattttattggttagatcggcggtacgtattggaacgacgtttttgttaggtcggcgcgatcgcgattacggtgtgagcgaggatttttattgattaattagtgtagttattacgtgtatcgattttggtatttgtatcgattatttttgtatacggcgatacgatttagggaatttaggggtttaggtgtttagatttagttaagattcgaagtgttttatcgattagagagttttcgtgggttcgtagtttttt

SEQ ID NO: 8642 - DNA, 571 bp, Artificial Sequence
  chemically treated genomic DNA (Homo sapiens) CpG-island No: 8642
aaaaaactacgaacccacgaaaactctctaatcgataaaacacttcgaatcttaactaaatctaaacacctaaacccctaaattccctaaatcgtatcgccgtatacaaaaataatcgatacaaataccaaaatcgatacacgtaataactacactaattaatcaataaaaatcctcgctcacaccgtaatcgcgatcgcgccgacctaacaaaaacgtcgttccaatacgtaccgccgatctaaccaataaaatataactacgaatccactcgtatcgccgatataaaaatatcgttccgtactactaacgctaaaataattaacgtactacttaaacgaataaataaccacgaccgcactaacataatccattaaacgaccatctttaaaatacgaatccatcaatactcgaaaaatacaaatataaacgcgacgtcgtatactataaatcgaaataacgtcgccgtacgaaataatcctaattacgaattactactaaaaaatactccttttttacaaaccccccgcgaatacgtcgccaatctaactaataatacaacccgtaacgt

SEQ ID NO: 8643 - DNA, 571 bp, Artificial Sequence
  chemically treated genomic DNA (Homo sapiens) CpG-island No: 8643
gaagggttgcggatttacggggattttttagtcggtaggatatttcgggttttggttaaatttaggtatttgggtttttgagttttttagatcgtatcgtcgtgtatagaggtaatcggtataggtattagggtcgatgtacgtagtgattgtattgattagttagtgagggttttcgtttatatcgtgatcgcggtcgcgtcgatttgataggaacgtcgttttaatacgtatcgtcggtttgattaatagggtgtgattacgggtttattcgtatcgtcgatgtggaaatgtcgtttcgtattgttagcgttaaggtagttgacgtgttgtttgagcgggtgagtgattacgatcgtattagtatagtttattggacggttatttttagagtgcgagtttattagtgttcgggaagtgtaagtgtgggcgcgacgtcgtatgttgtagatcggagtgacgtcgtcgtgcgagatgattttggttgcggattgttgttaaaaaatgttttttttttgtaagtttttcgcggatacgtcgttagtttagttgatgatgtagttcgtggcgt

SEQ ID NO: 8644 - DNA, 571 bp, Artificial Sequence
  chemically treated genomic DNA (Homo sapiens) CpG-island No: 8644
acgccacgaactacatcatcaactaaactaacgacgtatccgcgaaaaacttacaaaaaaaaaacattttttaacaacaatccgcaaccaaaatcatctcgcacgacgacgtcactccgatctacaacatacgacgtcgcgcccacacttacacttcccgaacactaataaactcgcactctaaaaataaccgtccaataaactatactaatacgatcgtaatcactcacccgctcaaacaacacgtcaactaccttaacgctaacaatacgaaacgacatttccacatcgacgatacgaataaacccgtaatcacaccctattaatcaaaccgacgatacgtattaaaacgacgttcctatcaaatcgacgcgaccgcgatcacgatataaacgaaaaccctcactaactaatcaatacaatcactacgtacatcgaccctaatacctataccgattacctctatacacgacgatacgatctaaaaaactcaaaaacccaaatacctaaatttaaccaaaacccgaaatatcctaccgactaaaaaatccccgtaaatccgcaacccttc

SEQ ID NO: 8645 - DNA, 624 bp, Artificial Sequence
  chemically treated genomic DNA (Homo sapiens) CpG-island No: 8645
  misc_feature (13)..(13): n is either a, c, g or t
  misc_feature (26)..(26): n is either a, c, g or t
  misc_feature (29)..(29): n is either a, c, g or t
  misc_feature (35)..(35): n is either a, c, g or t
  misc_feature (38)..(38): n is either a, c, g or t
  misc_feature (47)..(47): n is either a, c, g or t
  misc_feature (56)..(56): n is either a, c, g or t
  misc_feature (63)..(65): n is either a, c, g or t
  misc_feature (72)..(72): n is either a, c, g or t
  misc_feature (75)..(75): n is either a, c, g or t
  misc_feature (79)..(80): n is either a, c, g or t
  misc_feature (96)..(96): n is either a, c, g or t
  misc_feature (98)..(98): n is either a, c, g or t
  misc_feature (103)..(103): n is either a, c, g or t
  misc_feature (111)..(113): n is either a, c, g or t
  misc_feature (130)..(132): n is either a, c, g or t
  misc_feature (142)..(142): n is either a, c, g or t
  misc_feature (150)..(151): n is either a, c, g or t
  misc_feature (169)..(169): n is either a, c, g or t
  misc_feature (171)..(171): n is either a, c, g or t
  misc_feature (190)..(190): n is either a, c, g or t
  misc_feature (194)..(194): n is either a, c, g or t
  misc_feature (235)..(235): n is either a, c, g or t
  misc_feature (244)..(244): n is either a, c, g or t
  misc_feature (249)..(250): n is either a, c, g or t
  misc_feature (254)..(254): n is either a, c, g or t
  misc_feature (261)..(261): n is either a, c, g or t
  misc_feature (269)..(269): n is either a, c, g or t
  misc_feature (277)..(277): n is either a, c, g or t
  misc_feature (287)..(287): n is either a, c, g or t
  misc_feature (299)..(299): n is either a, c, g or t
  misc_feature (315)..(315): n is either a, c, g or t
  misc_feature (322)..(322): n is either a, c, g or t
  misc_feature (332)..(334): n is either a, c, g or t
  misc_feature (340)..(340): n is either a, c, g or t
  misc_feature (359)..(359): n is either a, c, g or t
  misc_feature (362)..(362): n is either a, c, g or t
  misc_feature (373)..(374): n is either a, c, g or t
  misc_feature (376)..(377): n is either a, c, g or t
  misc_feature (392)..(392): n is either a, c, g or t
  misc_feature (406)..(406): n is either a, c, g or t
  misc_feature (430)..(430): n is either a, c, g or t
  misc_feature (460)..(460): n is either a, c, g or t
  misc_feature (462)..(462): n is either a, c, g or t
  misc_feature (464)..(464): n is either a, c, g or t
  misc_feature (467)..(467): n is either a, c, g or t
  misc_feature (469)..(469): n is either a, c, g or t
  misc_feature (475)..(475): n is either a, c, g or t
  misc_feature (478)..(478): n is either a, c, g or t
  misc_feature (480)..(480): n is either a, c, g or t
  misc_feature (490)..(490): n is either a, c, g or t
  misc_feature (496)..(496): n is either a, c, g or t
  misc_feature (513)..(514): n is either a, c, g or t
  misc_feature (525)..(525): n is either a, c, g or t
  misc_feature (532)..(532): n is either a, c, g or t
  misc_feature (542)..(542): n is either a, c, g or t
  misc_feature (546)..(546): n is either a, c, g or t
  misc_feature (548)..(548): n is either a, c, g or t
  misc_feature (553)..(553): n is either a, c, g or t
  misc_feature (571)..(571): n is either a, c, g or t
  misc_feature (585)..(585): n is either a, c, g or t
  misc_feature (588)..(588): n is either a, c, g or t
gacgcgttgggtnatgagtcgcgcgnagncgagtngtntagtagagngagggggtncgagagnnnggtgganggncggnngagtgcgagcgcgtgngnagagngtgcgagnnngaagggtgtgcgagagnnnagtgcgaggncgcgtggnnggcgcgagagcgagtggngntgggagagatcgcgcgagntgtntgcgtgagcgtgagagagcgagcgagagagagagtggtagngcgcgaggnggttnngtgnggatggngcgagttnagtggcgnttgattgagnggtcgcgcgggngcgcgagcgtgggggngggaganagcgtggagnnngcgagnagagagagaggcgagcgtntgngagacgcgcgnngnngagggtgaaggaggngtgtggcgaggggngagggcgcgagaggattgcgagtngcgtagcgtggcgatggcgcggggcgcgtngngngtngnagcggnggnancggaggagtngcgcgngtcgtgcggagaggggnngtacgcgaggngcgtcgnagagggtcgngtangntcgantggggtcggataggtatngtggttcgtgagtnggnagagatgtagtgtatcgcggcgtgtataggtgtcgt

SEQ ID NO: 8646 - DNA, 624 bp, Artificial Sequence
  chemically treated genomic DNA (Homo sapiens) CpG-island No: 8646
  misc_feature (37)..(37): n is either a, c, g or t
  misc_feature (40)..(40): n is either a, c, g or t
  misc_feature (54)..(54): n is either a, c, g or t
  misc_feature (72)..(72): n is either a, c, g or t
  misc_feature (77)..(77): n is either a, c, g or t
  misc_feature (79)..(79): n is either a, c, g or t
  misc_feature (83)..(83): n is either a, c, g or t
  misc_feature (93)..(93): n is either a, c, g or t
  misc_feature (100)..(100): n is either a, c, g or t
  misc_feature (111)..(112): n is either a, c, g or t
  misc_feature (129)..(129): n is either a, c, g or t
  misc_feature (135)..(135): n is either a, c, g or t
  misc_feature (145)..(145): n is either a, c, g or t
  misc_feature (147)..(147): n is either a, c, g or t
  misc_feature (150)..(150): n is either a, c, g or t
  misc_feature (156)..(156): n is either a, c, g or t
  misc_feature (158)..(158): n is either a, c, g or t
  misc_feature (161)..(161): n is either a, c, g or t
  misc_feature (163)..(163): n is either a, c, g or t
  misc_feature (165)..(165): n is either a, c, g or t
  misc_feature (195)..(195): n is either a, c, g or t
  misc_feature (219)..(219): n is either a, c, g or t
  misc_feature (233)..(233): n is either a, c, g or t
  misc_feature (248)..(249): n is either a, c, g or t
  misc_feature (251)..(252): n is either a, c, g or t
  misc_feature (263)..(263): n is either a, c, g or t
  misc_feature (266)..(266): n is either a, c, g or t
  misc_feature (285)..(285): n is either a, c, g or t
  misc_feature (291)..(293): n is either a, c, g or t
  misc_feature (303)..(303): n is either a, c, g or t
  misc_feature (310)..(310): n is either a, c, g or t
  misc_feature (326)..(326): n is either a, c, g or t
  misc_feature (338)..(338): n is either a, c, g or t
  misc_feature (348)..(348): n is either a, c, g or t
  misc_feature (356)..(356): n is either a, c, g or t
  misc_feature (364)..(364): n is either a, c, g or t
  misc_feature (371)..(371): n is either a, c, g or t
  misc_feature (375)..(376): n is either a, c, g or t
  misc_feature (381)..(381): n is either a, c, g or t
  misc_feature (390)..(390): n is either a, c, g or t
  misc_feature (431)..(431): n is either a, c, g or t
  misc_feature (435)..(435): n is either a, c, g or t
  misc_feature (454)..(454): n is either a, c, g or t
  misc_feature (456)..(456): n is either a, c, g or t
  misc_feature (474)..(475): n is either a, c, g or t
  misc_feature (483)..(483): n is either a, c, g or t
  misc_feature (493)..(495): n is either a, c, g or t
  misc_feature (512)..(514): n is either a, c, g or t
  misc_feature (522)..(522): n is either a, c, g or t
  misc_feature (527)..(527): n is either a, c, g or t
  misc_feature (529)..(529): n is either a, c, g or t
  misc_feature (545)..(546): n is either a, c, g or t
  misc_feature (550)..(550): n is either a, c, g or t
  misc_feature (553)..(553): n is either a, c, g or t
  misc_feature (560)..(562): n is either a, c, g or t
  misc_feature (569)..(569): n is either a, c, g or t
  misc_feature (578)..(578): n is either a, c, g or t
  misc_feature (587)..(587): n is either a, c, g or t
  misc_feature (590)..(590): n is either a, c, g or t
  misc_feature (596)..(596): n is either a, c, g or t
  misc_feature (599)..(599): n is either a, c, g or t
  misc_feature (612)..(612): n is either a, c, g or t
acgacacctatacacgccgcgatacactacatctctnccnactcacgaaccacnatacctatccgaccccantcgancntacncgaccctctncgacgcncctcgcgtacnncccctctccgcacgacncgcgcnactcctccgntnccnccgctncnacncncnacgcgccccgcgccatcgccacgctacgcnactcgcaatcctctcgcgccctcncccctcgccacacncctccttcaccctcnncnncgcgcgtctcncanacgctcgcctctctctctnctcgcnnnctccacgctntctcccncccccacgctcgcgcncccgcgcgaccnctcaatcaancgccactnaactcgcnccatccncacnnaaccncctcgcgcnctaccactctctctctcgctcgctctctcacgctcacgcanacanctcgcgcgatctctcccancnccactcgctctcgcgccnnccacgcgncctcgcactnnnctctcgcacacccttcnnnctcgcacnctctncncacgcgctcgcactcnnccgnccntccaccnnnctctcgnaccccctcnctctactanacnactcgnctncgcgcgactcatnacccaacgcgtc

SEQ ID NO: 8647 - DNA, 624 bp, Artificial Sequence
  chemically treated genomic DNA (Homo sapiens) CpG-island No: 8647
  misc_feature (37)..(37): n is either a, c, g or t
  misc_feature (40)..(40): n is either a, c, g or t
  misc_feature (54)..(54): n is either a, c, g or t
  misc_feature (72)..(72): n is either a, c, g or t
  misc_feature (77)..(77): n is either a, c, g or t
  misc_feature (79)..(79): n is either a, c, g or t
  misc_feature (83)..(83): n is either a, c, g or t
  misc_feature (93)..(93): n is either a, c, g or t
  misc_feature (100)..(100): n is either a, c, g or t
  misc_feature (111)..(112): n is either a, c, g or t
  misc_feature (129)..(129): n is either a, c, g or t
  misc_feature (135)..(135): n is either a, c, g or t
  misc_feature (145)..(145): n is either a, c, g or t
  misc_feature (147)..(147): n is either a, c, g or t
  misc_feature (150)..(150): n is either a, c, g or t
  misc_feature (156)..(156): n is either a, c, g or t
  misc_feature (158)..(158): n is either a, c, g or t
  misc_feature (161)..(161): n is either a, c, g or t
  misc_feature (163)..(163): n is either a, c, g or t
  misc_feature (165)..(165): n is either a, c, g or t
  misc_feature (195)..(195): n is either a, c, g or t
  misc_feature (219)..(219): n is either a, c, g or t
  misc_feature (233)..(233): n is either a, c, g or t
  misc_feature (248)..(249): n is either a, c, g or t
  misc_feature (251)..(252): n is either a, c, g or t
  misc_feature (263)..(263): n is either a, c, g or t
  misc_feature (266)..(266): n is either a, c, g or t
  misc_feature (285)..(285): n is either a, c, g or t
  misc_feature (291)..(293): n is either a, c, g or t
  misc_feature (303)..(303): n is either a, c, g or t
  misc_feature (310)..(310): n is either a, c, g or t
  misc_feature (326)..(326): n is either a, c, g or t
  misc_feature (338)..(338): n is either a, c, g or t
  misc_feature (348)..(348): n is either a, c, g or t
  misc_feature (356)..(356): n is either a, c, g or t
  misc_feature (364)..(364): n is either a, c, g or t
  misc_feature (371)..(371): n is either a, c, g or t
  misc_feature (375)..(376): n is either a, c, g or t
  misc_feature (381)..(381): n is either a, c, g or t
  misc_feature (390)..(390): n is either a, c, g or t
  misc_feature (431)..(431): n is either a, c, g or t
  misc_feature (435)..(435): n is either a, c, g or t
  misc_feature (454)..(454): n is either a, c, g or t
  misc_feature (456)..(456): n is either a, c, g or t
  misc_feature (474)..(475): n is either a, c, g or t
  misc_feature (483)..(483): n is either a, c, g or t
  misc_feature (493)..(495): n is either a, c, g or t
  misc_feature (512)..(514): n is either a, c, g or t
  misc_feature (522)..(522): n is either a, c, g or t
  misc_feature (527)..(527): n is either a, c, g or t
  misc_feature (529)..(529): n is either a, c, g or t
  misc_feature (545)..(546): n is either a, c, g or t
  misc_feature (550)..(550): n is either a, c, g or t
  misc_feature (553)..(553): n is either a, c, g or t
  misc_feature (560)..(562): n is either a, c, g or t
  misc_feature (569)..(569): n is either a, c, g or t
  misc_feature (578)..(578): n is either a, c, g or t
  misc_feature (587)..(587): n is either a, c, g or t
  misc_feature (590)..(590): n is either a, c, g or t
  misc_feature (596)..(596): n is either a, c, g or t
  misc_feature (599)..(599): n is either a, c, g or t
  misc_feature (612)..(612): n is either a, c, g or t
gcgatatttgtgtacgtcgcgatatattatatttttnttnatttacggattatnatgtttattcgattttantcgantntatncgattttttncgacgtntttcgcgtatnnttttttttcgtacgatncgcgtngttttttcgntnttntcgttntnatntntnacgcgtttcgcgttatcgttacgttgcgtnattcgtaattttttcgcgtttttntttttcgttatatnttttttttatttttnntnncgcgcgttttntanacgttcgtttttttttttnttcgtnnnttttacgttnttttttntttttacgttcgcgtnttcgcgcgattntttaattaancgttattnaattcgtnttatttntatnnaattntttcgcgtnttattattttttttttcgttcgtttttttacgtttacgtangtanttcgcgcggttttttttantnttattcgttttcgcgttnnttacgcgntttcgtattnnnttttcgtatattttttnnnttcgtatnttttntntacgcgttcgtatttnntcgnttntttattnnnttttcgngtttttttnttttattanatngttcgnttncgcgcgatttatnatttaacgcgtt

SEQ ID NO: 8648 - DNA, 624 bp, Artificial Sequence
  chemically treated genomic DNA (Homo sapiens) CpG-island No: 8648
  misc_feature (13)..(13): n is either a, c, g or t
  misc_feature (26)..(26): n is either a, c, g or t
  misc_feature (29)..(29): n is either a, c, g or t
  misc_feature (35)..(35): n is either a, c, g or t
  misc_feature (38)..(38): n is either a, c, g or t
  misc_feature (47)..(47): n is either a, c, g or t
  misc_feature (56)..(56): n is either a, c, g or t
  misc_feature (63)..(65): n is either a, c, g or t
  misc_feature (72)..(72): n is either a, c, g or t
  misc_feature (75)..(75): n is either a, c, g or t
  misc_feature (79)..(80): n is either a, c, g or t
  misc_feature (96)..(96): n is either a, c, g or t
  misc_feature (98)..(98): n is either a, c, g or t
  misc_feature (103)..(103): n is either a, c, g or t
  misc_feature (111)..(113): n is either a, c, g or t
  misc_feature (130)..(132): n is either a, c, g or t
  misc_feature (142)..(142): n is either a, c, g or t
  misc_feature (150)..(151): n is either a, c, g or t
  misc_feature (169)..(169): n is either a, c, g or t
  misc_feature (171)..(171): n is either a, c, g or t
  misc_feature (190)..(190): n is either a, c, g or t
  misc_feature (194)..(194): n is either a, c, g or t
  misc_feature (235)..(235): n is either a, c, g or t
  misc_feature (244)..(244): n is either a, c, g or t
  misc_feature (249)..(250): n is either a, c, g or t
  misc_feature (254)..(254): n is either a, c, g or t
  misc_feature (261)..(261): n is either a, c, g or t
  misc_feature (269)..(269): n is either a, c, g or t
  misc_feature (277)..(277): n is either a, c, g or t
  misc_feature (287)..(287): n is either a, c, g or t
  misc_feature (299)..(299): n is either a, c, g or t
  misc_feature (315)..(315): n is either a, c, g or t
  misc_feature (322)..(322): n is either a, c, g or t
  misc_feature (332)..(334): n is either a, c, g or t
  misc_feature (340)..(340): n is either a, c, g or t
  misc_feature (359)..(359): n is either a, c, g or t
  misc_feature (362)..(362): n is either a, c, g or t
  misc_feature (373)..(374): n is either a, c, g or t
  misc_feature (376)..(377): n is either a, c, g or t
  misc_feature (392)..(392): n is either a, c, g or t
  misc_feature (406)..(406): n is either a, c, g or t
  misc_feature (430)..(430): n is either a, c, g or t
  misc_feature (460)..(460): n is either a, c, g or t
  misc_feature (462)..(462): n is either a, c, g or t
  misc_feature (464)..(464): n is either a, c, g or t
  misc_feature (467)..(467): n is either a, c, g or t
  misc_feature (469)..(469): n is either a, c, g or t
  misc_feature (475)..(475): n is either a, c, g or t
  misc_feature (478)..(478): n is either a, c, g or t
  misc_feature (480)..(480): n is either a, c, g or t
  misc_feature (490)..(490): n is either a, c, g or t
  misc_feature (496)..(496): n is either a, c, g or t
  misc_feature (513)..(514): n is either a, c, g or t
  misc_feature (525)..(525): n is either a, c, g or t
  misc_feature (532)..(532): n is either a, c, g or t
  misc_feature (542)..(542): n is either a, c, g or t
  misc_feature (546)..(546): n is either a, c, g or t
  misc_feature (548)..(548): n is either a, c, g or t
  misc_feature (553)..(553): n is either a, c, g or t
  misc_feature (571)..(571): n is either a, c, g or t
  misc_feature (585)..(585): n is either a, c, g or t
  misc_feature (588)..(588): n is either a, c, g or t
aacgcgttaaatnataaatcgcgcgnaancgaacnatntaataaaanaaaaaaacncgaaaannnaataaanaancgannaaatacgaacgcgtananaaaanatacgaannnaaaaaatatacgaaaannnaatacgaaancgcgtaannaacgcgaaaacgaataanantaaaaaaaaccgcgcgaantacntacgtaaacgtaaaaaaacgaacgaaaaaaaaaataataanacgcgaaanaattnnatanaaataanacgaattnaataacgnttaattaaanaatcgcgcgaanacgcgaacgtaaaaanaaaaaanaacgtaaaannnacgaanaaaaaaaaaaacgaacgtntanaaaacgcgcgnnannaaaaataaaaaaaanatataacgaaaaanaaaaacgcgaaaaaattacgaatnacgcaacgtaacgataacgcgaaacgcgtnananatnanaacganaanancgaaaaaacnacgcgnatcgtacgaaaaaaaannatacgcgaaanacgtcgnaaaaaatcgnatanantcgantaaaatcgaataaacatnataatccgtaaatnaanaaaaatataatatatcgcgacgtacacaaatatcgc

SEQ ID NO: 8649 - DNA, 835 bp, Artificial Sequence
  chemically treated genomic DNA (Homo sapiens) CpG-island No: 8649
ggagtatacggattcgcgcgtttttcgtttttttttgtagggtttcgcgggaaagttaacgtaaagggtacggggttatatttatcgttgggcgtagtagttttttaggcgcggggtcgggacgaggcggcgagcggaggtagtaggagaaggacgagaagtaggcggtagggcggcgtgcgggtcggggcgttggtaggtatcgagtcggcggggtcgcgttgggggtcgtaggaagcgtcggtaaggttgtagttcgttaggggcggttgtcgcgagttgttgtcgggcggttttatggtttatagttttcgggcgtcgtttcgtgtggtcggcgagagcgtcgggttagttgcggggcggtcgcgggcggagtcggttacgtcggttcggcgcgtatggtgtcgcggcgggtagggggtttcgggttcggggtacggggcgcggggttcggggttgggcggcgttttttttttcggttcgtttagtttcgtagttattttcggggcgggacgtagaggagtttaggggttttcgtcgtttcgttaatttggagtttttttagcggttattttttttttcggcgggcgcggtcgttttagcgattgcgggggttgtcgtcgggtttgaggatgttgaggcggcgcgcgggagcgagcggcgcggggacgcgcgggagcgagcggcgcggggacgcgcggagcgggcgtgcgtttcgtttttcgagagcgcgttcgagcggggtttcgggtgttgatgttgttgttggatgttgtgttgttgttgttgtttggttcggaacgtattgcgtatgttttgttggggggcggggaag

SEQ ID NO: 8650 - DNA, 835 bp, Artificial Sequence
  chemically treated genomic DNA (Homo sapiens) CpG-island No: 8650
cttccccgccccccaacaaaacatacgcaatacgttccgaaccaaacaacaacaacaacacaacatccaacaacaacatcaacacccgaaaccccgctcgaacgcgctctcgaaaaacgaaacgcacgcccgctccgcgcgtccccgcgccgctcgctcccgcgcgtccccgcgccgctcgctcccgcgcgccgcctcaacatcctcaaacccgacgacaacccccgcaatcgctaaaacgaccgcgcccgccgaaaaaaaaaataaccgctaaaaaaactccaaattaacgaaacgacgaaaacccctaaactcctctacgtcccgccccgaaaataactacgaaactaaacgaaccgaaaaaaaaaacgccgcccaaccccgaaccccgcgccccgtaccccgaacccgaaaccccctacccgccgcgacaccatacgcgccgaaccgacgtaaccgactccgcccgcgaccgccccgcaactaacccgacgctctcgccgaccacacgaaacgacgcccgaaaactataaaccataaaaccgcccgacaacaactcgcgacaaccgcccctaacgaactacaaccttaccgacgcttcctacgacccccaacgcgaccccgccgactcgatacctaccaacgccccgacccgcacgccgccctaccgcctacttctcgtccttctcctactacctccgctcgccgcctcgtcccgaccccgcgcctaaaaaactactacgcccaacgataaatataaccccgtaccctttacgttaactttcccgcgaaaccctacaaaaaaaaacgaaaaacgcgcgaatccgtatactcc

SEQ ID NO: 8651 - DNA, 835 bp, Artificial Sequence
  chemically treated genomic DNA (Homo sapiens) CpG-island No: 8651
ttttttcgttttttaataaagtatgcgtagtgcgtttcgggttaggtaatagtagtagtatagtatttagtaatagtattagtattcgaagtttcgttcgggcgcgttttcggggggcggggcgtacgttcgtttcgcgcgttttcgcgtcgttcgttttcgcgcgttttcgcgtcgttcgttttcgcgcgtcgttttagtatttttaggttcggcggtagttttcgtagtcgttgaagcggtcgcgttcgtcgggggagggagtagtcgttggggaggttttaagttggcggagcggcgaggatttttggatttttttgcgtttcgtttcgggagtggttgcgaggttaggcgagtcgggaaagggggcgtcgtttagtttcgagtttcgcgtttcgtgtttcgagttcggagttttttgttcgtcgcggtattatgcgcgtcgagtcggcgtgatcggtttcgttcgcggtcgtttcgtagttagttcggcgttttcgtcggttatacggagcggcgttcgggagttatgagttatgaagtcgttcggtagtagttcgcggtagtcgtttttggcgggttgtagttttgtcggcgttttttgcggtttttaacgcggtttcgtcggttcggtgtttgttagcgtttcggttcgtacgtcgttttgtcgtttgtttttcgttttttttttgttgttttcgttcgtcgtttcgtttcggtttcgcgtttggggggttgttgcgtttagcggtgggtatggtttcgtgttttttgcgttggttttttcgcggggttttgtagaggaaagcgaagggcgcgcgggttcgtgtgtttt

SEQ ID NO: 8652 - DNA, 835 bp, Artificial Sequence
  chemically treated genomic DNA (Homo sapiens) CpG-island No: 8652
aaaacacacgaacccgcgcgcccttcgctttcctctacaaaaccccgcgaaaaaaccaacgcaaaaaacacgaaaccatacccaccgctaaacgcaacaaccccccaaacgcgaaaccgaaacgaaacgacgaacgaaaacaacaaaaaaaaaacgaaaaacaaacgacaaaacgacgtacgaaccgaaacgctaacaaacaccgaaccgacgaaaccgcgttaaaaaccgcaaaaaacgccgacaaaactacaacccgccaaaaacgactaccgcgaactactaccgaacgacttcataactcataactcccgaacgccgctccgtataaccgacgaaaacgccgaactaactacgaaacgaccgcgaacgaaaccgatcacgccgactcgacgcgcataataccgcgacgaacaaaaaactccgaactcgaaacacgaaacgcgaaactcgaaactaaacgacgccccctttcccgactcgcctaacctcgcaaccactcccgaaacgaaacgcaaaaaaatccaaaaatcctcgccgctccgccaacttaaaacctccccaacgactactccctcccccgacgaacgcgaccgcttcaacgactacgaaaactaccgccgaacctaaaaatactaaaacgacgcgcgaaaacgaacgacgcgaaaacgcgcgaaaacgaacgacgcgaaaacgcgcgaaacgaacgtacgccccgccccccgaaaacgcgcccgaacgaaacttcgaatactaatactattactaaatactatactactactattacctaacccgaaacgcactacgcatactttattaaaaaacgaaaaaa

SEQ ID NO: 8653 - DNA, 870 bp, Artificial Sequence
  chemically treated genomic DNA (Homo sapiens) CpG-island No: 8653
aggcggggttaggttcgttaatagtcgggcggggttttttttttcgggtttcgtttcggtcgattttattttttcgcgcggtttcgtttcgtcgtttttttgttagtggttttttttcgcgtaggtttcgattttagtcgtatttttttcggttttgtagtggcggcgaggaggcgagtcggagcgacggcggggttggggtcggagtcgagtcggggtcgggtagtagtagggattttttagaggcggggtttgtgggatcgttatgggcgtggagatcgagattatttttttcggagacggtatcgggtttttttcggagttaggggaggggaggggtttcggggcggagttcggagggcgggggtttgattcggaggtggcgtggagggtgttgaagggtcggggggttggatggggaaggtaggcggagacgttacgggatttttgggggtttaggagattatttttcgttattttttttcgcgtttatttaggggaatgtaggcggtattcggaggcgggggtttgcggttcggaggcgggggtttgcggttcgttatcgtttcgggttttttttgtcgcggttgtagtcgttcggttattcgttgttgttgatattttagtttgggtttcggtttcgttttttttgttttattcggcgagttttggaaagtaggatttgttttcggatattcgttgttcggggatttttttttagcgcgtttttcgtcgggttttttttcggtcgtttttttgcgggtcgggttgtgagcggttgtggggatagatttaggttggggaagggggaagcgtttttttgttcgttttcggatttcgttttattttgtcgtcgtttttagatttttt

SEQ ID NO: 8654 - DNA, 870 bp, Artificial Sequence
  chemically treated genomic DNA (Homo sapiens) CpG-island No: 8654
aaaaaatctaaaaacgacgacaaaataaaacgaaatccgaaaacgaacaaaaaaacgcttcccccttccccaacctaaatctatccccacaaccgctcacaacccgacccgcaaaaaaacgaccgaaaaaaaacccgacgaaaaacgcgctaaaaaaaaatccccgaacaacgaatatccgaaaacaaatcctactttccaaaactcgccgaataaaacaaaaaaaacgaaaccgaaacccaaactaaaatatcaacaacaacgaataaccgaacgactacaaccgcgacaaaaaaaacccgaaacgataacgaaccgcaaacccccgcctccgaaccgcaaacccccgcctccgaataccgcctacattcccctaaataaacgcgaaaaaaaataacgaaaaataatctcctaaacccccaaaaatcccgtaacgtctccgcctaccttccccatccaaccccccgacccttcaacaccctccacgccacctccgaatcaaacccccgccctccgaactccgccccgaaacccctcccctcccctaactccgaaaaaaacccgataccgtctccgaaaaaaataatctcgatctccacgcccataacgatcccacaaaccccgcctctaaaaaatccctactactacccgaccccgactcgactccgaccccaaccccgccgtcgctccgactcgcctcctcgccgccactacaaaaccgaaaaaaatacgactaaaatcgaaacctacgcgaaaaaaaaccactaacaaaaaaacgacgaaacgaaaccgcgcgaaaaaataaaatcgaccgaaacgaaacccgaaaaaaaaaaccccgcccgactattaacgaacctaaccccgcct

SEQ ID NO: 8655 - DNA, 870 bp, Artificial Sequence
  chemically treated genomic DNA (Homo sapiens) CpG-island No: 8655
agggagtttgaaagcggcggtaggataaagcgagattcggaagcgggtaagggagcgttttttttttttttagtttgggtttgtttttatagtcgtttatagttcggttcgtagggaagcgatcgaggggaggttcggcgggggacgcgttaggaggaggttttcgagtagcgggtattcgagagtaggttttgttttttagagttcgtcgagtagggtagggaaagcgaagtcgaaatttaggttggggtattagtagtagcggataatcgaacgattgtagtcgcgataggagaagttcggggcggtggcgggtcgtagattttcgttttcgggtcgtagattttcgttttcgagtgtcgtttatatttttttaggtgagcgcggaagaggatggcggaggatggttttttagatttttaagaatttcgtgacgttttcgtttgttttttttatttagtttttcgattttttagtattttttacgttattttcgaattagattttcgtttttcgggtttcgtttcgggatttttttttttttttggtttcggagggagttcggtatcgttttcgggggagatggtttcgatttttacgtttatagcggttttataggtttcgtttttggggggtttttgttgttgttcgatttcggttcggtttcggttttagtttcgtcgtcgtttcggttcgttttttcgtcgttattgtagagtcggaggaggtgcggttggagtcgggatttgcgcggggaggggttattggtaagggggcggcggggcggagtcgcgcggaaaggtggggtcggtcggggcggggttcgggggaagggatttcgttcggttgttagcgagtttggtttcgttt

SEQ ID NO: 8656 - DNA, 870 bp, Artificial Sequence
  chemically treated genomic DNA (Homo sapiens) CpG-island No: 8656
aaacgaaaccaaactcgctaacaaccgaacgaaatcccttcccccgaaccccgccccgaccgaccccacctttccgcgcgactccgccccgccgcccccttaccaataacccctccccgcgcaaatcccgactccaaccgcacctcctccgactctacaataacgacgaaaaaacgaaccgaaacgacgacgaaactaaaaccgaaaccgaaccgaaatcgaacaacaacaaaaaccccccaaaaacgaaacctataaaaccgctataaacgtaaaaatcgaaaccatctcccccgaaaacgataccgaactccctccgaaaccaaaaaaaaaaaaaaatcccgaaacgaaacccgaaaaacgaaaatctaattcgaaaataacgtaaaaaatactaaaaaatcgaaaaactaaataaaaaaaacaaacgaaaacgtcacgaaattcttaaaaatctaaaaaaccatcctccgccatcctcttccgcgctcacctaaaaaaatataaacgacactcgaaaacgaaaatctacgacccgaaaacgaaaatctacgacccgccaccgccccgaacttctcctatcgcgactacaatcgttcgattatccgctactactaataccccaacctaaatttcgacttcgctttccctaccctactcgacgaactctaaaaaacaaaacctactctcgaatacccgctactcgaaaacctcctcctaacgcgtcccccgccgaacctcccctcgatcgcttccctacgaaccgaactataaacgactataaaaacaaacccaaactaaaaaaaaaaaaaacgctcccttacccgcttccgaatctcgctttatcctaccgccgctttcaaactccct

SEQ ID NO: 8657 - DNA, 747 bp, Artificial Sequence
  chemically treated genomic DNA (Homo sapiens) CpG-island No: 8657
gagcggttcgaagtttttttcgaggtacgggtgcgacggggatgtcgtaggcgttcgtattcgttttcgtttatcgcgtttattttcggtttttttttttatttattaggtcgggcgtttgcggtttttacgttagtttcgggtcgggggtttttcgcgtaggcgcgtcgtgcgcggggatcgttcggtttggcggggaggtcgtcggtcgcgataggtatttttttgtttttttaaggttagtaggttcgcggtcgttttgttatatattcgggttcggttcgacgatttcggagtcgttcgattgcgggtggaagggagttcgttcgcgtttgcggaacgcgcgaatgttggcgtttatcgtttttcggacgtagcgtcgcgcgagtattttcgttttttgcgtcgcgggttttatagcgagttcgcgcgggcgtgtcggggcggcggaggacggttttaggtttaaagggattgggcggcggttttaggtggcgggttttggtttgcggaaggggttggagtcgttgtttttcggtgatcggcgcgtggttcggttaattttgtcgtcgttatttattcgtaatcgcgttcgttgacggtcgggtttttggtcgtcgggtttttgcgggtattatagagcggggtggcgttcgttttttcgagttttcggtgttagggaatttatcgtttattattttttgtttcgttttgggttttgttcggggattaaattattggaaggta

SEQ ID NO: 8658 - DNA, 747 bp, Artificial Sequence
  chemically treated genomic DNA (Homo sapiens) CpG-island No: 8658
taccttccaataatttaatccccgaacaaaacccaaaacgaaacaaaaaataataaacgataaattccctaacaccgaaaactcgaaaaaacgaacgccaccccgctctataatacccgcaaaaacccgacgaccaaaaacccgaccgtcaacgaacgcgattacgaataaataacgacgacaaaattaaccgaaccacgcgccgatcaccgaaaaacaacgactccaaccccttccgcaaaccaaaacccgccacctaaaaccgccgcccaatccctttaaacctaaaaccgtcctccgccgccccgacacgcccgcgcgaactcgctataaaacccgcgacgcaaaaaacgaaaatactcgcgcgacgctacgtccgaaaaacgataaacgccaacattcgcgcgttccgcaaacgcgaacgaactcccttccacccgcaatcgaacgactccgaaatcgtcgaaccgaacccgaatatataacaaaacgaccgcgaacctactaaccttaaaaaaacaaaaaaatacctatcgcgaccgacgacctccccgccaaaccgaacgatccccgcgcacgacgcgcctacgcgaaaaacccccgacccgaaactaacgtaaaaaccgcaaacgcccgacctaataaataaaaaaaaaaaccgaaaataaacgcgataaacgaaaacgaatacgaacgcctacgacatccccgtcgcacccgtacctcgaaaaaaacttcgaaccgctc

SEQ ID NO: 8659 - DNA, 747 bp, Artificial Sequence
  chemically treated genomic DNA (Homo sapiens) CpG-island No: 8659
tgttttttagtggtttggttttcgagtaggatttaaggcggggtagggggtggtgagcggtgaattttttggtatcgaggattcgagggagcggacgttatttcgttttgtggtgttcgtaaggattcggcgattaaggattcgatcgttaacggacgcggttgcgggtgggtggcggcggtaggattggtcgggttacgcgtcggttatcgagaagtagcgattttagtttttttcgtaaattaagattcgttatttagagtcgtcgtttaatttttttgggtttgaagtcgtttttcgtcgtttcggtacgttcgcgcggattcgttgtggaattcgcggcgtagggggcgggagtgttcgcgcggcgttgcgttcgggagacggtgggcgttaatattcgcgcgtttcgtagacgcgggcgggtttttttttattcgtagtcggacggtttcggggtcgtcgggtcgggttcgagtgtgtagtaggacggtcgcgggtttgttggttttgggagggtagagaggtgtttgtcgcggtcggcgattttttcgttaggtcgggcggttttcgcgtacgacgcgtttgcgcgggaggttttcggttcggggttggcgtggaggtcgtaggcgttcggtttagtgggtgggaggaagggtcgggagtgggcgcgatgagcgagagcgggtgcggacgtttacgatattttcgtcgtattcgtgtttcggggaggatttcgagtcgttt

SEQ ID NO: 8660 - DNA, 747 bp, Artificial Sequence
  chemically treated genomic DNA (Homo sapiens) CpG-island No: 8660
aaacgactcgaaatcctccccgaaacacgaatacgacgaaaatatcgtaaacgtccgcacccgctctcgctcatcgcgcccactcccgacccttcctcccacccactaaaccgaacgcctacgacctccacgccaaccccgaaccgaaaacctcccgcgcaaacgcgtcgtacgcgaaaaccgcccgacctaacgaaaaaatcgccgaccgcgacaaacacctctctaccctcccaaaaccaacaaacccgcgaccgtcctactacacactcgaacccgacccgacgaccccgaaaccgtccgactacgaataaaaaaaaacccgcccgcgtctacgaaacgcgcgaatattaacgcccaccgtctcccgaacgcaacgccgcgcgaacactcccgccccctacgccgcgaattccacaacgaatccgcgcgaacgtaccgaaacgacgaaaaacgacttcaaacccaaaaaaattaaacgacgactctaaataacgaatcttaatttacgaaaaaaactaaaatcgctacttctcgataaccgacgcgtaacccgaccaatcctaccgccgccacccacccgcaaccgcgtccgttaacgatcgaatccttaatcgccgaatccttacgaacaccacaaaacgaaataacgtccgctccctcgaatcctcgataccaaaaaattcaccgctcaccaccccctaccccgccttaaatcctactcgaaaaccaaaccactaaaaaaca

SEQ ID NO: 8661 - DNA, 510 bp, Artificial Sequence
  chemically treated genomic DNA (Homo sapiens) CpG-island No: 8661
ttttcgatcggaatatttcgttttttggaggttacgtttcgttttttacggtatagagttcggaagtgttttggattttcgtttttttatttttcggtttcgagtttcgtttaggttcggttttatttcggagtttattcgaagggggttgttacgttagcgcgttttagcgtaagacggcgttatttcgttgtaatagttttcggcgggttttggatgttgatgttttgtatttaacgcggtgtaattttcgaagtcgagcgagtttcggaggaattttagtatttgttacggtaattttattagttcgttaagatggcgatgtaagcggttaagagggcgaacgtgagtatcgggtgttttgcggagggtgggagaatttcgggtttgatttttttagcggcgtggatcggagtatttttgtttttttttcgtttttagagcggagaattttagaatttttattttgttagcgaagatattattcggttttatttttagagatatgtt

SEQ ID NO: 8662 - DNA, 510 bp, Artificial Sequence
  chemically treated genomic DNA (Homo sapiens) CpG-island No: 8662
aacatatctctaaaaataaaaccgaataatatcttcgctaacaaaataaaaattctaaaattctccgctctaaaaacgaaaaaaaaacaaaaatactccgatccacgccgctaaaaaaatcaaacccgaaattctcccaccctccgcaaaacacccgatactcacgttcgccctcttaaccgcttacatcgccatcttaacgaactaataaaattaccgtaacaaatactaaaattcctccgaaactcgctcgacttcgaaaattacaccgcgttaaatacaaaacatcaacatccaaaacccgccgaaaactattacaacgaaataacgccgtcttacgctaaaacgcgctaacgtaacaacccccttcgaataaactccgaaataaaaccgaacctaaacgaaactcgaaaccgaaaaataaaaaaacgaaaatccaaaacacttccgaactctataccgtaaaaaacgaaacgtaacctccaaaaaacgaaatattccgatcgaaaa

SEQ ID NO: 8663 - DNA, 510 bp, Artificial Sequence
  chemically treated genomic DNA (Homo sapiens) CpG-island No: 8663
agtatatttttgaggatggggtcggatagtgttttcgttgataggataggaattttggagtttttcgttttggggacggaggaggagtaagaatgtttcgatttacgtcgttaagaaagttaaattcgaagtttttttatttttcgtagaatattcgatatttacgttcgtttttttggtcgtttgtatcgttattttggcgggttgatgaagttatcgtagtagatattgaaattttttcggagttcgttcggtttcgggggttatatcgcgttagatgtaggatattaatatttaggattcgtcggaagttgttatagcggaatagcgtcgttttacgttgagacgcgttgacgtagtagtttttttcgaatagatttcggggtaaaatcgagtttgagcgagattcgaggtcggaagatggaaaggcgagagtttaagatattttcgggttttgtatcgtaaagggcggggcgtagtttttaaaaggcgagatgtttcggtcgggga

SEQ ID NO: 8664 - DNA, 510 bp, Artificial Sequence
  chemically treated genomic DNA (Homo sapiens) CpG-island No: 8664
tccccgaccgaaacatctcgccttttaaaaactacgccccgccctttacgatacaaaacccgaaaatatcttaaactctcgcctttccatcttccgacctcgaatctcgctcaaactcgattttaccccgaaatctattcgaaaaaaactactacgtcaacgcgtctcaacgtaaaacgacgctattccgctataacaacttccgacgaatcctaaatattaatatcctacatctaacgcgatataacccccgaaaccgaacgaactccgaaaaaatttcaatatctactacgataacttcatcaacccgccaaaataacgatacaaacgaccaaaaaaacgaacgtaaatatcgaatattctacgaaaaataaaaaaacttcgaatttaactttcttaacgacgtaaatcgaaacattcttactcctcctccgtccccaaaacgaaaaactccaaaattcctatcctatcaacgaaaacactatccgaccccatcctcaaaaatatact

SEQ ID NO: 8665 - DNA, 1438 bp, Artificial Sequence
  chemically treated genomic DNA (Homo sapiens) CpG-island No: 8665
tacggtttttcgggggcggcgacggtttatatgttttcggtaggcggggttgttgggttggttgggtcggggtttcgtggagggcggcggcggcggcgagcgggttaggtcggaggttggacgcggggatcggacgcggcggtcgagttcgagcgtaatttttcgagttagtcggtaaatttcgaggcgcggcggcggcggcggcgcgaaacgtagcgcggacggttagcgcgggttagcggcgtttttatgttcggcgcggcggttgcgtttttgtcgttttttttttagtttcgcgcgttcgggcgcgggggcgcggcggcggcggcgtggcggcgggggtttcgggcgttttcggtcgttttagtttttatcgtcgtttttcgcgcgtttattggtttaggcgcggcggttatttcgggaggcgtttttgcggttttttcgcgtttgttcgggaaggtcggagggagtcggtttcgttcgttcggtacgggttagtttaggacggagtattggcgcgtcgttatcgttgtttcgttagtttttggaggtcgcgcggtcggcggttttttttacgcgtaggatgggggtcgaggggttggggaggggtcgggagttcgagaggagggggcggcgttgcgttttttcggggaggcgttgatttcggttcgttcgtttttggttcgcgcggagtcggcggcgggggattcgggaagtttttatttttcggcgtatttttcgtaatttcggttttcgtcggagattaaattgggtttaggttggttttttttgaaaatgtagaagttggtttttaaagttttttcgttttggaaacgcgcgtgtattcggggttttagggaaagtgtgggttttggtttggcgtttgcggaatagagtttggtcgttgattttgttgcgtgattttggtcgagttacggattcgtagtcgtcgtcgtttgtttcgtagagagggggagacgttcgttttcggcggggtgtaagagttaagcggatcgtaagtgttacgtacgggtagggtaagggtatgtttattcgtttgtgggtggttttttttttgtcgggtttggtagaggagggaaagtcgcgaaaaggaaggagaaaataggggaggacgaggcgtggcggagttcggggtttttggagtcgcgaggtcggagatttgagtcgggagtttggttttttgttgttttttagcgggcgcggcgtattgtgggtattttcgtcggacggatttagcgcggtagcgcggttacggttcgtattttatttttttcgttgtgttagttaagggagaaatttagtttcgttttacgtttataagcgcgagttttgtttggatttacggtttgagtaattgtagtttttatttagggagtttttgttatttattcggttatttatttagttgatgttgagt

SEQ ID NO: 8666 - DNA, 1438 bp, Artificial Sequence
  chemically treated genomic DNA (Homo sapiens) CpG-island No: 8666
actcaacatcaactaaataaataaccgaataaataacaaaaactccctaaataaaaactacaattactcaaaccgtaaatccaaacaaaactcgcgcttataaacgtaaaacgaaactaaatttctcccttaactaacacaacgaaaaaaataaaatacgaaccgtaaccgcgctaccgcgctaaatccgtccgacgaaaatacccacaatacgccgcgcccgctaaaaaacaacaaaaaaccaaactcccgactcaaatctccgacctcgcgactccaaaaaccccgaactccgccacgcctcgtcctcccctattttctccttccttttcgcgactttccctcctctaccaaacccgacaaaaaaaaaaccacccacaaacgaataaacatacccttaccctacccgtacgtaacacttacgatccgcttaactcttacaccccgccgaaaacgaacgtctccccctctctacgaaacaaacgacgacgactacgaatccgtaactcgaccaaaatcacgcaacaaaatcaacgaccaaactctattccgcaaacgccaaaccaaaacccacactttccctaaaaccccgaatacacgcgcgtttccaaaacgaaaaaactttaaaaaccaacttctacattttcaaaaaaaaccaacctaaacccaatttaatctccgacgaaaaccgaaattacgaaaaatacgccgaaaaataaaaacttcccgaatcccccgccgccgactccgcgcgaaccaaaaacgaacgaaccgaaatcaacgcctccccgaaaaaacgcaacgccgccccctcctctcgaactcccgacccctccccaacccctcgacccccatcctacgcgtaaaaaaaaccgccgaccgcgcgacctccaaaaactaacgaaacaacgataacgacgcgccaatactccgtcctaaactaacccgtaccgaacgaacgaaaccgactccctccgaccttcccgaacaaacgcgaaaaaaccgcaaaaacgcctcccgaaataaccgccgcgcctaaaccaataaacgcgcgaaaaacgacgataaaaactaaaacgaccgaaaacgcccgaaacccccgccgccacgccgccgccgccgcgcccccgcgcccgaacgcgcgaaactaaaaaaaaaacgacaaaaacgcaaccgccgcgccgaacataaaaacgccgctaacccgcgctaaccgtccgcgctacgtttcgcgccgccgccgccgccgcgcctcgaaatttaccgactaactcgaaaaattacgctcgaactcgaccgccgcgtccgatccccgcgtccaacctccgacctaacccgctcgccgccgccgccgccctccacgaaaccccgacccaaccaacccaacaaccccgcctaccgaaaacatataaaccgtcgccgcccccgaaaaaccgta

SEQ ID NO: 8667 - DNA, 1438 bp, Artificial Sequence
  chemically treated genomic DNA (Homo sapiens) CpG-island No: 8667
gtttaatattagttgaatgaatggtcgagtgagtggtagaggttttttagatggaagttgtaattgtttaggtcgtgagtttaaataggattcgcgtttataggcgtggagcggagttggattttttttttggttaatatagcgggaaggatgaggtgcgggtcgtagtcgcgttgtcgcgttgagttcgttcggcggggatgtttatagtgcgtcgcgttcgttggagggtagtagagggttaggttttcggtttaggttttcggtttcgcggttttaaggatttcgggtttcgttacgtttcgtttttttttattttttttttttttttcgcggtttttttttttttattagattcggtaggaagaaagttatttataaacgaataagtatgtttttgttttgttcgtgcgtggtatttacgattcgtttagtttttatatttcgtcgaaggcgggcgtttttttttttttgcggagtaggcggcggcggttgcgagttcgtgattcgattaaggttacgtagtaaagttagcgattaagttttgtttcgtagacgttaggttaaagtttatattttttttaaagtttcgagtgtacgcgcgtttttagaacgggagaattttggagattaatttttgtatttttaaagggggttagtttgggtttagtttaattttcggcggggatcggggttgcgggaaatgcgtcggggagtgagggtttttcggatttttcgtcgtcgatttcgcgcgggttaggggcgggcgggtcgggattagcgttttttcgggagagcgtagcgtcgtttttttttttcgggttttcggtttttttttagtttttcggtttttattttgcgcgtgggagaaatcgtcgatcgcgcggtttttaggggttggcggagtagcggtggcgacgcgttagtatttcgttttgggttggttcgtgtcgggcgggcggggtcggtttttttcgattttttcgggtaggcgcgggggggtcgtagggacgtttttcggagtggtcgtcgcgtttaggttaatgagcgcgcggggagcggcgatggaggttggggcggtcgggagcgttcgggattttcgtcgttacgtcgtcgtcgtcgcgttttcgcgttcgagcgcgcggggttggagagggggcgatagaggcgtagtcgtcgcgtcgggtatggaggcgtcgttggttcgcgttggtcgttcgcgttgcgtttcgcgtcgtcgtcgtcgtcgcgtttcgaagtttgtcggttgattcggaaagttgcgttcgggttcggtcgtcgcgttcggttttcgcgtttagttttcggtttgattcgttcgtcgtcgtcgtcgttttttacggggtttcggtttagttaatttagtagtttcgtttgtcgggggtatgtgagtcgtcgtcgttttcgagaggtcgtg

SEQ ID NO: 8668 - DNA, 1438 bp, Artificial Sequence
  chemically treated genomic DNA (Homo sapiens) CpG-island No: 8668
cacgacctctcgaaaacgacgacgactcacatacccccgacaaacgaaactactaaattaactaaaccgaaaccccgtaaaaaacgacgacgacgacgaacgaatcaaaccgaaaactaaacgcgaaaaccgaacgcgacgaccgaacccgaacgcaactttccgaatcaaccgacaaacttcgaaacgcgacgacgacgacgacgcgaaacgcaacgcgaacgaccaacgcgaaccaacgacgcctccatacccgacgcgacgactacgcctctatcgccccctctccaaccccgcgcgctcgaacgcgaaaacgcgacgacgacgacgtaacgacgaaaatcccgaacgctcccgaccgccccaacctccatcgccgctccccgcgcgctcattaacctaaacgcgacgaccactccgaaaaacgtccctacgacccccccgcgcctacccgaaaaaatcgaaaaaaaccgaccccgcccgcccgacacgaaccaacccaaaacgaaatactaacgcgtcgccaccgctactccgccaacccctaaaaaccgcgcgatcgacgatttctcccacgcgcaaaataaaaaccgaaaaactaaaaaaaaaccgaaaacccgaaaaaaaaaaacgacgctacgctctcccgaaaaaacgctaatcccgacccgcccgcccctaacccgcgcgaaatcgacgacgaaaaatccgaaaaaccctcactccccgacgcatttcccgcaaccccgatccccgccgaaaattaaactaaacccaaactaaccccctttaaaaatacaaaaattaatctccaaaattctcccgttctaaaaacgcgcgtacactcgaaactttaaaaaaaatataaactttaacctaacgtctacgaaacaaaacttaatcgctaactttactacgtaaccttaatcgaatcacgaactcgcaaccgccgccgcctactccgcaaaaaaaaaaaaacgcccgccttcgacgaaatataaaaactaaacgaatcgtaaataccacgcacgaacaaaacaaaaacatacttattcgtttataaataactttcttcctaccgaatctaataaaaaaaaaaaaaccgcgaaaaaaaaaaaaaaaataaaaaaaaacgaaacgtaacgaaacccgaaatccttaaaaccgcgaaaccgaaaacctaaaccgaaaacctaaccctctactaccctccaacgaacgcgacgcactataaacatccccgccgaacgaactcaacgcgacaacgcgactacgacccgcacctcatccttcccgctatattaaccaaaaaaaaaatccaactccgctccacgcctataaacgcgaatcctatttaaactcacgacctaaacaattacaacttccatctaaaaaacctctaccactcactcgaccattcattcaactaatattaaac

SEQ ID NO: 8669 - DNA, 583 bp, Artificial Sequence
  chemically treated genomic DNA (Homo sapiens) CpG-island No: 8669
cgagtttcgtttcggtcggtcgagtagttaatcgtttcgcggggcggggttgcggcgagttgtcgtaattaatagaggtggagggggcggggtttggttttcggcgcgcggcggtagggtcgttttcggtaaagcgagttgaattttgaggggagtcgttgattagtagtatggaggatttcgtcgcgtttgggatcgggggttcgttcgtaaatggtaatggtaacggcggcggtaaagggaagtaggcggcgtttaagggtcgcgaagcgtttcgaagttagtagcggtgagttagaggtgaggagttcggaaagtttcggttggggttcggagacgttcgtcggcgggaagcggcggttgaggtgattcggtttcggtttcggagttttcggcgcgttcgattagtttcgcgtagtgggcgtttgcggggttttagcggttgaattttgggttttttggttcggattagtgttcgttcgttttttgtcgcgggttgggggttttttagttttttggttttcgtttttgcgcgaagatgagcgcggtattgagcggattagatattttttaaatatttatt

SEQ ID NO: 8670 - DNA, 583 bp, Artificial Sequence
  chemically treated genomic DNA (Homo sapiens) CpG-island No: 8670
aataaatatttaaaaaatatctaatccgctcaataccgcgctcatcttcgcgcaaaaacgaaaaccaaaaaactaaaaaacccccaacccgcgacaaaaaacgaacgaacactaatccgaaccaaaaaacccaaaattcaaccgctaaaaccccgcaaacgcccactacgcgaaactaatcgaacgcgccgaaaactccgaaaccgaaaccgaatcacctcaaccgccgcttcccgccgacgaacgtctccgaaccccaaccgaaactttccgaactcctcacctctaactcaccgctactaacttcgaaacgcttcgcgacccttaaacgccgcctacttccctttaccgccgccgttaccattaccatttacgaacgaacccccgatcccaaacgcgacgaaatcctccatactactaatcaacgactcccctcaaaattcaactcgctttaccgaaaacgaccctaccgccgcgcgccgaaaaccaaaccccgccccctccacctctattaattacgacaactcgccgcaaccccgccccgcgaaacgattaactactcgaccgaccgaaacgaaactcg

SEQ ID NO: 8671 - DNA, 583 bp, Artificial Sequence
  chemically treated genomic DNA (Homo sapiens) CpG-island No: 8671
gataaatatttggaaagtatttggttcgtttaatatcgcgtttattttcgcgtaggggcgaaagttagagggttagaaagtttttaattcgcggtaggagacgggcggatattggttcgggttaaagagtttagagtttagtcgttaggatttcgtaggcgtttattgcgcggggttgatcgagcgcgtcgagggtttcggggtcgaggtcgaattattttagtcgtcgtttttcgtcggcgggcgttttcgggttttagtcgaagtttttcgggttttttatttttgatttatcgttgttggtttcggaacgtttcgcggtttttgggcgtcgtttgtttttttttgtcgtcgtcgttgttattgttatttgcgggcgggttttcggttttaggcgcggcggggttttttatgttgttggttagcggttttttttagggtttagttcgttttgtcggaggcgattttatcgtcgcgcgtcgggagttaggtttcgttttttttatttttattggttacggtagttcgtcgtaatttcgtttcgcgaggcgattggttgttcgatcggtcggagcgggattcg

SEQ ID NO: 8672 - DNA, 583 bp, Artificial Sequence
  chemically treated genomic DNA (Homo sapiens) CpG-island No: 8672
cgaatcccgctccgaccgatcgaacaaccaatcgcctcgcgaaacgaaattacgacgaactaccgtaaccaataaaaataaaaaaaacgaaacctaactcccgacgcgcgacgataaaatcgcctccgacaaaacgaactaaaccctaaaaaaaaccgctaaccaacaacataaaaaaccccgccgcgcctaaaaccgaaaacccgcccgcaaataacaataacaacgacgacgacaaaaaaaaacaaacgacgcccaaaaaccgcgaaacgttccgaaaccaacaacgataaatcaaaaataaaaaacccgaaaaacttcgactaaaacccgaaaacgcccgccgacgaaaaacgacgactaaaataattcgacctcgaccccgaaaccctcgacgcgctcgatcaaccccgcgcaataaacgcctacgaaatcctaacgactaaactctaaactctttaacccgaaccaatatccgcccgtctcctaccgcgaattaaaaactttctaaccctctaactttcgcccctacgcgaaaataaacgcgatattaaacgaaccaaatactttccaaatatttatc

SEQ ID NO: 8673 - DNA, 965 bp, Artificial Sequence
  chemically treated genomic DNA (Homo sapiens) CpG-island No: 8673
tttttttttcgttcgtgtttttttttttattggtcgtttttttgtcgatttgtgttcgttatttttttttttttcgtttttttcgtttttttttttttttttcgttttttgttttatttattttcgtttgtttcgttcgcgtttttttcgtattttttgttttttttttttttattagttgcggtttgtttttttttttgcgtttcgttttcgttttcgcgtatgttcgtttttattttttttttggtgtcgtttttttgttttgtgcgcgtcgtttttcgtttcgtttttgttatcgttgatgcgtattttatttcgttcgcgtggattgtttgtttttggcgtttatttatttcgttttttatttgttcgatttatttatacggtttgttttttattttatgcgtagttgttagtttcgttagtttcgtgcgtgtcgtagtgttcgcgtacgttgtttgtattttttgattgttttttgcgtttttttgttttcgcggtttgtttcgttttttgtacgacgtagtattttatttgtagtatgtacgtatatcggttttcgatatcgttattcgttttttttgtttatttttgaagtcgcgttcgcgtcgttttttgtgtttatgttttgatcgtttttatgtgcgtattgtatttcgatttcggatttttcgtttattcgtcgtattttgtttttatagcgcgtttgtttattttcgcgtatcgtcgtttttttgtgcgtgtttgttgtttttatacgtttcgcgtacgtcgttttagcgtgttcgatttgttcgttgttttacgtgtgcgtgattttttttgcgtttttttttttcgtacgttttcgatattcgttagttttttttttatcgtcgtcgttttgcgtcgacgttttttttttcgtgtttcgtatattgttcgatgcgtttcgtgtttgttatatatgtttttttttttgtttt

SEQ ID NO: 8674 - DNA, 965 bp, Artificial Sequence
  chemically treated genomic DNA (Homo sapiens) CpG-island No: 8674
aaaacaaaaaaaaaaacatatataacaaacacgaaacgcatcgaacaatatacgaaacacgaaaaaaaaaacgtcgacgcaaaacgacgacgataaaaaaaaaactaacgaatatcgaaaacgtacgaaaaaaaaaaacgcaaaaaaaatcacgcacacgtaaaacaacgaacaaatcgaacacgctaaaacgacgtacgcgaaacgtataaaaacaacaaacacgcacaaaaaaacgacgatacgcgaaaataaacaaacgcgctataaaaacaaaatacgacgaataaacgaaaaatccgaaatcgaaatacaatacgcacataaaaacgatcaaaacataaacacaaaaaacgacgcgaacgcgacttcaaaaataaacaaaaaaaacgaataacgatatcgaaaaccgatatacgtacatactacaaataaaatactacgtcgtacaaaaaacgaaacaaaccgcgaaaacaaaaaaacgcaaaaaacaatcaaaaaatacaaacaacgtacgcgaacactacgacacgcacgaaactaacgaaactaacaactacgcataaaataaaaaacaaaccgtataaataaatcgaacaaataaaaaacgaaataaataaacgccaaaaacaaacaatccacgcgaacgaaataaaatacgcatcaacgataacaaaaacgaaacgaaaaacgacgcgcacaaaacaaaaaaacgacaccaaaaaaaaaataaaaacgaacatacgcgaaaacgaaaacgaaacgcaaaaaaaaaaacaaaccgcaactaataaaaaaaaaaaaaacaaaaaatacgaaaaaaacgcgaacgaaacaaacgaaaataaataaaacaaaaaacgaaaaaaaaaaaaaaaaacgaaaaaaacgaaaaaaaaaaaaataacgaacacaaatcgacaaaaaaacgaccaataaaaaaaaaaacacgaacgaaaaaaaaa

SEQ ID NO: 8675 - DNA, 965 bp, Artificial Sequence
  chemically treated genomic DNA (Homo sapiens) CpG-island No: 8675
aagataaaagagagagtatgtgtgatagatacgaggcgtatcgagtagtgtacggaatacggagagagagacgtcgacgtagagcgacgacggtgaggagagagttgacgagtgtcgagagcgtgcgagagagaggagcgtagagagagttacgtatacgtgagatagcgagtagatcgagtacgttgaggcgacgtacgcgagacgtatgagagtagtagatacgtatagagagacgacgatgcgcgagagtaagtagacgcgttatgaggatagagtacgacgagtagacgagagattcgagatcgaagtgtaatgcgtatatgagagcgattagagtataagtatagagaacgacgcggacgcgattttaggagtaagtagagagagcgagtgacggtatcgggagtcgatgtacgtatatgttataagtgagatattgcgtcgtataggagacgagatagatcgcgaggataagaggacgtagaggatagttagagaatgtagatagcgtgcgcgagtattgcggtacgtacgaagttaacgagattgatagttacgtatgagataggaagtaagtcgtatgagtagatcggatagatgagagacgaggtggatgagcgttagagataagtagtttacgcggacgaaatgagatgcgtattagcgatggtagagacggagcgaagagcgacgcgtataaagtaaaaaagcgatattagaggagaggtgaaggcgagtatgcgcgagagcgaggacggaacgtaaagagagggataggtcgtagttgataggagagaaagagatagagagtgcggaaggagcgcgaacgaggtagacggaggtggatgaaataggagacgagggaaagagaaggagacgaagagggcggaggagagagggatggcggatataagtcgataggaggacgattaataggaaaggagatacgagcgaggggaaag

SEQ ID NO: 8676 - DNA, 965 bp, Artificial Sequence
  chemically treated genomic DNA (Homo sapiens) CpG-island No: 8676
ctttcccctcgctcgtatctcctttcctattaatcgtcctcctatcgacttatatccgccatccctctctcctccgccctcttcgtctccttctctttccctcgtctcctatttcatccacctccgtctacctcgttcgcgctccttccgcactctctatctctttctctcctatcaactacgacctatccctctctttacgttccgtcctcgctctcgcgcatactcgccttcacctctcctctaatatcgcttttttactttatacgcgtcgctcttcgctccgtctctaccatcgctaatacgcatctcatttcgtccgcgtaaactacttatctctaacgctcatccacctcgtctctcatctatccgatctactcatacgacttacttcctatctcatacgtaactatcaatctcgttaacttcgtacgtaccgcaatactcgcgcacgctatctacattctctaactatcctctacgtcctcttatcctcgcgatctatctcgtctcctatacgacgcaatatctcacttataacatatacgtacatcgactcccgataccgtcactcgctctctctacttactcctaaaatcgcgtccgcgtcgttctctatacttatactctaatcgctctcatatacgcattacacttcgatctcgaatctctcgtctactcgtcgtactctatcctcataacgcgtctacttactctcgcgcatcgtcgtctctctatacgtatctactactctcatacgtctcgcgtacgtcgcctcaacgtactcgatctactcgctatctcacgtatacgtaactctctctacgctcctctctctcgcacgctctcgacactcgtcaactctctcctcaccgtcgtcgctctacgtcgacgtctctctctccgtattccgtacactactcgatacgcctcgtatctatcacacatactctctcttttatctt

SEQ ID NO: 8677 - DNA, 516 bp, Artificial Sequence
  chemically treated genomic DNA (Homo sapiens) CpG-island No: 8677
tataggcgtcgatttttatttgtcgtttgtacgtagagattgatagttttttcgttgcggtcgtaattatcggtagtttacggtgttagggttagttttcgcggcgtttatttggtcgttttgtattttgggaggtatgggcgtttggcggtttttgcgttttgagtcgaacgatagttgttttagagtggtgaaattcggttatttatgggtattacgttaaattagtcgggtatgggcggtttatgttgatatgtcgaggttttttttggttgtcgttcgtatcgggtttttcgcgtttttggtttggggcgggtttttattatattggttaggtcgcgttgttgtgttcgttgggttcggtgttttggggtttcgttggtttcgtttagtgttttttgggattacggatgtggcggcgttcgtcgttttgtgtgtgttagtaggatgagtttagttttgtatcgttagagttgtgtttgtgggattgttatagtcgttaatggattaggtgtg

SEQ ID NO: 8678 - DNA, 516 bp, Artificial Sequence
  chemically treated genomic DNA (Homo sapiens) CpG-island No: 8678
cacacctaatccattaacgactataacaatcccacaaacacaactctaacgatacaaaactaaactcatcctactaacacacacaaaacgacgaacgccgccacatccgtaatcccaaaaaacactaaacgaaaccaacgaaaccccaaaacaccgaacccaacgaacacaacaacgcgacctaaccaatataataaaaacccgccccaaaccaaaaacgcgaaaaacccgatacgaacgacaaccaaaaaaaacctcgacatatcaacataaaccgcccatacccgactaatttaacgtaatacccataaataaccgaatttcaccactctaaaacaactatcgttcgactcaaaacgcaaaaaccgccaaacgcccatacctcccaaaatacaaaacgaccaaataaacgccgcgaaaactaaccctaacaccgtaaactaccgataattacgaccgcaacgaaaaaactatcaatctctacgtacaaacgacaaataaaaatcgacgcctata

SEQ ID NO: 8679 - DNA, 516 bp, Artificial Sequence
  chemically treated genomic DNA (Homo sapiens) CpG-island No: 8679
tatatttagtttattggcgattatgatagttttataggtataattttagcggtgtagagttgggtttattttattaatatatatagaacggcgaacgtcgttatattcgtggttttaagaagtattgaacggggttagcgaggttttagaatatcgaatttaacggatataatagcgcgatttagttaatgtggtgagaattcgttttagattaagggcgcgaagaattcgatacgaacgataattagaaaggatttcggtatattagtatggatcgtttatgttcggttaatttgacgtagtgtttataagtgatcgggttttattattttgagatagttgtcgttcgatttaagacgtaaggatcgttaagcgtttatgttttttaaagtgtaaggcggttaggtgagcgtcgcgaagattagttttaatatcgtgggttatcggtgattacgatcgtagcgagaggattgttagtttttacgtgtaagcggtaggtgagagtcgacgtttgtg

SEQ ID NO: 8680 - DNA, 516 bp, Artificial Sequence
  chemically treated genomic DNA (Homo sapiens) CpG-island No: 8680
cacaaacgtcgactctcacctaccgcttacacgtaaaaactaacaatcctctcgctacgatcgtaatcaccgataacccacgatattaaaactaatcttcgcgacgctcacctaaccgccttacactttaaaaaacataaacgcttaacgatccttacgtcttaaatcgaacgacaactatctcaaaataataaaacccgatcacttataaacactacgtcaaattaaccgaacataaacgatccatactaatataccgaaatcctttctaattatcgttcgtatcgaattcttcgcgcccttaatctaaaacgaattctcaccacattaactaaatcgcgctattatatccgttaaattcgatattctaaaacctcgctaaccccgttcaatacttcttaaaaccacgaatataacgacgttcgccgttctatatatattaataaaataaacccaactctacaccgctaaaattatacctataaaactatcataatcgccaataaactaaatata

SEQ ID NO: 8681 - DNA, 578 bp, Artificial Sequence
  chemically treated genomic DNA (Homo sapiens) CpG-island No: 8681
ttcggcggttcgggtgtaagtgggcgagggtcggatttacgcgtgtcgtcgaagcgcgtagcgatggtgtttaggaaggtgttttgcggcgttaggaggtttcgtatggtcggtattttaggcgttcgcggttgttcgttttattttttcggggtgcggggatttcgcgtcgggggagggcgtttagttcggtcgtttttcgtcgggtttcgcgttttttagcgtagtcgtcggggggtaatgcgtagatcgggattcggggtcgcgtcggacgttggcgcgcgagggggcgttcgcgtcgtcggggttcggagtatggcgcgcggtttttcgcgttttcgtcgtttataaatttcgggttttaggtttcgcggtcgtcgcgtttttagtatttttcgtcgcggtagcggttcgcgtgtcggttgcgggtgggttttcgttcggtttcgttcggcgtcggttttcggtagtttttttcgtttgtcggggagaagttgtagtttttttttttttttttcgcgttcgtcgtttgtatcggggtaattatggagacggggtatatttagttagggtcgttt

SEQ ID NO: 8682 - DNA, 578 bp, Artificial Sequence
  chemically treated genomic DNA (Homo sapiens) CpG-island No: 8682
aaacgaccctaactaaatataccccgtctccataattaccccgatacaaacgacgaacgcgaaaaaaaaaaaaaaaaactacaacttctccccgacaaacgaaaaaaactaccgaaaaccgacgccgaacgaaaccgaacgaaaacccacccgcaaccgacacgcgaaccgctaccgcgacgaaaaatactaaaaacgcgacgaccgcgaaacctaaaacccgaaatttataaacgacgaaaacgcgaaaaaccgcgcgccatactccgaaccccgacgacgcgaacgccccctcgcgcgccaacgtccgacgcgaccccgaatcccgatctacgcattaccccccgacgactacgctaaaaaacgcgaaacccgacgaaaaacgaccgaactaaacgccctcccccgacgcgaaatccccgcaccccgaaaaaataaaacgaacaaccgcgaacgcctaaaataccgaccatacgaaacctcctaacgccgcaaaacaccttcctaaacaccatcgctacgcgcttcgacgacacgcgtaaatccgaccctcgcccacttacacccgaaccgccgaa

SEQ ID NO: 8683 - DNA, 578 bp, Artificial Sequence
  chemically treated genomic DNA (Homo sapiens) CpG-island No: 8683
aggcggttttggttgggtgtgtttcgtttttatggttatttcggtgtaggcggcgggcgcgggagggagggagggaggttgtagttttttttcgatagacggagggagttgtcgagagtcggcgtcgagcgaagtcgagcggaagtttattcgtagtcgatacgcgagtcgttgtcgcggcgggaggtgttgagagcgcggcggtcgcggggtttggagttcgggatttgtgggcggcgagggcgcgaggggtcgcgcgttatgtttcgggtttcgacggcgcggacgttttttcgcgcgttagcgttcggcgcgatttcggatttcggtttgcgtattgtttttcgacggttgcgttagggagcgcggggttcggcggggggcggtcgagttgggcgttttttttcggcgcggagttttcgtatttcggagggatggggcgggtagtcgcgggcgtttaagatgtcggttatgcggggttttttggcgtcgtagaatatttttttggatattatcgttacgcgtttcgacggtacgcgtgagttcgattttcgtttatttgtattcgggtcgtcgga

SEQ ID NO: 8684 - DNA, 578 bp, Artificial Sequence
  chemically treated genomic DNA (Homo sapiens) CpG-island No: 8684
tccgacgacccgaatacaaataaacgaaaatcgaactcacgcgtaccgtcgaaacgcgtaacgataatatccaaaaaaatattctacgacgccaaaaaaccccgcataaccgacatcttaaacgcccgcgactacccgccccatccctccgaaatacgaaaactccgcgccgaaaaaaaacgcccaactcgaccgccccccgccgaaccccgcgctccctaacgcaaccgtcgaaaaacaatacgcaaaccgaaatccgaaatcgcgccgaacgctaacgcgcgaaaaaacgtccgcgccgtcgaaacccgaaacataacgcgcgacccctcgcgccctcgccgcccacaaatcccgaactccaaaccccgcgaccgccgcgctctcaacacctcccgccgcgacaacgactcgcgtatcgactacgaataaacttccgctcgacttcgctcgacgccgactctcgacaactccctccgtctatcgaaaaaaaactacaacctccctccctccctcccgcgcccgccgcctacaccgaaataaccataaaaacgaaacacacccaaccaaaaccgcct

SEQ ID NO: 8685 - DNA, 581 bp, Artificial Sequence
  chemically treated genomic DNA (Homo sapiens) CpG-island No: 8685
atcggcggttcgggagtttgagggcgtgggacggttattcgcgagtcgacgttgcgcgatgcgtaggagatttggttggagaatagcggcgtttggtggtttcgttaggtcggttataatggcgttcgcggtagttcgtttttatttatcggggagcggggttatcgcgtcgggggtgggcgttttgtacggtcgtttttcgtcgggtttcgcgtatttatgcgttgtcgacggggggtttagcgttgttcgggtatcggggacgcgtcggtacgaggcgcgcgtggggcgatcgcgtcgacggggttcggtgttaggcgcgcggtttatacgcgtttacgtcgttttttttattcgggtatttggtttcgcggtcgtcgcgtatattgttttattcgtcgcggttgcggtacgcgagacggtagcgggagggtaatcgtacgcgaacgtacggcgtcggtatacggttgtatttatcgatagacggggtgttgtagttgttatttatttatttattcgcgttcgtcgttagtttcggggatttttaggtgtcgggttttttttgtttgggtcgttattaa

SEQ ID NO: 8686 - DNA, 581 bp, Artificial Sequence
  chemically treated genomic DNA (Homo sapiens) CpG-island No: 8686
ttaataacgacccaaacaaaaaaaacccgacacctaaaaatccccgaaactaacgacgaacgcgaataaataaataaataacaactacaacaccccgtctatcgataaatacaaccgtataccgacgccgtacgttcgcgtacgattaccctcccgctaccgtctcgcgtaccgcaaccgcgacgaataaaacaatatacgcgacgaccgcgaaaccaaatacccgaataaaaaaaacgacgtaaacgcgtataaaccgcgcgcctaacaccgaaccccgtcgacgcgatcgccccacgcgcgcctcgtaccgacgcgtccccgatacccgaacaacgctaaaccccccgtcgacaacgcataaatacgcgaaacccgacgaaaaacgaccgtacaaaacgcccacccccgacgcgataaccccgctccccgataaataaaaacgaactaccgcgaacgccattataaccgacctaacgaaaccaccaaacgccgctattctccaaccaaatctcctacgcatcgcgcaacgtcgactcgcgaataaccgtcccacgccctcaaactcccgaaccgccgat

SEQ ID NO: 8687 - DNA, 581 bp, Artificial Sequence
  chemically treated genomic DNA (Homo sapiens) CpG-island No: 8687
ttggtggcggtttaggtagggagagttcgatatttaggaattttcggagttggcggcgggcgcgggtgggtgggtgggtggtagttgtaatatttcgtttgtcggtgggtgtagtcgtgtgtcggcgtcgtgcgttcgcgtgcggttgttttttcgttgtcgtttcgcgtgtcgtagtcgcggcgggtggagtagtgtgcgcggcggtcgcggggttaggtgttcgggtaaagagggcggcgtgggcgcgtgtgggtcgcgcgtttagtatcgggtttcgtcggcgcggtcgttttacgcgcgtttcgtatcggcgcgttttcggtattcggatagcgttaagtttttcgtcggtagcgtatgggtgcgcggggttcggcggggggcggtcgtgtagggcgtttattttcggcgcggtgatttcgtttttcggtgggtaggggcgggttgtcgcgggcgttattgtagtcggtttagcggggttattaggcgtcgttgttttttaattaggttttttacgtatcgcgtaacgtcggttcgcgagtgatcgttttacgtttttaagttttcgggtcgtcggt

SEQ ID NO: 8688 - DNA, 581 bp, Artificial Sequence
  chemically treated genomic DNA (Homo sapiens) CpG-island No: 8688
accgacgacccgaaaacttaaaaacgtaaaacgatcactcgcgaaccgacgttacgcgatacgtaaaaaacctaattaaaaaacaacgacgcctaataaccccgctaaaccgactacaataacgcccgcgacaacccgcccctacccaccgaaaaacgaaatcaccgcgccgaaaataaacgccctacacgaccgccccccgccgaaccccgcgcacccatacgctaccgacgaaaaacttaacgctatccgaataccgaaaacgcgccgatacgaaacgcgcgtaaaacgaccgcgccgacgaaacccgatactaaacgcgcgacccacacgcgcccacgccgccctctttacccgaacacctaaccccgcgaccgccgcgcacactactccacccgccgcgactacgacacgcgaaacgacaacgaaaaaacaaccgcacgcgaacgcacgacgccgacacacgactacacccaccgacaaacgaaatattacaactaccacccacccacccacccgcgcccgccgccaactccgaaaattcctaaatatcgaactctccctacctaaaccgccaccaa

SEQ ID NO: 8689 - DNA, 538 bp, Artificial Sequence
  chemically treated genomic DNA (Homo sapiens) CpG-island No: 8689
tcgttttatagaggttcgtgaatgggggtggggttttgcgaggggcggggttacgttattttttgtgcgggacgcgttgtagttggagaggaaaggtagagcgaggaggggcgaggttaagaaagcgcgcgtttttgggaggggaggagtttggttaaggagcgtcgcgttatattcggtagagttagagttcgtgcggaggcggtgcggagtatttcggttttgagcggttgggcgatcggcgcgtcgtgcggggttgcggcggagtttttttaaggaaggtgtaagaggttggtagtttcgattgaagtatatcgatcggcgatagtagttaggagttatgagcgatagcggcgagtagaattacggcgagcgggtacgtagagttgcggtagggggtggttgtgtggttttagttttttgtatttttttttaggttcgtcggtttcgggttaggaggtaggggcgttttaggtttcgaagtttgaagtcgggagggtaggtaagggagatagtatttaattaaaaaaagtttttg

SEQ ID NO: 8690 - DNA, 538 bp, Artificial Sequence
  chemically treated genomic DNA (Homo sapiens) CpG-island No: 8690
caaaaactttttttaattaaatactatctcccttacctaccctcccgacttcaaacttcgaaacctaaaacgcccctacctcctaacccgaaaccgacgaacctaaaaaaaaatacaaaaaactaaaaccacacaaccaccccctaccgcaactctacgtacccgctcgccgtaattctactcgccgctatcgctcataactcctaactactatcgccgatcgatatacttcaatcgaaactaccaacctcttacaccttccttaaaaaaactccgccgcaaccccgcacgacgcgccgatcgcccaaccgctcaaaaccgaaatactccgcaccgcctccgcacgaactctaactctaccgaatataacgcgacgctccttaaccaaactcctcccctcccaaaaacgcgcgctttcttaacctcgcccctcctcgctctacctttcctctccaactacaacgcgtcccgcacaaaaaataacgtaaccccgcccctcgcaaaaccccacccccattcacgaacctctataaaacga

SEQ ID NO: 8691 - DNA, 538 bp, Artificial Sequence
  chemically treated genomic DNA (Homo sapiens) CpG-island No: 8691
taaaggttttttttggttaaatgttgttttttttgtttgttttttcggttttagatttcggagtttaaaacgtttttgttttttggttcgaggtcgacgggtttagaaaaagatgtaaggagttaggattatatagttattttttatcgtagttttacgtattcgttcgtcgtagttttgttcgtcgttgtcgtttatgatttttggttgttgtcgtcggtcgatgtgttttaatcgaagttgttaattttttgtattttttttaaggaggtttcgtcgtagtttcgtacgacgcgtcggtcgtttagtcgtttagagtcgaaatgtttcgtatcgttttcgtacgggttttaattttatcggatgtgacgcggcgttttttagttaggtttttttttttttagaaacgcgcgtttttttggtttcgttttttttcgttttgttttttttttttagttgtagcgcgtttcgtataggaagtgacgtgatttcgtttttcgtagggttttatttttatttacgagtttttatgaggcgg

SEQ ID NO: 8692 - DNA, 538 bp, Artificial Sequence
  chemically treated genomic DNA (Homo sapiens) CpG-island No: 8692
ccgcctcataaaaactcgtaaataaaaataaaaccctacgaaaaacgaaatcacgtcacttcctatacgaaacgcgctacaactaaaaaaaaaaaacaaaacgaaaaaaaacgaaaccaaaaaaacgcgcgtttctaaaaaaaaaaaaacctaactaaaaaacgccgcgtcacatccgataaaattaaaacccgtacgaaaacgatacgaaacatttcgactctaaacgactaaacgaccgacgcgtcgtacgaaactacgacgaaacctccttaaaaaaaatacaaaaaattaacaacttcgattaaaacacatcgaccgacgacaacaaccaaaaatcataaacgacaacgacgaacaaaactacgacgaacgaatacgtaaaactacgataaaaaataactatataatcctaactccttacatctttttctaaacccgtcgacctcgaaccaaaaaacaaaaacgttttaaactccgaaatctaaaaccgaaaaaacaaacaaaaaaaacaacatttaaccaaaaaaaaccttta

SEQ ID NO: 8693 - DNA, 1404 bp, Artificial Sequence
  chemically treated genomic DNA (Homo sapiens) CpG-island No: 8693
cggtcgcgtagtcgggcggcgattattcgtttttcggtcgttgattttagcgtttcggtttcgtcgtagtttttggtttttcggcgttcgtttttttattcgttatttggttttcgtcgtcgtcgttcgggaagttttcggtattttttagaatagagagtagttgttaacgttaggttgtcgtttgtcgcggggtttcggatacgcggggtttgggcggagaggacgtgatttcgcgttggtttttcgtttttttttttcggtcgggaaattgaggttcgggatcgggaattattttttcgcgagtacggttcgcgagggttcggttaatttcggttttaggcgtttcgattttcgcgcgcgatttttcgattatacgcgtcgttcggttattttagagagcgtggcggggagcgggttttagagcgagcgtacggttcgggaacgcgtagggcgttagtattggttaagtcgttgcgaaagttgttgttttttagtttgttttcgttttttattttcgggatatattttttcgtttgttttggtagtagcgtatttatattcggtttattttgcgtatattttttttcgcgtttattcgtagttttttttttttttacgttcgcggtttttcgtcgttttttcgcgcgtttttattcgcgttcggggcgcgtttttttcgtttcgtcgttcgttcggtttcggcgtcgcgttcgttcggggtttcggcgttcggagttttagttcggggtcgcgattcgttttcgttcgtttggcgcggggtcggagttcgagtagttattgtcgagcgcggtgggcgcgaggcgaggggcgtagcggcgcggggcggggagggggcgttcgttcgttttttttcggttgcgtatacgttcgtataaatttttatatagatatacgcggggtgcgttgtcgtcgttcgtcgttgttttttttttcgttatcgttttgagagggagagagagggaggtagagagagcgttttgttcgcgcgtcgtcgttcggttcgggattttgtttcgaggaggtagtcgcgtcgagttttcgttttcgtttttgttttcgggcgggtcgggtcggtcgcggtggggggagttaggttgagggtgggggtgggtggcgggcgggcggagggcggggagggggggcggaggaggaggagagacgagggtagcggaggaggcgaggagcgtcgggtatcgggtcgggggagtcgcgggttttcggggaagagacggatgatgaataagttttatatcgggaatttgagtttcgtcgttatcgtcgacgattttcggtagttttttggggataggaagttgtttttggcgggataggttttgttgaagttcggttacgttttcgtggattatttcgattagaatt

SEQ ID NO: 8694 - DNA, 1404 bp, Artificial Sequence
  chemically treated genomic DNA (Homo sapiens) CpG-island No: 8694
aattctaatcgaaataatccacgaaaacgtaaccgaacttcaacaaaacctatcccgccaaaaacaacttcctatccccaaaaaactaccgaaaatcgtcgacgataacgacgaaactcaaattcccgatataaaacttattcatcatccgtctcttccccgaaaacccgcgactcccccgacccgatacccgacgctcctcgcctcctccgctaccctcgtctctcctcctcctccgccccccctccccgccctccgcccgcccgccacccacccccaccctcaacctaactccccccaccgcgaccgacccgacccgcccgaaaacaaaaacgaaaacgaaaactcgacgcgactacctcctcgaaacaaaatcccgaaccgaacgacgacgcgcgaacaaaacgctctctctacctccctctctctccctctcaaaacgataacgaaaaaaaaaacaacgacgaacgacgacaacgcaccccgcgtatatctatataaaaatttatacgaacgtatacgcaaccgaaaaaaaacgaacgaacgccccctccccgccccgcgccgctacgcccctcgcctcgcgcccaccgcgctcgacaataactactcgaactccgaccccgcgccaaacgaacgaaaacgaatcgcgaccccgaactaaaactccgaacgccgaaaccccgaacgaacgcgacgccgaaaccgaacgaacgacgaaacgaaaaaaacgcgccccgaacgcgaataaaaacgcgcgaaaaaacgacgaaaaaccgcgaacgtaaaaaaaaaaaaaactacgaataaacgcgaaaaaaaatatacgcaaaataaaccgaatataaatacgctactaccaaaacaaacgaaaaaatatatcccgaaaataaaaaacgaaaacaaactaaaaaacaacaactttcgcaacgacttaaccaatactaacgccctacgcgttcccgaaccgtacgctcgctctaaaacccgctccccgccacgctctctaaaataaccgaacgacgcgtataatcgaaaaatcgcgcgcgaaaatcgaaacgcctaaaaccgaaattaaccgaaccctcgcgaaccgtactcgcgaaaaaataattcccgatcccgaacctcaatttcccgaccgaaaaaaaaaaacgaaaaaccaacgcgaaatcacgtcctctccgcccaaaccccgcgtatccgaaaccccgcgacaaacgacaacctaacgttaacaactactctctattctaaaaaataccgaaaacttcccgaacgacgacgacgaaaaccaaataacgaataaaaaaacgaacgccgaaaaaccaaaaactacgacgaaaccgaaacgctaaaatcaacgaccgaaaaacgaataatcgccgcccgactacgcgaccg

SEQ ID NO: 8695 - DNA, 1404 bp, Artificial Sequence
  chemically treated genomic DNA (Homo sapiens) CpG-island No: 8695
agttttggtcggggtagtttacgaaggcgtagtcggattttagtaggatttgtttcgttaggggtagttttttgtttttaaagagttgtcggaggtcgtcggcggtgacggcggggtttaggttttcgatgtaaagtttgtttattattcgtttttttttcgagagttcgcggttttttcggttcggtattcggcgtttttcgtttttttcgttgttttcgtttttttttttttttcgtttttttttttcgtttttcgttcgttcgttatttatttttatttttagtttggttttttttatcgcggtcggttcggttcgttcgggggtagaggcggaggcggggattcggcgcggttgttttttcggggtagagtttcgggtcgggcggcggcgcgcggataaagcgttttttttgttttttttttttttttttttaaggcggtggcgggaggaggagtagcggcgggcggcggtagcgtatttcgcgtgtgtttgtgtgagagtttgtacgggcgtgtgcgtagtcgagagggagcgagcgagcgtttttttttcgtttcgcgtcgttgcgtttttcgtttcgcgtttatcgcgttcggtagtggttgttcgggtttcggtttcgcgttaggcgggcggaagcgggtcgcggtttcgggttggggtttcgggcgtcggaatttcgggcgggcgcggcgtcgaggtcgggcgagcggcggggcggggaaggcgcgtttcgggcgcgggtgggagcgcgcgagggggcgacggggagtcgcgggcgtgggagggagaggggttgcgagtgagcgcggagaggggtgtgcgtaaggtggatcggatgtgagtgcgttgttgttagagtaagcgggaaggtgtgtttcggaggtgagaggcgagggtaggttgggagataataattttcgtagcgatttggttagtgttggcgttttgcgcgttttcgggtcgtgcgttcgttttgagattcgtttttcgttacgttttttgaggtgatcgagcggcgcgtgtggtcgaaggatcgcgcgcgggagtcgggacgtttaggatcggggttggtcgggttttcgcggatcgtgttcgcggggaagtggttttcggtttcgggttttagtttttcgatcggggagggaaggcggaaggttagcgcggagttacgtttttttcgtttagatttcgcgtgttcggaatttcgcggtaggcggtagtttgacgttggtagttgttttttattttgggaagtgtcgagggtttttcgggcggcggcggcgaaagttaggtggcgggtggggaaacgaacgtcgaggggttagggattgcggcgaggtcggagcgttggggttagcggtcgggggacggatggtcgtcgttcggttgcgcggtcg

SEQ ID NO: 8696 - DNA, 1404 bp, Artificial Sequence
  chemically treated genomic DNA (Homo sapiens) CpG-island No: 8696
cgaccgcgcaaccgaacgacgaccatccgtcccccgaccgctaaccccaacgctccgacctcgccgcaatccctaacccctcgacgttcgtttccccacccgccacctaactttcgccgccgccgcccgaaaaaccctcgacacttcccaaaataaaaaacaactaccaacgtcaaactaccgcctaccgcgaaattccgaacacgcgaaatctaaacgaaaaaaacgtaactccgcgctaaccttccgccttccctccccgatcgaaaaactaaaacccgaaaccgaaaaccacttccccgcgaacacgatccgcgaaaacccgaccaaccccgatcctaaacgtcccgactcccgcgcgcgatccttcgaccacacgcgccgctcgatcacctcaaaaaacgtaacgaaaaacgaatctcaaaacgaacgcacgacccgaaaacgcgcaaaacgccaacactaaccaaatcgctacgaaaattattatctcccaacctaccctcgcctctcacctccgaaacacaccttcccgcttactctaacaacaacgcactcacatccgatccaccttacgcacacccctctccgcgctcactcgcaacccctctccctcccacgcccgcgactccccgtcgccccctcgcgcgctcccacccgcgcccgaaacgcgccttccccgccccgccgctcgcccgacctcgacgccgcgcccgcccgaaattccgacgcccgaaaccccaacccgaaaccgcgacccgcttccgcccgcctaacgcgaaaccgaaacccgaacaaccactaccgaacgcgataaacgcgaaacgaaaaacgcaacgacgcgaaacgaaaaaaaaacgctcgctcgctccctctcgactacgcacacgcccgtacaaactctcacacaaacacacgcgaaatacgctaccgccgcccgccgctactcctcctcccgccaccgccttaaaaaaaaaaaaaaaaaaaacaaaaaaaacgctttatccgcgcgccgccgcccgacccgaaactctaccccgaaaaaacaaccgcgccgaatccccgcctccgcctctacccccgaacgaaccgaaccgaccgcgataaaaaaaaccaaactaaaaataaaaataaataacgaacgaacgaaaaacgaaaaaaaaaaacgaaaaaaaaaaaaaaacgaaaacaacgaaaaaaacgaaaaacgccgaataccgaaccgaaaaaaccgcgaactctcgaaaaaaaaacgaataataaacaaactttacatcgaaaacctaaaccccgccgtcaccgccgacgacctccgacaactctttaaaaacaaaaaactacccctaacgaaacaaatcctactaaaatccgactacgccttcgtaaactaccccgaccaaaact

SEQ ID NO: 8697 - DNA, 584 bp, Artificial Sequence
  chemically treated genomic DNA (Homo sapiens) CpG-island No: 8697
ttcgtcgttcgttttttcgtttttcgttcggttagaagtatttttttacgaggtgttttgttttaattcggtgggggttagggttgagaatcgggaaagaggcgatcggggggttcgcgagcgcgttggagtttagataggagacggagagcgatatatatatatattcgcgcgcgcgtattttttaattttttttagtatacgtttcgtttttagtcgcgcgggttttcgggtttcggtcggcgtttttcgaatttcggttcggcgggagttttttttttatcggcgtgtggagtgggggcggggcggcggcgaggttaaggtgatatttaggagcgggtagggatagggttgtcgttgcggcggatttcggggggtttcggttcgttttttcggggttatcgggaggagagggtagggaggggagttcggtggagtttcgggtttcggattagcggaatggagaggtgggggtcgggagagtagcggggtcgcgttagttttgtagtttgagttttaaatgagtttatttttttaaattggcgtcgttttttattaaatttgttttttcggtaatgttattt

SEQ ID NO: 8698 - DNA, 584 bp, Artificial Sequence
  chemically treated genomic DNA (Homo sapiens) CpG-island No: 8698
aaataacattaccgaaaaaacaaatttaataaaaaacgacgccaatttaaaaaaataaactcatttaaaactcaaactacaaaactaacgcgaccccgctactctcccgacccccacctctccattccgctaatccgaaacccgaaactccaccgaactcccctccctaccctctcctcccgataaccccgaaaaaacgaaccgaaaccccccgaaatccgccgcaacgacaaccctatccctacccgctcctaaatatcaccttaacctcgccgccgccccgcccccactccacacgccgataaaaaaaaaactcccgccgaaccgaaattcgaaaaacgccgaccgaaacccgaaaacccgcgcgactaaaaacgaaacgtatactaaaaaaaattaaaaaatacgcgcgcgcgaatatatatatatatcgctctccgtctcctatctaaactccaacgcgctcgcgaaccccccgatcgcctctttcccgattctcaaccctaacccccaccgaattaaaacaaaacacctcgtaaaaaaatacttctaaccgaacgaaaaacgaaaaaacgaacgacgaa

SEQ ID NO: 8699 - DNA, 584 bp, Artificial Sequence
  chemically treated genomic DNA (Homo sapiens) CpG-island No: 8699
gggtggtattatcggaaaaataaatttaataaagagcggcgttaatttgaaaggatgagtttatttgaaatttaagttgtagggttggcgcggtttcgttgttttttcggtttttatttttttatttcgttaattcggggttcgaagttttatcgggtttttttttttgtttttttttttcggtggtttcgagaaaacgagtcgaagtttttcggagttcgtcgtagcgatagttttgtttttgttcgtttttgggtgttattttggtttcgtcgtcgtttcgtttttattttatacgtcggtggggaaggggttttcgtcgggtcggggttcggggggcgtcggtcggggttcgggggttcgcgcggttgggagcggagcgtgtgttggggagagttggggagtgcgcgcgcgcgagtgtgtgtgtgtgtcgtttttcgttttttgtttgggttttagcgcgttcgcgggtttttcggtcgtttttttttcggtttttaattttggtttttatcgagttgagatagggtatttcgtaaaaaggtgtttttggtcgagcgggaggcggggggacgggcggcgga

SEQ ID NO: 8700 - DNA, 584 bp, Artificial Sequence
  chemically treated genomic DNA (Homo sapiens) CpG-island No: 8700
tccgccgcccgtccccccgcctcccgctcgaccaaaaacacctttttacgaaataccctatctcaactcgataaaaaccaaaattaaaaaccgaaaaaaaaacgaccgaaaaacccgcgaacgcgctaaaacccaaacaaaaaacgaaaaacgacacacacacacactcgcgcgcgcgcactccccaactctccccaacacacgctccgctcccaaccgcgcgaacccccgaaccccgaccgacgccccccgaaccccgacccgacgaaaaccccttccccaccgacgtataaaataaaaacgaaacgacgacgaaaccaaaataacacccaaaaacgaacaaaaacaaaactatcgctacgacgaactccgaaaaacttcgactcgttttctcgaaaccaccgaaaaaaaaaaacaaaaaaaaaaacccgataaaacttcgaaccccgaattaacgaaataaaaaaataaaaaccgaaaaaacaacgaaaccgcgccaaccctacaacttaaatttcaaataaactcatcctttcaaattaacgccgctctttattaaatttatttttccgataataccaccc

SEQ ID NO: 8701 - DNA, 511 bp, Artificial Sequence
  chemically treated genomic DNA (Homo sapiens) CpG-island No: 8701
tagcgtagcggtttcgggttttttttttaagagttcgaaggcgtcgagggtttatttatgtttatttttacgtttgttatatcggggaagttattttcggggcgtttatagatagggcgttttgtcgggaattttaggtttaattagaattgtttttttagatggcgcgggtatcgtcggtttggtttggtttgggagcgttgcggtagggcggaggttttagggagtaaggtggttttcgtcgggtaggtttggaaaggaaggcgggatttggagagttcggttatagacggtttttcgtttgtttcgtcgttattcgaaaggagggagtttcgttcgtattttttgttcggtttattttagttcgagaggggttaaggattcgtcgggtttcggttggggcgttcgacgttcgggttacggttggtaaggttttttagcggttttagtttttatagcgtattttttgtttgggttatagacgacgttgtaaattgtagaatattttttg

SEQ ID NO: 8702 - DNA, 511 bp, Artificial Sequence
  chemically treated genomic DNA (Homo sapiens) CpG-island No: 8702
caaaaaatattctacaatttacaacgtcgtctataacccaaacaaaaaatacgctataaaaactaaaaccgctaaaaaaccttaccaaccgtaacccgaacgtcgaacgccccaaccgaaacccgacgaatccttaacccctctcgaactaaaataaaccgaacaaaaaatacgaacgaaactccctcctttcgaataacgacgaaacaaacgaaaaaccgtctataaccgaactctccaaatcccgccttcctttccaaacctacccgacgaaaaccaccttactccctaaaacctccgccctaccgcaacgctcccaaaccaaaccaaaccgacgatacccgcgccatctaaaaaaacaattctaattaaacctaaaattcccgacaaaacgccctatctataaacgccccgaaaataacttccccgatataacaaacgtaaaaataaacataaataaaccctcgacgccttcgaactcttaaaaaaaaaacccgaaaccgctacgcta

SEQ ID NO: 8703 - DNA, 511 bp, Artificial Sequence
  chemically treated genomic DNA (Homo sapiens) CpG-island No: 8703
taaagagtgttttgtaatttgtagcgtcgtttgtagtttaagtaggaggtgcgttgtggaaattgaggtcgttgggaggttttgttaatcgtgattcggacgtcggacgttttagtcgaggttcggcgagtttttagtttttttcgaattaaaatggatcgaatagaaaatgcggacggggtttttttttttcgggtagcggcggggtagacgggaggtcgtttgtgatcgagttttttaagtttcgtttttttttttaagtttgttcggcggagattattttattttttgagattttcgttttgtcgtagcgtttttaggttaggttaggtcggcggtgttcgcgttatttaaagggataattttggttgaatttgggattttcggtagggcgttttgtttgtgagcgtttcggaggtaattttttcggtgtggtaggcgtggaaatgggtatggatgaattttcggcgttttcgagtttttgaggaaagagttcgggatcgttgcgtta

SEQ ID NO: 8704 - DNA, 511 bp, Artificial Sequence
  chemically treated genomic DNA (Homo sapiens) CpG-island No: 8704
taacgcaacgatcccgaactctttcctcaaaaactcgaaaacgccgaaaattcatccatacccatttccacgcctaccacaccgaaaaaattacctccgaaacgctcacaaacaaaacgccctaccgaaaatcccaaattcaaccaaaattatccctttaaataacgcgaacaccgccgacctaacctaacctaaaaacgctacgacaaaacgaaaatctcaaaaaataaaataatctccgccgaacaaacttaaaaaaaaaaacgaaacttaaaaaactcgatcacaaacgacctcccgtctaccccgccgctacccgaaaaaaaaaaaccccgtccgcattttctattcgatccattttaattcgaaaaaaactaaaaactcgccgaacctcgactaaaacgtccgacgtccgaatcacgattaacaaaacctcccaacgacctcaatttccacaacgcacctcctacttaaactacaaacgacgctacaaattacaaaacactcttta

SEQ ID NO: 8705 - DNA, 506 bp, Artificial Sequence
  chemically treated genomic DNA (Homo sapiens) CpG-island No: 8705
tagcggtcgcgataggcgttatcgtggggtttcgggggtgtagacgtaggaggtcgcgggttttagcgttatcgtcgcgttttttacgtgtttatttttttcgggcgcgaatatttgcgacggtcgagaaatgataggcgattagggtggcgttttgcggcggtttaaagacgtttagttttatttcgcggttaagagggaaagtcgacggagtggtaaaggttggtgcgttcgttggatttgagcgggtatagtgacgtacgcggcgtatttttgtttttttgtagatttagggtaattgttagcgttttcgggaaaattattttaaatataaagcggtttttaagtcgaggggcgtttaaagtgttttttattttttgtattcgtttttttttaggtatttttttttttcgttagtgtttcgttcgcggtataaatgacgtttttcgtattcggttaatgattcgtgttttaatgaatcgaatgtataggtatgcgtatttatt

SEQ ID NO: 8706 - DNA, 506 bp, Artificial Sequence
  chemically treated genomic DNA (Homo sapiens) CpG-island No: 8706
aataaatacgcatacctatacattcgattcattaaaacacgaatcattaaccgaatacgaaaaacgtcatttataccgcgaacgaaacactaacgaaaaaaaaaaatacctaaaaaaaaacgaatacaaaaaataaaaaacactttaaacgcccctcgacttaaaaaccgctttatatttaaaataattttcccgaaaacgctaacaattaccctaaatctacaaaaaaacaaaaatacgccgcgtacgtcactatacccgctcaaatccaacgaacgcaccaacctttaccactccgtcgactttccctcttaaccgcgaaataaaactaaacgtctttaaaccgccgcaaaacgccaccctaatcgcctatcatttctcgaccgtcgcaaatattcgcgcccgaaaaaaataaacacgtaaaaaacgcgacgataacgctaaaacccgcgacctcctacgtctacacccccgaaaccccacgataacgcctatcgcgaccgcta

SEQ ID NO: 8707 - DNA, 506 bp, Artificial Sequence
  chemically treated genomic DNA (Homo sapiens) CpG-island No: 8707
agtgagtgcgtatatttgtatattcggtttattaaaatacgaattattaatcggatgcgaaaggcgttatttatgtcgcggacggggtattggcgggagggaaaagtgtttaaaaggaggcgggtgtagagggtggaggatattttgaacgtttttcggtttgggagtcgttttgtgtttagagtaattttttcgagggcgttaataattattttgaatttataagggggtaagggtgcgtcgcgtgcgttattgtgttcgtttaagtttagcgggcgtattaatttttgttatttcgtcggtttttttttttggtcgcggggtagggttgggcgtttttgggtcgtcgtagggcgttattttaatcgtttgttatttttcggtcgtcgtaggtgttcgcgttcgagagggatgagtacgtgaagagcgcggcggtggcgttggggttcgcggttttttacgtttgtattttcgaggttttacggtaacgtttgtcgcggtcgttg

SEQ ID NO: 8708 - DNA, 506 bp, Artificial Sequence
  chemically treated genomic DNA (Homo sapiens) CpG-island No: 8708
caacgaccgcgacaaacgttaccgtaaaacctcgaaaatacaaacgtaaaaaaccgcgaaccccaacgccaccgccgcgctcttcacgtactcatccctctcgaacgcgaacacctacgacgaccgaaaaataacaaacgattaaaataacgccctacgacgacccaaaaacgcccaaccctaccccgcgaccaaaaaaaaaaaccgacgaaataacaaaaattaatacgcccgctaaacttaaacgaacacaataacgcacgcgacgcacccttacccccttataaattcaaaataattattaacgccctcgaaaaaattactctaaacacaaaacgactcccaaaccgaaaaacgttcaaaatatcctccaccctctacacccgcctccttttaaacacttttccctcccgccaataccccgtccgcgacataaataacgcctttcgcatccgattaataattcgtattttaataaaccgaatatacaaatatacgcactcact

SEQ ID NO: 8709 - DNA, 1103 bp, Artificial Sequence
  chemically treated genomic DNA (Homo sapiens) CpG-island No: 8709
ttttacgtttgcgcggaataaaattttcgtttttcgttcggtttcgtagttttgtcgcgtatagggtaggtgggaaggcgttattggcggggcgggcgcggggtttattttggtcggcgcggggttttttaggggttcgtaaggttttcgtagttcgtagtcgtcgtcgtcgtttggcgggttttttttaggttttcgtattaagttttcggttgttaagtttttaaatgcgggtcggttagttgggggtggttcgaggcggcgtcgggggcgggggttgtcgtcgtcgggagagtttgcgggatcgttcgcgttagaggaggtggcggaagggggtttagtgggttgtttatcgtttgggtcgttttttgcgttgggtgcgttgggttcggtttttttttgggcgttttcgtcgtcggggaagcggttggattttacgtttatttcgggttcgttcgcggtgtttacgtcgggcgaggcggaattgtagttggagttgttttcgtttagaaagttcgggtttacgtagtcgtcgtttttagcgtcgggtttcggttttcgagtaggtttcgcgtcgtacgtttttcgggcgttttcgtagagtttagcgatgttttcggtgtttttgattatcggtcggaaggtcgatacgtaggagtttttgcgtgcgggcggcgggggcggcgtacgtaacggggttaggggcggtggtagcgtttcgttcgtgtcgttttcgtttaggggttcgcgggatagagcgttcgggtagcgttttttcgcgtcgaggttattttttttggttggttcggtatcgtttaggggttttggggtatcgttgttagtagttgtcgttgtcgtcgtcgttgtcgtcgttacggttgtcgttacggttttggtttggttttgagtagcggggtaggacggtatcgggaggttgtttgttgttggttagaatatgggaaacgtcgggtatatagtggcggcggcggtcgttgtagttattgtcgttgcgtttttggttgtttcggagggttgatgtttttagaatatggcgtcgtcgttcgggttcgtttttgttttcgggggtaagtggttggttttcg

SEQ ID NO: 8710 - DNA, 1103 bp, Artificial Sequence
  chemically treated genomic DNA (Homo sapiens) CpG-island No: 8710
cgaaaaccaaccacttacccccgaaaacaaaaacgaacccgaacgacgacgccatattctaaaaacatcaaccctccgaaacaaccaaaaacgcaacgacaataactacaacgaccgccgccgccactatatacccgacgtttcccatattctaaccaacaacaaacaacctcccgataccgtcctaccccgctactcaaaaccaaaccaaaaccgtaacgacaaccgtaacgacgacaacgacgacgacaacgacaactactaacaacgataccccaaaacccctaaacgataccgaaccaaccaaaaaaaataacctcgacgcgaaaaaacgctacccgaacgctctatcccgcgaacccctaaacgaaaacgacacgaacgaaacgctaccaccgcccctaaccccgttacgtacgccgcccccgccgcccgcacgcaaaaactcctacgtatcgaccttccgaccgataatcaaaaacaccgaaaacatcgctaaactctacgaaaacgcccgaaaaacgtacgacgcgaaacctactcgaaaaccgaaacccgacgctaaaaacgacgactacgtaaacccgaactttctaaacgaaaacaactccaactacaattccgcctcgcccgacgtaaacaccgcgaacgaacccgaaataaacgtaaaatccaaccgcttccccgacgacgaaaacgcccaaaaaaaaaccgaacccaacgcacccaacgcaaaaaacgacccaaacgataaacaacccactaaacccccttccgccacctcctctaacgcgaacgatcccgcaaactctcccgacgacgacaacccccgcccccgacgccgcctcgaaccacccccaactaaccgacccgcatttaaaaacttaacaaccgaaaacttaatacgaaaacctaaaaaaaacccgccaaacgacgacgacgactacgaactacgaaaaccttacgaacccctaaaaaaccccgcgccgaccaaaataaaccccgcgcccgccccgccaataacgccttcccacctaccctatacgcgacaaaactacgaaaccgaacgaaaaacgaaaattttattccgcgcaaacgtaaaa

SEQ ID NO: 8711 - DNA, 1103 bp, Artificial Sequence
  chemically treated genomic DNA (Homo sapiens) CpG-island No: 8711
cgggagttagttatttgttttcgggggtaggggcgggttcgggcggcggcgttatgttttgggggtattaatttttcggggtagttaaggacgtagcggtagtggttgtagcggtcgtcgtcgttattgtgtattcgacgttttttatgttttggttagtagtaggtagtttttcggtatcgttttatttcgttgtttagagttaagttaaggtcgtggcggtagtcgtggcggcggtagcggcggcggtagcggtagttgttggtagcggtgttttagagtttttggacggtgtcgagttagttaaagagagtggtttcggcgcggaggagcgttgttcgagcgttttgtttcgcgggtttttggacgaagacggtacggacgaggcgttgttatcgtttttggtttcgttgcgtgcgtcgttttcgtcgttcgtacgtaaaggtttttacgtgtcggtttttcggtcggtggttaaggatatcgagagtatcgttaagttttacgggagcgttcgggaggcgtacggcgcggggtttgttcgggggtcgggattcggcgttgggagcggcggttacgtgagttcggattttttgagcgagggtagttttagttataatttcgtttcgttcgacgtggatatcgcggacgagttcgaggtggacgtggaatttaatcgttttttcgacgacgaggacgtttaagaggagatcgagtttagcgtatttagcgtagggggcggtttagacggtgaatagtttattggattttttttcgttattttttttggcgcggacggtttcgtaaattttttcgacggcggtagttttcgttttcggcgtcgtttcgggttatttttagttggtcggttcgtatttggggatttggtagtcgaagatttggtgcggagatttgagaggagttcgttaagcggcggcggcggttacgagttgcgagagttttgcgggtttttaggaggtttcgcgtcggttaaggtgagtttcgcgttcgtttcgttagtggcgtttttttatttattttgtgcgcggtagggttgcggggtcgggcggagaacgggaattttgtttcgcgtaggcgtggga

SEQ ID NO: 8712 - DNA, 1103 bp, Artificial Sequence
  chemically treated genomic DNA (Homo sapiens) CpG-island No: 8712
tcccacgcctacgcgaaacaaaattcccgttctccgcccgaccccgcaaccctaccgcgcacaaaataaataaaaaaacgccactaacgaaacgaacgcgaaactcaccttaaccgacgcgaaacctcctaaaaacccgcaaaactctcgcaactcgtaaccgccgccgccgcttaacgaactcctctcaaatctccgcaccaaatcttcgactaccaaatccccaaatacgaaccgaccaactaaaaataacccgaaacgacgccgaaaacgaaaactaccgccgtcgaaaaaatttacgaaaccgtccgcgccaaaaaaaataacgaaaaaaaatccaataaactattcaccgtctaaaccgccccctacgctaaatacgctaaactcgatctcctcttaaacgtcctcgtcgtcgaaaaaacgattaaattccacgtccacctcgaactcgtccgcgatatccacgtcgaacgaaacgaaattataactaaaactaccctcgctcaaaaaatccgaactcacgtaaccgccgctcccaacgccgaatcccgacccccgaacaaaccccgcgccgtacgcctcccgaacgctcccgtaaaacttaacgatactctcgatatccttaaccaccgaccgaaaaaccgacacgtaaaaacctttacgtacgaacgacgaaaacgacgcacgcaacgaaaccaaaaacgataacaacgcctcgtccgtaccgtcttcgtccaaaaacccgcgaaacaaaacgctcgaacaacgctcctccgcgccgaaaccactctctttaactaactcgacaccgtccaaaaactctaaaacaccgctaccaacaactaccgctaccgccgccgctaccgccgccacgactaccgccacgaccttaacttaactctaaacaacgaaataaaacgataccgaaaaactacctactactaaccaaaacataaaaaacgtcgaatacacaataacgacgacgaccgctacaaccactaccgctacgtccttaactaccccgaaaaattaatacccccaaaacataacgccgccgcccgaacccgcccctacccccgaaaacaaataactaactcccg

SEQ ID NO: 8713 - DNA, 1002 bp, Artificial Sequence
  chemically treated genomic DNA (Homo sapiens) CpG-island No: 8713
cgtcgttatcgtcgttagtattattttttttttgtttattcgattcgttattggtatcgttttcgtcgtttttttgtaaggagaaggttcgtttgcgcgtgtcgttattaaatatggttttgacgtttttttaagtatggtttagttcgtttgtggtcgatttgttattgagtttgaggtgattacgttaggagttgaagttggcggtatcgggttgcgtgtatttggcgtcgggagttcggtgcgagtggaagatgaatttgttgggcgagaagatatgttgtagtagtcgtatttgatgtatttggtacgagagttgttgtaacgcgtagggatgaagttattacgcgagttttacgcgtattcgtgtattatatcgaaggcgaagttttcgggtagtttgggtggtttgtgttcgtttaggaacgatttgtataggcgttcggtttttcgtttagtgattatgtcgtagcggcgcgacgagatgggtatggtttcggttcgacgtagaatttttagttgtatcggcgtgtattgtacgtacgtgatgtttagggttacgcggcggttgtggattttattatagttgtagtttttgaggagggtgttggagatttgcgttaggtataggcgtttttggtcgtcgatgattagcgatataatgggtatttcgtatagcgacgtttcgtttatttggttgggtttgagagcgttggagttcgagtacggttgtagtttttgtttggagttgggcgaggaattgttttcgcgtttcggttttagttgagtggtgagagtttttatgtcgtcgtttttgcgaaatagagaaagtagagagtagatgagttatttttagcgtcgtcgtcgaggttcgggttcgtttagtagggcgtttcgagttgggcgcgcgggggatatttggtagtggggagtttaaatttatttattttttggataggcgttttttgttatttagatttatgttggcgtcgttaataatag

SEQ ID NO: 8714 - DNA, 1002 bp, Artificial Sequence
  chemically treated genomic DNA (Homo sapiens) CpG-island No: 8714
ctattattaacgacgccaacataaatctaaataacaaaaaacgcctatccaaaaaataaataaatttaaactccccactaccaaatatcccccgcgcgcccaactcgaaacgccctactaaacgaacccgaacctcgacgacgacgctaaaaataactcatctactctctactttctctatttcgcaaaaacgacgacataaaaactctcaccactcaactaaaaccgaaacgcgaaaacaattcctcgcccaactccaaacaaaaactacaaccgtactcgaactccaacgctctcaaacccaaccaaataaacgaaacgtcgctatacgaaatacccattatatcgctaatcatcgacgaccaaaaacgcctatacctaacgcaaatctccaacaccctcctcaaaaactacaactataataaaatccacaaccgccgcgtaaccctaaacatcacgtacgtacaatacacgccgatacaactaaaaattctacgtcgaaccgaaaccatacccatctcgtcgcgccgctacgacataatcactaaacgaaaaaccgaacgcctatacaaatcgttcctaaacgaacacaaaccacccaaactacccgaaaacttcgccttcgatataatacacgaatacgcgtaaaactcgcgtaataacttcatccctacgcgttacaacaactctcgtaccaaatacatcaaatacgactactacaacatatcttctcgcccaacaaattcatcttccactcgcaccgaactcccgacgccaaatacacgcaacccgataccgccaacttcaactcctaacgtaatcacctcaaactcaataacaaatcgaccacaaacgaactaaaccatacttaaaaaaacgtcaaaaccatatttaataacgacacgcgcaaacgaaccttctccttacaaaaaaacgacgaaaacgataccaataacgaatcgaataaacaaaaaaaaaataatactaacgacgataacgacg

SEQ ID NO: 8715 - DNA, 1002 bp, Artificial Sequence
  chemically treated genomic DNA (Homo sapiens) CpG-island No: 8715
ttgttgttaacggcgttaatatgggtttgagtaataaaagacgtttgtttagggggtgaatgagtttggattttttattgttaagtatttttcgcgcgtttaattcggagcgttttgttgggcgggttcgagtttcggcggcggcgttgaaaatggtttatttgttttttgttttttttatttcgtaggagcggcggtatggaggtttttattatttagttggggtcggggcgcgagggtagtttttcgtttaattttaagtaggagttgtagtcgtattcgggttttagcgtttttaaatttaattaggtgggcgagacgtcgttgtacggggtgtttattgtgtcgttggttatcgacggttaggagcgtttatgtttggcgtagatttttaatattttttttaagaattatagttataatgagatttataatcgtcgcgtggttttgggtattacgtgcgtgtagtgtacgtcggtatagttggagattttgcgtcgggtcggggttatgtttatttcgtcgcgtcgttgcggtatgattattaagcgagaggtcgaacgtttgtgtaagtcgtttttgggcgagtataaattatttaagttgttcgagaatttcgttttcgatgtggtgtacgagtgcgcgtggggttcgcgtggtagttttatttttgcgcgttataatagttttcgtgttaagtgtattaagtgcggttattgtagtatgttttttcgtttaataagtttattttttattcgtatcgaattttcgacgttaagtatacgtagttcgatgtcgttaattttaatttttggcgtggttattttaaatttagtgataagtcggttatagacgaattgagttatgtttgggaggacgttaaggttatgtttaatggcggtacgcgtaagcggattttttttttataaggaggcggcggaggcggtgttaatggcgggtcgggtgggtaggggaagggtggtgttggcggcggtggcggcg

SEQ ID NO: 8716 - DNA, 1002 bp, Artificial Sequence
  chemically treated genomic DNA (Homo sapiens) CpG-island No: 8716
cgccgccaccgccgccaacaccacccttcccctacccacccgacccgccattaacaccgcctccgccgcctccttataaaaaaaaaatccgcttacgcgtaccgccattaaacataaccttaacgtcctcccaaacataactcaattcgtctataaccgacttatcactaaatttaaaataaccacgccaaaaattaaaattaacgacatcgaactacgtatacttaacgtcgaaaattcgatacgaataaaaaataaacttattaaacgaaaaaacatactacaataaccgcacttaatacacttaacacgaaaactattataacgcgcaaaaataaaactaccacgcgaaccccacgcgcactcgtacaccacatcgaaaacgaaattctcgaacaacttaaataatttatactcgcccaaaaacgacttacacaaacgttcgacctctcgcttaataatcataccgcaacgacgcgacgaaataaacataaccccgacccgacgcaaaatctccaactataccgacgtacactacacgcacgtaatacccaaaaccacgcgacgattataaatctcattataactataattcttaaaaaaaatattaaaaatctacgccaaacataaacgctcctaaccgtcgataaccaacgacacaataaacaccccgtacaacgacgtctcgcccacctaattaaatttaaaaacgctaaaacccgaatacgactacaactcctacttaaaattaaacgaaaaactaccctcgcgccccgaccccaactaaataataaaaacctccataccgccgctcctacgaaataaaaaaaacaaaaaacaaataaaccattttcaacgccgccgccgaaactcgaacccgcccaacaaaacgctccgaattaaacgcgcgaaaaatacttaacaataaaaaatccaaactcattcaccccctaaacaaacgtcttttattactcaaacccatattaacgccgttaacaacaa

SEQ ID NO: 8717 - DNA, 545 bp, Artificial Sequence
  chemically treated genomic DNA (Homo sapiens) CpG-island No: 8717
  misc_feature (457)..(457): n is either a, c, g or t
  misc_feature (488)..(488): n is either a, c, g or t
  misc_feature (532)..(532): n is either a, c, g or t
tatcggacgtgggtatttatagtgcggcggcggttggagtcgggcgagcggtgagcggaggtgcgcggcgggaggagcggcgggcgggagttcgggattcgtcgggtttttcgggtgacggcgcggttttttttcgcgcgcgcgtatagtcgtgttttttggtttttcgcgtttttattcgcggtttttttcgtttttagcgggtacggggcgtcgggatttcgggcgcggagatgcgaattttgagtcgttgatttcgaggtcggggattggttcgaagaagaggtcgaagtttggagcgtatggggtcggcggcggggatcgcgcggttattattttagtggcggggtaggcgcgtttgatagttgagagtcggggcgttatatttatcggtcgcgtagtcggtagcgtttttttcgggttcgttcgttcgcgggttacgcgcggggttcggcgntttttcgtaggttaagggttgtacgttttanggtaagcgggcgtatatttgcgtgtagtattttgcgtttgcgtntcgttttagttgg

SEQ ID NO: 8718 - DNA, 545 bp, Artificial Sequence
  chemically treated genomic DNA (Homo sapiens) CpG-island No: 8718
  misc_feature (14)..(14): n is either a, c, g or t
  misc_feature (58)..(58): n is either a, c, g or t
  misc_feature (89)..(89): n is either a, c, g or t
ccaactaaaacganacgcaaacgcaaaatactacacgcaaatatacgcccgcttaccntaaaacgtacaacccttaacctacgaaaaancgccgaaccccgcgcgtaacccgcgaacgaacgaacccgaaaaaaacgctaccgactacgcgaccgataaatataacgccccgactctcaactatcaaacgcgcctaccccgccactaaaataataaccgcgcgatccccgccgccgaccccatacgctccaaacttcgacctcttcttcgaaccaatccccgacctcgaaatcaacgactcaaaattcgcatctccgcgcccgaaatcccgacgccccgtacccgctaaaaacgaaaaaaaccgcgaataaaaacgcgaaaaaccaaaaaacacgactatacgcgcgcgcgaaaaaaaaccgcgccgtcacccgaaaaacccgacgaatcccgaactcccgcccgccgctcctcccgccgcgcacctccgctcaccgctcgcccgactccaaccgccgccgcactataaatacccacgtccgata

SEQ ID NO: 8719 - DNA, 545 bp, Artificial Sequence
  chemically treated genomic DNA (Homo sapiens) CpG-island No: 8719
  misc_feature (14)..(14): n is either a, c, g or t
  misc_feature (58)..(58): n is either a, c, g or t
  misc_feature (89)..(89): n is either a, c, g or t
ttagttagagcggnacgtaggcgtagggtgttgtacgtaggtgtgcgttcgtttattntggggcgtgtagtttttggtttgcgggaagncgtcgggtttcgcgcgtggttcgcgggcgggcggattcggggagggcgttatcgattgcgcggtcggtgggtgtggcgtttcggtttttagttgttaggcgcgtttgtttcgttattggggtggtgatcgcgcggttttcgtcgtcggttttatgcgttttaggtttcggtttttttttcgggttagttttcgatttcggggttaacggtttagggttcgtattttcgcgttcggggtttcggcgtttcgtgttcgttgagagcgggaggggtcgcgggtgggagcgcggagaattagggagtacggttgtgcgcgcgcgcggggaggggtcgcgtcgttattcggagagttcggcggatttcggattttcgttcgtcgtttttttcgtcgcgtattttcgtttatcgttcgttcggttttagtcgtcgtcgtattgtgagtatttacgttcggta

SEQ ID NO: 8720 - DNA, 545 bp, Artificial Sequence
  chemically treated genomic DNA (Homo sapiens) CpG-island No: 8720
  misc_feature (457)..(457): n is either a, c, g or t
  misc_feature (488)..(488): n is either a, c, g or t
  misc_feature (532)..(532): n is either a, c, g or t
taccgaacgtaaatactcacaatacgacgacgactaaaaccgaacgaacgataaacgaaaatacgcgacgaaaaaaacgacgaacgaaaatccgaaatccgccgaactctccgaataacgacgcgacccctccccgcgcgcgcgcacaaccgtactccctaattctccgcgctcccacccgcgacccctcccgctctcaacgaacacgaaacgccgaaaccccgaacgcgaaaatacgaaccctaaaccgttaaccccgaaatcgaaaactaacccgaaaaaaaaaccgaaacctaaaacgcataaaaccgacgacgaaaaccgcgcgatcaccaccccaataacgaaacaaacgcgcctaacaactaaaaaccgaaacgccacacccaccgaccgcgcaatcgataacgccctccccgaatccgcccgcccgcgaaccacgcgcgaaacccgacgncttcccgcaaaccaaaaactacacgccccanaataaacgaacgcacacctacgtacaacaccctacgcctacgtnccgctctaactaa

SEQ ID NO: 8721 - DNA, 718 bp, Artificial Sequence
  chemically treated genomic DNA (Homo sapiens) CpG-island No: 8721
  misc_feature (41)..(41): n is either a, c, g or t
  misc_feature (99)..(99): n is either a, c, g or t
  misc_feature (141)..(141): n is either a, c, g or t
  misc_feature (151)..(151): n is either a, c, g or t
  misc_feature (252)..(252): n is either a, c, g or t
  misc_feature (262)..(262): n is either a, c, g or t
  misc_feature (273)..(273): n is either a, c, g or t
  misc_feature (428)..(428): n is either a, c, g or t
  misc_feature (610)..(610): n is either a, c, g or t
  misc_feature (634)..(634): n is either a, c, g or t
  misc_feature (654)..(654): n is either a, c, g or t
  misc_feature (661)..(661): n is either a, c, g or t
  misc_feature (686)..(686): n is either a, c, g or t
agacgtcgtagggaacggtttggttattgtttcgggggcgncgaaagttagggagagcgggagagcgggagagcgggagagcgggagagcgggagtttngggttgagggggttggacgcggggagcgggtttcgaggttgnaggaaaaggntcgtttcgggattttgaggggcggggaacgggatttcgcggggtagcgacgttcgggtaggtcgcggcgggttcggttttcgttaggcggtagttcggggntttcgggttnggaggtcgggntttaagcgataattcggtttcgcgagggggagggggcgtttatttatacgtgttgataggtcgtggttcgtacgggcgttttgagtattttttgatagacggggtagtagaaattattttcggtgtaggacgtggtcgtagagaggttttcggtntatggcgggggatggggaaataaggcgatggcgatagcggtagcggtcgaggtgacggtggcggttcggggttcgattttttatatgaattcggaggggggagggggatcgtattaggatatagcgcgcgttaggaagggggcggggttttgggtagggcggggtcgaacgtagagacgttnattgtcgtacgcgtcgggtaaganggcgattttttttacggttnttttttnatagggggttggatgggggacggtngtttggcgggaggttgggttcgtagtatgtcg

SEQ ID NO: 8722 - DNA, 718 bp, Artificial Sequence
  chemically treated genomic DNA (Homo sapiens) CpG-island No: 8722
  misc_feature (33)..(33): n is either a, c, g or t
  misc_feature (58)..(58): n is either a, c, g or t
  misc_feature (65)..(65): n is either a, c, g or t
  misc_feature (85)..(85): n is either a, c, g or t
  misc_feature (109)..(109): n is either a, c, g or t
  misc_feature (291)..(291): n is either a, c, g or t
  misc_feature (446)..(446): n is either a, c, g or t
  misc_feature (457)..(457): n is either a, c, g or t
  misc_feature (467)..(467): n is either a, c, g or t
  misc_feature (568)..(568): n is either a, c, g or t
  misc_feature (578)..(578): n is either a, c, g or t
  misc_feature (620)..(620): n is either a, c, g or t
  misc_feature (678)..(678): n is either a, c, g or t
cgacatactacgaacccaacctcccgccaaacnaccgtcccccatccaaccccctatnaaaaaanaaccgtaaaaaaaatcgccntcttacccgacgcgtacgacaatnaacgtctctacgttcgaccccgccctacccaaaaccccgcccccttcctaacgcgcgctatatcctaatacgatccccctcccccctccgaattcatataaaaaatcgaaccccgaaccgccaccgtcacctcgaccgctaccgctatcgccatcgccttatttccccatcccccgccatanaccgaaaacctctctacgaccacgtcctacaccgaaaataatttctactaccccgtctatcaaaaaatactcaaaacgcccgtacgaaccacgacctatcaacacgtataaataaacgccccctccccctcgcgaaaccgaattatcgcttaaancccgacctccnaacccgaaanccccgaactaccgcctaacgaaaaccgaacccgccgcgacctacccgaacgtcgctaccccgcgaaatcccgttccccgcccctcaaaatcccgaaacganccttttcctncaacctcgaaacccgctccccgcgtccaaccccctcaacccnaaactcccgctctcccgctctcccgctctcccgctctcccgctctccctaactttcgncgcccccgaaacaataaccaaaccgttccctacgacgtct

SEQ ID NO: 8723 - DNA, 718 bp, Artificial Sequence
  chemically treated genomic DNA (Homo sapiens) CpG-island No: 8723
  misc_feature (33)..(33): n is either a, c, g or t
  misc_feature (58)..(58): n is either a, c, g or t
  misc_feature (65)..(65): n is either a, c, g or t
  misc_feature (85)..(85): n is either a, c, g or t
  misc_feature (109)..(109): n is either a, c, g or t
  misc_feature (291)..(291): n is either a, c, g or t
  misc_feature (446)..(446): n is either a, c, g or t
  misc_feature (457)..(457): n is either a, c, g or t
  misc_feature (467)..(467): n is either a, c, g or t
  misc_feature (568)..(568): n is either a, c, g or t
  misc_feature (578)..(578): n is either a, c, g or t
  misc_feature (620)..(620): n is either a, c, g or t
  misc_feature (678)..(678): n is either a, c, g or t
cggtatgttgcgagtttagtttttcgttaagtnatcgttttttatttagttttttgtngggaggnagtcgtgggaggggtcgttnttttgttcggcgcgtgcggtagtnagcgtttttgcgttcggtttcgttttatttagggtttcgttttttttttggcgcgcgttgtattttgatgcgatttttttttttttttcgggtttatgtagggagtcgggtttcgggtcgttatcgttatttcggtcgttgtcgttgtcgttatcgttttgtttttttatttttcgttatgngtcgaggatttttttgcggttacgttttatatcgaagatgatttttattgtttcgtttgttaggaggtgtttaaaacgttcgtgcggattacggtttgttagtacgtgtgagtagacgttttttttttttcgcggagtcgggttgtcgtttaggnttcggtttttnggttcgggantttcgggttgtcgtttggcgggaatcgagttcgtcgcggtttgttcgagcgtcgttgtttcgcgaggtttcgtttttcgttttttagagtttcggggcggntttttttttntagtttcggggttcgtttttcgcgtttagtttttttagtttnaagttttcgttttttcgttttttcgttttttcgttttttcgttttttttggttttcgncgttttcggggtagtggttaggtcgttttttgcggcgttt

SEQ ID NO: 8724 - DNA, 718 bp, Artificial Sequence
  chemically treated genomic DNA (Homo sapiens) CpG-island No: 8724
  misc_feature (41)..(41): n is either a, c, g or t
  misc_feature (99)..(99): n is either a, c, g or t
  misc_feature (141)..(141): n is either a, c, g or t
  misc_feature (151)..(151): n is either a, c, g or t
  misc_feature (252)..(252): n is either a, c, g or t
  misc_feature (262)..(262): n is either a, c, g or t
  misc_feature (273)..(273): n is either a, c, g or t
  misc_feature (428)..(428): n is either a, c, g or t
  misc_feature (610)..(610): n is either a, c, g or t
  misc_feature (634)..(634): n is either a, c, g or t
  misc_feature (654)..(654): n is either a, c, g or t
  misc_feature (661)..(661): n is either a, c, g or t
  misc_feature (686)..(686): n is either a, c, g or t
aaacgccgcaaaaaacgacctaaccactaccccgaaaacgncgaaaaccaaaaaaaacgaaaaaacgaaaaaacgaaaaaacgaaaaaacgaaaacttnaaactaaaaaaactaaacgcgaaaaacgaaccccgaaactanaaaaaaaaanccgccccgaaactctaaaaaacgaaaaacgaaacctcgcgaaacaacgacgctcgaacaaaccgcgacgaactcgattcccgccaaacgacaacccgaaantcccgaaccnaaaaaccgaancctaaacgacaacccgactccgcgaaaaaaaaaaaacgtctactcacacgtactaacaaaccgtaatccgcacgaacgttttaaacacctcctaacaaacgaaacaataaaaatcatcttcgatataaaacgtaaccgcaaaaaaatcctcgacncataacgaaaaataaaaaaacaaaacgataacgacaacgacaacgaccgaaataacgataacgacccgaaacccgactccctacataaacccgaaaaaaaaaaaaaaatcgcatcaaaatacaacgcgcgccaaaaaaaaaacgaaaccctaaataaaacgaaaccgaacgcaaaaacgctnactaccgcacgcgccgaacaaaanaacgacccctcccacgactncctcccnacaaaaaactaaataaaaaacgatnacttaacgaaaaactaaactcgcaacataccg

SEQ ID NO: 8725 - DNA, 754 bp, Artificial Sequence
  chemically treated genomic DNA (Homo sapiens) CpG-island No: 8725
  misc_feature (82)..(82): n is either a, c, g or t
  misc_feature (186)..(186): n is either a, c, g or t
  misc_feature (364)..(364): n is either a, c, g or t
  misc_feature (385)..(385): n is either a, c, g or t
  misc_feature (392)..(392): n is either a, c, g or t
  misc_feature (598)..(598): n is either a, c, g or t
  misc_feature (605)..(605): n is either a, c, g or t
  misc_feature (658)..(658): n is either a, c, g or t
ttttaggacgcggttttacgttttaggttacgtttttatcgggttttaggcgcgggttcgcgtttcgtttttagttttcgtntttcgtttaaggtttttttttttattgttttttcgtttttatttatttcgatttcgagtttcgagtgtttagttcgtgttcgcggtttttttttcgtttcgttntttcggtatttcggtttttttacgttttcgtcggggagatttttatttaggagtttcgaagcggcgttgtggacggagttgttttttttttacgtgttcgtagagattcggtttagcgtttttttcgagttttttgttcggtcgtcgttattttcgtagtcgaggtttcggggtaaantggagggcggcgtgcgttgtngtttatncggtttttaacggggtcggagtcgaggtttatggtgtagggagattcgttcgtcgtcgttagtagttttgttttggtattgcgttgtttatagtttattcggtcgttatcgaacgcgggagcgtcggggatttgggcggaggagttaggagaggcggggaggtacggggtgtgaagtgcggtttgtatagtaatcggcgtacggtngtttttncgcgggttgtgacgtaagtagttgggcgttcgcggtgatatttgcgttttttncgtttcgtttcgttaggttcgggattttagttattttttttgttaaatatattgggttttttaggaagttttcgttaatgtttaagatttagtttt

SEQ ID NO: 8726 - DNA, 754 bp, Artificial Sequence
  chemically treated genomic DNA (Homo sapiens) CpG-island No: 8726
  misc_feature (97)..(97): n is either a, c, g or t
  misc_feature (150)..(150): n is either a, c, g or t
  misc_feature (157)..(157): n is either a, c, g or t
  misc_feature (363)..(363): n is either a, c, g or t
  misc_feature (370)..(370): n is either a, c, g or t
  misc_feature (391)..(391): n is either a, c, g or t
  misc_feature (569)..(569): n is either a, c, g or t
  misc_feature (673)..(673): n is either a, c, g or t
aaaactaaatcttaaacattaacgaaaacttcctaaaaaacccaatatatttaacaaaaaaaataactaaaatcccgaacctaacgaaacgaaacgnaaaaaacgcaaatatcaccgcgaacgcccaactacttacgtcacaacccgcgnaaaaacnaccgtacgccgattactatacaaaccgcacttcacaccccgtacctccccgcctctcctaactcctccgcccaaatccccgacgctcccgcgttcgataacgaccgaataaactataaacaacgcaataccaaaacaaaactactaacgacgacgaacgaatctccctacaccataaacctcgactccgaccccgttaaaaaccgnataaacnacaacgcacgccgccctccantttaccccgaaacctcgactacgaaaataacgacgaccgaacaaaaaactcgaaaaaaacgctaaaccgaatctctacgaacacgtaaaaaaaaaacaactccgtccacaacgccgcttcgaaactcctaaataaaaatctccccgacgaaaacgtaaaaaaaccgaaataccgaaanaacgaaacgaaaaaaaaaccgcgaacacgaactaaacactcgaaactcgaaatcgaaataaataaaaacgaaaaaacaataaaaaaaaaaaccttaaacgaaanacgaaaactaaaaacgaaacgcgaacccgcgcctaaaacccgataaaaacgtaacctaaaacgtaaaaccgcgtcctaaaa

SEQ ID NO: 8727 - DNA, 754 bp, Artificial Sequence
  chemically treated genomic DNA (Homo sapiens) CpG-island No: 8727
  misc_feature (97)..(97): n is either a, c, g or t
  misc_feature (150)..(150): n is either a, c, g or t
  misc_feature (157)..(157): n is either a, c, g or t
  misc_feature (363)..(363): n is either a, c, g or t
  misc_feature (370)..(370): n is either a, c, g or t
  misc_feature (391)..(391): n is either a, c, g or t
  misc_feature (569)..(569): n is either a, c, g or t
  misc_feature (673)..(673): n is either a, c, g or t
aagattaaattttgaatattgacgaaaattttttgaaaggtttaatgtatttgataggagaggtaattggggtttcgggtttagcgaggcggggcgngggaggcgtaggtgttatcgcgggcgtttagttgtttacgttataattcgcgngaaggtngtcgtgcgtcggttgttatataggtcgtattttatatttcgtgttttttcgttttttttggttttttcgtttagattttcggcgttttcgcgttcggtgacggtcgggtaggttgtaggtagcgtaatgttaagatagagttgttggcggcggcgggcgaatttttttgtattatgagtttcggtttcggtttcgttaggggtcgnataagtnatagcgtacgtcgttttttantttgtttcggggtttcggttgcgaagatagcggcggtcggataggaagttcgaggaaagcgttgggtcgggtttttacgaatacgtgaaggaaaagtagtttcgtttataacgtcgtttcggggtttttaggtgagagttttttcggcggaagcgtggaggggtcggggtgtcggganagcggggcggggaggaagtcgcggatacgggttgggtattcggggttcggggtcggggtgagtagaggcggaaaagtagtgaaaagggaggttttgggcgaagnacgggggttgagggcggggcgcgagttcgcgtttggagttcggtgagggcgtggtttagagcgtgaggtcgcgttttgggg

SEQ ID NO: 8728 - DNA, 754 bp, Artificial Sequence
  chemically treated genomic DNA (Homo sapiens) CpG-island No: 8728
  misc_feature (82)..(82): n is either a, c, g or t
  misc_feature (186)..(186): n is either a, c, g or t
  misc_feature (364)..(364): n is either a, c, g or t
  misc_feature (385)..(385): n is either a, c, g or t
  misc_feature (392)..(392): n is either a, c, g or t
  misc_feature (598)..(598): n is either a, c, g or t
  misc_feature (605)..(605): n is either a, c, g or t
  misc_feature (658)..(658): n is either a, c, g or t
ccccaaaacgcgacctcacgctctaaaccacgccctcaccgaactccaaacgcgaactcgcgccccgccctcaacccccgtncttcgcccaaaacctcccttttcactacttttccgcctctactcaccccgaccccgaaccccgaatacccaacccgtatccgcgacttcctccccgccccgctntcccgacaccccgacccctccacgcttccgccgaaaaaactctcacctaaaaaccccgaaacgacgttataaacgaaactacttttccttcacgtattcgtaaaaacccgacccaacgctttcctcgaacttcctatccgaccgccgctatcttcgcaaccgaaaccccgaaacaaantaaaaaacgacgtacgctatnacttatncgacccctaacgaaaccgaaaccgaaactcataatacaaaaaaattcgcccgccgccgccaacaactctatcttaacattacgctacctacaacctacccgaccgtcaccgaacgcgaaaacgccgaaaatctaaacgaaaaaaccaaaaaaaacgaaaaaacacgaaatataaaatacgacctatataacaaccgacgcacgacnaccttcncgcgaattataacgtaaacaactaaacgcccgcgataacacctacgcctcccncgccccgcctcgctaaacccgaaaccccaattacctctcctatcaaatacattaaacctttcaaaaaattttcgtcaatattcaaaatttaatctt

SEQ ID NO: 8729 - DNA, 992 bp, Artificial Sequence
  chemically treated genomic DNA (Homo sapiens) CpG-island No: 8729
agggtcgtcgacgttagttatggttcgggtagagtttcgtaaggtgttatagtatcggggttagcgtttttcggaaaagtatgtttcgttggcggtcgttaggttttttcgcggagtttcggaaaggaaaattcgtttttacgggggttttacgacgttttcgggttttaggtttcgggacgttggtagaggcgtagtagatttttttttttagttcgtacggttttagcggttcggtcgcgttttagttcgggttgttcgtttttcgtttttcggcggcgtcggaaagttttcggggttggcggcggttaagagtagagttagggtagtcgtagtcgttttttagttcgtcgtttatcgtcgtaggggtaggtttgagcgggggtttttattaagtcgtcgatatttttcgggaatttttttattgggttatatataaatttcgtttttttttttaaattttcgttgtcggttttatcgatgcgaaagtcgcggtggagtttagattatttttttcggcgtcgggtttagttcgttttcgtttttttttttttcgcggaattttttttcgtcgttcgaagaaattcgaaggttttcggtaagtttcgtttttagcgcgggggcggggtcgttcgagttgtttcgggtttagttcggttgttttcgtgcgcggtcgttgcgtattcggtattgggcggcgttggttggttttttggttgcggttttttagtcggcggcggttgttgttgtttgtggttcgggcggttgggagaagcggagtgttggtgagtgacgcggcggaggtgtagtttgacgcggtgtgttacgtgggggagagaataaaattttagcgagattcgggtcgtgaacgaaagtagtgacggaggagtttgtattatcggtaagaggagtaggaggaggaggtaggagttagagagagtcggggggacggagggggacggggaggttcggatattcgcgtttggggtttt

SEQ ID NO: 8730 - DNA, 992 bp, Artificial Sequence
  chemically treated genomic DNA (Homo sapiens) CpG-island No: 8730
aaaaccccaaacgcgaatatccgaacctccccgtccccctccgtccccccgactctctctaactcctacctcctcctcctactcctcttaccgataatacaaactcctccgtcactactttcgttcacgacccgaatctcgctaaaattttattctctcccccacgtaacacaccgcgtcaaactacacctccgccgcgtcactcaccaacactccgcttctcccaaccgcccgaaccacaaacaacaacaaccgccgccgactaaaaaaccgcaaccaaaaaaccaaccaacgccgcccaataccgaatacgcaacgaccgcgcacgaaaacaaccgaactaaacccgaaacaactcgaacgaccccgcccccgcgctaaaaacgaaacttaccgaaaaccttcgaatttcttcgaacgacgaaaaaaaattccgcgaaaaaaaaaaaaacgaaaacgaactaaacccgacgccgaaaaaaataatctaaactccaccgcgactttcgcatcgataaaaccgacaacgaaaatttaaaaaaaaaaacgaaatttatatataacccaataaaaaaattcccgaaaaatatcgacgacttaataaaaacccccgctcaaacctacccctacgacgataaacgacgaactaaaaaacgactacgactaccctaactctactcttaaccgccgccaaccccgaaaactttccgacgccgccgaaaaacgaaaaacgaacaacccgaactaaaacgcgaccgaaccgctaaaaccgtacgaactaaaaaaaaaaatctactacgcctctaccaacgtcccgaaacctaaaacccgaaaacgtcgtaaaacccccgtaaaaacgaattttcctttccgaaactccgcgaaaaaacctaacgaccgccaacgaaacatacttttccgaaaaacgctaaccccgatactataacaccttacgaaactctacccgaaccataactaacgtcgacgaccct

SEQ ID NO: 8731 - DNA, 992 bp, Artificial Sequence
  chemically treated genomic DNA (Homo sapiens) CpG-island No: 8731
aaggttttaagcgcgggtgttcgggttttttcgttttttttcgttttttcggttttttttggtttttgttttttttttttgttttttttatcggtggtataagttttttcgttattgttttcgtttacggttcggatttcgttggagttttatttttttttttacgtaatatatcgcgttaaattatattttcgtcgcgttatttattaatatttcgttttttttagtcgttcgggttataggtagtagtagtcgtcgtcgattgaggagtcgtagttagggagttagttagcgtcgtttagtgtcgagtgcgtagcggtcgcgtacggaaatagtcgagttaggttcggagtagttcgagcggtttcgttttcgcgttggggacggaatttgtcgaagattttcgggttttttcgggcgacgagaaggggtttcgcggggagagggaaggcgaaggcgggttgagttcggcgtcgggaggagtggtttaaattttatcgcggttttcgtatcggtaaagtcggtagcggaaatttgaaggaggaagcggggtttgtgtgtggtttagtgggggaattttcgaggggtgtcggcgatttggtggaaattttcgtttaggtttgtttttgcggcggtgagcggcgggttagaaggcggttgcggttgttttggttttgtttttgatcgtcgttagtttcgggaatttttcgacgtcgtcgggagacgggggacgggtagttcgggttgggacgcggtcggatcgttggagtcgtgcgggttggggaagaaggtttgttgcgtttttgttaacgtttcggggtttgggattcgggggcgtcgtgggattttcgtggggacgggttttttttttcgagatttcgcggagaaatttggcggtcgttagcggagtatgttttttcggggggcgttggtttcgatattgtggtattttgcggggttttgttcggattatggttgacgtcgacggtttt

SEQ ID NO: 8732 - DNA, 992 bp, Artificial Sequence
  chemically treated genomic DNA (Homo sapiens) CpG-island No: 8732
aaaaccgtcgacgtcaaccataatccgaacaaaaccccgcaaaataccacaatatcgaaaccaacgccccccgaaaaaacatactccgctaacgaccgccaaatttctccgcgaaatctcgaaaaaaaaaacccgtccccacgaaaatcccacgacgcccccgaatcccaaaccccgaaacgttaacaaaaacgcaacaaaccttcttccccaacccgcacgactccaacgatccgaccgcgtcccaacccgaactacccgtcccccgtctcccgacgacgtcgaaaaattcccgaaactaacgacgatcaaaaacaaaaccaaaacaaccgcaaccgccttctaacccgccgctcaccgccgcaaaaacaaacctaaacgaaaatttccaccaaatcgccgacacccctcgaaaattcccccactaaaccacacacaaaccccgcttcctccttcaaatttccgctaccgactttaccgatacgaaaaccgcgataaaatttaaaccactcctcccgacgccgaactcaacccgccttcgccttccctctccccgcgaaaccccttctcgtcgcccgaaaaaacccgaaaatcttcgacaaattccgtccccaacgcgaaaacgaaaccgctcgaactactccgaacctaactcgactatttccgtacgcgaccgctacgcactcgacactaaacgacgctaactaactccctaactacgactcctcaatcgacgacgactactactacctataacccgaacgactaaaaaaaacgaaatattaataaataacgcgacgaaaatataatttaacgcgatatattacgtaaaaaaaaaaataaaactccaacgaaatccgaaccgtaaacgaaaacaataacgaaaaaacttataccaccgataaaaaaaacaaaaaaaaaaaacaaaaaccaaaaaaaaccgaaaaaacgaaaaaaaacgaaaaaacccgaacacccgcgcttaaaacctt

SEQ ID NO: 8733 - DNA, 651 bp, Artificial Sequence
  chemically treated genomic DNA (Homo sapiens) CpG-island No: 8733
tcgacgcggtcgatttattagatagcgagtgggcgtgagaacgtagtttttcggtcgtttttttagtacgtggatttcggagcgcgggttttcgttttatcgtttcggggagtggcgcgcgcgtaggtcgagttttcgggcgagttcgcgcggggttgtattttatcgggtcggcgttgggggtcgcgcggggtttttggttcgttagggattcggtggcggtggttgggttttattcgttagcggcgggaaggacgcgcgggaaagcgagggagtaggaagcgggtggcggcggcggtcggggttcgttggaaaggagggagcgtcgtaggcgggaggagggagcgcggaggagggaggtcgggaggaaggagggagcgcggtaggtaggcggagggagggttgattagtatgtagtagcgttcgcgttcggttttattgttttaatattttttttttttttcgcgttaatttgttatcgtttagtaggcgaacgttgttgttttaaatgttgttttttttaaatgagacggataattagttgtttcgtacgaatgtcgtattttttttatttttgattgttattatttttttgtttttggtagttttgatatttcgtaattagtttgttgtttttttttttttttttcg

SEQ ID NO: 8734 - DNA, 651 bp, Artificial Sequence
  chemically treated genomic DNA (Homo sapiens) CpG-island No: 8734
cgaaaaaaaaaaaaaaaaacaacaaactaattacgaaatatcaaaactaccaaaaacaaaaaaataataacaatcaaaaataaaaaaaatacgacattcgtacgaaacaactaattatccgtctcatttaaaaaaaacaacatttaaaacaacaacgttcgcctactaaacgataacaaattaacgcgaaaaaaaaaaaaaatattaaaacaataaaaccgaacgcgaacgctactacatactaatcaaccctccctccgcctacctaccgcgctccctccttcctcccgacctccctcctccgcgctccctcctcccgcctacgacgctccctcctttccaacgaaccccgaccgccgccgccacccgcttcctactccctcgctttcccgcgcgtccttcccgccgctaacgaataaaacccaaccaccgccaccgaatccctaacgaaccaaaaaccccgcgcgacccccaacgccgacccgataaaatacaaccccgcgcgaactcgcccgaaaactcgacctacgcgcgcgccactccccgaaacgataaaacgaaaacccgcgctccgaaatccacgtactaaaaaaacgaccgaaaaactacgttctcacgcccactcgctatctaataaatcgaccgcgtcga

SEQ ID NO: 8735 - DNA, 651 bp, Artificial Sequence
  chemically treated genomic DNA (Homo sapiens) CpG-island No: 8735
cgggaagaaaagagaaaagtagtaggttgattacgaggtgttaaaattgttaggagtaagaaggtgatagtaattaggggtgagaagagtgcggtattcgtgcggggtaattaattattcgttttatttgagaagagtagtatttgaggtagtagcgttcgtttgttgaacggtgatagattggcgcggaggagaggggaggtgttaaaataatggagtcgggcgcgagcgttgttgtatgttaattagtttttttttcgtttgtttgtcgcgtttttttttttttttcggtttttttttttcgcgtttttttttttcgtttgcggcgtttttttttttttagcgggtttcggtcgtcgtcgttattcgttttttgttttttcgttttttcgcgcgtttttttcgtcgttggcgagtggaatttagttatcgttatcgagtttttagcgggttaggagtttcgcgcggtttttagcgtcggttcggtggagtgtagtttcgcgcgggttcgttcgagggttcggtttgcgcgcgcgttatttttcggggcggtggggcgaggattcgcgtttcgggatttacgtattggggaagcggtcgaagagttgcgtttttacgtttattcgttgtttggtgaatcgatcgcgtcgg

SEQ ID NO: 8736 - DNA, 651 bp, Artificial Sequence
  chemically treated genomic DNA (Homo sapiens) CpG-island No: 8736
ccgacgcgatcgattcaccaaacaacgaataaacgtaaaaacgcaactcttcgaccgcttccccaatacgtaaatcccgaaacgcgaatcctcgccccaccgccccgaaaaataacgcgcgcgcaaaccgaaccctcgaacgaacccgcgcgaaactacactccaccgaaccgacgctaaaaaccgcgcgaaactcctaacccgctaaaaactcgataacgataactaaattccactcgccaacgacgaaaaaaacgcgcgaaaaaacgaaaaaacaaaaaacgaataacgacgacgaccgaaacccgctaaaaaaaaaaaaacgccgcaaacgaaaaaaaaaaacgcgaaaaaaaaaaaccgaaaaaaaaaaaaaaacgcgacaaacaaacgaaaaaaaaactaattaacatacaacaacgctcgcgcccgactccattattttaacacctcccctctcctccgcgccaatctatcaccgttcaacaaacgaacgctactacctcaaatactactcttctcaaataaaacgaataattaattaccccgcacgaataccgcactcttctcacccctaattactatcaccttcttactcctaacaattttaacacctcgtaatcaacctactacttttctcttttcttcccg

SEQ ID NO: 8737 - DNA, 591 bp, Artificial Sequence
  chemically treated genomic DNA (Homo sapiens) CpG-island No: 8737
acgagtataggttgtttttcgaaagatcgagataaagaggcgtttttcgttcgaataaatcggcggtatttacgtaagtgttatttagtttgtggttttttattacggcggttttggtatttagttcggtcgttttgcgcgcgttggttagttcgttcgagtcgttttcgattattaggtagttataggaggttacggcgttagtagcgggcggcgggttttgcggttgcggtttttgtttgtaggttatggtacgggagagggcgcgcgtgagggtcgcgggttcgggtagaagtagtaggaagtttcggaaggcgcgcgtcgttcgtcgttagttcggtttcgcgtcggcgtttagggttcggggtagtagggttatgtacgcggaagtggcgcgttaagtggggcgggcggttcggggacggttttcggggtaggggggcgcgggtttcgggtaagcgtagttttacggtgattaagtatgcgttcgtcgttaggtaagatttaggaggatgtttagaggcggggtcgttttttagtttttcgtttcggtggcggagtttgaggggttttttcgttttcgtttttatt

SEQ ID NO: 8738 - DNA, 591 bp, Artificial Sequence
  chemically treated genomic DNA (Homo sapiens) CpG-island No: 8738
aataaaaacgaaaacgaaaaaacccctcaaactccgccaccgaaacgaaaaactaaaaaacgaccccgcctctaaacatcctcctaaatcttacctaacgacgaacgcatacttaatcaccgtaaaactacgcttacccgaaacccgcgcccccctaccccgaaaaccgtccccgaaccgcccgccccacttaacgcgccacttccgcgtacataaccctactaccccgaaccctaaacgccgacgcgaaaccgaactaacgacgaacgacgcgcgccttccgaaacttcctactacttctacccgaacccgcgaccctcacgcgcgccctctcccgtaccataacctacaaacaaaaaccgcaaccgcaaaacccgccgcccgctactaacgccgtaacctcctataactacctaataatcgaaaacgactcgaacgaactaaccaacgcgcgcaaaacgaccgaactaaataccaaaaccgccgtaataaaaaaccacaaactaaataacacttacgtaaataccgccgatttattcgaacgaaaaacgcctctttatctcgatctttcgaaaaacaacctatactcgt

SEQ ID NO: 8739 - DNA, 591 bp, Artificial Sequence
  chemically treated genomic DNA (Homo sapiens) CpG-island No: 8739
ggtgagaacggaggcggagaaattttttaggtttcgttatcggggcggggaattgggaggcggtttcgtttttgggtatttttttgggttttgtttagcggcgggcgtatgtttagttatcgtgaggttgcgtttgttcggggttcgcgtttttttatttcggggatcgttttcgggtcgttcgttttatttggcgcgttattttcgcgtgtatggttttgttgtttcgagttttgagcgtcggcgcgggatcgagttggcggcgggcggcgcgcgtttttcgaggttttttgttgtttttgttcgagttcgcggtttttacgcgcgttttttttcgtgttatggtttgtaggtaggagtcgtagtcgtagggttcgtcgttcgttgttggcgtcgtggttttttatgattatttggtgatcgggggcggttcgggcgggttggttagcgcgcgtagggcggtcgagttgggtgttagggtcgtcgtggtggagagttataagttgggtggtatttgcgtgagtatcgtcggtttgttcgggcggggggcgtttttttgtttcggtttttcgggggatagtttgtgttcgt

SEQ ID NO: 8740 - DNA, 591 bp, Artificial Sequence
  chemically treated genomic DNA (Homo sapiens) CpG-island No: 8740
acgaacacaaactatcccccgaaaaaccgaaacaaaaaaacgccccccgcccgaacaaaccgacgatactcacgcaaataccacccaacttataactctccaccacgacgaccctaacacccaactcgaccgccctacgcgcgctaaccaacccgcccgaaccgcccccgatcaccaaataatcataaaaaaccacgacgccaacaacgaacgacgaaccctacgactacgactcctacctacaaaccataacacgaaaaaaaacgcgcgtaaaaaccgcgaactcgaacaaaaacaacaaaaaacctcgaaaaacgcgcgccgcccgccgccaactcgatcccgcgccgacgctcaaaactcgaaacaacaaaaccatacacgcgaaaataacgcgccaaataaaacgaacgacccgaaaacgatccccgaaataaaaaaacgcgaaccccgaacaaacgcaacctcacgataactaaacatacgcccgccgctaaacaaaacccaaaaaaatacccaaaaacgaaaccgcctcccaattccccgccccgataacgaaacctaaaaaatttctccgcctccgttctcacc

SEQ ID NO: 8741 - DNA, 957 bp, Artificial Sequence
  chemically treated genomic DNA (Homo sapiens) CpG-island No: 8741
agggcgtcgtgtttcggcggcgtcgtttgttcgttttttttcggcggaaatgttcgagcgatgacggaaattcggagggaggggagagaaagagcgagagaaggggaaagataagtcgggagaggtcggtaggcgtgaggcgggtttgaagcggtagcgggcggttttcgttcggcgagagttaggtcgaggattcgcgtcgcgtttttcggtattttatcgcgttttttatcgattttcgcggcgcgcggtcgggcggggaagggcgggcgggggttttttttaggttgcgcgttcggagtcgtttgttgggtttgggcggggcgcggggttcgcggtcgttttattcggtttagttttttttttgtgggatttggcgacggcggcggagggagaggggagcggcgttcggtcggggtcgggggcgggtggggaggggggagggcggcggtcgggttggggttcgggattcgtatcgggatcgggtcgttatggacgataaggcgtttattaaggagttggattagtgggtcgagtagttgaacgagtgtaagtagttgaacgagaattaagtgcggacgttgtgcgagaaggtgagggcgtcgcgggggcgagtgcgggagcgcggggttgggacgggtcgtcgtttttttgttcgtttcggtttcgttcgtttttggttcggcgcgtttatcgggggtttgcggggttgtgggttcggtttcggcgtttatttaggcggtcggtttatcggtttagggttcggggcgttgggttgttttcgtttgttttttttattttcgttttacgttttcggtcggttgtttagatttcgggcgtggggggttcgggtgcggacgggcggggaaacgtagttttttgagttaagtaggaggttggtcggggtcgtttgcgttttattggggagtttttgttattttagtatttttcgagtgg

SEQ ID NO: 8742 - DNA, 957 bp, Artificial Sequence
  chemically treated genomic DNA (Homo sapiens) CpG-island No: 8742
ccactcgaaaaatactaaaataacaaaaactccccaataaaacgcaaacgaccccgaccaacctcctacttaactcaaaaaactacgtttccccgcccgtccgcacccgaaccccccacgcccgaaatctaaacaaccgaccgaaaacgtaaaacgaaaataaaaaaaacaaacgaaaacaacccaacgccccgaaccctaaaccgataaaccgaccgcctaaataaacgccgaaaccgaacccacaaccccgcaaacccccgataaacgcgccgaaccaaaaacgaacgaaaccgaaacgaacaaaaaaacgacgacccgtcccaaccccgcgctcccgcactcgcccccgcgacgccctcaccttctcgcacaacgtccgcacttaattctcgttcaactacttacactcgttcaactactcgacccactaatccaactccttaataaacgccttatcgtccataacgacccgatcccgatacgaatcccgaaccccaacccgaccgccgccctcccccctccccacccgcccccgaccccgaccgaacgccgctcccctctccctccgccgccgtcgccaaatcccacaaaaaaaaaactaaaccgaataaaacgaccgcgaaccccgcgccccgcccaaacccaacaaacgactccgaacgcgcaacctaaaaaaaacccccgcccgcccttccccgcccgaccgcgcgccgcgaaaatcgataaaaaacgcgataaaataccgaaaaacgcgacgcgaatcctcgacctaactctcgccgaacgaaaaccgcccgctaccgcttcaaacccgcctcacgcctaccgacctctcccgacttatctttccccttctctcgctctttctctcccctccctccgaatttccgtcatcgctcgaacatttccgccgaaaaaaaacgaacaaacgacgccgccgaaacacgacgccct

SEQ ID NO: 8743 - DNA, 957 bp, Artificial Sequence
  chemically treated genomic DNA (Homo sapiens) CpG-island No: 8743
ttattcgggaaatgttagagtggtaggaattttttagtggagcgtaggcgatttcgattaattttttgtttggtttagggggttacgttttttcgttcgttcgtattcgagttttttacgttcgggatttgggtagtcggtcgggggcgtgaggcggaggtggaaggggtaggcgagggtagtttaacgtttcgggttttgaatcgatgggtcggtcgtttaggtggacgtcggagtcggatttatagtttcgtaggttttcggtgggcgcgtcgggttaggggcggacgggatcggggcgggtaggaaagcggcggttcgttttagtttcgcgttttcgtattcgttttcgcggcgtttttattttttcgtatagcgttcgtatttggttttcgtttagttgtttatattcgtttagttgttcgatttattggtttagttttttggtgaacgttttgtcgtttatggcggttcgatttcgatgcggatttcgagttttagttcggtcgtcgtttttttttttttttattcgttttcggtttcggtcgggcgtcgttttttttttttttcgtcgtcgtcgttaggttttatagggggaggattgagtcgggtagggcggtcgcgggtttcgcgtttcgtttaagtttagtaggcggtttcgagcgcgtagtttggaggagattttcgttcgttttttttcgttcggtcgcgcgtcgcgggagtcggtgaaggacgcggtgaggtgtcggggagcgcggcgcgggttttcggtttagttttcgtcggacgaaggtcgttcgttgtcgttttaggttcgttttacgtttatcggtttttttcgatttgtttttttttttttttcgttttttttttttttttttttcgggttttcgttatcgttcgggtattttcgtcgggaaaaggcgagtaggcggcgtcgtcgggatacggcgtttt

SEQ ID NO: 8744 - DNA, 957 bp, Artificial Sequence
  chemically treated genomic DNA (Homo sapiens) CpG-island No: 8744
aaaacgccgtatcccgacgacgccgcctactcgccttttcccgacgaaaatacccgaacgataacgaaaacccgaaaaaaaaaaaaaaaaaaaacgaaaaaaaaaaaaaaacaaatcgaaaaaaaccgataaacgtaaaacgaacctaaaacgacaacgaacgaccttcgtccgacgaaaactaaaccgaaaacccgcgccgcgctccccgacacctcaccgcgtccttcaccgactcccgcgacgcgcgaccgaacgaaaaaaaacgaacgaaaatctcctccaaactacgcgctcgaaaccgcctactaaacttaaacgaaacgcgaaacccgcgaccgccctacccgactcaatcctccccctataaaacctaacgacgacgacgaaaaaaaaaaaaaacgacgcccgaccgaaaccgaaaacgaataaaaaaaaaaaaaaacgacgaccgaactaaaactcgaaatccgcatcgaaatcgaaccgccataaacgacaaaacgttcaccaaaaaactaaaccaataaatcgaacaactaaacgaatataaacaactaaacgaaaaccaaatacgaacgctatacgaaaaaataaaaacgccgcgaaaacgaatacgaaaacgcgaaactaaaacgaaccgccgctttcctacccgccccgatcccgtccgcccctaacccgacgcgcccaccgaaaacctacgaaactataaatccgactccgacgtccacctaaacgaccgacccatcgattcaaaacccgaaacgttaaactaccctcgcctaccccttccacctccgcctcacgcccccgaccgactacccaaatcccgaacgtaaaaaactcgaatacgaacgaacgaaaaaacgtaaccccctaaaccaaacaaaaaattaatcgaaatcgcctacgctccactaaaaaattcctaccactctaacatttcccgaataa

SEQ ID NO: 8745 - DNA, 682 bp, Artificial Sequence
  chemically treated genomic DNA (Homo sapiens) CpG-island No: 8745
cgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggatggtggtaggtgacgatggtgacggtgttagggatggtggtaggtgatgatggtgacggtgttagggatggtggtaggtgatgatggtgacggtgttagggatggtggtaggtgatgatggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgacggtgttagggatggtggtaggtgatgacggtgacggtgttagggatggtggtaggtgatgacgttgacggtgttagggatggtggtaggtgatgacggtgatagtgttagggatggtggtaggtgatgacggtgatggtgttagggatggttgtaggtaatg

SEQ ID NO: 8746 - DNA, 682 bp, Artificial Sequence
  chemically treated genomic DNA (Homo sapiens) CpG-island No: 8746
cattacctacaaccatccctaacaccatcaccgtcatcacctaccaccatccctaacactatcaccgtcatcacctaccaccatccctaacaccgtcaacgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccgtcatcacctaccaccatccctaacaccgtcaccatcatcacctaccaccatccctaacaccgtcaccatcatcacctaccaccatccctaacaccgtcaccatcatcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcgtcacctaccaccatccctaacaccgtcaccatcg

SEQ ID NO: 8747 - DNA, 682 bp, Artificial Sequence
  chemically treated genomic DNA (Homo sapiens) CpG-island No: 8747
tattatttataattatttttaatattattatcgttattatttattattatttttaatattgttatcgttattatttattattatttttaatatcgttagcgttattatttattattatttttaatatcgttatcgttattatttattattatttttaatatcgttatcgttattatttattattatttttaatatcgttatcgttattatttattattatttttaatatcgttatcgttattatttgttattatttttaatatcgttatcgttattatttgttattatttttaatatcgttatcgttattatttgttattatttttaatatcgttattattattatttgttattatttttaatatcgttattattattatttgttattatttttaatatcgttattattattatttgttattatttttaatatcgttattatcgttatttgttattatttttaatatcgttattatcgttatttgttattatttttaatatcgttattatcgttatttgttattatttttaatatcgttattatcgttatttgttattatttttaatatcgttattatcgttatttgttattatttttaatatcgttattatcgttatttgttattatttttaatatcgttattatcgttatttgttattatttttaatatcgttattatcg

SEQ ID NO: 8748 - DNA, 682 bp, Artificial Sequence
  chemically treated genomic DNA (Homo sapiens) CpG-island No: 8748
cgataataacgatattaaaaataataacaaataacgataataacgatattaaaaataataacaaataacgataataacgatattaaaaataataacaaataacgataataacgatattaaaaataataacaaataacgataataacgatattaaaaataataacaaataacgataataacgatattaaaaataataacaaataacgataataacgatattaaaaataataacaaataacgataataacgatattaaaaataataacaaataataataataacgatattaaaaataataacaaataataataataacgatattaaaaataataacaaataataataataacgatattaaaaataataacaaataataacgataacgatattaaaaataataacaaataataacgataacgatattaaaaataataacaaataataacgataacgatattaaaaataataataaataataacgataacgatattaaaaataataataaataataacgataacgatattaaaaataataataaataataacgataacgatattaaaaataataataaataataacgctaacgatattaaaaataataataaataataacgataacaatattaaaaataataataaataataacgataataatattaaaaataattataaataata

SEQ ID NO: 8749 - DNA, 509 bp, Artificial Sequence
  chemically treated genomic DNA (Homo sapiens) CpG-island No: 8749
  misc_feature (206)..(206): n is either a, c, g or t
ggatagcggttttcggtaaatcggtagaattcgaggttaacgttattgagtatagacgcgtcggttgttacgtagcggtatgtgcgtttttaattagttgaatgtgtagcgacgttaatgtcggaaacgtgttttttttattcggtattagagtaaattgtagcgttagattgggtagtaattttttaagtaacggttgcggtatntgagggtttacgggtaatattcgcgtttcgtattgtagtaacgttagttaggcgagtagcgtttgcggcgtattttacgttcgtaatattacgtcgttgtttttaattattttttgtatcgtaaattcggaagttaatttatcgacgcgagtataaagttcgcgttagttgagttgttcgttattaagacgtaaggcgatggtttttttcgtatttgtcgtagtgacgttacgttagttagagagattttagaggatttttatgcgtgttattttttgattttttattttgttttaatgaaat

SEQ ID NO: 8750 - DNA, 509 bp, Artificial Sequence
  chemically treated genomic DNA (Homo sapiens) CpG-island No: 8750
  misc_feature (304)..(304): n is either a, c, g or t
atttcattaaaacaaaataaaaaatcaaaaaataacacgcataaaaatcctctaaaatctctctaactaacgtaacgtcactacgacaaatacgaaaaaaaccatcgccttacgtcttaataacgaacaactcaactaacgcgaactttatactcgcgtcgataaattaacttccgaatttacgatacaaaaaataattaaaaacaacgacgtaatattacgaacgtaaaatacgccgcaaacgctactcgcctaactaacgttactacaatacgaaacgcgaatattacccgtaaaccctcanataccgcaaccgttacttaaaaaattactacccaatctaacgctacaatttactctaataccgaataaaaaaaacacgtttccgacattaacgtcgctacacattcaactaattaaaaacgcacataccgctacgtaacaaccgacgcgtctatactcaataacgttaacctcgaattctaccgatttaccgaaaaccgctatcc

SEQ ID NO: 8751 - DNA, 509 bp, Artificial Sequence
  chemically treated genomic DNA (Homo sapiens) CpG-island No: 8751
  misc_feature (304)..(304): n is either a, c, g or t
attttattgagataagatgaggaattaaaagatggtacgtatggggattttttagaatttttttgattggcgtggcgttattgcggtaagtgcgggagaaattatcgttttacgttttaatgacgagtaatttaattggcgcgagttttgtgttcgcgtcgatgaattagttttcggatttgcggtgtagggggtggttgagggtagcggcgtgatgttgcgggcgtggaatacgtcgtaaacgttgttcgtttggttggcgttattgtaatgcggggcgcgggtgttgttcgtgaatttttangtgtcgtaatcgttgtttgaagaattgttgtttaatttgacgttgtaatttgttttggtgtcggatggggaaaatacgttttcggtattaacgtcgttgtatatttagttggttgaaggcgtatatgtcgttacgtggtagtcgacgcgtttgtgtttaatgacgttgatttcgggttttatcggtttgtcgaaagtcgttgttt

SEQ ID NO: 8752 - DNA, 509 bp, Artificial Sequence
  chemically treated genomic DNA (Homo sapiens) CpG-island No: 8752
  misc_feature (206)..(206): n is either a, c, g or t
aaacaacgactttcgacaaaccgataaaacccgaaatcaacgtcattaaacacaaacgcgtcgactaccacgtaacgacatatacgccttcaaccaactaaatatacaacgacgttaataccgaaaacgtattttccccatccgacaccaaaacaaattacaacgtcaaattaaacaacaattcttcaaacaacgattacgacacntaaaaattcacgaacaacacccgcgccccgcattacaataacgccaaccaaacgaacaacgtttacgacgtattccacgcccgcaacatcacgccgctaccctcaaccaccccctacaccgcaaatccgaaaactaattcatcgacgcgaacacaaaactcgcgccaattaaattactcgtcattaaaacgtaaaacgataatttctcccgcacttaccgcaataacgccacgccaatcaaaaaaattctaaaaaatccccatacgtaccatcttttaattcctcatcttatctcaataaaat

SEQ ID NO: 8753 - DNA, 512 bp, Artificial Sequence
  chemically treated genomic DNA (Homo sapiens) CpG-island No: 8753
gattcgcgaattggcggtataggttgttgaagtaatgacggatttttttaaatatatgcgcggcgtaaatgtggttgttttgtacggcggttagcgttatgacgtgtaattacgcgttttgcgttaggggtcgtagatcgttgtcggtatttcgggtcgtttgttggattatttgaaacgtggtattttggatttttttaaattgagcggtttggttttggatgaagttgacgaaatgttgcgtatgggttttatcgaagacgttgaaattattatggcgtagatttcggaaggttattagatcgttttgttttttgtaattatgtcggaagcgattcgtcgtattattcgtcgttttatgaaagagtcgtaggaagtgcgtatttagtttagcgtgattattcgttttgatattagttagagttattggattgtttggggtatgcgtaaaaacgaagtattggtacgttttttggaagcggaagattttgatgcggcgattattttcgttt

SEQ ID NO: 8754 - DNA, 512 bp, Artificial Sequence
  chemically treated genomic DNA (Homo sapiens) CpG-island No: 8754
aaacgaaaataatcgccgcatcaaaatcttccgcttccaaaaaacgtaccaatacttcgtttttacgcataccccaaacaatccaataactctaactaatatcaaaacgaataatcacgctaaactaaatacgcacttcctacgactctttcataaaacgacgaataatacgacgaatcgcttccgacataattacaaaaaacaaaacgatctaataaccttccgaaatctacgccataataatttcaacgtcttcgataaaacccatacgcaacatttcgtcaacttcatccaaaaccaaaccgctcaatttaaaaaaatccaaaataccacgtttcaaataatccaacaaacgacccgaaataccgacaacgatctacgacccctaacgcaaaacgcgtaattacacgtcataacgctaaccgccgtacaaaacaaccacatttacgccgcgcatatatttaaaaaaatccgtcattacttcaacaacctataccgccaattcgcgaatc

SEQ ID NO: 8755 - DNA, 512 bp, Artificial Sequence
  chemically treated genomic DNA (Homo sapiens) CpG-island No: 8755
gaacgaagataatcgtcgtattaaaatttttcgtttttaggaaacgtattagtgtttcgtttttgcgtatattttagatagtttagtagttttggttgatgttaggacgggtagttacgttggattgaatgcgtattttttgcggtttttttataaagcggcgggtaatgcgacgaatcgttttcggtatggttgtagagaatagagcggtttgatgatttttcgggatttgcgttataatggttttaacgttttcgatgaagtttatgcgtagtatttcgttagttttatttagaattagatcgtttagtttagagaggtttagagtgttacgttttaggtggtttagtagacggttcggagtatcgataacgatttgcggtttttgacgtagggcgcgtaattgtacgttataacgttggtcgtcgtatagagtaattatatttacgtcgcgtatgtgtttagagaaattcgttattgttttagtaatttgtatcgttagttcgcgggtt

SEQ ID NO: 8756 - DNA, 512 bp, Artificial Sequence
  chemically treated genomic DNA (Homo sapiens) CpG-island No: 8756
aacccgcgaactaacgatacaaattactaaaacaataacgaatttctctaaacacatacgcgacgtaaatataattactctatacgacgaccaacgttataacgtacaattacgcgccctacgtcaaaaaccgcaaatcgttatcgatactccgaaccgtctactaaaccacctaaaacgtaacactctaaacctctctaaactaaacgatctaattctaaataaaactaacgaaatactacgcataaacttcatcgaaaacgttaaaaccattataacgcaaatcccgaaaaatcatcaaaccgctctattctctacaaccataccgaaaacgattcgtcgcattacccgccgctttataaaaaaaccgcaaaaaatacgcattcaatccaacgtaactacccgtcctaacatcaaccaaaactactaaactatctaaaatatacgcaaaaacgaaacactaatacgtttcctaaaaacgaaaaattttaatacgacgattatcttcgttc

SEQ ID NO: 8757 - DNA, 1007 bp, Artificial Sequence
  chemically treated genomic DNA (Homo sapiens) CpG-island No: 8757
gagtcgggcgggtacgtgttaggcgtttggttgcgggaaatcgacgttgttgcgtatggttgtcgggttggagcgggtgatagaaggcgatatttggattaacgattagcgcgtgattgaaatggagttaaaagatcgcgggattgcgatggtgttttagaattacgcgttttattcgtatatgagtgtcgaagaaaatatggcgtgggggttgaaaattcgcggtatgggtaagtagtaaattgtcgagcgcgttaaagaagcggcgcgtattttggagttggacggtttgtttaaacgtcgttcgcgcgagtttttcggcggttagcgttagcgtgtggcgatgggtcgcgcgattgtgcgcgattcggcggtgtttttgtttgatgagtcgttttttaatttcgatgttaagttgcgcgtgtagatgcgttttgaattgtaatagttgtatcgtcgtttgaaaacgattttattttacgttatttacgattaggttgaagcgatgacgttcgtttagcgagtaatggtgatgaacggcggtgttgtcgaatagaattgtatattagttgaagtttacgaaaattcgttagtttgttgtagcgagtttattcgtattcgcgataatcgttgatagttcgtgatacgaaggtagtattcgacggtagtttaagtgttcgtaatcggtggatttatagtcggcgaaaagattcggatcgtcggataatgttaattttatagagcggggttattttaggattcggaaattcggtaaaattggtacgatcggggataaacggggtttaggttatagagtttaggtagaaatcgtgggtatcgggaaatacggatttttaagggaatagaacgttggaaaaggttaatttttaaagcgtaatcgggggggtaattggtttgaaaattttggtgaaagggcgcgtcgtaataggtagaaaggcggcggtttaaaagtagcgcgtcgttttaaataacgagtatattaatga

SEQ ID NO: 8758 - DNA, 1007 bp, Artificial Sequence
  chemically treated genomic DNA (Homo sapiens) CpG-island No: 8758
tcattaatatactcgttatttaaaacgacgcgctacttttaaaccgccgcctttctacctattacgacgcgccctttcaccaaaattttcaaaccaattacccccccgattacgctttaaaaattaaccttttccaacgttctattcccttaaaaatccgtatttcccgatacccacgatttctacctaaactctataacctaaaccccgtttatccccgatcgtaccaattttaccgaatttccgaatcctaaaataaccccgctctataaaattaacattatccgacgatccgaatcttttcgccgactataaatccaccgattacgaacacttaaactaccgtcgaatactaccttcgtatcacgaactatcaacgattatcgcgaatacgaataaactcgctacaacaaactaacgaattttcgtaaacttcaactaatatacaattctattcgacaacaccgccgttcatcaccattactcgctaaacgaacgtcatcgcttcaacctaatcgtaaataacgtaaaataaaatcgttttcaaacgacgatacaactattacaattcaaaacgcatctacacgcgcaacttaacatcgaaattaaaaaacgactcatcaaacaaaaacaccgccgaatcgcgcacaatcgcgcgacccatcgccacacgctaacgctaaccgccgaaaaactcgcgcgaacgacgtttaaacaaaccgtccaactccaaaatacgcgccgcttctttaacgcgctcgacaatttactacttacccataccgcgaattttcaacccccacgccatattttcttcgacactcatatacgaataaaacgcgtaattctaaaacaccatcgcaatcccgcgatcttttaactccatttcaatcacgcgctaatcgttaatccaaatatcgccttctatcacccgctccaacccgacaaccatacgcaacaacgtcgatttcccgcaaccaaacgcctaacacgtacccgcccgactc

SEQ ID NO: 8759 - DNA, 1007 bp, Artificial Sequence
  chemically treated genomic DNA (Homo sapiens) CpG-island No: 8759
ttattaatgtattcgttgtttaaaacgacgcgttatttttgaatcgtcgtttttttgtttattgcgacgcgtttttttattagggtttttaggttagttattttttcggttgcgttttgggggttggttttttttaacgttttgtttttttaaaagttcgtgtttttcggtgtttacggtttttgtttaggttttatggtttggatttcgtttgttttcggtcgtgttagttttgtcgggttttcgggttttaaaatggtttcgttttgtggggttggtattgttcggcgattcgggttttttcgtcggttatgagtttatcgattacgggtatttaagttgtcgtcgaatgttgttttcgtattacgggttgttagcggttatcgcggatgcgagtaaattcgttataataggttggcgggttttcgtagattttaattggtgtgtaattttgttcggtaatatcgtcgtttattattattattcgttgggcgagcgttatcgttttaatttgatcgtgagtaacgtagagtgaagtcgtttttaggcgacggtgtaattgttgtagtttaagacgtatttgtacgcgtagtttggtatcgaggttagagagcggtttattaaataggaatatcgtcggatcgcgtataatcgcgcggtttatcgttatacgttggcgttgatcgtcggaaagttcgcgcgggcgacgtttgagtagatcgtttagttttagaatgcgcgtcgtttttttaacgcgttcggtaatttgttgtttgtttatgtcgcgaatttttagtttttacgttatgtttttttcgatatttatatgcggataaagcgcgtagttttggaatattatcgtaatttcgcgattttttggttttattttagttacgcgttggtcgttgatttagatatcgttttttgttattcgttttagttcggtaattatgcgtagtagcgtcgatttttcgtagttagacgtttggtacgtattcgttcggttt

SEQ ID NO: 8760 - DNA, 1007 bp, Artificial Sequence
  chemically treated genomic DNA (Homo sapiens) CpG-island No: 8760
aaaccgaacgaatacgtaccaaacgtctaactacgaaaaatcgacgctactacgcataattaccgaactaaaacgaataacaaaaaacgatatctaaatcaacgaccaacgcgtaactaaaataaaaccaaaaaatcgcgaaattacgataatattccaaaactacgcgctttatccgcatataaatatcgaaaaaaacataacgtaaaaactaaaaattcgcgacataaacaaacaacaaattaccgaacgcgttaaaaaaacgacgcgcattctaaaactaaacgatctactcaaacgtcgcccgcgcgaactttccgacgatcaacgccaacgtataacgataaaccgcgcgattatacgcgatccgacgatattcctatttaataaaccgctctctaacctcgataccaaactacgcgtacaaatacgtcttaaactacaacaattacaccgtcgcctaaaaacgacttcactctacgttactcacgatcaaattaaaacgataacgctcgcccaacgaataataataataaacgacgatattaccgaacaaaattacacaccaattaaaatctacgaaaacccgccaacctattataacgaatttactcgcatccgcgataaccgctaacaacccgtaatacgaaaacaacattcgacgacaacttaaatacccgtaatcgataaactcataaccgacgaaaaaacccgaatcgccgaacaataccaaccccacaaaacgaaaccattttaaaacccgaaaacccgacaaaactaacacgaccgaaaacaaacgaaatccaaaccataaaacctaaacaaaaaccgtaaacaccgaaaaacacgaacttttaaaaaaacaaaacgttaaaaaaaaccaacccccaaaacgcaaccgaaaaaataactaacctaaaaaccctaataaaaaaacgcgtcgcaataaacaaaaaaacgacgattcaaaaataacgcgtcgttttaaacaacgaatacattaataa

SEQ ID NO: 8761 - DNA, 503 bp, Artificial Sequence
  chemically treated genomic DNA (Homo sapiens) CpG-island No: 8761
agaaaagcgacggtgtcgtgtattagggtattatcgttcgcgtgaagttaggacgttagtattaggaaaacgatttgtcggatttgatcgtttcgttcgattaatcgtttttgttgattttcgacggcgtaatcgattcgtataatttcggcgcgtgtttgcgtagtgcggacgtcgtagttttatgcggtgattgtgtcgaaagatcgtttcgtatagtttaacgttacggcgaaaaaagtagtttgcggcgcggtagaaagcgtttcgttgattcgggtgattaattttgcgcgtattatgcgtatgttgtaggaagagaatatttggatcgtcggtacggtaggcgaggcggattatatattttattagagtaaaatgatcggatcgttggcgttggtgatggggtcggaaagtgaaggtatgcgttcgttgattcgtgaatattgcgattagttgattagtatttcgatggttggaaacgttttttttttgaacgtttt

SEQ ID NO: 8762 - DNA, 503 bp, Artificial Sequence
  chemically treated genomic DNA (Homo sapiens) CpG-island No: 8762
aaaacgttcaaaaaaaaaacgtttccaaccatcgaaatactaatcaactaatcgcaatattcacgaatcaacgaacgcataccttcactttccgaccccatcaccaacgccaacgatccgatcattttactctaataaaatatataatccgcctcgcctaccgtaccgacgatccaaatattctcttcctacaacatacgcataatacgcgcaaaattaatcacccgaatcaacgaaacgctttctaccgcgccgcaaactacttttttcgccgtaacgttaaactatacgaaacgatctttcgacacaatcaccgcataaaactacgacgtccgcactacgcaaacacgcgccgaaattatacgaatcgattacgccgtcgaaaatcaacaaaaacgattaatcgaacgaaacgatcaaatccgacaaatcgttttcctaatactaacgtcctaacttcacgcgaacgataataccctaatacacgacaccgtcgcttttct

SEQ ID NO: 8763 - DNA, 503 bp, Artificial Sequence
  chemically treated genomic DNA (Homo sapiens) CpG-island No: 8763
gaaacgtttagggaagaaacgtttttagttatcgggatgttgattaattaatcgtaatgtttacgagttagcggacgtatatttttatttttcgattttattattagcgttagcgattcggttattttgttttgatagagtgtatgattcgtttcgtttgtcgtatcgacgatttagatattttttttttgtaatatacgtatggtgcgcgtaaggttagttattcgaattagcggaacgttttttgtcgcgtcgtaggttatttttttcgtcgtagcgttgagttgtgcggagcgatttttcggtataattatcgtatgaagttgcggcgttcgtattacgtaggtacgcgtcgaggttgtgcggatcggttacgtcgtcgaggattagtaggaacggttgatcgagcgaagcgattagattcggtagatcgtttttttgatattgacgttttggttttacgcgggcgataatgttttgatgtacggtatcgtcgttttttt

SEQ ID NO: 8764 - DNA, 503 bp, Artificial Sequence
  chemically treated genomic DNA (Homo sapiens) CpG-island No: 8764
aaaaaaacgacgataccgtacatcaaaacattatcgcccgcgtaaaaccaaaacgtcaatatcaaaaaaacgatctaccgaatctaatcgcttcgctcgatcaaccgttcctactaatcctcgacgacgtaaccgatccgcacaacctcgacgcgtacctacgtaatacgaacgccgcaacttcatacgataattataccgaaaaatcgctccgcacaactcaacgctacgacgaaaaaaataacctacgacgcgacaaaaaacgttccgctaattcgaataactaaccttacgcgcaccatacgtatattacaaaaaaaaaatatctaaatcgtcgatacgacaaacgaaacgaatcatacactctatcaaaacaaaataaccgaatcgctaacgctaataataaaatcgaaaaataaaaatatacgtccgctaactcgtaaacattacgattaattaatcaacatcccgataactaaaaacgtttcttccctaaacgtttc

SEQ ID NO: 8765 - DNA, 560 bp, Artificial Sequence
  chemically treated genomic DNA (Homo sapiens) CpG-island No: 8765
  misc_feature (243)..(243): n is either a, c, g or t
  misc_feature (492)..(492): n is either a, c, g or t
ttaacgtcgcggcgagtggcgttataattacgtattggtgtttaaagatcgttcggattatcgttttattttcggtgaaaaaggtgaagtgttggatatcgtcgtcgagtttcgtcgtattgttaatcgtatcgtcgaagaagcgatgattgtcgttaatatttgtgcggttcgcgtattgcgcgataagttcggttttggtatttataacgtgtatatgggttttgattcggcgaatgcgancgcgttggtagcgttgttgaaaacgtacggtttgtatgtcgatgtcgaagaagtgtttacgttggacggtttttgtaaattgcgtcgtgaattggacgcgtaattaattggttttttcgatagtcgtattcgtcgtttttagttatttgttgaaattagtattgaattcggtttttattttggtttcggtttggaagtatacgttatttggatttcgtcgattcgtaaatatggcgatatgattaattnacgtttgttgaaagcggttattaaagggcgaattgcgacgcgtttataggatgaataagttattcgtt

SEQ ID NO: 8766 - DNA, 560 bp, Artificial Sequence
  chemically treated genomic DNA (Homo sapiens) CpG-island No: 8766
  misc_feature (69)..(69): n is either a, c, g or t
  misc_feature (318)..(318): n is either a, c, g or t
aacgaataacttattcatcctataaacgcgtcgcaattcgccctttaataaccgctttcaacaaacgtnaattaatcatatcgccatatttacgaatcgacgaaatccaaataacgtatacttccaaaccgaaaccaaaataaaaaccgaattcaatactaatttcaacaaataactaaaaacgacgaatacgactatcgaaaaaaccaattaattacgcgtccaattcacgacgcaatttacaaaaaccgtccaacgtaaacacttcttcgacatcgacatacaaaccgtacgttttcaacaacgctaccaacgcgntcgcattcgccgaatcaaaacccatatacacgttataaataccaaaaccgaacttatcgcgcaatacgcgaaccgcacaaatattaacgacaatcatcgcttcttcgacgatacgattaacaatacgacgaaactcgacgacgatatccaacacttcacctttttcaccgaaaataaaacgataatccgaacgatctttaaacaccaatacgtaattataacgccactcgccgcgacgttaa

SEQ ID NO: 8767 - DNA, 560 bp, Artificial Sequence
  chemically treated genomic DNA (Homo sapiens) CpG-island No: 8767
  misc_feature (69)..(69): n is either a, c, g or t
  misc_feature (318)..(318): n is either a, c, g or t
agcggatgatttgtttattttgtgggcgcgtcgtagttcgttttttgataatcgtttttagtagacgtnggttgattatgtcgttatatttacggatcggcgaagtttaggtggcgtatgtttttagatcgaggttaaagtgaggatcgggtttagtgttaattttagtaaatgattggaagcgacgaatgcggttgtcgaggaaattagttggttgcgcgtttagtttacgacgtagtttgtagaaatcgtttagcgtgagtattttttcggtatcgatatgtagatcgtgcgtttttagtaacgttgttagcgcgntcgtattcgtcggattaaagtttatatgtacgttatagatgttaaaatcgagtttatcgcgtagtacgcgggtcgtataaatgttagcggtaattatcgttttttcgacgatacggttggtaatgcgacgaggttcggcgacgatatttagtattttattttttttatcgagaataaagcggtaattcgggcgatttttaaatattagtgcgtggttatgacgttattcgtcgcggcgttgg

SEQ ID NO: 8768 - DNA, 560 bp, Artificial Sequence
  chemically treated genomic DNA (Homo sapiens) CpG-island No: 8768
  misc_feature (243)..(243): n is either a, c, g or t
  misc_feature (492)..(492): n is either a, c, g or t
ccaacgccgcgacgaataacgtcataaccacgcactaatatttaaaaatcgcccgaattaccgctttattctcgataaaaaaaataaaatactaaatatcgtcgccgaacctcgtcgcattaccaaccgtatcgtcgaaaaaacgataattaccgctaacatttatacgacccgcgtactacgcgataaactcgattttaacatctataacgtacatataaactttaatccgacgaatacgancgcgctaacaacgttactaaaaacgcacgatctacatatcgataccgaaaaaatactcacgctaaacgatttctacaaactacgtcgtaaactaaacgcgcaaccaactaatttcctcgacaaccgcattcgtcgcttccaatcatttactaaaattaacactaaacccgatcctcactttaacctcgatctaaaaacatacgccacctaaacttcgccgatccgtaaatataacgacataatcaaccnacgtctactaaaaacgattatcaaaaaacgaactacgacgcgcccacaaaataaacaaatcatccgct

SEQ ID NO: 8769 - DNA, 573 bp, Artificial Sequence
  chemically treated genomic DNA (Homo sapiens) CpG-island No: 8769
cgttatttacggtgcggtgcgtgaggcggtttgtttcgttatagtgttagtgggtgattagttttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggcggatgattcgttcggtagtatcgtattttatattgcgcgttagatcgttttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttacggttgtcgtatgcgcggtattgatttagttttttttcgcggtgtatcgtcgttatttgttcgaagcggttatggttataacgggttatataatcggaatagtcggtgaagtttagtaattgatcgtaacggttttacgttatggtttacgtattttataggaacggga

SEQ ID NO: 8770 - DNA, 573 bp, Artificial Sequence
  chemically treated genomic DNA (Homo sapiens) CpG-island No: 8770
tcccgttcctataaaatacgtaaaccataacgtaaaaccgttacgatcaattactaaacttcaccgactattccgattatataacccgttataaccataaccgcttcgaacaaataacgacgatacaccgcgaaaaaaaactaaatcaataccgcgcatacgacaaccgtaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaaacgatctaacgcgcaatataaaatacgatactaccgaacgaatcatccgcctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaaactaatcacccactaacactataacgaaacaaaccgcctcacgcaccgcaccgtaaataacg

SEQ ID NO: 8771 - DNA, 573 bp, Artificial Sequence
  chemically treated genomic DNA (Homo sapiens) CpG-island No: 8771
tttcgtttttgtagaatgcgtaaattatgacgtggagtcgttacggttagttgttgagttttatcgattgtttcggttatgtaattcgttatgattatgatcgtttcgggtagatgacggcggtgtatcgcgaggaagggttgagttagtatcgcgtatacgatagtcgtggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtagggcggtttgacgcgtagtatggaatacgatgttgtcggacgggttattcgtttgattagtgaaaacggtagttatattatttttcgttacgatgtatttgatcggttgatataggaaatcggttttgacggtcgtatatagcgttattattacgatttgatcggtaaatttattcgtagcgaggatgaggggttggttatttattggtattatgacgaagtagatcgttttacgtatcgtatcgtgaatggcg

SEQ ID NO: 8772 - DNA, 573 bp, Artificial Sequence
  chemically treated genomic DNA (Homo sapiens) CpG-island No: 8772
cgccattcacgatacgatacgtaaaacgatctacttcgtcataataccaataaataaccaacccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaacgaataacccgtccgacaacatcgtattccatactacgcgtcaaaccgccctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccacgactatcgtatacgcgatactaactcaacccttcctcgcgatacaccgccgtcatctacccgaaacgatcataatcataacgaattacataaccgaaacaatcgataaaactcaacaactaaccgtaacgactccacgtcataatttacgcattctacaaaaacgaaa

SEQ ID NO: 8773 - DNA, 801 bp, Artificial Sequence
  chemically treated genomic DNA (Homo sapiens) CpG-island No: 8773
tcgcgttcgcggatcgattttagttttattttagtcgttttttgtttgggtagaatgggggtttcgcgggaacgcgatgtgttgttagtttatagttcgttttttttttgcgggtcggtattcgtcgttggcggcgtcgatttgtgggaggtttagagggcgggtgagtgcggagcggaaggcgcgggcgaagtatcgtaggggtttcgttgatttcgttatacgtcgggtagggttgtaacggtttttttcgattggagcggtcgcgcgttttttcggtcggttattggtttttttgtttttaggttttcgttttcggttttcgtgtttttttttagtttttagagcggagtcgggaggtaaattttaagcggttgtgggatttacgttttattcggaattttaagttttgtcgtttcgtttggcgtttaaattttgcggatttttattggtcgttcgtttttttcggtttcgcgcgttttagggtttcgcgggttttcggtttcgggatattttcggttttggggaattttcggttttttcgtagtttcggcgttcgggatattttcggttttcggtagttgttttagtcggaggttcgcgggcgttttatgttggtagtgttaatgtcgtcggttggtattcggttggttgcgcgttgggaacgttagcgaggtagcgttatcggtttgaggagggtgaaagtttaatttttggtttttgaagttagcggaagggaacgggtatgttttggaaaggttcgtcgggaatttttttagaaattaggcgaagttttttgtt

SEQ ID NO: 8774 - DNA, 801 bp, Artificial Sequence
  chemically treated genomic DNA (Homo sapiens) CpG-island No: 8774
aacaaaaaacttcgcctaatttctaaaaaaattcccgacgaacctttccaaaacatacccgttcccttccgctaacttcaaaaaccaaaaattaaactttcaccctcctcaaaccgataacgctacctcgctaacgttcccaacgcgcaaccaaccgaataccaaccgacgacattaacactaccaacataaaacgcccgcgaacctccgactaaaacaactaccgaaaaccgaaaatatcccgaacgccgaaactacgaaaaaaccgaaaattccccaaaaccgaaaatatcccgaaaccgaaaacccgcgaaaccctaaaacgcgcgaaaccgaaaaaaacgaacgaccaataaaaatccgcaaaatttaaacgccaaacgaaacgacaaaacttaaaattccgaataaaacgtaaatcccacaaccgcttaaaatttacctcccgactccgctctaaaaactaaaaaaaaacacgaaaaccgaaaacgaaaacctaaaaacaaaaaaaccaataaccgaccgaaaaaacgcgcgaccgctccaatcgaaaaaaaccgttacaaccctacccgacgtataacgaaatcaacgaaacccctacgatacttcgcccgcgccttccgctccgcactcacccgccctctaaacctcccacaaatcgacgccgccaacgacgaataccgacccgcaaaaaaaaaacgaactataaactaacaacacatcgcgttcccgcgaaacccccattctacccaaacaaaaaacgactaaaataaaactaaaatcgatccgcgaacgcga

SEQ ID NO: 8775 - DNA, 801 bp, Artificial Sequence
  chemically treated genomic DNA (Homo sapiens) CpG-island No: 8775
agtagggagtttcgtttggtttttgagggaattttcggcgggtttttttaaaatatgttcgttttttttcgttaattttaggggttaagaattgaatttttattttttttaagtcggtggcgttgtttcgttggcgtttttagcgcgtagttaatcggatgttagtcggcggtattagtattgttagtatggggcgttcgcggattttcgattgaggtagttgtcgggagtcggaagtgtttcgggcgtcgggattgcgagggggtcgggagttttttaagatcggaagtgtttcgaggtcgggagttcgcgggattttggagcgcgcggggtcggaagaggcgggcggttagtggaggttcgtagagtttgggcgttaggcgagacggtagggtttaaagtttcgggtgaggcgtgggttttataatcgtttggaatttgtttttcggtttcgttttggaagttaagaaggggtacgagagtcggagacgggaatttgagagtagggaagttagtagtcggtcggaggagcgcgcggtcgttttagtcggaaggagtcgttgtagttttgttcggcgtgtggcggggttagcgaggtttttgcggtgtttcgttcgcgtttttcgtttcgtatttattcgttttttgggttttttataggtcggcgtcgttagcggcgggtatcggttcgtagagggagggcgggttgtgaattggtagtatatcgcgttttcgcggggtttttattttgtttaggtagggagcggttgggatgggattgaggtcggttcgcgagcgcgg

SEQ ID NO: 8776 - DNA, 801 bp, Artificial Sequence
  chemically treated genomic DNA (Homo sapiens) CpG-island No: 8776
ccgcgctcgcgaaccgacctcaatcccatcccaaccgctccctacctaaacaaaataaaaaccccgcgaaaacgcgatatactaccaattcacaacccgccctccctctacgaaccgatacccgccgctaacgacgccgacctataaaaaacccaaaaaacgaataaatacgaaacgaaaaacgcgaacgaaacaccgcaaaaacctcgctaaccccgccacacgccgaacaaaactacaacgactccttccgactaaaacgaccgcgcgctcctccgaccgactactaacttccctactctcaaattcccgtctccgactctcgtaccccttcttaacttccaaaacgaaaccgaaaaacaaattccaaacgattataaaacccacgcctcacccgaaactttaaaccctaccgtctcgcctaacgcccaaactctacgaacctccactaaccgcccgcctcttccgaccccgcgcgctccaaaatcccgcgaactcccgacctcgaaacacttccgatcttaaaaaactcccgaccccctcgcaatcccgacgcccgaaacacttccgactcccgacaactacctcaatcgaaaatccgcgaacgccccatactaacaatactaataccgccgactaacatccgattaactacgcgctaaaaacgccaacgaaacaacgccaccgacttaaaaaaaataaaaattcaattcttaacccctaaaattaacgaaaaaaaacgaacatattttaaaaaaacccgccgaaaattccctcaaaaaccaaacgaaactccctact

SEQ ID NO: 8777 - DNA, 732 bp, Artificial Sequence
  chemically treated genomic DNA (Homo sapiens) CpG-island No: 8777
tttttattcgttaagttggggtcggacgcgttgaggttttcggcgtttcggcgcgagtgatagcgtcgttttcgtttcggaggtagtgttggggggaagttcgtttttcggttttttcgggtcgtttttgttcgcgtcgttttcgtcggttttttattcggaattttttttttttgttcgttttgatttcggcgtttagttgtcgtagtgtgtgcgtgaattcgcggaagagtaggtattttcggattagttcgttagtgcgttttacggttttcgttatcgtagcgttagcgtttttaggggtggtgcggtgagggacggaggggcggggtttgggagaaatggggcggggtcggacgcgggcgtcgagtacgttacgtcgcgataggtttattagttcgtacgtatcgggcgattagtttgaggtttcgtttttcggtcggtttttcgttcgaggtttcgtttttgagttagttttagttcgtttggtcgttcgagttatttttatttttttcgaggagtggcgaggggaggttttggcggcgtcggcggcggttttgtttgaattattgaaagtggcggttgttatttacgttaaataagattggattttaagaatattttaggtagtttcgaggcgggtagggggtgcggcgttttgttggttggcgttatatcgtagagttttcggttttttgttttttttttatacggaggaagttggagttttaa

SEQ ID NO: 8778 - DNA, 732 bp, Artificial Sequence
  chemically treated genomic DNA (Homo sapiens) CpG-island No: 8778
ttaaaactccaacttcctccgtataaaaaaaaaacaaaaaaccgaaaactctacgatataacgccaaccaacaaaacgccgcaccccctacccgcctcgaaactacctaaaatattcttaaaatccaatcttatttaacgtaaataacaaccgccactttcaataattcaaacaaaaccgccgccgacgccgccaaaacctcccctcgccactcctcgaaaaaaataaaaataactcgaacgaccaaacgaactaaaactaactcaaaaacgaaacctcgaacgaaaaaccgaccgaaaaacgaaacctcaaactaatcgcccgatacgtacgaactaataaacctatcgcgacgtaacgtactcgacgcccgcgtccgaccccgccccatttctcccaaaccccgcccctccgtccctcaccgcaccacccctaaaaacgctaacgctacgataacgaaaaccgtaaaacgcactaacgaactaatccgaaaatacctactcttccgcgaattcacgcacacactacgacaactaaacgccgaaatcaaaacgaacaaaaaaaaaaaattccgaataaaaaaccgacgaaaacgacgcgaacaaaaacgacccgaaaaaaccgaaaaacgaacttccccccaacactacctccgaaacgaaaacgacgctatcactcgcgccgaaacgccgaaaacctcaacgcgtccgaccccaacttaacgaataaaaa

SEQ ID NO: 8779 - DNA, 732 bp, Artificial Sequence
  chemically treated genomic DNA (Homo sapiens) CpG-island No: 8779
ttagggttttagtttttttcgtgtaggaggagggtaggggatcgggagttttgcgatgtaacgttaattaatagggcgtcgtattttttgttcgtttcgggattatttgggatgtttttaagatttagttttgtttgacgtgggtggtagtcgttatttttagtaatttagataaagtcgtcgtcggcgtcgttaggattttttttcgttatttttcgggaggggtaagggtgattcgagcggttaggcgggttggggttggtttaggggcggggtttcgggcggggagtcggtcgaggggcggggttttaggttggtcgttcggtgcgtgcgggttggtaggtttgtcgcggcgtgacgtgttcggcgttcgcgttcggtttcgttttattttttttaggtttcgttttttcgttttttatcgtattatttttaaagacgttagcgttgcgatggcggaggtcgtggagcgtattgacgagttggttcgggagtatttgttttttcgcgggtttacgtatatattgcggtagttggacgtcgagattaaggcggataaggagaaggggtttcgggtgagaggtcggcgggagcggcgcgggtagaggcggttcgagggagtcggggagcgggtttttttttagtattgttttcggggcgagagcggcgttgttattcgcgtcggggcgtcggagattttagcgcgttcgattttagtttgacggatgagga

SEQ ID NO: 8780 - DNA, 732 bp, Artificial Sequence
  chemically treated genomic DNA (Homo sapiens) CpG-island No: 8780
tcctcatccgtcaaactaaaatcgaacgcgctaaaatctccgacgccccgacgcgaataacaacgccgctctcgccccgaaaacaatactaaaaaaaaacccgctccccgactccctcgaaccgcctctacccgcgccgctcccgccgacctctcacccgaaaccccttctccttatccgccttaatctcgacgtccaactaccgcaatatatacgtaaacccgcgaaaaaacaaatactcccgaaccaactcgtcaatacgctccacgacctccgccatcgcaacgctaacgtctttaaaaataatacgataaaaaacgaaaaaacgaaacctaaaaaaaataaaacgaaaccgaacgcgaacgccgaacacgtcacgccgcgacaaacctaccaacccgcacgcaccgaacgaccaacctaaaaccccgcccctcgaccgactccccgcccgaaaccccgcccctaaaccaaccccaacccgcctaaccgctcgaatcacccttacccctcccgaaaaataacgaaaaaaaatcctaacgacgccgacgacgactttatctaaattactaaaaataacgactaccacccacgtcaaacaaaactaaatcttaaaaacatcccaaataatcccgaaacgaacaaaaaatacgacgccctattaattaacgttacatcgcaaaactcccgatcccctaccctcctcctacacgaaaaaaactaaaaccctaa

SEQ ID NO: 8781 - DNA, 502 bp, Artificial Sequence
  chemically treated genomic DNA (Homo sapiens) CpG-island No: 8781
cgaggcggtgggaagtgggttgcgtcgagtatatgttttaggcggtgggtagtgcgggttatgcgtaggttaggcggggggcgggggtagttagtttcggggttgattatcgcgggaataacgggatggtttagttcggcgtaattgttgatcgcgagagaattaatttagcgttgggggttaaaggttgtgatttgttttaggatttggattaagtgtcgtttgttgcggtttgggaacggtttatatagcgcgtcgttgggattgtgtagtattaatttcggttaagtgggaggaaaatatggacgtggaggtggtcggttgtttgtgaaggttgggtgtgggcgggagtggtggtgacgttggtggaggttgcgggagagttttgtgcgtaatgtttgtatcggaagtatcgtgggcgataaaaaggggggaggattaagatataaaggggggagagaggttacggggagttagtgttttagaggaggtatagaaaagg

SEQ ID NO: 8782 - DNA, 502 bp, Artificial Sequence
  chemically treated genomic DNA (Homo sapiens) CpG-island No: 8782
ccttttctatacctcctctaaaacactaactccccgtaacctctctcccccctttatatcttaatcctcccccctttttatcgcccacgatacttccgatacaaacattacgcacaaaactctcccgcaacctccaccaacgtcaccaccactcccgcccacacccaaccttcacaaacaaccgaccacctccacgtccatattttcctcccacttaaccgaaattaatactacacaatcccaacgacgcgctatataaaccgttcccaaaccgcaacaaacgacacttaatccaaatcctaaaacaaatcacaacctttaacccccaacgctaaattaattctctcgcgatcaacaattacgccgaactaaaccatcccgttattcccgcgataatcaaccccgaaactaactacccccgccccccgcctaacctacgcataacccgcactacccaccgcctaaaacatatactcgacgcaacccacttcccaccgcctcg

SEQ ID NO: 8783 - DNA, 502 bp, Artificial Sequence
  chemically treated genomic DNA (Homo sapiens) CpG-island No: 8783
ttttttttatgttttttttggggtattaatttttcgtaattttttttttttttttgtattttagtttttttttttttttgtcgtttacggtattttcggtataagtattacgtataaagttttttcgtagtttttattagcgttattattattttcgtttatatttaatttttataagtagtcggttatttttacgtttatattttttttttatttaatcggggttaatgttatataattttagcggcgcgttatataagtcgtttttaagtcgtagtaaacggtatttagtttaagttttaaagtaggttatagtttttaatttttaacgttaggttagttttttcgcggttagtagttgcgtcgggttaaattatttcgttgttttcgcggtaattaatttcggggttggttgttttcgtttttcgtttggtttacgtatggttcgtattatttatcgtttggggtatatgttcggcgtaatttattttttatcgtttcg

SEQ ID NO: 8784 - DNA, 502 bp, Artificial Sequence
  chemically treated genomic DNA (Homo sapiens) CpG-island No: 8784
cgaaacgataaaaaataaattacgccgaacatataccccaaacgataaataatacgaaccatacgtaaaccaaacgaaaaacgaaaacaaccaaccccgaaattaattaccgcgaaaacaacgaaataatttaacccgacgcaactactaaccgcgaaaaaactaacctaacgttaaaaattaaaaactataacctactttaaaacttaaactaaataccgtttactacgacttaaaaacgacttatataacgcgccgctaaaattatataacattaaccccgattaaataaaaaaaaaatataaacgtaaaaataaccgactacttataaaaattaaatataaacgaaaataataataacgctaataaaaactacgaaaaaactttatacgtaatacttataccgaaaataccgtaaacgacaaaaaaaaaaaaaaactaaaatacaaaaaaaaaaaaaaaattacgaaaaattaataccccaaaaaaaacataaaaaaaa

SEQ ID NO: 8785 - DNA, 656 bp, Artificial Sequence
  chemically treated genomic DNA (Homo sapiens) CpG-island No: 8785
  misc_feature (572)..(572): n is either a, c, g or t
attggcggtatttgtttaagtttttacgattggtattgcgatttgttttttgcgttttcgtaaatttggggcgagtaaattgacgtatcggaatttgttgattggtataattttagttatattatcgtttgggggttaaacgtgtcgtagacgcgtatttcggatgtttatttttttattgaagtgcgttataaagggattaaaattgttgtcgttatattagattacgttgaaatcgttaaattgtgcgatttgtggttggtatcgaaatagggtatcgatgcggtaatggcgttggcgatgggttacgtagttttgcgtgaattttatttcgataatttaagttagtattttatttattatgtgcgtcgttatatcgatatgtcgatgttggtgatgttggaagaacgcgacggttattacgttgtaggtcgtatgttgcgcgttgttgatttggttgatgcgttgggttaggaaaataattcggaatggaaaattgtcgtttttaatattaatggcgatatggttgcgtcgaacggttttattggttttcgttggggcgagaagggtanatggtattttgagtagttagcggtaatattggcgaagaaatcgagttgtaattgatttgttgggtagttaggatgagatcgttg

SEQ ID NO: 8786 - DNA, 656 bp, Artificial Sequence
  chemically treated genomic DNA (Homo sapiens) CpG-island No: 8786
  misc_feature (85)..(85): n is either a, c, g or t
caacgatctcatcctaactacccaacaaatcaattacaactcgatttcttcgccaatattaccgctaactactcaaaataccatntacccttctcgccccaacgaaaaccaataaaaccgttcgacgcaaccatatcgccattaatattaaaaacgacaattttccattccgaattattttcctaacccaacgcatcaaccaaatcaacaacgcgcaacatacgacctacaacgtaataaccgtcgcgttcttccaacatcaccaacatcgacatatcgatataacgacgcacataataaataaaatactaacttaaattatcgaaataaaattcacgcaaaactacgtaacccatcgccaacgccattaccgcatcgataccctatttcgataccaaccacaaatcgcacaatttaacgatttcaacgtaatctaatataacgacaacaattttaatccctttataacgcacttcaataaaaaaataaacatccgaaatacgcgtctacgacacgtttaacccccaaacgataatataactaaaattataccaatcaacaaattccgatacgtcaatttactcgccccaaatttacgaaaacgcaaaaaacaaatcgcaataccaatcgtaaaaacttaaacaaataccgccaat

SEQ ID NO: 8787 - DNA, 656 bp, Artificial Sequence
  chemically treated genomic DNA (Homo sapiens) CpG-island No: 8787
  misc_feature (85)..(85): n is either a, c, g or t
tagcgattttattttggttatttagtagattagttgtagttcggttttttcgttagtattgtcgttggttgtttaagatgttatntgtttttttcgttttagcggaagttaatagaatcgttcggcgtaattatgtcgttattggtattaaaggcgatagttttttatttcggattgtttttttggtttagcgtattaattagattagtagcgcgtagtatacgatttgtagcgtagtaatcgtcgcgtttttttagtattattagtatcggtatgtcggtgtagcgacgtatatagtgggtgaaatattggtttgggttgtcgaggtggaatttacgtagaattacgtggtttatcgttagcgttattgtcgtatcggtgttttgtttcggtgttagttatagatcgtatagtttggcgattttagcgtagtttggtgtgacggtaatagttttggtttttttgtaacgtattttagtaaagaagtgagtattcggggtacgcgtttgcggtacgtttgatttttaggcgatgatgtagttggagttgtattagttagtagatttcggtacgttagtttgttcgttttaggtttgcggagacgtaggaggtaagtcgtagtattagtcgtagaagtttaagtaagtatcgttaat

SEQ ID NO: 8788 - DNA, 656 bp, Artificial Sequence
  chemically treated genomic DNA (Homo sapiens) CpG-island No: 8788
  misc_feature (572)..(572): n is either a, c, g or t
attaacgatacttacttaaacttctacgactaatactacgacttacctcctacgtctccgcaaacctaaaacgaacaaactaacgtaccgaaatctactaactaatacaactccaactacatcatcgcctaaaaatcaaacgtaccgcaaacgcgtaccccgaatactcacttctttactaaaatacgttacaaaaaaaccaaaactattaccgtcacaccaaactacgctaaaatcgccaaactatacgatctataactaacaccgaaacaaaacaccgatacgacaataacgctaacgataaaccacgtaattctacgtaaattccacctcgacaacccaaaccaatatttcacccactatatacgtcgctacaccgacataccgatactaataatactaaaaaaacgcgacgattactacgctacaaatcgtatactacgcgctactaatctaattaatacgctaaaccaaaaaaacaatccgaaataaaaaactatcgcctttaataccaataacgacataattacgccgaacgattctattaacttccgctaaaacgaaaaaaacanataacatcttaaacaaccaacgacaatactaacgaaaaaaccgaactacaactaatctactaaataaccaaaataaaatcgcta

SEQ ID NO: 8789 - DNA, 543 bp, Artificial Sequence
  chemically treated genomic DNA (Homo sapiens) CpG-island No: 8789
ttagtaatttatggcgttatgttcgcgcggtaacggtaatagaaattagttagtatggtaattttggtttttgtttcgttaagtcggataataatggcggtgttgtgatttcgtttcgaaagatatgtttttcgagttgatgaaatttcggtcggaaaacgcggtaagaatgcggatattaagcgtatattcgataaagagggtgagtagatgttggcggtcgtaggtaaaaatcgtatgttattttcgatattttaggtaagttttgggatacgtcgtagttagtcgttgagttggaacgttggaagttggatggtcgcgacgttagtttattgattggcgggtttgaagggttgtcgtttgtttgtaaagcggcggttgagtagagttggtcgttgtcggcgtttatttttttttattcgttggttcgcgtgttggtcgtagagagtttgtatcgggcgtggagtattattattaattatttttattatcgtgagtgataagggagttttgagtagaaaacgtagcggatgaaattataga

SEQ ID NO: 8790 - DNA, 543 bp, Artificial Sequence
  chemically treated genomic DNA (Homo sapiens) CpG-island No: 8790
tctataatttcatccgctacgttttctactcaaaactcccttatcactcacgataataaaaataattaataataatactccacgcccgatacaaactctctacgaccaacacgcgaaccaacgaataaaaaaaaataaacgccgacaacgaccaactctactcaaccgccgctttacaaacaaacgacaacccttcaaacccgccaatcaataaactaacgtcgcgaccatccaacttccaacgttccaactcaacgactaactacgacgtatcccaaaacttacctaaaatatcgaaaataacatacgatttttacctacgaccgccaacatctactcaccctctttatcgaatatacgcttaatatccgcattcttaccgcgttttccgaccgaaatttcatcaactcgaaaaacatatctttcgaaacgaaatcacaacaccgccattattatccgacttaacgaaacaaaaaccaaaattaccatactaactaatttctattaccgttaccgcgcgaacataacgccataaattactaa

SEQ ID NO: 8791 - DNA, 543 bp, Artificial Sequence
  chemically treated genomic DNA (Homo sapiens) CpG-island No: 8791
tttgtagttttattcgttgcgttttttatttaaagtttttttattatttacggtgataaggatggttggtggtgatgttttacgttcggtatagattttttgcgattagtacgcgaattagcggatgggggagggtaagcgtcgatagcgattagttttgtttagtcgtcgttttataggtaggcgataattttttaggttcgttaattagtagattgacgtcgcgattatttagtttttagcgttttagtttagcggttaattgcggcgtattttagggtttgtttggaatatcgagggtgatatgcggtttttgtttgcggtcgttaatatttgtttattttttttgtcgagtatgcgtttgatgttcgtatttttgtcgcgtttttcggtcggaattttattagttcgaagggtatatttttcggaacggagttatagtatcgttattattattcggtttaacggaataggagttagggttattatattggttgatttttgttgtcgttgtcgcgcgaatataacgttatgggttattgg

SEQ ID NO: 8792 - DNA, 543 bp, Artificial Sequence
  chemically treated genomic DNA (Homo sapiens) CpG-island No: 8792
ccaataacccataacgttatattcgcgcgacaacgacaacaaaaatcaaccaatataataaccctaactcctattccgttaaaccgaataataataacgatactataactccgttccgaaaaatatacccttcgaactaataaaattccgaccgaaaaacgcgacaaaaatacgaacatcaaacgcatactcgacaaaaaaaataaacaaatattaacgaccgcaaacaaaaaccgcatatcaccctcgatattccaaacaaaccctaaaatacgccgcaattaaccgctaaactaaaacgctaaaaactaaataatcgcgacgtcaatctactaattaacgaacctaaaaaattatcgcctacctataaaacgacgactaaacaaaactaatcgctatcgacgcttaccctcccccatccgctaattcgcgtactaatcgcaaaaaatctataccgaacgtaaaacatcaccaccaaccatccttatcaccgtaaataataaaaaaactttaaataaaaaacgcaacgaataaaactacaaa

SEQ ID NO: 8793 - DNA, 500 bp, Artificial Sequence
  chemically treated genomic DNA (Homo sapiens) CpG-island No: 8793
cgttaagaaagatgcgatggtgtcgatgggcggtttgttgtgtatgaaagacgatagtttttttgatgtgtatatcgagtgtagaattttttgcgtggtgtaggaaggtttttcgatatatggcggtttggaaggaagcgcgatggattttttggcggtaggtttgtatgacggtatgaatttcgattggttggtttatttttacgcgtaggtatagtatttggtcgatggtttggaagagattggcgttgtttgttagtaggcgggcggttacgtcgtattcgttgatgtcggtaaattgttgtcgtatatttcggtagattagttttcggtataggcgttggtttgcgagttgtataaagtcgtcggtattcgtgcggtagaaattggtttttttttgttaggtcgcgattcgaaaatcggtaaataattgttatgttcggttgaattgttgcgtttaattatttcgcgcgtaatatatatttaaatatatatggatt

SEQ ID NO: 8794 - DNA, 500 bp, Artificial Sequence
  chemically treated genomic DNA (Homo sapiens) CpG-island No: 8794
aatccatatatatttaaatatatattacgcgcgaaataattaaacgcaacaattcaaccgaacataacaattatttaccgattttcgaatcgcgacctaacaaaaaaaaaccaatttctaccgcacgaataccgacgactttatacaactcgcaaaccaacgcctataccgaaaactaatctaccgaaatatacgacaacaatttaccgacatcaacgaatacgacgtaaccgcccgcctactaacaaacaacgccaatctcttccaaaccatcgaccaaatactatacctacgcgtaaaaataaaccaaccaatcgaaattcataccgtcatacaaacctaccgccaaaaaatccatcgcgcttccttccaaaccgccatatatcgaaaaaccttcctacaccacgcaaaaaattctacactcgatatacacatcaaaaaaactatcgtctttcatacacaacaaaccgcccatcgacaccatcgcatctttcttaacg

SEQ ID NO: 8795 - DNA, 500 bp, Artificial Sequence
  chemically treated genomic DNA (Homo sapiens) CpG-island No: 8795
agtttatatgtgtttgagtatatgttgcgcgcggaatggttaaacgtagtagtttagtcgggtatggtagttgtttatcggttttcggatcgcggtttaataggaaagagttaatttttatcgtacggatatcggcgattttatatagttcgtaggttagcgtttgtgtcgggaattggtttgtcgggatatgcggtaatagtttatcggtattaacgaatgcggcgtgatcgttcgtttgttggtagataacgttaattttttttagattatcgattagatattgtatttgcgcgtagagataagttagttagtcgagatttatgtcgttatatagatttatcgttagaaaatttatcgcgtttttttttaggtcgttatatgtcgggaagtttttttgtattacgtaaagggttttgtattcggtgtatatattaaagaagttgtcgttttttatgtatagtaggtcgtttatcggtattatcgtattttttttggcg

SEQ ID NO: 8796 - DNA, 500 bp, Artificial Sequence
  chemically treated genomic DNA (Homo sapiens) CpG-island No: 8796
cgccaaaaaaaatacgataataccgataaacgacctactatacataaaaaacgacaacttctttaatatatacaccgaatacaaaaccctttacgtaatacaaaaaaacttcccgacatataacgacctaaaaaaaaacgcgataaattttctaacgataaatctatataacgacataaatctcgactaactaacttatctctacgcgcaaatacaatatctaatcgataatctaaaaaaaattaacgttatctaccaacaaacgaacgatcacgccgcattcgttaataccgataaactattaccgcatatcccgacaaaccaattcccgacacaaacgctaacctacgaactatataaaatcgccgatatccgtacgataaaaattaactctttcctattaaaccgcgatccgaaaaccgataaacaactaccatacccgactaaactactacgtttaaccattccgcgcgcaacatatactcaaacacatataaact

SEQ ID NO: 8797 - DNA, 543 bp, Artificial Sequence
  chemically treated genomic DNA (Homo sapiens) CpG-island No: 8797
  misc_feature (79)..(79): n is either a, c, g or t
  misc_feature (161)..(161): n is either a, c, g or t
ttttggacgcgtttcgagggggttgtttatattcgcgcgcgggttttttcggggttcggcgggaggtttcgggagaggnaggtcgagggaattataggtttttgtgtcgcgtgtagtagtagttggcggcgtgaggattatatcggcgttagagtcgtttntttaaggttcggagatttttatttcgaatttttttttcgcgtttggttgtatcgggttgggtttttttcgcggatattcggggtttcggtcgggcgtttatttattcggagcgggattacgcgcgggtttcgtttgtagcgcggtgttcgcggggggcggttaggtcgagcggtatcgtttcgtatcggggcgcgggtcgggttcgggtgtaaacgcgcgtttcgtgtttttttcgtcgttcgcggggttttcgcgtttcgttatcggtttcgtttcgcgtcgcgtttttcgtttatgtagggttagattacgcgggtttgggggcgtaagcggattttttttcggttttggacgtcgggggtttttgtttcgttttttggg

SEQ ID NO: 8798 - DNA, 543 bp, Artificial Sequence
  chemically treated genomic DNA (Homo sapiens) CpG-island No: 8798
  misc_feature (383)..(383): n is either a, c, g or t
  misc_feature (465)..(465): n is either a, c, g or t
cccaaaaaacgaaacaaaaacccccgacgtccaaaaccgaaaaaaaatccgcttacgcccccaaacccgcgtaatctaaccctacataaacgaaaaacgcgacgcgaaacgaaaccgataacgaaacgcgaaaaccccgcgaacgacgaaaaaaacacgaaacgcgcgtttacacccgaacccgacccgcgccccgatacgaaacgataccgctcgacctaaccgccccccgcgaacaccgcgctacaaacgaaacccgcgcgtaatcccgctccgaataaataaacgcccgaccgaaaccccgaatatccgcgaaaaaaacccaacccgatacaaccaaacgcgaaaaaaaaattcgaaataaaaatctccgaaccttaaanaaacgactctaacgccgatataatcctcacgccgccaactactactacacgcgacacaaaaacctataattccctcgacctncctctcccgaaacctcccgccgaaccccgaaaaaacccgcgcgcgaatataaacaaccccctcgaaacgcgtccaaaa

SEQ ID NO: 8799 - DNA, 543 bp, Artificial Sequence
  chemically treated genomic DNA (Homo sapiens) CpG-island No: 8799
  misc_feature (383)..(383): n is either a, c, g or t
  misc_feature (465)..(465): n is either a, c, g or t
tttagggggcggagtagaagttttcggcgtttagggtcgggggagggttcgtttgcgtttttaggttcgcgtggtttggttttgtatgggcgggaggcgcggcgcggggcggggtcggtgacgggacgcggagatttcgcgggcggcgggaggggtacgaggcgcgcgtttgtattcgagttcggttcgcgtttcgatgcggagcgatgtcgttcggtttggtcgtttttcgcgagtatcgcgttgtagacgaagttcgcgcgtgatttcgtttcgggtaagtgggcgttcggtcggagtttcgggtgttcgcggggagagtttagttcggtgtagttagacgcggaagggaaattcggggtgaaagttttcggattttaggnagacggttttggcgtcggtgtggtttttacgtcgttagttgttgttgtacgcgatataaagatttgtggttttttcggtttntttttttcgggatttttcgtcgggtttcggggaagttcgcgcgcgggtgtggatagttttttcggagcgcgtttaggg

SEQ ID NO: 8800 - DNA, 543 bp, Artificial Sequence
  chemically treated genomic DNA (Homo sapiens) CpG-island No: 8800
  misc_feature (79)..(79): n is either a, c, g or t
  misc_feature (161)..(161): n is either a, c, g or t
ccctaaacgcgctccgaaaaaactatccacacccgcgcgcgaacttccccgaaacccgacgaaaaatcccgaaaaaaanaaaccgaaaaaaccacaaatctttatatcgcgtacaacaacaactaacgacgtaaaaaccacaccgacgccaaaaccgtctncctaaaatccgaaaactttcaccccgaatttcccttccgcgtctaactacaccgaactaaactctccccgcgaacacccgaaactccgaccgaacgcccacttacccgaaacgaaatcacgcgcgaacttcgtctacaacgcgatactcgcgaaaaacgaccaaaccgaacgacatcgctccgcatcgaaacgcgaaccgaactcgaatacaaacgcgcgcctcgtacccctcccgccgcccgcgaaatctccgcgtcccgtcaccgaccccgccccgcgccgcgcctcccgcccatacaaaaccaaaccacgcgaacctaaaaacgcaaacgaaccctcccccgaccctaaacgccgaaaacttctactccgccccctaaa

SEQ ID NO: 8801 - DNA, 1006 bp, Artificial Sequence
  chemically treated genomic DNA (Homo sapiens) CpG-island No: 8801
  misc_feature (131)..(132): n is either a, c, g or t
  misc_feature (135)..(136): n is either a, c, g or t
  misc_feature (138)..(139): n is either a, c, g or t
  misc_feature (149)..(151): n is either a, c, g or t
  misc_feature (161)..(161): n is either a, c, g or t
  misc_feature (170)..(170): n is either a, c, g or t
  misc_feature (189)..(189): n is either a, c, g or t
  misc_feature (192)..(192): n is either a, c, g or t
  misc_feature (198)..(198): n is either a, c, g or t
  misc_feature (201)..(201): n is either a, c, g or t
  misc_feature (212)..(212): n is either a, c, g or t
  misc_feature (218)..(218): n is either a, c, g or t
  misc_feature (223)..(224): n is either a, c, g or t
  misc_feature (235)..(235): n is either a, c, g or t
  misc_feature (240)..(240): n is either a, c, g or t
  misc_feature (243)..(243): n is either a, c, g or t
  misc_feature (247)..(247): n is either a, c, g or t
  misc_feature (251)..(251): n is either a, c, g or t
  misc_feature (259)..(259): n is either a, c, g or t
  misc_feature (269)..(269): n is either a, c, g or t
  misc_feature (277)..(277): n is either a, c, g or t
  misc_feature (280)..(280): n is either a, c, g or t
  misc_feature (289)..(289): n is either a, c, g or t
  misc_feature (296)..(296): n is either a, c, g or t
  misc_feature (301)..(301): n is either a, c, g or t
  misc_feature (309)..(310): n is either a, c, g or t
  misc_feature (319)..(319): n is either a, c, g or t
  misc_feature (333)..(333): n is either a, c, g or t
  misc_feature (336)..(337): n is either a, c, g or t
  misc_feature (910)..(910): n is either a, c, g or t
  misc_feature (935)..(935): n is either a, c, g or t
cggtttttcgcgtttcggggcgttttttggcggtagcggtagtagcgggtaacgcgcggagggtttagggggcgtataggggattttcgggtatatttagagaggcgggcgcggttttcgggcgggggcgnnatnngnntagttatttnnnggggagcggnagtttcgtntttttttggttcggcgggnttntacggnttngttttattaangtattngcggnnttaagtagggntaggnaangttngttnttcggaancgcggcgttngtcgcgtntgnaagtcgaangttcgangtttnttttcggnntttcggcgnttttcgtcgtcgtncgnnttattattattatcgtcgtcgttatcgttatttcgggaatttagggttgcggtagttgttgtcgcggttgtcgtcgtcgattgattgttgtggtaaatgaggtacgagtagggtgtagagtcgtcgttggggggcgcgtcggtcgtcgtcgtcgaggaggtcgtagtcgttgcggttgtcgcggttgtcgcggtagaggtcgcgttgttgagtttcgcggcggtcgcgggagtttggtagagattagggtggcggaagttatatagtagtttcggtcgagagtaggggtgcgagagggcgtcgaacgtgtttagtggtcggatggaagtagcgaagggcgacgaagtcgcggtcgtcgcgtttgaggttgtagtcgcggttcgtcgttcgtcgtgacgtttacgtgcgggtagtagtgtagcggtacgtgcgagtggaaggggtagggtaggttttcggtggcggtcgcgtgcgttattatgtaggtgtagaagttggggtcggttgggtgcggttaggatatggttaggcgttgtcgtttgttttttatgcgtcggttttggaattatattntgcggggagagacgcgtcgtagttntgggttagggagcgtttcgtgtttttagtttttgttttaggatttttgtttttttcggatttttgaatggt

SEQ ID NO: 8802 - DNA, 1006 bp, Artificial Sequence
  chemically treated genomic DNA (Homo sapiens) CpG-island No: 8802
  misc_feature (72)..(72): n is either a, c, g or t
  misc_feature (97)..(97): n is either a, c, g or t
  misc_feature (670)..(671): n is either a, c, g or t
  misc_feature (674)..(674): n is either a, c, g or t
  misc_feature (688)..(688): n is either a, c, g or t
  misc_feature (697)..(698): n is either a, c, g or t
  misc_feature (706)..(706): n is either a, c, g or t
  misc_feature (711)..(711): n is either a, c, g or t
  misc_feature (718)..(718): n is either a, c, g or t
  misc_feature (727)..(727): n is either a, c, g or t
  misc_feature (730)..(730): n is either a, c, g or t
  misc_feature (738)..(738): n is either a, c, g or t
  misc_feature (748)..(748): n is either a, c, g or t
  misc_feature (756)..(756): n is either a, c, g or t
  misc_feature (760)..(760): n is either a, c, g or t
  misc_feature (764)..(764): n is either a, c, g or t
  misc_feature (767)..(767): n is either a, c, g or t
  misc_feature (772)..(772): n is either a, c, g or t
  misc_feature (783)..(784): n is either a, c, g or t
  misc_feature (789)..(789): n is either a, c, g or t
  misc_feature (795)..(795): n is either a, c, g or t
  misc_feature (806)..(806): n is either a, c, g or t
  misc_feature (809)..(809): n is either a, c, g or t
  misc_feature (815)..(815): n is either a, c, g or t
  misc_feature (818)..(818): n is either a, c, g or t
  misc_feature (837)..(837): n is either a, c, g or t
  misc_feature (846)..(846): n is either a, c, g or t
  misc_feature (856)..(858): n is either a, c, g or t
  misc_feature (868)..(869): n is either a, c, g or t
  misc_feature (871)..(872): n is either a, c, g or t
  misc_feature (875)..(876): n is either a, c, g or t
accattcaaaaatccgaaaaaaacaaaaatcctaaaacaaaaactaaaaacacgaaacgctccctaacccanaactacgacgcgtctctccccgcanaatataattccaaaaccgacgcataaaaaacaaacgacaacgcctaaccatatcctaaccgcacccaaccgaccccaacttctacacctacataataacgcacgcgaccgccaccgaaaacctaccctaccccttccactcgcacgtaccgctacactactacccgcacgtaaacgtcacgacgaacgacgaaccgcgactacaacctcaaacgcgacgaccgcgacttcgtcgcccttcgctacttccatccgaccactaaacacgttcgacgccctctcgcacccctactctcgaccgaaactactatataacttccgccaccctaatctctaccaaactcccgcgaccgccgcgaaactcaacaacgcgacctctaccgcgacaaccgcgacaaccgcaacgactacgacctcctcgacgacgacgaccgacgcgccccccaacgacgactctacaccctactcgtacctcatttaccacaacaatcaatcgacgacgacaaccgcgacaacaactaccgcaaccctaaattcccgaaataacgataacgacgacgataataataataanncgnacgacgacgaaaancgccgaaannccgaaaanaaacntcgaacnttcgacttncanacgcgacnaacgccgcgnttccgaanaacnaacnttncctanccctacttaannccgcnaatacnttaataaaacnaanccgtanaancccgccgaaccaaaaaaanacgaaactnccgctccccnnnaaataactanncnnatnncgcccccgcccgaaaaccgcgcccgcctctctaaatatacccgaaaatcccctatacgccccctaaaccctccgcgcgttacccgctactaccgctaccgccaaaaaacgccccgaaacgcgaaaaaccg

SEQ ID NO: 8803 - DNA, 1006 bp, Artificial Sequence
  chemically treated genomic DNA (Homo sapiens) CpG-island No: 8803
  misc_feature (72)..(72): n is either a, c, g or t
  misc_feature (97)..(97): n is either a, c, g or t
  misc_feature (670)..(671): n is either a, c, g or t
  misc_feature (674)..(674): n is either a, c, g or t
  misc_feature (688)..(688): n is either a, c, g or t
  misc_feature (697)..(698): n is either a, c, g or t
  misc_feature (706)..(706): n is either a, c, g or t
  misc_feature (711)..(711): n is either a, c, g or t
  misc_feature (718)..(718): n is either a, c, g or t
  misc_feature (727)..(727): n is either a, c, g or t
  misc_feature (730)..(730): n is either a, c, g or t
  misc_feature (738)..(738): n is either a, c, g or t
  misc_feature (748)..(748): n is either a, c, g or t
  misc_feature (756)..(756): n is either a, c, g or t
  misc_feature (760)..(760): n is either a, c, g or t
  misc_feature (764)..(764): n is either a, c, g or t
  misc_feature (767)..(767): n is either a, c, g or t
  misc_feature (772)..(772): n is either a, c, g or t
  misc_feature (783)..(784): n is either a, c, g or t
  misc_feature (789)..(789): n is either a, c, g or t
  misc_feature (795)..(795): n is either a, c, g or t
  misc_feature (806)..(806): n is either a, c, g or t
  misc_feature (809)..(809): n is either a, c, g or t
  misc_feature (815)..(815): n is either a, c, g or t
  misc_feature (818)..(818): n is either a, c, g or t
  misc_feature (837)..(837): n is either a, c, g or t
  misc_feature (846)..(846): n is either a, c, g or t
  misc_feature (856)..(858): n is either a, c, g or t
  misc_feature (868)..(869): n is either a, c, g or t
  misc_feature (871)..(872): n is either a, c, g or t
  misc_feature (875)..(876): n is either a, c, g or t
gttatttagaggttcggaaggggtagaggttttgggataggagttgggaatacggggcgttttttaatttanggttgcggcgcgttttttttcgtanggtgtggttttagaatcggcgtatgaaggataagcggtagcgtttggttatgttttggtcgtatttagtcgattttagtttttatatttatatgatgacgtacgcggtcgttatcggaagtttgttttattttttttattcgtacgtgtcgttgtattattattcgtacgtgggcgttacggcgggcggcgggtcgcggttgtagttttaggcgcggcggtcgcggtttcgtcgtttttcgttatttttattcggttattggatacgttcggcgttttttcgtatttttattttcggtcggagttgttgtgtagttttcgttattttggtttttattaggttttcgcggtcgtcgcggggtttaatagcgcggtttttgtcgcggtagtcgcggtagtcgtagcggttgcggttttttcggcggcggcggtcggcgcgttttttagcggcggttttgtattttgttcgtgttttatttgttatagtagttagtcggcggcggtagtcgcggtagtagttgtcgtagttttgggttttcggggtggcggtggcggcggcggtggtggtggtggnncgngcggcggcgggggncgtcggggnntcgggggnaggtntcggatnttcggtttntangcgcggtnggcgtcgcgntttcgagnagtnggtnttntttgnttttatttggnntcgtnggtgtnttagtaagatnggntcgtgnagnttcgtcggattaagagggnacgaggttntcgttttttnnnagataattanntnngtnncgttttcgttcgggggtcgcgttcgtttttttgagtgtgttcgggagttttttgtgcgttttttgagtttttcgcgcgttgttcgttgttgtcgttgtcgttagggggcgtttcggggcgcgggaggtcg

SEQ ID NO: 8804 - DNA, 1006 bp, Artificial Sequence
  chemically treated genomic DNA (Homo sapiens) CpG-island No: 8804
  misc_feature (131)..(132): n is either a, c, g or t
  misc_feature (135)..(136): n is either a, c, g or t
  misc_feature (138)..(139): n is either a, c, g or t
  misc_feature (149)..(151): n is either a, c, g or t
  misc_feature (161)..(161): n is either a, c, g or t
  misc_feature (170)..(170): n is either a, c, g or t
  misc_feature (189)..(189): n is either a, c, g or t
  misc_feature (192)..(192): n is either a, c, g or t
  misc_feature (198)..(198): n is either a, c, g or t
  misc_feature (201)..(201): n is either a, c, g or t
  misc_feature (212)..(212): n is either a, c, g or t
  misc_feature (218)..(218): n is either a, c, g or t
  misc_feature (223)..(224): n is either a, c, g or t
  misc_feature (235)..(235): n is either a, c, g or t
  misc_feature (240)..(240): n is either a, c, g or t
  misc_feature (243)..(243): n is either a, c, g or t
  misc_feature (247)..(247): n is either a, c, g or t
  misc_feature (251)..(251): n is either a, c, g or t
  misc_feature (259)..(259): n is either a, c, g or t
  misc_feature (269)..(269): n is either a, c, g or t
  misc_feature (277)..(277): n is either a, c, g or t
  misc_feature (280)..(280): n is either a, c, g or t
  misc_feature (289)..(289): n is either a, c, g or t
  misc_feature (296)..(296): n is either a, c, g or t
  misc_feature (301)..(301): n is either a, c, g or t
  misc_feature (309)..(310): n is either a, c, g or t
  misc_feature (319)..(319): n is either a, c, g or t
  misc_feature (333)..(333): n is either a, c, g or t
  misc_feature (336)..(337): n is either a, c, g or t
  misc_feature (910)..(910): n is either a, c, g or t
  misc_feature (935)..(935): n is either a, c, g or t
cgacctcccgcgccccgaaacgccccctaacgacaacgacaacaacgaacaacgcgcgaaaaactcaaaaaacgcacaaaaaactcccgaacacactcaaaaaaacgaacgcgacccccgaacgaaaacgnnacnnanntaattatctnnnaaaaaacganaacctcgtnccctcttaatccgacgaanctncacganccnatcttactaanacaccnacgannccaaataaaancaaanaanaccnactnctcgaaancgcgacgccnaccgcgcntanaaaccgaanatccganacctncccccgannccccgacgncccccgccgccgcncgnnccaccaccaccaccgccgccgccaccgccaccccgaaaacccaaaactacgacaactactaccgcgactaccgccgccgactaactactataacaaataaaacacgaacaaaatacaaaaccgccgctaaaaaacgcgccgaccgccgccgccgaaaaaaccgcaaccgctacgactaccgcgactaccgcgacaaaaaccgcgctattaaaccccgcgacgaccgcgaaaacctaataaaaaccaaaataacgaaaactacacaacaactccgaccgaaaataaaaatacgaaaaaacgccgaacgtatccaataaccgaataaaaataacgaaaaacgacgaaaccgcgaccgccgcgcctaaaactacaaccgcgacccgccgcccgccgtaacgcccacgtacgaataataatacaacgacacgtacgaataaaaaaaataaaacaaacttccgataacgaccgcgtacgtcatcatataaatataaaaactaaaatcgactaaatacgaccaaaacataaccaaacgctaccgcttatccttcatacgccgattctaaaaccacaccntacgaaaaaaaacgcgccgcaaccntaaattaaaaaacgccccgtattcccaactcctatcccaaaacctctaccccttccgaacctctaaataac

SEQ ID NO: 8805 - DNA, 755 bp, Artificial Sequence
  chemically treated genomic DNA (Homo sapiens) CpG-island No: 8805
  misc_feature (152)..(152): n is either a, c, g or t
  misc_feature (229)..(229): n is either a, c, g or t
  misc_feature (474)..(474): n is either a, c, g or t
  misc_feature (592)..(592): n is either a, c, g or t
attcgtattttcgcggtttcggggtatacggagtttttggtagtgcgtttttatgggttttttttaaggtcggcggaggtatttcgggtcgggcgcggcgtttcgttcgtcggtcgtagcgattgaattgcgcgcggattttttcgcggggntttttcgttttcgttacgttgatttttcgtgtagtgttgtggtgcgaaaatgtttcgtcggtgcgtatcgggtcggntagtttcggcggcgggggcgagattggcgggaggggggcgcggggggggcgcggtaagaggtggcggcgggtagagggtgtttttttttttttttttttagagtcggggtttgtaaatcgaggttagagtgttttcgtgggtcgagcgtattttttttttgttcgggtgcgtttagttattggtgtttgagaggaaatagtggaggtagcggggtaggtcgtttggggcgtcggcgattatattngcggtcgagtcggggcgcgtcgggaaaggtcgggagggcggcggcgcgcgggggttgggcgaagtttcgcgattcgcgagggaggtcgcgcgaagtcgatgcggcgggtcgtaagagntcgggtatgatttttttagtagtagatttttcgcggtcgtcggttcgtagaagtaatttataagttttcggcggaaagattaaaaataattttttttcgaaattcggaggagagaaatcgttttatagtttttaaggtattttcgaaaaatgtagggtagtat

SEQ ID NO: 8806 - DNA, 755 bp, Artificial Sequence
  chemically treated genomic DNA (Homo sapiens) CpG-island No: 8806
  misc_feature (164)..(164): n is either a, c, g or t
  misc_feature (282)..(282): n is either a, c, g or t
  misc_feature (527)..(527): n is either a, c, g or t
  misc_feature (604)..(604): n is either a, c, g or t
atactaccctacatttttcgaaaataccttaaaaactataaaacgatttctctcctccgaatttcgaaaaaaaattatttttaatctttccgccgaaaacttataaattacttctacgaaccgacgaccgcgaaaaatctactactaaaaaaatcatacccganctcttacgacccgccgcatcgacttcgcgcgacctccctcgcgaatcgcgaaacttcgcccaacccccgcgcgccgccgccctcccgacctttcccgacgcgccccgactcgaccgcnaatataatcgccgacgccccaaacgacctaccccgctacctccactatttcctctcaaacaccaataactaaacgcacccgaacaaaaaaaaaatacgctcgacccacgaaaacactctaacctcgatttacaaaccccgactctaaaaaaaaaaaaaaaaaaacaccctctacccgccgccacctcttaccgcgccccccccgcgcccccctcccgccaatctcgcccccgccgccgaaactanccgacccgatacgcaccgacgaaacattttcgcaccacaacactacacgaaaaatcaacgtaacgaaaacgaaaaanccccgcgaaaaaatccgcgcgcaattcaatcgctacgaccgacgaacgaaacgccgcgcccgacccgaaatacctccgccgaccttaaaaaaaacccataaaaacgcactaccaaaaactccgtataccccgaaaccgcgaaaatacgaat

SEQ ID NO: 8807 - DNA, 755 bp, Artificial Sequence
  chemically treated genomic DNA (Homo sapiens) CpG-island No: 8807
  misc_feature (164)..(164): n is either a, c, g or t
  misc_feature (282)..(282): n is either a, c, g or t
  misc_feature (527)..(527): n is either a, c, g or t
  misc_feature (604)..(604): n is either a, c, g or t
gtgttgttttgtatttttcgggggtgttttgggggttgtggggcggtttttttttttcgggtttcgggggggggttgtttttaattttttcgtcgggggtttgtgggttgtttttgcgggtcggcggtcgcggggggtttgttattaggggggttatgttcggntttttgcggttcgtcgtatcggtttcgcgcggtttttttcgcgggtcgcggggtttcgtttagttttcgcgcgtcgtcgttttttcggtttttttcggcgcgtttcggttcggtcgtnaatataatcgtcgacgttttaggcgatttgtttcgttgtttttattgtttttttttaggtattagtgattgagcgtattcggataagaaaaaagtgcgttcggtttacggggatattttggtttcggtttataaatttcggttttggagggaaaagaaaaaaaatattttttgttcgtcgttattttttatcgcgtttttttcgcgtttttttttcgttaatttcgttttcgtcgtcgaggttgntcgattcggtgcgtatcggcgaggtattttcgtattatagtattgtacggaaagttagcgtgacggggacgaggagntttcgcggagggattcgcgcgtagtttagtcgttacggtcgacggacggagcgtcgcgttcggttcgagatgttttcgtcggttttaaagggggtttataaagacgtattgttaagggtttcgtgtgtttcggggtcgcgggaatgcggat

SEQ ID NO: 8808 - DNA, 755 bp, Artificial Sequence
  chemically treated genomic DNA (Homo sapiens) CpG-island No: 8808
  misc_feature (152)..(152): n is either a, c, g or t
  misc_feature (229)..(229): n is either a, c, g or t
  misc_feature (474)..(474): n is either a, c, g or t
  misc_feature (592)..(592): n is either a, c, g or t
atccgcattcccgcgaccccgaaacacacgaaacccttaacaatacgtctttataaaccccctttaaaaccgacgaaaacatctcgaaccgaacgcgacgctccgtccgtcgaccgtaacgactaaactacgcgcgaatccctccgcgaaanctcctcgtccccgtcacgctaactttccgtacaatactataatacgaaaatacctcgccgatacgcaccgaatcgancaacctcgacgacgaaaacgaaattaacgaaaaaaaaacgcgaaaaaaacgcgataaaaaataacgacgaacaaaaaatattttttttcttttccctccaaaaccgaaatttataaaccgaaaccaaaatatccccgtaaaccgaacgcacttttttcttatccgaatacgctcaatcactaatacctaaaaaaaaacaataaaaacaacgaaacaaatcgcctaaaacgtcgacgattatattnacgaccgaaccgaaacgcgccgaaaaaaaccgaaaaaacgacgacgcgcgaaaactaaacgaaaccccgcgacccgcgaaaaaaaccgcgcgaaaccgatacgacgaaccgcaaaaanccgaacataacccccctaataacaaaccccccgcgaccgccgacccgcaaaaacaacccacaaacccccgacgaaaaaattaaaaacaacccccccccgaaacccgaaaaaaaaaaaccgccccacaacccccaaaacacccccgaaaaatacaaaacaacac

SEQ ID NO: 8809 - DNA, 1005 bp, Artificial Sequence
  chemically treated genomic DNA (Homo sapiens) CpG-island No: 8809
  misc_feature (18)..(18): n is either a, c, g or t
  misc_feature (32)..(32): n is either a, c, g or t
  misc_feature (62)..(63): n is either a, c, g or t
  misc_feature (352)..(352): n is either a, c, g or t
  misc_feature (626)..(626): n is either a, c, g or t
  misc_feature (633)..(633): n is either a, c, g or t
  misc_feature (710)..(710): n is either a, c, g or t
tacgttttcggcgggggnttttcggggcgggnaggcggtttttcgatcggtttaggtttttnnttttaatttgaatttcgtttttataaacgtttcgcgatgagttaatttgttggagggtaggcgggtcggaggcgggaggtttatagagggagagagggttagaggaagagggcgggagcgagcgaattagagagaaaggagaggagggaggaggcgcgtcgcgttatggtgttttgcgcggggttagggttagggtcggggtcgggttaggtcgggttatgagtcgcgtcgggagttgggatatggacgggttgcgggtagacggcgggggcgtcggtggcgtttcggnttttttttttttttttatcggtggcggcggcggcggcgttaggttagtgtcgcggtttttttttcgcgtttgtgttcgtcgggacgtattcggggcgggcggcggcggcggtagcggcggttgcggcggcggcggcggtagttttcggttttgcgtatttcgggatttttgagcgtacgggttttttttcgtcgtcgtttttttttgtcgttgtagcggcgcgttcggaggtttttttagttaaagagtgtttagtatttacgtttgtagcggntcgttgntagcgttttcgagcgttttagcgttgggttacggttattatttcggtaacggttattatagttgtcgtatgtcgtancggcgtgggtttataatagaatgcgtttaagttaacgtcgaacgtttcgatgggaggttttttttcggagaatatatggacgtgttaggtttggcgagtagtagcgtatcggttaattaggtgttagcgcgatttaaggaggtatttttttattagggttatacgagtttttattagtacgtgttcggttatatcgatatggtgtttattttcggtttcggggagtttcggtacgaggtttatatttttatggaggggtattagttttggacgttggttaacgggtggaatagtt

SEQ ID NO: 8810 - DNA, 1005 bp, Artificial Sequence
  chemically treated genomic DNA (Homo sapiens) CpG-island No: 8810
  misc_feature (296)..(296): n is either a, c, g or t
  misc_feature (373)..(373): n is either a, c, g or t
  misc_feature (380)..(380): n is either a, c, g or t
  misc_feature (654)..(654): n is either a, c, g or t
  misc_feature (943)..(944): n is either a, c, g or t
  misc_feature (974)..(974): n is either a, c, g or t
  misc_feature (988)..(988): n is either a, c, g or t
aactattccacccgttaaccaacgtccaaaactaatacccctccataaaaatataaacctcgtaccgaaactccccgaaaccgaaaataaacaccatatcgatataaccgaacacgtactaataaaaactcgtataaccctaataaaaaaatacctccttaaatcgcgctaacacctaattaaccgatacgctactactcgccaaacctaacacgtccatatattctccgaaaaaaaacctcccatcgaaacgttcgacgttaacttaaacgcattctattataaacccacgccgntacgacatacgacaactataataaccgttaccgaaataataaccgtaacccaacgctaaaacgctcgaaaacgctancaacganccgctacaaacgtaaatactaaacactctttaactaaaaaaacctccgaacgcgccgctacaacgacaaaaaaaaacgacgacgaaaaaaaacccgtacgctcaaaaatcccgaaatacgcaaaaccgaaaactaccgccgccgccgccgcaaccgccgctaccgccgccgccgcccgccccgaatacgtcccgacgaacacaaacgcgaaaaaaaaaccgcgacactaacctaacgccgccgccgccgccaccgataaaaaaaaaaaaaaaanccgaaacgccaccgacgcccccgccgtctacccgcaacccgtccatatcccaactcccgacgcgactcataacccgacctaacccgaccccgaccctaaccctaaccccgcgcaaaacaccataacgcgacgcgcctcctccctcctctcctttctctctaattcgctcgctcccgccctcttcctctaaccctctctccctctataaacctcccgcctccgacccgcctaccctccaacaaattaactcatcgcgaaacgtttataaaaacgaaattcaaattaaaannaaaaacctaaaccgatcgaaaaaccgcctncccgccccgaaaancccccgccgaaaacgta

SEQ ID NO: 8811 - DNA, 1005 bp, Artificial Sequence
  chemically treated genomic DNA (Homo sapiens) CpG-island No: 8811
  misc_feature (296)..(296): n is either a, c, g or t
  misc_feature (373)..(373): n is either a, c, g or t
  misc_feature (380)..(380): n is either a, c, g or t
  misc_feature (654)..(654): n is either a, c, g or t
  misc_feature (943)..(944): n is either a, c, g or t
  misc_feature (974)..(974): n is either a, c, g or t
  misc_feature (988)..(988): n is either a, c, g or t
ggttgttttattcgttagttagcgtttaggattggtatttttttatggagatgtaggtttcgtgtcgaggtttttcggagtcgaaagtggatattatgtcgatatagtcgggtacgtgttggtaagggttcgtatagttttggtagaaggatatttttttgggtcgcgttggtatttggttggtcggtacgttgttgttcgttaggtttgatacgtttatgtatttttcgggggaaagttttttatcgaggcgttcggcgttgatttgagcgtattttgttgtaagtttacgtcgntgcgatatacggtagttgtagtagtcgttgtcgaagtggtagtcgtagtttagcgttggagcgttcgggggcgttgntagcggntcgttgtaggcgtgggtgttgggtattttttggttgggggagttttcgggcgcgtcgttataacggtagaagaggacgacgacgaggaagagttcgtgcgtttagaggtttcggggtacgtaaagtcggaggttgtcgtcgtcgtcgtcgtagtcgtcgttgtcgtcgtcgtcgttcgtttcgaatgcgtttcggcgaatataggcgcggagagaaagtcgcggtattggtttgacgtcgtcgtcgtcgttatcgatgaggaggaggaagaggntcggggcgttatcggcgttttcgtcgtttgttcgtagttcgtttatgttttagttttcggcgcggtttatggttcggtttggttcggtttcggttttggttttggtttcgcgtaggatattatggcgcggcgcgttttttttttttttttttttttttttggttcgttcgttttcgttttttttttttagttttttttttttttgtgagtttttcgttttcggttcgtttgttttttaataggttagtttatcgcgggacgtttataaaaacgaagtttaggttggganngggggtttgggtcggtcggggggtcgtttnttcgtttcgagggnttttcgtcgggggcgtg

SEQ ID NO: 8812 - DNA, 1005 bp, Artificial Sequence
  chemically treated genomic DNA (Homo sapiens) CpG-island No: 8812
  misc_feature (18)..(18): n is either a, c, g or t
  misc_feature (32)..(32): n is either a, c, g or t
  misc_feature (62)..(63): n is either a, c, g or t
  misc_feature (352)..(352): n is either a, c, g or t
  misc_feature (626)..(626): n is either a, c, g or t
  misc_feature (633)..(633): n is either a, c, g or t
  misc_feature (710)..(710): n is either a, c, g or t
cacgcccccgacgaaaanccctcgaaacgaanaaacgaccccccgaccgacccaaacccccnntcccaacctaaacttcgtttttataaacgtcccgcgataaactaacctattaaaaaacaaacgaaccgaaaacgaaaaactcacaaaaaaaaaaaaaactaaaaaaaaaaaacgaaaacgaacgaaccaaaaaaaaaaaaaaaaaaaaaaaaaacgcgccgcgccataatatcctacgcgaaaccaaaaccaaaaccgaaaccgaaccaaaccgaaccataaaccgcgccgaaaactaaaacataaacgaactacgaacaaacgacgaaaacgccgataacgccccgancctcttcctcctcctcatcgataacgacgacgacgacgtcaaaccaataccgcgactttctctccgcgcctatattcgccgaaacgcattcgaaacgaacgacgacgacgacaacgacgactacgacgacgacgacgacaacctccgactttacgtaccccgaaacctctaaacgcacgaactcttcctcgtcgtcgtcctcttctaccgttataacgacgcgcccgaaaactcccccaaccaaaaaatacccaacacccacgcctacaacganccgctancaacgcccccgaacgctccaacgctaaactacgactaccacttcgacaacgactactacaactaccgtatatcgcancgacgtaaacttacaacaaaatacgctcaaatcaacgccgaacgcctcgataaaaaactttcccccgaaaaatacataaacgtatcaaacctaacgaacaacaacgtaccgaccaaccaaataccaacgcgacccaaaaaaatatccttctaccaaaactatacgaacccttaccaacacgtacccgactatatcgacataatatccactttcgactccgaaaaacctcgacacgaaacctacatctccataaaaaaataccaatcctaaacgctaactaacgaataaaacaacc

SEQ ID NO: 8813 - DNA, 613 bp, Artificial Sequence
  chemically treated genomic DNA (Homo sapiens) CpG-island No: 8813
  misc_feature (118)..(118): n is either a, c, g or t
  misc_feature (134)..(135): n is either a, c, g or t
  misc_feature (404)..(404): n is either a, c, g or t
ttttgtcgcgagttcgggttggcggcggtcgttatagatgcgttagtttgggagttttcggtagtcgtttttgagacgagtggtgggtcgagagatttgtgtaggtgggatgagggtncgtaaggtttatggtnnggtggttgtttggaatttgcgcggcgtaattgtagtttacgttggtcgacgacgggtgcgagaggtggtttaggttgaagataggttcggacgcgggcgttatggattcgacgaagttgtcgtttacgtatatcgggttgttttgtaagttggcgttggcgaagtcgtcgtcgttgttcgttatgggatggggttcgaatttcggcgttgcgtagcgtttttgttgtggtaggtagttgttgagtggcgtcgtgtaggcggttaggttngtatatattgggttgtgatttggcgaaagtaggcggcgagggcgcgtcgtaggttaggtcgggtattggcggtagttggtcggagtaggttacgtggttagcggcgtcgtcgagcggtgggttgcgtttaggggattggttagtcggcgagtgtaggatgtttttggttttttggttttttttgtattttatgcgtcggttttggaatt

SEQ ID NO: 8814 - DNA, 613 bp, Artificial Sequence
  chemically treated genomic DNA (Homo sapiens) CpG-island No: 8814
  misc_feature (210)..(210): n is either a, c, g or t
  misc_feature (479)..(480): n is either a, c, g or t
  misc_feature (496)..(496): n is either a, c, g or t
aattccaaaaccgacgcataaaatacaaaaaaaaccaaaaaaccaaaaacatcctacactcgccgactaaccaatcccctaaacgcaacccaccgctcgacgacgccgctaaccacgtaacctactccgaccaactaccgccaatacccgacctaacctacgacgcgccctcgccgcctactttcgccaaatcacaacccaatatatacnaacctaaccgcctacacgacgccactcaacaactacctaccacaacaaaaacgctacgcaacgccgaaattcgaaccccatcccataacgaacaacgacgacgacttcgccaacgccaacttacaaaacaacccgatatacgtaaacgacaacttcgtcgaatccataacgcccgcgtccgaacctatcttcaacctaaaccacctctcgcacccgtcgtcgaccaacgtaaactacaattacgccgcgcaaattccaaacaaccaccnnaccataaaccttacgnaccctcatcccacctacacaaatctctcgacccaccactcgtctcaaaaacgactaccgaaaactcccaaactaacgcatctataacgaccgccgccaacccgaactcgcgacaaaa

SEQ ID NO: 8815 - DNA, 613 bp, Artificial Sequence
  chemically treated genomic DNA (Homo sapiens) CpG-island No: 8815
  misc_feature (210)..(210): n is either a, c, g or t
  misc_feature (479)..(480): n is either a, c, g or t
  misc_feature (496)..(496): n is either a, c, g or t
ggttttagaatcggcgtatgaagtataagaaggattagaaggttaagggtattttgtattcgtcggttagttagttttttgagcgtagtttatcgttcggcggcgtcgttggttacgtggtttatttcggttagttgtcgttagtgttcggtttggtttacgacgcgttttcgtcgtttgttttcgttaaattatagtttaatatgtatnggtttggtcgtttatacggcgttatttagtagttgtttgttataatagaagcgttacgtagcgtcggagttcgagttttattttatggcgagtaacggcggcggtttcgttagcgttaatttgtagggtagttcggtgtacgtgggcggtaatttcgtcgagtttatggcgttcgcgttcgggtttgtttttaatttgggttatttttcgtattcgtcgtcggttagcgtggattatagttgcgtcgcgtagattttaggtaattattnnattatggattttgcgnatttttattttatttatatagatttttcggtttattattcgttttagggacgattgtcggaggtttttaaattgacgtatttgtagcggtcgtcgttagttcgaattcgcggtaaaa

SEQ ID NO: 8816 - DNA, 613 bp, Artificial Sequence
  chemically treated genomic DNA (Homo sapiens) CpG-island No: 8816
  misc_feature (118)..(118): n is either a, c, g or t
  misc_feature (134)..(135): n is either a, c, g or t
  misc_feature (404)..(404): n is either a, c, g or t
ttttaccgcgaattcgaactaacgacgaccgctacaaatacgtcaatttaaaaacctccgacaatcgtccctaaaacgaataataaaccgaaaaatctatataaataaaataaaaatncgcaaaatccataatnnaataattacctaaaatctacgcgacgcaactataatccacgctaaccgacgacgaatacgaaaaataacccaaattaaaaacaaacccgaacgcgaacgccataaactcgacgaaattaccgcccacgtacaccgaactaccctacaaattaacgctaacgaaaccgccgccgttactcgccataaaataaaactcgaactccgacgctacgtaacgcttctattataacaaacaactactaaataacgccgtataaacgaccaaaccnatacatattaaactataatttaacgaaaacaaacgacgaaaacgcgtcgtaaaccaaaccgaacactaacgacaactaaccgaaataaaccacgtaaccaacgacgccgccgaacgataaactacgctcaaaaaactaactaaccgacgaatacaaaatacccttaaccttctaatccttcttatacttcatacgccgattctaaaacc

SEQ ID NO: 8817 - DNA, 541 bp, Artificial Sequence
  chemically treated genomic DNA (Homo sapiens) CpG-island No: 8817
  misc_feature (359)..(359): n is either a, c, g or t
cgggaagtcgggtagcggttttatttagggagcgtacgtagcggtcgggttcggaggtagaggcggttaggggcggcgggggaacgtacgggtggtagaggtcgtttatcgtcgtcgttgtcgggggttgggagggtatcgcggattacgaggtagagaatacggtcgatttgggggtaaaattatacgaggcgaattcggcggcggtggcggtcgggttattagttatatttgtaggtcggttttgcgcgtttggtttcggcggttcgaagcgcgtcgcgaatatttcgtcgtttttatggtttataagcgagtttacgtagtagttgttgagggtgttattggaagatattttgagngcgtttcgtatttttatttaatattatattgttcgtcgtcgagtagtttttcgtcggcgttcgagttatcgattagttcgtaggttgtagtttttattattggtcgcgcggtttacgtgattatatttattaatatcgggagtaaattagttcgttaaattgggggttgttgtgattaaaaa

SEQ ID NO: 8818 - DNA, 541 bp, Artificial Sequence
  chemically treated genomic DNA (Homo sapiens) CpG-island No: 8818
  misc_feature (183)..(183): n is either a, c, g or t
tttttaatcacaacaacccccaatttaacgaactaatttactcccgatattaataaatataatcacgtaaaccgcgcgaccaataataaaaactacaacctacgaactaatcgataactcgaacgccgacgaaaaactactcgacgacgaacaatataatattaaataaaaatacgaaacgcnctcaaaatatcttccaataacaccctcaacaactactacgtaaactcgcttataaaccataaaaacgacgaaatattcgcgacgcgcttcgaaccgccgaaaccaaacgcgcaaaaccgacctacaaatataactaataacccgaccgccaccgccgccgaattcgcctcgtataattttacccccaaatcgaccgtattctctacctcgtaatccgcgataccctcccaacccccgacaacgacgacgataaacgacctctaccacccgtacgttcccccgccgcccctaaccgcctctacctccgaacccgaccgctacgtacgctccctaaataaaaccgctacccgacttcccg

SEQ ID NO: 8819 - DNA, 541 bp, Artificial Sequence
  chemically treated genomic DNA (Homo sapiens) CpG-island No: 8819
  misc_feature (183)..(183): n is either a, c, g or t
tttttaattatagtagtttttagtttagcggattgatttattttcggtattggtaaatatgattacgtgggtcgcgcgattaatggtggaggttgtagtttgcgaattagtcggtggttcgggcgtcggcggggagttgttcggcggcggatagtgtaatgttgggtgggagtgcgggacgtntttaaaatgttttttagtggtatttttagtaattattacgtggattcgtttataggttatgagggcgacgaggtgttcgcggcgcgtttcgggtcgtcggggttaggcgcgtagggtcggtttgtaggtgtggttgatggttcggtcgttatcgtcgtcgagttcgtttcgtgtagttttgtttttagatcggtcgtgttttttgtttcgtggttcgcggtgtttttttagttttcggtagcggcggcgatgagcggtttttattattcgtacgttttttcgtcgtttttggtcgtttttgttttcgagttcggtcgttacgtgcgttttttggatggagtcgttgttcggtttttcg

SEQ ID NO: 8820 - DNA, 541 bp, Artificial Sequence
  chemically treated genomic DNA (Homo sapiens) CpG-island No: 8820
  misc_feature (359)..(359): n is either a, c, g or t
cgaaaaaccgaacaacgactccatccaaaaaacgcacgtaacgaccgaactcgaaaacaaaaacgaccaaaaacgacgaaaaaacgtacgaataataaaaaccgctcatcgccgccgctaccgaaaactaaaaaaacaccgcgaaccacgaaacaaaaaacacgaccgatctaaaaacaaaactacacgaaacgaactcgacgacgataacgaccgaaccatcaaccacacctacaaaccgaccctacgcgcctaaccccgacgacccgaaacgcgccgcgaacacctcgtcgccctcataacctataaacgaatccacgtaataattactaaaaataccactaaaaaacattttaaanacgtcccgcactcccacccaacattacactatccgccgccgaacaactccccgccgacgcccgaaccaccgactaattcgcaaactacaacctccaccattaatcgcgcgacccacgtaatcatatttaccaataccgaaaataaatcaatccgctaaactaaaaactactataattaaaaa

SEQ ID NO: 8821 - DNA, 1435 bp, Artificial Sequence
  chemically treated genomic DNA (Homo sapiens) CpG-island No: 8821
  misc_feature (126)..(126): n is either a, c, g or t
  misc_feature (307)..(307): n is either a, c, g or t
  misc_feature (385)..(385): n is either a, c, g or t
  misc_feature (420)..(420): n is either a, c, g or t
  misc_feature (436)..(436): n is either a, c, g or t
  misc_feature (541)..(541): n is either a, c, g or t
  misc_feature (571)..(571): n is either a, c, g or t
  misc_feature (681)..(681): n is either a, c, g or t
  misc_feature (701)..(701): n is either a, c, g or t
  misc_feature (779)..(779): n is either a, c, g or t
  misc_feature (985)..(985): n is either a, c, g or t
  misc_feature (1045)..(1045): n is either a, c, g or t
  misc_feature (1048)..(1048): n is either a, c, g or t
  misc_feature (1327)..(1327): n is either a, c, g or t
  misc_feature (1367)..(1367): n is either a, c, g or t
  misc_feature (1371)..(1371): n is either a, c, g or t
cgaagagtagtttttatcggtcgcgcgttacgtttttatttaattttttttatgtcgcgacgtttatatttcgttttcgagggattagttttttttacgatttagagtagaagcggttcgtttcgnttgtatttacgggtttttatttaagcgtttagttttgtttttttttttttatttcgtttaatatttgttcgagagtaggcgttttgttttttcgtttcgtttttgtttaggtagttttcggtcgcgacggtttttttcggggttcgggggcgttgggcggcggttttgggttgttttggtntaatttggttgcggggtaggcgcgaggagcggcgcgtcgatcgggtcgagcggagaggtcgtttattggtcggttagncgttacgtggtcgttttcgtcggtatattaggttnattatttattttcggntttattcgttatgggttggagagggtagttcgggtagagagggttggcggagcggcgtaaacggcggtagttttgtttagtttttgttcggtttcgtatttcggntttcggtttgcgtttttagaaaggtggggnttcgaattatgagtttttatttggagtacgtgttatgtagtagtagcggcggggtcggcggcgacgtgtttagtttggtatttaagttttgtcgtttcgacgttcggttncgtggttttgtagttcgttnttttttttgggtaacggcgacggcgttttcgttagttgtttgtttttggtcgtcgttcgattttcgttttcgtttttnggtcgttttcgcgcggtcgttcgtatcgttttcggtcgcgttttagtacgcgtagtgtattttggagggggtttacgaatttggtgtcgtatttgtcgcggtagttgggggcgcggattacggttttttggggttcgggtcggcgtacgatttttcgggcgtgttggggcgggcggtcgacgacggcgggttttacgtttattatngttatttcggtcgttttttcgggcggcggtttttttttttttagcggttaggtggattancgncggttttcggcgaattcggttttttttcggtttgttttaaagcgttagtcgacggttattttggtgttttttagatcgtattttcggttttaggtatttattttaagttcgtttttttcgttttcggtttttttgtcgtttttagtacgttcgagtggatgaaagtgaagaggaatgtttttaagaaaggtaagttcgcgggttttggatggggttatttggggttggggacggagtttttttcgcggaaatgcgttgggagcgtggtgtcgttgtttnttttagatagcggtttgggttttgtggaggagacgcgttntttngggcgaattttatggagtttgtttcgagtatagattcggaaaatgtgttaggtattgagaaaat

SEQ ID NO: 8822 - DNA, 1435 bp, Artificial Sequence
  chemically treated genomic DNA (Homo sapiens) CpG-island No: 8822
  misc_feature (65)..(65): n is either a, c, g or t
  misc_feature (69)..(69): n is either a, c, g or t
  misc_feature (109)..(109): n is either a, c, g or t
  misc_feature (388)..(388): n is either a, c, g or t
  misc_feature (391)..(391): n is either a, c, g or t
  misc_feature (451)..(451): n is either a, c, g or t
  misc_feature (657)..(657): n is either a, c, g or t
  misc_feature (735)..(735): n is either a, c, g or t
  misc_feature (755)..(755): n is either a, c, g or t
  misc_feature (865)..(865): n is either a, c, g or t
  misc_feature (895)..(895): n is either a, c, g or t
  misc_feature (1000)..(1000): n is either a, c, g or t
  misc_feature (1016)..(1016): n is either a, c, g or t
  misc_feature (1051)..(1051): n is either a, c, g or t
  misc_feature (1129)..(1129): n is either a, c, g or t
  misc_feature (1310)..(1310): n is either a, c, g or t
attttctcaatacctaacacattttccgaatctatactcgaaacaaactccataaaattcgcccnaaanaacgcgtctcctccacaaaacccaaaccgctatctaaaanaaacaacgacaccacgctcccaacgcatttccgcgaaaaaaactccgtccccaaccccaaataaccccatccaaaacccgcgaacttacctttcttaaaaacattcctcttcactttcatccactcgaacgtactaaaaacgacaaaaaaaccgaaaacgaaaaaaacgaacttaaaataaatacctaaaaccgaaaatacgatctaaaaaacaccaaaataaccgtcgactaacgctttaaaacaaaccgaaaaaaaaccgaattcgccgaaaaccgncgntaatccacctaaccgctaaaaaaaaaaaaaccgccgcccgaaaaaacgaccgaaataacnataataaacgtaaaacccgccgtcgtcgaccgcccgccccaacacgcccgaaaaatcgtacgccgacccgaaccccaaaaaaccgtaatccgcgcccccaactaccgcgacaaatacgacaccaaattcgtaaaccccctccaaaatacactacgcgtactaaaacgcgaccgaaaacgatacgaacgaccgcgcgaaaacgaccnaaaaacgaaaacgaaaatcgaacgacgaccaaaaacaaacaactaacgaaaacgccgtcgccgttacccaaaaaaaanaacgaactacaaaaccacgnaaccgaacgtcgaaacgacaaaacttaaataccaaactaaacacgtcgccgccgaccccgccgctactactacataacacgtactccaaataaaaactcataattcgaanccccacctttctaaaaacgcaaaccgaaanccgaaatacgaaaccgaacaaaaactaaacaaaactaccgccgtttacgccgctccgccaaccctctctacccgaactaccctctccaacccataacgaataaanccgaaaataaataatnaacctaatataccgacgaaaacgaccacgtaacgnctaaccgaccaataaacgacctctccgctcgacccgatcgacgcgccgctcctcgcgcctaccccgcaaccaaattanaccaaaacaacccaaaaccgccgcccaacgcccccgaaccccgaaaaaaaccgtcgcgaccgaaaactacctaaacaaaaacgaaacgaaaaaacaaaacgcctactctcgaacaaatattaaacgaaataaaaaaaaaaaaacaaaactaaacgcttaaataaaaacccgtaaatacaancgaaacgaaccgcttctactctaaatcgtaaaaaaaactaatccctcgaaaacgaaatataaacgtcgcgacataaaaaaaattaaataaaaacgtaacgcgcgaccgataaaaactactcttcg

SEQ ID NO: 8823 - DNA, 1435 bp, Artificial Sequence
  chemically treated genomic DNA (Homo sapiens) CpG-island No: 8823
  misc_feature (65)..(65): n is either a, c, g or t
  misc_feature (69)..(69): n is either a, c, g or t
  misc_feature (109)..(109): n is either a, c, g or t
  misc_feature (388)..(388): n is either a, c, g or t
  misc_feature (391)..(391): n is either a, c, g or t
  misc_feature (451)..(451): n is either a, c, g or t
  misc_feature (657)..(657): n is either a, c, g or t
  misc_feature (735)..(735): n is either a, c, g or t
  misc_feature (755)..(755): n is either a, c, g or t
  misc_feature (865)..(865): n is either a, c, g or t
  misc_feature (895)..(895): n is either a, c, g or t
  misc_feature (1000)..(1000): n is either a, c, g or t
  misc_feature (1016)..(1016): n is either a, c, g or t
  misc_feature (1051)..(1051): n is either a, c, g or t
  misc_feature (1129)..(1129): n is either a, c, g or t
  misc_feature (1310)..(1310): n is either a, c, g or t
atttttttaatgtttggtatatttttcgaatttgtattcgaggtagattttatggaattcgtttngggnaacgcgttttttttataaaatttaaatcgttgtttggaanaggtagcgatattacgtttttagcgtattttcgcgggggaggtttcgtttttaattttaggtggttttatttaaggttcgcggatttattttttttagaggtatttttttttatttttatttattcgaacgtgttgaaggcggtagggaggtcggaggcgggagagacggatttggggtaggtgtttggggtcggggatgcggtttggaaagtattagggtggtcgtcggttgacgttttgagataagtcggaaaagggtcgggttcgtcgaaggtcgncgntaatttatttggtcgttgaggaggaaagagtcgtcgttcgagaagacggtcgaggtggtngtagtggacgtgagattcgtcgtcgtcggtcgttcgttttagtacgttcgggaagtcgtacgtcggttcggattttaggaagtcgtagttcgcgtttttagttgtcgcggtaggtgcggtattaggttcgtaggttttttttagggtgtattgcgcgtattggggcgcggtcggaggcggtacggacggtcgcgcgggggcggttngggggcgaaggcgagggtcgggcggcggttaggggtagatagttgacgaaggcgtcgtcgtcgttgtttagagggaanggcgggttgtagagttacgnggtcgggcgtcggagcggtagaatttgggtgttaagttgagtacgtcgtcgtcgatttcgtcgttgttgttgtatgatacgtattttaggtaggagtttatggttcgggnttttatttttttgagggcgtaggtcggggntcggagtacggagtcgggtagaggttgagtaggattgtcgtcgtttgcgtcgtttcgttagttttttttattcgagttgttttttttaatttatggcgagtgagntcggaggtaaatagtnggtttaatatatcggcgggggcggttacgtggcgnttggtcggttaatgggcggttttttcgttcggttcggtcggcgcgtcgtttttcgcgtttgtttcgtagttaagttangttaaagtagtttagggtcgtcgtttagcgttttcgagtttcgaggagagtcgtcgcgatcgggggttgtttgggtaagggcggggcgagagggtagaacgtttgttttcggataggtattgggcgaggtggggggagaaaggtaggattggacgtttgggtgagggttcgtggatgtagncggggcgagtcgtttttgttttggatcgtggggggggttagtttttcgagggcggagtgtgggcgtcgcggtatggaaaaggttaaatgggagcgtgacgcgcggtcggtggagattgtttttcg

SEQ ID NO: 8824 - DNA, 1435 bp, Artificial Sequence
  chemically treated genomic DNA (Homo sapiens) CpG-island No: 8824
  misc_feature (126)..(126): n is either a, c, g or t
  misc_feature (307)..(307): n is either a, c, g or t
  misc_feature (385)..(385): n is either a, c, g or t
  misc_feature (420)..(420): n is either a, c, g or t
  misc_feature (436)..(436): n is either a, c, g or t
  misc_feature (541)..(541): n is either a, c, g or t
  misc_feature (571)..(571): n is either a, c, g or t
  misc_feature (681)..(681): n is either a, c, g or t
  misc_feature (701)..(701): n is either a, c, g or t
  misc_feature (779)..(779): n is either a, c, g or t
  misc_feature (985)..(985): n is either a, c, g or t
  misc_feature (1045)..(1045): n is either a, c, g or t
  misc_feature (1048)..(1048): n is either a, c, g or t
  misc_feature (1327)..(1327): n is either a, c, g or t
  misc_feature (1367)..(1367): n is either a, c, g or t
  misc_feature (1371)..(1371): n is either a, c, g or t
cgaaaaacaatctccaccgaccgcgcgtcacgctcccatttaaccttttccataccgcgacgcccacactccgccctcgaaaaactaaccccccccacgatccaaaacaaaaacgactcgccccgnctacatccacgaaccctcacccaaacgtccaatcctacctttctccccccacctcgcccaatacctatccgaaaacaaacgttctaccctctcgccccgcccttacccaaacaacccccgatcgcgacgactctcctcgaaactcgaaaacgctaaacgacgaccctaaactactttaacntaacttaactacgaaacaaacgcgaaaaacgacgcgccgaccgaaccgaacgaaaaaaccgcccattaaccgaccaancgccacgtaaccgcccccgccgatatattaaaccnactatttacctccganctcactcgccataaattaaaaaaaacaactcgaataaaaaaaactaacgaaacgacgcaaacgacgacaatcctactcaacctctacccgactccgtactccganccccgacctacgccctcaaaaaaataaaancccgaaccataaactcctacctaaaatacgtatcatacaacaacaacgacgaaatcgacgacgacgtactcaacttaacacccaaattctaccgctccgacgcccgaccncgtaactctacaacccgccnttccctctaaacaacgacgacgacgccttcgtcaactatctacccctaaccgccgcccgaccctcgccttcgcccccnaaccgcccccgcgcgaccgtccgtaccgcctccgaccgcgccccaatacgcgcaatacaccctaaaaaaaacctacgaacctaataccgcacctaccgcgacaactaaaaacgcgaactacgacttcctaaaatccgaaccgacgtacgacttcccgaacgtactaaaacgaacgaccgacgacgacgaatctcacgtccactacnaccacctcgaccgtcttctcgaacgacgactctttcctcctcaacgaccaaataaattancgncgaccttcgacgaacccgacccttttccgacttatctcaaaacgtcaaccgacgaccaccctaatactttccaaaccgcatccccgaccccaaacacctaccccaaatccgtctctcccgcctccgacctccctaccgccttcaacacgttcgaataaataaaaataaaaaaaaatacctctaaaaaaaataaatccgcgaaccttaaataaaaccacctaaaattaaaaacgaaacctcccccgcgaaaatacgctaaaaacgtaatatcgctacctnttccaaacaacgatttaaattttataaaaaaaacgcgttncccnaaacgaattccataaaatctacctcgaatacaaattcgaaaaatataccaaacattaaaaaaat

SEQ ID NO: 8825 - DNA, 813 bp, Artificial Sequence
  chemically treated genomic DNA (Homo sapiens) CpG-island No: 8825
tggcgaacggggtgggtggtgttggcgagggtggtgttggattggtggggttggggaggtgttgtgcggttcgggtggggcgcggttggggtagcgcgggtgtgagggtgcggcgggggtggcggttttgggcgtgggtgtagggtgggtgttggagttttgggtggtggaggtttcgcgagggatagcgacgcggaagggtgttgttggagtttggggtgggtgtgcgcgttttaggaggttggtgttgaggtttggcgtttcgcggggcggtgttgttgttgaggtcggtggcggtgttgggtcgggtgtggtttgtgtggcgcgtgttgtgtgatacgtgttttgttgtgcgcgcggtgtgggtgtggggtgtgtagtggtggtgtgcgttgttgcggggcgtgtgacgttttgtgtgtgcgggtgtgagcggaggtggagagcgtggggtgtcgcgtgtgtggcgcgggtgtgggttggtgtcgtggtttttgcggcgtgttgtgtggtggggcgtgtgagagtttcgtggggaggtcgcgttgcggggtggtgggagagagttgttggcgtggacgagtgtggtggtgcggcgcgattgtgtttttggggtgtgtggttgttggggggtgttggtgttggaggatgtcgttgggagtgcgtttgggcgtggaggtgtggtggtgggtcggggttgtgcgcgcggggtgtggtgtcggtgaggggtgagcgatgtgtcgtggtgtgggtgaacgatatagttattattagtgttttagtaattgtttttggtgttattattataaataa

SEQ ID NO: 8826 - DNA, 813 bp, Artificial Sequence
  chemically treated genomic DNA (Homo sapiens) CpG-island No: 8826
ttatttataataataacaccaaaaacaattactaaaacactaataataactatatcgttcacccacaccacgacacatcgctcacccctcaccgacaccacaccccgcgcgcacaaccccgacccaccaccacacctccacgcccaaacgcactcccaacgacatcctccaacaccaacaccccccaacaaccacacaccccaaaaacacaatcgcgccgcaccaccacactcgtccacgccaacaactctctcccaccaccccgcaacgcgacctccccacgaaactctcacacgccccaccacacaacacgccgcaaaaaccacgacaccaacccacacccgcgccacacacgcgacaccccacgctctccacctccgctcacacccgcacacacaaaacgtcacacgccccgcaacaacgcacaccaccactacacaccccacacccacaccgcgcgcacaacaaaacacgtatcacacaacacgcgccacacaaaccacacccgacccaacaccgccaccgacctcaacaacaacaccgccccgcgaaacgccaaacctcaacaccaacctcctaaaacgcgcacacccaccccaaactccaacaacacccttccgcgtcgctatccctcgcgaaacctccaccacccaaaactccaacacccaccctacacccacgcccaaaaccgccacccccgccgcaccctcacacccgcgctaccccaaccgcgccccacccgaaccgcacaacacctccccaaccccaccaatccaacaccaccctcgccaacaccacccaccccgttcgcca

SEQ ID NO: 8827 - DNA, 813 bp, Artificial Sequence
  chemically treated genomic DNA (Homo sapiens) CpG-island No: 8827
ttgtttgtggtggtagtattaaaagtagttattggagtattagtggtaattgtatcgtttatttatattacgatatatcgtttattttttatcgatattatatttcgcgcgtataatttcgatttattattatatttttacgtttaaacgtatttttaacgatattttttagtattagtattttttaatagttatatattttaagaatatagtcgcgtcgtattattatattcgtttacgttaatagtttttttttattatttcgtagcgcggtttttttacgaagtttttatacgttttattatataatacgtcgtagagattacgatattagtttatattcgcgttatatacgcggtattttacgttttttattttcgtttatattcgtatatataaggcgttatacgtttcgtagtaacgtatattattattatatattttatatttatatcgcgcgtataataaaatacgtgttatataatacgcgttatataagttatattcggtttaatatcgttatcgattttaataataatatcgtttcgcggaacgttagattttaatattaattttttaaaacgcgtatatttattttagattttaatagtattttttcgcgtcgttgtttttcgcgaaatttttattatttaaaattttaatatttattttatatttacgtttaaaatcgttattttcgtcgtatttttatattcgcgttattttaatcgcgttttattcgaatcgtatagtatttttttaattttattaatttaatattattttcgttaatattatttatttcgttcgtta

SEQ ID NO: 8828 - DNA, 813 bp, Artificial Sequence
  chemically treated genomic DNA (Homo sapiens) CpG-island No: 8828
taacgaacgaaataaataatattaacgaaaataatattaaattaataaaattaaaaaaatactatacgattcgaataaaacgcgattaaaataacgcgaatataaaaatacgacgaaaataacgattttaaacgtaaatataaaataaatattaaaattttaaataataaaaatttcgcgaaaaacaacgacgcgaaaaaatactattaaaatctaaaataaatatacgcgttttaaaaaattaatattaaaatctaacgttccgcgaaacgatattattattaaaatcgataacgatattaaaccgaatataacttatataacgcgtattatataacacgtattttattatacgcgcgatataaatataaaatatataataataatatacgttactacgaaacgtataacgccttatatatacgaatataaacgaaaataaaaaacgtaaaataccgcgtatataacgcgaatataaactaatatcgtaatctctacgacgtattatataataaaacgtataaaaacttcgtaaaaaaaccgcgctacgaaataataaaaaaaaactattaacgtaaacgaatataataatacgacgcgactatattcttaaaatatataactattaaaaaatactaatactaaaaaatatcgttaaaaatacgtttaaacgtaaaaatataataataaatcgaaattatacgcgcgaaatataatatcgataaaaaataaacgatatatcgtaatataaataaacgatacaattaccactaatactccaataactacttttaatactaccaccacaaacaa

SEQ ID NO: 8829 - DNA, 503 bp, Artificial Sequence
  chemically treated genomic DNA (Homo sapiens) CpG-island No: 8829
gttcgttcggtttttcgcgttttttcgtttttttttttgattttttttcgcgtcgttttttcgtcggttttttagttttttagttatcgtcgttttacgtagtcgtcgcgttcgtttttattttcgatttcgatttttaggtcggcgtcgtcgtttttatgtttttttgttttcgcgttttcgtttttatattttttgttttttttgttttattcggtatcgttttttcgttcgtttaggtttcgcgacgtttattggcgtttttttttcggttgtttgcgtttttcgtacgtgtttgttttttgtggattttttagtcgtttcgtttttcgtttgtcgcgttttcgttattcgtttttttcgttttcgttttttcgttgttcggttttcgcgttcgtttcgcgtattacgttttattttttgtttatacgtttaagttttttggtttttttatttttttttttgtttttattgtttttgttttcggttcgtttatatttttt

SEQ ID NO: 8830 - DNA, 503 bp, Artificial Sequence
  chemically treated genomic DNA (Homo sapiens) CpG-island No: 8830
aaaaaatataaacgaaccgaaaacaaaaacaataaaaacaaaaaaaaaaataaaaaaaccaaaaaacttaaacgtataaacaaaaaataaaacgtaatacgcgaaacgaacgcgaaaaccgaacaacgaaaaaacgaaaacgaaaaaaacgaataacgaaaacgcgacaaacgaaaaacgaaacgactaaaaaatccacaaaaaacaaacacgtacgaaaaacgcaaacaaccgaaaaaaaaacgccaataaacgtcgcgaaacctaaacgaacgaaaaaacgataccgaataaaacaaaaaaaacaaaaaatataaaaacgaaaacgcgaaaacaaaaaaacataaaaacgacgacgccgacctaaaaatcgaaatcgaaaataaaaacgaacgcgacgactacgtaaaacgacgataactaaaaaactaaaaaaccgacgaaaaaacgacgcgaaaaaaaatcaaaaaaaaaaacgaaaaaacgcgaaaaaccgaacgaac

SEQ ID NO: 8831 - DNA, 503 bp, Artificial Sequence
  chemically treated genomic DNA (Homo sapiens) CpG-island No: 8831
gaggagtgtgagcgagtcggaggtagaggtagtggggatagaggagggagtagaggagttagaggatttgggcgtatgagtaggaggtgagacgtagtgcgcgggacggacgcgagagtcgagtagcgagggagcggaggcgaggggagcgagtggcggaagcgcggtaagcgggagacggagcgattagagggtttatagaggatagatacgtgcgaggaacgtaggtagtcgaggagggagcgttagtgaacgtcgcggagtttgagcgagcgagaaggcgatgtcgagtggagtaggggggatagaggatgtaggggcgagagcgcgggagtagggaagtatgggggcggcggcgtcggtttgggggtcgaggtcgggggtgggggcgggcgcggcggttgcgtggggcggcggtggttggggggttggggggtcggcgggggggcggcgcgggggggggttaggggggggggcgggggggcgcggagggtcgggcgggt

SEQ ID NO: 8832 - DNA, 503 bp, Artificial Sequence
  chemically treated genomic DNA (Homo sapiens) CpG-island No: 8832
acccgcccgaccctccgcgcccccccgcccccccccctaacccccccccgcgccgcccccccgccgaccccccaaccccccaaccaccgccgccccacgcaaccgccgcgcccgcccccacccccgacctcgacccccaaaccgacgccgccgcccccatacttccctactcccgcgctctcgcccctacatcctctatcccccctactccactcgacatcgccttctcgctcgctcaaactccgcgacgttcactaacgctccctcctcgactacctacgttcctcgcacgtatctatcctctataaaccctctaatcgctccgtctcccgcttaccgcgcttccgccactcgctcccctcgcctccgctccctcgctactcgactctcgcgtccgtcccgcgcactacgtctcacctcctactcatacgcccaaatcctctaactcctctactccctcctctatccccactacctctacctccgactcgctcacactcctc

SEQ ID NO: 8833 - DNA, 804 bp, Artificial Sequence
  chemically treated genomic DNA (Homo sapiens) CpG-island No: 8833
agtaatatcgtcgtttataagatttatatttttatatttacgtaaatataattttattattcgatcgtatagttattagtatacgcgtatcggataatagatttattatacgtaatatatattatcgatttataagtatagataattatattatatttttacgtatatatttataatttttatatatcgattatataattttatattaaatattatttcgtataattataatatatagtatttttaatattatatatttatttacgatatatcggtttttttataaaacgtatatataatttataaattattatatagtacgtttattatatagattatcgtatatcgcgtatttatataatattatatattttacgacgagtaatattttttcgagatattataatacgttcgtatacgtattagattttttatagtttatttcgcgataacgcgttacgttatattatatataaatatattatacgttcgatatattttatatataatcgttaaatttagttattttcgtatataattttaagacgagattcgtacgtatttaatatcgtaattatatattttatatatttaaattttaaatcgttatttcgaaaaatttagtatagtaacgattaaataattatattaagttagatataaaagttacggatttaatcgatagttaaataattttgttatttaatttacgttatatattgattttatttttcgatatttcgttagaaatttatttatatttttattatgagataataaattagttagtttttatatttatta

SEQ ID NO: 8834 - DNA, 804 bp, Artificial Sequence
  chemically treated genomic DNA (Homo sapiens) CpG-island No: 8834
taataaatataaaaactaactaatttattatctcataataaaaatataaataaatttctaacgaaatatcgaaaaataaaatcaatatataacgtaaattaaataacaaaattatttaactatcgattaaatccgtaacttttatatctaacttaatataattatttaatcgttactatactaaatttttcgaaataacgatttaaaatttaaatatataaaatatataattacgatattaaatacgtacgaatctcgtcttaaaattatatacgaaaataactaaatttaacgattatatataaaatatatcgaacgtataatatatttatatataatataacgtaacgcgttatcgcgaaataaactataaaaaatctaatacgtatacgaacgtattataatatctcgaaaaaatattactcgtcgtaaaatatataatattatataaatacgcgatatacgataatctatataataaacgtactatataataatttataaattatatatacgttttataaaaaaaccgatatatcgtaaataaatatataatattaaaaatactatatattataattatacgaaataatatttaatataaaattatataatcgatatataaaaattataaatatatacgtaaaaatataatataattatctatacttataaatcgataatatatattacgtataataaatctattatccgatacgcgtatactaataactatacgatcgaataataaaattatatttacgtaaatataaaaatataaatcttataaacgacgatattact

SEQ ID NO: 8835 - DNA, 804 bp, Artificial Sequence
  chemically treated genomic DNA (Homo sapiens) CpG-island No: 8835
tggtgggtgtggaggttgattagtttgttgttttatgatggaggtgtgggtgggtttttggcggggtgtcggggggtggggttagtgtgtgacgtgggttgagtggtaaggttgtttggttatcggttgggttcgtggtttttgtgtttggtttggtgtggttgtttagtcgttgttgtgttgggtttttcggggtggcggtttggaatttgggtgtgtaaggtgtgtggttgcgatgttgggtgcgtgcgggtttcgttttggggttgtgtgcggagatggttgggtttggcggttgtgtgtggggtgtgtcgggcgtgtggtgtgtttgtgtgtagtgtggcgtggcgcgttgtcgcgagatgggttgtggagagtttggtgcgtgtacggacgtgttgtggtgtttcgagggggtgttgttcgtcgtggggtgtgtggtgttgtgtgggtgcgcggtgtgcggtggtttgtgtggtgggcgtgttgtgtagtggtttgtgggttgtgtgtacgttttgtgagggggtcggtgtgtcgtaggtgggtgtgtggtgttgggggtgttgtgtgttgtggttgtgcggggtggtgtttggtgtggggttgtgtggtcggtgtgtgggggttgtgggtgtgtgcgtgggggtgtggtgtggttgtttgtgtttgtgggtcggtggtgtgtgttgcgtgtggtgggtttgttgttcggtgcgcgtgtgttggtggttgtgcggtcgggtggtggggttgtgtttgcgtgggtgtgggggtgtgagttttgtgggcggcggtgttgtt

SEQ ID NO: 8836 - DNA, 804 bp, Artificial Sequence
  chemically treated genomic DNA (Homo sapiens) CpG-island No: 8836
aacaacaccgccgcccacaaaactcacacccccacacccacgcaaacacaaccccaccacccgaccgcacaaccaccaacacacgcgcaccgaacaacaaacccaccacacgcaacacacaccaccgacccacaaacacaaacaaccacaccacacccccacgcacacacccacaacccccacacaccgaccacacaaccccacaccaaacaccaccccgcacaaccacaacacacaacacccccaacaccacacacccacctacgacacaccgaccccctcacaaaacgtacacacaacccacaaaccactacacaacacgcccaccacacaaaccaccgcacaccgcgcacccacacaacaccacacaccccacgacgaacaacaccccctcgaaacaccacaacacgtccgtacacgcaccaaactctccacaacccatctcgcgacaacgcgccacgccacactacacacaaacacaccacacgcccgacacaccccacacacaaccgccaaacccaaccatctccgcacacaaccccaaaacgaaacccgcacgcacccaacatcgcaaccacacaccttacacacccaaattccaaaccgccaccccgaaaaacccaacacaacaacgactaaacaaccacaccaaaccaaacacaaaaaccacgaacccaaccgataaccaaacaaccttaccactcaacccacgtcacacactaaccccaccccccgacaccccgccaaaaacccacccacacctccatcataaaacaacaaactaatcaacctccacacccacca

SEQ ID NO: 8837 - DNA, 553 bp, Artificial Sequence
  chemically treated genomic DNA (Homo sapiens) CpG-island No: 8837
cgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtcggagtaacgtgggtcgagttatcggaggtcgacgggatttgagtaagcgttgatgtcgaggtttcgtgaagttatattttgttttgttgttttgatatttgtattataaaag

SEQ ID NO: 8838 - DNA, 553 bp, Artificial Sequence
  chemically treated genomic DNA (Homo sapiens) CpG-island No: 8838
cttttataatacaaatatcaaaacaacaaaacaaaatataacttcacgaaacctcgacatcaacgcttactcaaatcccgtcgacctccgataactcgacccacgttactccgacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacg

SEQ ID NO: 8839 - DNA, 553 bp, Artificial Sequence
  chemically treated genomic DNA (Homo sapiens) CpG-island No: 8839
tttttgtggtataggtgttagagtaataaagtaggatgtggttttacggaatttcgatattaacgtttatttagatttcgtcgattttcgataattcggtttacgttatttcggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcg

SEQ ID NO: 8840 - DNA, 553 bp, Artificial Sequence
  chemically treated genomic DNA (Homo sapiens) CpG-island No: 8840
cgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctaccgaaataacgtaaaccgaattatcgaaaatcgacgaaatctaaataaacgttaatatcgaaattccgtaaaaccacatcctactttattactctaacacctataccacaaaaa

SEQ ID NO: 8841 - DNA, 842 bp, Artificial Sequence
  chemically treated genomic DNA (Homo sapiens) CpG-island No: 8841
gtcgagcgcgttaaagaagcggcgcgtattttggagttggacggtttgtttaaagggcgcgggcgtacgtttatcggcggttagcgttatatgatggcgatgggtcgcgcgattgtgcgcgattcggcggtatttttgtttgatgagtcgttttttaatttcgatgttaagttgcgcgtgtagatgcgttttgaattgtaataattgtatcgtcgtttgaaaacgattttattttacgtgatttacgattaggttgaagcgatgacgttcgtttagcgagtaatggtgatgaacggcggtgttgtcgaatagattggtatattagttgaagtttacgaaaagttcgttaatttgtttatagcgagtttgatttgtagttcggcgatgaatttgttgatatgtcgcgtgaataacgaaggtacgtatttcgaatttgacggtagtatttttttattataaacggtggttattattagtatgttaggcgtaaaatgattttcggtattttttcggaatatattgcgcgaaattcgtaggtagaaagttgcgtatcgattgtgattgatacgttggaaatttttcgggtaatgatttggcgtacggatttttgggcgattagaaacgtgtgttgcgattggcgtttttagaacgttcgacggtaagtataacgttggtacgtgtatttggcggaaattaattgtatttttttaaggtggaattagttatcgagtattagaacgggtttattttcgaattcgtttaatcgtgtggcggaaatggtttcggaataatttggggtaaatacgttcggtataaatttgttaaatgattgaattgattga

SEQ ID NO: 8842 - DNA, 842 bp, Artificial Sequence
  chemically treated genomic DNA (Homo sapiens) CpG-island No: 8842
tcaatcaattcaatcatttaacaaatttataccgaacgtatttaccccaaattattccgaaaccatttccgccacacgattaaacgaattcgaaaataaacccgttctaatactcgataactaattccaccttaaaaaaatacaattaatttccgccaaatacacgtaccaacgttatacttaccgtcgaacgttctaaaaacgccaatcgcaacacacgtttctaatcgcccaaaaatccgtacgccaaatcattacccgaaaaatttccaacgtatcaatcacaatcgatacgcaactttctacctacgaatttcgcgcaatatattccgaaaaaataccgaaaatcattttacgcctaacatactaataataaccaccgtttataataaaaaaatactaccgtcaaattcgaaatacgtaccttcgttattcacgcgacatatcaacaaattcatcgccgaactacaaatcaaactcgctataaacaaattaacgaacttttcgtaaacttcaactaatataccaatctattcgacaacaccgccgttcatcaccattactcgctaaacgaacgtcatcgcttcaacctaatcgtaaatcacgtaaaataaaatcgttttcaaacgacgatacaattattacaattcaaaacgcatctacacgcgcaacttaacatcgaaattaaaaaacgactcatcaaacaaaaataccgccgaatcgcgcacaatcgcgcgacccatcgccatcatataacgctaaccgccgataaacgtacgcccgcgccctttaaacaaaccgtccaactccaaaatacgcgccgcttctttaacgcgctcgac

SEQ ID NO: 8843 - DNA, 842 bp, Artificial Sequence
  chemically treated genomic DNA (Homo sapiens) CpG-island No: 8843
ttagttaatttagttatttaataagtttgtgtcggacgtgtttgttttaggttgtttcggagttattttcgttatacgattggacgagttcggggataagttcgttttaatattcggtggttggttttattttaaaaaggtgtagttgattttcgttagatgtacgtattagcgttgtgtttatcgtcgggcgttttggaggcgttagtcgtaatatacgtttttggtcgtttaagagttcgtgcgttaggttattgttcgagggatttttagcgtgttaattataatcggtacgtagttttttgtttgcgagtttcgcgtaatatgtttcggggaaatgtcgagagttattttacgtttggtatattgatggtagttatcgtttatggtaggagggtattgtcgttaagttcgaaatgcgtgttttcgttatttacgcggtatgttagtaggtttatcgtcggattgtagattaaattcgttataaataggttggcgggtttttcgtagattttaattggtgtgttaatttgttcggtaatatcgtcgtttattattattattcgttgggcgagcgttatcgttttaatttgatcgtgagttacgtagagtgaagtcgtttttaggcgacggtgtaattgttgtagtttaagacgtatttgtacgcgtagtttggtatcgaggttagagagcggtttattaaataggaatatcgtcggatcgcgtataatcgcgcggtttatcgttattatgtgacgttgatcgtcggtaagcgtgcgttcgcgttttttgagtagatcgtttagttttagaatgcgcgtcgtttttttaacgcgttcggt

SEQ ID NO: 8844 - DNA, 842 bp, Artificial Sequence
  chemically treated genomic DNA (Homo sapiens) CpG-island No: 8844
accgaacgcgttaaaaaaacgacgcgcattctaaaactaaacgatctactcaaaaaacgcgaacgcacgcttaccgacgatcaacgtcacataataacgataaaccgcgcgattatacgcgatccgacgatattcctatttaataaaccgctctctaacctcgataccaaactacgcgtacaaatacgtcttaaactacaacaattacaccgtcgcctaaaaacgacttcactctacgtaactcacgatcaaattaaaacgataacgctcgcccaacgaataataataataaacgacgatattaccgaacaaattaacacaccaattaaaatctacgaaaaacccgccaacctatttataacgaatttaatctacaatccgacgataaacctactaacataccgcgtaaataacgaaaacacgcatttcgaacttaacgacaataccctcctaccataaacgataactaccatcaatataccaaacgtaaaataactctcgacatttccccgaaacatattacgcgaaactcgcaaacaaaaaactacgtaccgattataattaacacgctaaaaatccctcgaacaataacctaacgcacgaactcttaaacgaccaaaaacgtatattacgactaacgcctccaaaacgcccgacgataaacacaacgctaatacgtacatctaacgaaaatcaactacacctttttaaaataaaaccaaccaccgaatattaaaacgaacttatccccgaactcgtccaatcgtataacgaaaataactccgaaacaacctaaaacaaacacgtccgacacaaacttattaaataactaaattaactaa

SEQ ID NO: 8845 - DNA, 665 bp, Artificial Sequence
  chemically treated genomic DNA (Homo sapiens) CpG-island No: 8845
  misc_feature (322)..(322): n is either a, c, g or t
  misc_feature (333)..(334): n is either a, c, g or t
cgttttaatatcgcgaaattcgtttatttttacgaaggtatggttcgatatcggttaatgtatttgcgtttaataggtttgttcgattggaaaggtgagtacgagggaagggcgggggcgtcggagagtcgggtcgtttatatttttcgtagttatttcggtcgtggtaggaatcgaaattcggagcggtcgaagtttagcgtttcgttggggtagagggtcgcggcggttgggaacgtcgtttttcgacgtatcggtcgtttttagcgtagcgcgtttcgcggggtgttggtaacgcggggggttcggggcgggggcgggnacggggcgggnntcgcggggcgaggattaatttagttcgtcgcgtttatttcgcgttcgtaggggcgtcgaggattttcggggcgcggggcgcgggttggggtttagtgaggtttggtaggttgtgcgcggatcgcgttttggacggcgaaagtaggttcggagggggcggttagttcggcgttttagcgttcgaggcgagttagaaggcggtttacggtcgtcgtttttcggtttcggttcggttattgcgttgcgtttatttcgttttggagtttgggcgcgggttttgattttttcggtttttttttgatatttggtggatggcgttattagaattttta

SEQ ID NO: 8846 - DNA, 665 bp, Artificial Sequence
  chemically treated genomic DNA (Homo sapiens) CpG-island No: 8846
  misc_feature (332)..(333): n is either a, c, g or t
  misc_feature (344)..(344): n is either a, c, g or t
taaaaattctaataacgccatccaccaaatatcaaaaaaaaaccgaaaaaatcaaaacccgcgcccaaactccaaaacgaaataaacgcaacgcaataaccgaaccgaaaccgaaaaacgacgaccgtaaaccgccttctaactcgcctcgaacgctaaaacgccgaactaaccgccccctccgaacctactttcgccgtccaaaacgcgatccgcgcacaacctaccaaacctcactaaaccccaacccgcgccccgcgccccgaaaatcctcgacgcccctacgaacgcgaaataaacgcgacgaactaaattaatcctcgccccgcganncccgccccgtncccgcccccgccccgaaccccccgcgttaccaacaccccgcgaaacgcgctacgctaaaaacgaccgatacgtcgaaaaacgacgttcccaaccgccgcgaccctctaccccaacgaaacgctaaacttcgaccgctccgaatttcgattcctaccacgaccgaaataactacgaaaaatataaacgacccgactctccgacgcccccgcccttccctcgtactcacctttccaatcgaacaaacctattaaacgcaaatacattaaccgatatcgaaccataccttcgtaaaaataaacgaatttcgcgatattaaaacg

SEQ ID NO: 8847 - DNA, 665 bp, Artificial Sequence
  chemically treated genomic DNA (Homo sapiens) CpG-island No: 8847
  misc_feature (332)..(333): n is either a, c, g or t
  misc_feature (344)..(344): n is either a, c, g or t
taggagttttggtgacgttatttattaggtgttaggagagggtcgggaaggttaggattcgcgtttaggttttagagcggagtgggcgtagcgtagtagtcgggtcgggatcgggaggcgacggtcgtgggtcgttttttggttcgtttcggacgttgggacgtcggattggtcgtttttttcgggtttgttttcgtcgtttagggcgcggttcgcgtatagtttgttaagttttattgggttttagttcgcgtttcgcgtttcggagattttcgacgtttttgcgaacgcggggtggacgcgacgggttgggttggttttcgtttcgcggnnttcgtttcgtnttcgttttcgtttcgagtttttcgcgttattagtatttcgcggagcgcgttgcgttgggggcggtcggtgcgtcggggagcggcgtttttagtcgtcgcgattttttgttttagcggagcgttgagtttcggtcgtttcgggtttcggtttttgttacggtcgaggtggttgcggggaatgtgggcgattcggtttttcggcgttttcgtttttttttcgtgtttatttttttagtcgggtaagtttgttgggcgtaggtgtattaatcgatatcgggttatattttcgtgaaaataagcgggtttcgcggtattggggcg

SEQ ID NO: 8848 - DNA, 665 bp, Artificial Sequence
  chemically treated genomic DNA (Homo sapiens) CpG-island No: 8848
  misc_feature (322)..(322): n is either a, c, g or t
  misc_feature (333)..(334): n is either a, c, g or t
cgccccaataccgcgaaacccgcttattttcacgaaaatataacccgatatcgattaatacacctacgcccaacaaacttacccgactaaaaaaataaacacgaaaaaaaaacgaaaacgccgaaaaaccgaatcgcccacattccccgcaaccacctcgaccgtaacaaaaaccgaaacccgaaacgaccgaaactcaacgctccgctaaaacaaaaaatcgcgacgactaaaaacgccgctccccgacgcaccgaccgcccccaacgcaacgcgctccgcgaaatactaataacgcgaaaaactcgaaacgaaaacgaanacgaaacgaannccgcgaaacgaaaaccaacccaacccgtcgcgtccaccccgcgttcgcaaaaacgtcgaaaatctccgaaacgcgaaacgcgaactaaaacccaataaaacttaacaaactatacgcgaaccgcgccctaaacgacgaaaacaaacccgaaaaaaacgaccaatccgacgtcccaacgtccgaaacgaaccaaaaaacgacccacgaccgtcgcctcccgatcccgacccgactactacgctacgcccactccgctctaaaacctaaacgcgaatcctaaccttcccgaccctctcctaacacctaataaataacgtcaccaaaactccta

SEQ ID NO: 8849 - DNA, 526 bp, Artificial Sequence
  chemically treated genomic DNA (Homo sapiens) CpG-island No: 8849
gtttggggaatattttttatggggaaatttcggacgggggggcggggagaggatcggcgtggtcggtcgttagaggtagggagacgtcggacgacgtcggaggtgcgggggtgcgacggtaggatggatcggggttcgtgggttcgcgcgggagaggtggggtagagcgcgtgggcggttggcgcgggagtggggagtgagaggggtgtggaagtagaggtggtcggcgcgagaggacggaggagagggacgggtgggtgtttcggggtagcgtcgaggtagagcgagtaggcgacgtgagggatggcggagttgttcgaggaggattgggtggtagggtcgaagtggtcggagggagtagggtttcggtagagtcggttcggggtgggttaggggaggtttggggcgtgttagggacgcgcgggagagagggggattggggcgttgagaggtggcggggtgtttgggtgagagcgtggggggagtgggggtaagggtatagggtaggtggaggagtggggggggt

SEQ ID NO: 8850 - DNA, 526 bp, Artificial Sequence
  chemically treated genomic DNA (Homo sapiens) CpG-island No: 8850
accccccccactcctccacctaccctatacccttacccccactccccccacgctctcacccaaacaccccgccacctctcaacgccccaatccccctctctcccgcgcgtccctaacacgccccaaacctcccctaacccaccccgaaccgactctaccgaaaccctactccctccgaccacttcgaccctaccacccaatcctcctcgaacaactccgccatccctcacgtcgcctactcgctctacctcgacgctaccccgaaacacccacccgtccctctcctccgtcctctcgcgccgaccacctctacttccacacccctctcactccccactcccgcgccaaccgcccacgcgctctaccccacctctcccgcgcgaacccacgaaccccgatccatcctaccgtcgcacccccgcacctccgacgtcgtccgacgtctccctacctctaacgaccgaccacgccgatcctctccccgcccccccgtccgaaatttccccataaaaaatattccccaaac

SEQ ID NO: 8851 - DNA, 526 bp, Artificial Sequence
  chemically treated genomic DNA (Homo sapiens) CpG-island No: 8851
gttttttttatttttttatttattttatgtttttgtttttattttttttacgtttttatttaggtatttcgttattttttaacgttttaatttttttttttttcgcgcgtttttgatacgttttaggttttttttgatttatttcgaatcgattttgtcgagattttgtttttttcggttatttcggttttgttatttagtttttttcgagtagtttcgttattttttacgtcgtttgttcgttttgtttcggcgttatttcgggatatttattcgtttttttttttcgttttttcgcgtcggttatttttgtttttatattttttttattttttattttcgcgttagtcgtttacgcgttttattttatttttttcgcgcgggtttacgggtttcggtttattttgtcgtcgtattttcgtattttcggcgtcgttcggcgtttttttgtttttggcgatcgattacgtcggtttttttttcgttttttcgttcggaatttttttataaagagtgttttttaggt

SEQ ID NO: 8852 - DNA, 526 bp, Artificial Sequence
  chemically treated genomic DNA (Homo sapiens) CpG-island No: 8852
acctaaaaaacactctttataaaaaaattccgaacgaaaaaacgaaaaaaaaaccgacgtaatcgatcgccaaaaacaaaaaaacgccgaacgacgccgaaaatacgaaaatacgacgacaaaataaaccgaaacccgtaaacccgcgcgaaaaaaataaaataaaacgcgtaaacgactaacgcgaaaataaaaaataaaaaaaatataaaaacaaaaataaccgacgcgaaaaaacgaaaaaaaaaaacgaataaatatcccgaaataacgccgaaacaaaacgaacaaacgacgtaaaaaataacgaaactactcgaaaaaaactaaataacaaaaccgaaataaccgaaaaaaacaaaatctcgacaaaatcgattcgaaataaatcaaaaaaaacctaaaacgtatcaaaaacgcgcgaaaaaaaaaaaaattaaaacgttaaaaaataacgaaatacctaaataaaaacgtaaaaaaaataaaaacaaaaacataaaataaataaaaaaataaaaaaaac

SEQ ID NO: 8853 - DNA, 638 bp, Artificial Sequence
  chemically treated genomic DNA (Homo sapiens) CpG-island No: 8853
  misc_feature (162)..(162): n is either a, c, g or t
  misc_feature (225)..(225): n is either a, c, g or t
  misc_feature (311)..(311): n is either a, c, g or t
  misc_feature (405)..(405): n is either a, c, g or t
ggcgggtacgtagggagtaagaagggacggggggtgataggaggagtaaagaacgaggtagtaatgcgggagggggcggaggtaacgagggggagaaggtttataggcgggggggcgaaaagttcgcggcgaagtaaatagcgaggggagagataaggcggncgttaggtagggtgagtggaggaaggaggaggatagaagaacgggcggtggtagtttcggggnggatagtcgagcgagcgttggggacggtgggtcggcgaggacgggtgaggaggtaaagggagtgagcggagattgacggagatagngatagatatgaggaagcgtaagcgggtaataaaattgggggtaggaattagcggaggtggggtagggaaggtagcggtgagcgagaatgtgggngtatagacgaaggtgaagatatggggagatagcgagagggaaggttgatgcgaaggttcggtacgggggacgagaggatgcgaaggtgggacgatcgttaagtatgggagggtgacggtcgacgatagaggtaaggatgcggagtaagttaggtaggagggagcggagggttaaggtaaaagggatagggaaagttacggaagaatgagggataggaatagggggtaaagatt

SEQ ID NO: 8854 - DNA, 638 bp, Artificial Sequence
  chemically treated genomic DNA (Homo sapiens) CpG-island No: 8854
  misc_feature (234)..(234): n is either a, c, g or t
  misc_feature (328)..(328): n is either a, c, g or t
  misc_feature (414)..(414): n is either a, c, g or t
  misc_feature (477)..(477): n is either a, c, g or t
aatctttaccccctattcctatccctcattcttccgtaactttccctatcccttttaccttaaccctccgctccctcctacctaacttactccgcatccttacctctatcgtcgaccgtcaccctcccatacttaacgatcgtcccaccttcgcatcctctcgtcccccgtaccgaaccttcgcatcaaccttccctctcgctatctccccatatcttcaccttcgtctatacncccacattctcgctcaccgctaccttccctaccccacctccgctaattcctacccccaattttattacccgcttacgcttcctcatatctatcnctatctccgtcaatctccgctcactccctttacctcctcacccgtcctcgccgacccaccgtccccaacgctcgctcgactatccnccccgaaactaccaccgcccgttcttctatcctcctccttcctccactcaccctacctaacgnccgccttatctctcccctcgctatttacttcgccgcgaacttttcgcccccccgcctataaaccttctccccctcgttacctccgccccctcccgcattactacctcgttctttactcctcctatcaccccccgtcccttcttactccctacgtacccgcc

SEQ ID NO: 8855 - DNA, 638 bp, Artificial Sequence
  chemically treated genomic DNA (Homo sapiens) CpG-island No: 8855
  misc_feature (234)..(234): n is either a, c, g or t
  misc_feature (328)..(328): n is either a, c, g or t
  misc_feature (414)..(414): n is either a, c, g or t
  misc_feature (477)..(477): n is either a, c, g or t
agtttttgttttttatttttattttttattttttcgtgattttttttgttttttttgttttagtttttcgtttttttttgtttaatttatttcgtatttttgtttttgtcgtcgatcgttatttttttatgtttagcgatcgttttattttcgtattttttcgtttttcgtatcgggttttcgtattagttttttttttcgttgtttttttatatttttattttcgtttatgtntttatattttcgtttatcgttattttttttgttttattttcgttggtttttatttttaattttgttattcgtttacgtttttttatatttattnttgttttcgttagttttcgtttattttttttgtttttttattcgttttcgtcgatttatcgtttttagcgttcgttcgattatttntttcggggttattatcgttcgtttttttgttttttttttttttttatttattttgtttggcgntcgttttattttttttttcgttatttatttcgtcgcgggtttttcgttttttcgtttatggattttttttttttcgttattttcgttttttttcgtattattatttcgttttttattttttttgttatttttcgtttttttttattttttgcgtattcgtt

SEQ ID NO: 8856 - DNA, 638 bp, Artificial Sequence
  chemically treated genomic DNA (Homo sapiens) CpG-island No: 8856
  misc_feature (162)..(162): n is either a, c, g or t
  misc_feature (225)..(225): n is either a, c, g or t
  misc_feature (311)..(311): n is either a, c, g or t
  misc_feature (405)..(405): n is either a, c, g or t
aacgaatacgcaaaaaataaaaaaaaacgaaaaataacaaaaaaaataaaaaacgaaataataatacgaaaaaaaacgaaaataacgaaaaaaaaaaaatccataaacgaaaaaacgaaaaacccgcgacgaaataaataacgaaaaaaaaaataaaacgancgccaaacaaaataaataaaaaaaaaaaaaaaacaaaaaaacgaacgataataaccccgaaanaaataatcgaacgaacgctaaaaacgataaatcgacgaaaacgaataaaaaaacaaaaaaaataaacgaaaactaacgaaaacaanaataaatataaaaaaacgtaaacgaataacaaaattaaaaataaaaaccaacgaaaataaaacaaaaaaaataacgataaacgaaaatataaanacataaacgaaaataaaaatataaaaaaacaacgaaaaaaaaaactaatacgaaaacccgatacgaaaaacgaaaaaatacgaaaataaaacgatcgctaaacataaaaaaataacgatcgacgacaaaaacaaaaatacgaaataaattaaacaaaaaaaaacgaaaaactaaaacaaaaaaaacaaaaaaaatcacgaaaaaataaaaaataaaaataaaaaacaaaaact

SEQ ID NO: 8857 - DNA, 565 bp, Artificial Sequence
  chemically treated genomic DNA (Homo sapiens) CpG-island No: 8857
  misc_feature (10)..(10): n is either a, c, g or t
  misc_feature (133)..(133): n is either a, c, g or t
  misc_feature (144)..(144): n is either a, c, g or t
  misc_feature (221)..(221): n is either a, c, g or t
  misc_feature (234)..(234): n is either a, c, g or t
  misc_feature (239)..(239): n is either a, c, g or t
  misc_feature (288)..(288): n is either a, c, g or t
  misc_feature (333)..(333): n is either a, c, g or t
gcggggtggnaggtgttgggagggggtgtttcgagggttgttagggtggtgtggtgtggtgcggtgaggttgtggtgtgtgtgggcggaggttgagtcgcgttgggatgtgggtgtgtggtgataggggtagngtaggtgtggnggtggggttgtggagtgtgtggcgtagtagtggcgcgggtgcgttgtgtggggcggtgggtggcgcgagacgtgggntgcggagggaggntcgangtgcgggagggtttggagtgaggatgagggagggttttgtagtgggggngggtgtggtggacggaggggttggagagtaggtgaggggggcggngcgagtgtgtgaggtaggtgagggaggtgcgagggatgagggtgtgggagggcgggagggatgtcggtgtgagcgagggtgaggagggggggggggggtggtggggtgcggggtggaggcgaggtgggttgtgaggggcgaggtgaggggaggaggggggaggaggtgtgtgagggggggtgatgtgtaggggagggggggaggagggggaggcggtagatgggggaggggg

SEQ ID NO: 8858 - DNA, 565 bp, Artificial Sequence
  chemically treated genomic DNA (Homo sapiens) CpG-island No: 8858
  misc_feature (233)..(233): n is either a, c, g or t
  misc_feature (278)..(278): n is either a, c, g or t
  misc_feature (327)..(327): n is either a, c, g or t
  misc_feature (332)..(332): n is either a, c, g or t
  misc_feature (345)..(345): n is either a, c, g or t
  misc_feature (422)..(422): n is either a, c, g or t
  misc_feature (433)..(433): n is either a, c, g or t
  misc_feature (556)..(556): n is either a, c, g or t
ccccctcccccatctaccgcctccccctcctccccccctcccctacacatcaccccccctcacacacctcctcccccctcctcccctcacctcgcccctcacaacccacctcgcctccaccccgcaccccaccaccccccccccccctcctcaccctcgctcacaccgacatccctcccgccctcccacaccctcatccctcgcacctccctcacctacctcacacactcgcnccgcccccctcacctactctccaacccctccgtccaccacacccncccccactacaaaaccctccctcatcctcactccaaaccctcccgcacntcgancctccctccgcancccacgtctcgcgccacccaccgccccacacaacgcacccgcgccactactacgccacacactccacaaccccaccnccacacctacnctacccctatcaccacacacccacatcccaacgcgactcaacctccgcccacacacaccacaacctcaccgcaccacaccacaccaccctaacaaccctcgaaacaccccctcccaacacctnccaccccgc

SEQ ID NO: 8859 - DNA, 565 bp, Artificial Sequence
  chemically treated genomic DNA (Homo sapiens) CpG-island No: 8859
  misc_feature (233)..(233): n is either a, c, g or t
  misc_feature (278)..(278): n is either a, c, g or t
  misc_feature (327)..(327): n is either a, c, g or t
  misc_feature (332)..(332): n is either a, c, g or t
  misc_feature (345)..(345): n is either a, c, g or t
  misc_feature (422)..(422): n is either a, c, g or t
  misc_feature (433)..(433): n is either a, c, g or t
  misc_feature (556)..(556): n is either a, c, g or t
tttttttttttatttgtcgtttttttttttttttttttttttttgtatattatttttttttatatattttttttttttttttttttttatttcgttttttataatttatttcgtttttatttcgtattttattattttttttttttttttttattttcgtttatatcggtatttttttcgtttttttatatttttatttttcgtattttttttatttattttatatattcgtntcgttttttttatttgttttttagttttttcgtttattatatttntttttattgtaaaatttttttttatttttattttaaattttttcgtatntcggnttttttttcgtantttacgtttcgcgttatttatcgttttatatagcgtattcgcgttattattgcgttatatattttataattttattnttatatttgtnttgtttttgttattatatatttatattttaacgcggtttaattttcgtttatatatattatagttttatcgtattatattatattattttggtaattttcggggtatttttttttagtatttnttatttcgt

SEQ ID NO: 8860 - DNA, 565 bp, Artificial Sequence
  chemically treated genomic DNA (Homo sapiens) CpG-island No: 8860
  misc_feature (10)..(10): n is either a, c, g or t
  misc_feature (133)..(133): n is either a, c, g or t
  misc_feature (144)..(144): n is either a, c, g or t
  misc_feature (221)..(221): n is either a, c, g or t
  misc_feature (234)..(234): n is either a, c, g or t
  misc_feature (239)..(239): n is either a, c, g or t
  misc_feature (288)..(288): n is either a, c, g or t
  misc_feature (333)..(333): n is either a, c, g or t
acgaaataanaaatactaaaaaaaaataccccgaaaattaccaaaataatataatataatacgataaaactataatatatataaacgaaaattaaaccgcgttaaaatataaatatataataacaaaaacaanacaaatataanaataaaattataaaatatataacgcaataataacgcgaatacgctatataaaacgataaataacgcgaaacgtaaantacgaaaaaaaanccganatacgaaaaaatttaaaataaaaataaaaaaaaattttacaataaaaanaaatataataaacgaaaaaactaaaaaacaaataaaaaaaacganacgaatatataaaataaataaaaaaaatacgaaaaataaaaatataaaaaaacgaaaaaaataccgatataaacgaaaataaaaaaaaaaaaaaaaaataataaaatacgaaataaaaacgaaataaattataaaaaacgaaataaaaaaaaaaaaaaaaaaaaaatatataaaaaaaaataatatacaaaaaaaaaaaaaaaaaaaaaaaaacgacaaataaaaaaaaaaa

SEQ ID NO: 8861 - DNA, 1564 bp, Artificial Sequence
  chemically treated genomic DNA (Homo sapiens) CpG-island No: 8861
  misc_feature (217)..(217): n is either a, c, g or t
  misc_feature (284)..(285): n is either a, c, g or t
  misc_feature (315)..(315): n is either a, c, g or t
  misc_feature (343)..(343): n is either a, c, g or t
  misc_feature (353)..(354): n is either a, c, g or t
  misc_feature (361)..(361): n is either a, c, g or t
  misc_feature (366)..(366): n is either a, c, g or t
  misc_feature (457)..(457): n is either a, c, g or t
  misc_feature (496)..(496): n is either a, c, g or t
  misc_feature (575)..(575): n is either a, c, g or t
  misc_feature (1223)..(1223): n is either a, c, g or t
  misc_feature (1237)..(1237): n is either a, c, g or t
  misc_feature (1277)..(1277): n is either a, c, g or t
  misc_feature (1300)..(1300): n is either a, c, g or t
  misc_feature (1404)..(1404): n is either a, c, g or t
  misc_feature (1511)..(1511): n is either a, c, g or t
  misc_feature (1527)..(1527): n is either a, c, g or t
  misc_feature (1534)..(1534): n is either a, c, g or t
  misc_feature (1544)..(1544): n is either a, c, g or t
  misc_feature (1556)..(1556): n is either a, c, g or t
gcgtgtttcgggggggagagacgggtggtaggggagggggggtgatagagggcgaaggggcgcgggtgaaagggttcggaggcgaggtagtaagtaagggggaggaagaggaggaggagtggggggaagcggtggttggcgcgacgcgtaggtaacgttggatggaagtagagcgggggagatagagtcggtcgtagtggtgggggaggaagtcggngttgaaggttcgggatgtcgtagagaggtttaggatggttgagggggagagagtagaggtcgcgagnngatggaggttgtcggtcggtggcgtggtgnggtcggtaggagtgggagcgaggtcgangcgttgcgannggtggtngatangggagcgaggggcgtgtgtcgggttgggtgtcgagaggcgattgtgggcgagggggtgtttgcgaggtggtgggtttggtttcgtagggangttgtagggtgtatacggattggtcgtggatcgaggcgnggagttcgggattgtacggtgggggagtggttggggcgtgtacgagggtaagggggaagtcggttgttaggcgagacgngggagggacgggaggacgatggggtgttacggttggtggcggatgcgagcggacgcggacgatcgtagtcggagcggagcggtaggtcgtggcgtaatacgcgttaatcggggtggggagaggggggggggggggggtagtcggtggggggtgggtgcgggttttagaagtagtttgtgggggagttgagtagagaaaagaaagggcgggggaaagggcggggaggggagtggagggggaggcggggttgtagaacgtgacggcgtagggggaggtaggggcggtgtgaagatacgggataggtggtgtagggagtgcgggggagggggggggttgtgtagtgagaggtgttgcggggtaggcggtgggggggggtgcggggaggtttgtggagggggagaaagggggtgttaggagaagggagtggggggggcgagggtggggcgagggcgggagggttagggagggtgggagggcgggggtggggggggtagcgggaggttaggagggcgagattagtcggggggaacgagggggaacgcgtggcgcgagggaagggtgggggaggggtcgagcgttggtggtacgggtcgggaggtttagggagggggggagattggaggtaggagaggcggcggggaacgtggngaggttaggggtgngcgggggggggagaggtggggggcgagtggtagcgtcganggcgtggggcgacggaggggggnggagcgcgcgagcggtcggagggaggagaggaggatgaggggggatagggagagtaaggagggggattgagtggttcgaggcgatgcggggcggagcgagtggngcggagagttgtgggtgtttgtgagtagcggaggagtaattgtgacgttgtgcgtggtcgagtcggtggtgagagttgggggttggtagtgtgaagaggttcgaagngttgtagatgcgaggnggagagntttgaggagntgagaggagagnagattttg

SEQ ID NO: 8862 - DNA, 1564 bp, Artificial Sequence
  chemically treated genomic DNA (Homo sapiens) CpG-island No: 8862
  misc_feature (9)..(9): n is either a, c, g or t
  misc_feature (21)..(21): n is either a, c, g or t
  misc_feature (31)..(31): n is either a, c, g or t
  misc_feature (38)..(38): n is either a, c, g or t
  misc_feature (54)..(54): n is either a, c, g or t
  misc_feature (161)..(161): n is either a, c, g or t
  misc_feature (265)..(265): n is either a, c, g or t
  misc_feature (288)..(288): n is either a, c, g or t
  misc_feature (328)..(328): n is either a, c, g or t
  misc_feature (342)..(342): n is either a, c, g or t
  misc_feature (990)..(990): n is either a, c, g or t
  misc_feature (1069)..(1069): n is either a, c, g or t
  misc_feature (1108)..(1108): n is either a, c, g or t
  misc_feature (1199)..(1199): n is either a, c, g or t
  misc_feature (1204)..(1204): n is either a, c, g or t
  misc_feature (1211)..(1212): n is either a, c, g or t
  misc_feature (1222)..(1222): n is either a, c, g or t
  misc_feature (1250)..(1250): n is either a, c, g or t
  misc_feature (1280)..(1281): n is either a, c, g or t
  misc_feature (1348)..(1348): n is either a, c, g or t
caaaatctnctctcctctcanctcctcaaanctctccncctcgcatctacaacncttcgaacctcttcacactaccaacccccaactctcaccaccgactcgaccacgcacaacgtcacaattactcctccgctactcacaaacacccacaactctccgcnccactcgctccgccccgcatcgcctcgaaccactcaatccccctccttactctccctatcccccctcatcctcctctcctccctccgaccgctcgcgcgctccncccccctccgtcgccccacgccntcgacgctaccactcgccccccacctctcccccccccgcncacccctaacctcnccacgttccccgccgcctctcctacctccaatctccccccctccctaaacctcccgacccgtaccaccaacgctcgacccctcccccacccttccctcgcgccacgcgttccccctcgttccccccgactaatctcgccctcctaacctcccgctaccccccccacccccgccctcccaccctccctaaccctcccgccctcgccccaccctcgccccccccactcccttctcctaacaccccctttctccccctccacaaacctccccgcacccccccccaccgcctaccccgcaacacctctcactacacaaccccccccctcccccgcactccctacaccacctatcccgtatcttcacaccgcccctacctccccctacgccgtcacgttctacaaccccgcctccccctccactcccctccccgccctttcccccgccctttcttttctctactcaactcccccacaaactacttctaaaacccgcacccaccccccaccgactacccccccccccccccctctccccaccccgattaacgcgtattacgccacgacctaccgctccgctccgactacgatcgtccgcgtccgctcgcatccgccaccaaccgtaacaccccatcgtcctcccgtccctcccncgtctcgcctaacaaccgacttcccccttaccctcgtacacgccccaaccactcccccaccgtacaatcccgaactccncgcctcgatccacgaccaatccgtatacaccctacaacntccctacgaaaccaaacccaccacctcgcaaacaccccctcgcccacaatcgcctctcgacacccaacccgacacacgcccctcgctcccntatcnaccaccnntcgcaacgcntcgacctcgctcccactcctaccgaccncaccacgccaccgaccgacaacctccatcnnctcgcgacctctactctctccccctcaaccatcctaaacctctctacgacatcccgaaccttcaacnccgacttcctcccccaccactacgaccgactctatctcccccgctctacttccatccaacgttacctacgcgtcgcgccaaccaccgcttccccccactcctcctcctcttcctcccccttacttactacctcgcctccgaaccctttcacccgcgccccttcgccctctatcaccccccctcccctaccacccgtctctcccccccgaaacacgc

SEQ ID NO: 8863 - DNA, 1564 bp, Artificial Sequence
  chemically treated genomic DNA (Homo sapiens) CpG-island No: 8863
  misc_feature (9)..(9): n is either a, c, g or t
  misc_feature (21)..(21): n is either a, c, g or t
  misc_feature (31)..(31): n is either a, c, g or t
  misc_feature (38)..(38): n is either a, c, g or t
  misc_feature (54)..(54): n is either a, c, g or t
  misc_feature (161)..(161): n is either a, c, g or t
  misc_feature (265)..(265): n is either a, c, g or t
  misc_feature (288)..(288): n is either a, c, g or t
  misc_feature (328)..(328): n is either a, c, g or t
  misc_feature (342)..(342): n is either a, c, g or t
  misc_feature (990)..(990): n is either a, c, g or t
  misc_feature (1069)..(1069): n is either a, c, g or t
  misc_feature (1108)..(1108): n is either a, c, g or t
  misc_feature (1199)..(1199): n is either a, c, g or t
  misc_feature (1204)..(1204): n is either a, c, g or t
  misc_feature (1211)..(1212): n is either a, c, g or t
  misc_feature (1222)..(1222): n is either a, c, g or t
  misc_feature (1250)..(1250): n is either a, c, g or t
  misc_feature (1280)..(1281): n is either a, c, g or t
  misc_feature (1348)..(1348): n is either a, c, g or t
taggatttnttttttttttanttttttaggnttttttntttcgtatttataatntttcggatttttttatattgttaatttttaatttttattatcggttcggttacgtatagcgttataattgttttttcgttatttataggtatttatagtttttcgtnttattcgtttcgtttcgtatcgtttcgggttatttaatttttttttttattttttttatttttttttatttttttttttttttttcgatcgttcgcgcgttttnttttttttcgtcgttttacgttntcggcgttgttattcgttttttatttttttttttttcgtntatttttggttttnttacgtttttcgtcgttttttttgtttttagtttttttttttttttgggtttttcggttcgtgttattagcgttcggttttttttttatttttttttcgcgttacgcgttttttttcgtttttttcggttggtttcgtttttttgatttttcgttgttttttttattttcgtttttttattttttttggttttttcgttttcgttttattttcgttttttttattttttttttttaatattttttttttttttttttataaattttttcgtatttttttttatcgtttatttcgtaatattttttattgtataattttttttttttttcgtattttttgtattatttgtttcgtgtttttatatcgtttttatttttttttacgtcgttacgttttgtaatttcgtttttttttttattttttttttcgttttttttttcgtttttttttttttttatttaatttttttataaattatttttaaaattcgtatttattttttatcgattatttttttttttttttttttttttatttcggttggcgcgtgttacgttacgatttgtcgtttcgtttcggttgcgatcgttcgcgttcgttcgtattcgttattagtcgtagtattttatcgttttttcgttttttttncgtttcgtttgatagtcgattttttttttgttttcgtgtacgttttagttatttttttatcgtgtagtttcggattttncgtttcggtttacgattagttcgtgtatattttgtagtntttttgcgaggttagatttattatttcgtaaatattttttcgtttatagtcgtttttcgatatttagttcgatatacgtttttcgtttttntgttnattattnntcgtaacgtntcgatttcgtttttatttttgtcggttntattacgttatcgatcgataatttttattnnttcgcgatttttatttttttttttttaattattttggatttttttacgatatttcggatttttaatntcgatttttttttttattattgcgatcggttttgtttttttcgttttatttttatttagcgttatttgcgcgtcgcgttaattatcgtttttttttattttttttttttttttttttttttatttattgtttcgttttcggatttttttattcgcgttttttcgttttttattatttttttttttttattattcgtttttttttttcggaatacgt

SEQ ID NO: 8864 - DNA, 1564 bp, Artificial Sequence
  chemically treated genomic DNA (Homo sapiens) CpG-island No: 8864
  misc_feature (217)..(217): n is either a, c, g or t
  misc_feature (284)..(285): n is either a, c, g or t
  misc_feature (315)..(315): n is either a, c, g or t
  misc_feature (343)..(343): n is either a, c, g or t
  misc_feature (353)..(354): n is either a, c, g or t
  misc_feature (361)..(361): n is either a, c, g or t
  misc_feature (366)..(366): n is either a, c, g or t
  misc_feature (457)..(457): n is either a, c, g or t
  misc_feature (496)..(496): n is either a, c, g or t
  misc_feature (575)..(575): n is either a, c, g or t
  misc_feature (1223)..(1223): n is either a, c, g or t
  misc_feature (1237)..(1237): n is either a, c, g or t
  misc_feature (1277)..(1277): n is either a, c, g or t
  misc_feature (1300)..(1300): n is either a, c, g or t
  misc_feature (1404)..(1404): n is either a, c, g or t
  misc_feature (1511)..(1511): n is either a, c, g or t
  misc_feature (1527)..(1527): n is either a, c, g or t
  misc_feature (1534)..(1534): n is either a, c, g or t
  misc_feature (1544)..(1544): n is either a, c, g or t
  misc_feature (1556)..(1556): n is either a, c, g or t
acgtattccgaaaaaaaaaaacgaataataaaaaaaaaaaaataataaaaaacgaaaaaacgcgaataaaaaaatccgaaaacgaaacaataaataaaaaaaaaaaaaaaaaaaaaaaataaaaaaaaacgataattaacgcgacgcgcaaataacgctaaataaaaataaaacgaaaaaaacaaaaccgatcgcaataataaaaaaaaaaatcganattaaaaatccgaaatatcgtaaaaaaatccaaaataattaaaaaaaaaaaaataaaaatcgcgaannaataaaaattatcgatcgataacgtaatanaaccgacaaaaataaaaacgaaatcganacgttacgannaataatnaacanaaaaacgaaaaacgtatatcgaactaaatatcgaaaaacgactataaacgaaaaaatatttacgaaataataaatctaacctcgcaaaaanactacaaaatatacacgaactaatcgtaaaccgaaacgnaaaatccgaaactacacgataaaaaaataactaaaacgtacacgaaaacaaaaaaaaaatcgactatcaaacgaaacgnaaaaaaaacgaaaaaacgataaaatactacgactaataacgaatacgaacgaacgcgaacgatcgcaaccgaaacgaaacgacaaatcgtaacgtaacacgcgccaaccgaaataaaaaaaaaaaaaaaaaaaaaaataatcgataaaaaataaatacgaattttaaaaataatttataaaaaaattaaataaaaaaaaaaaaaaacgaaaaaaaaaacgaaaaaaaaaataaaaaaaaaaacgaaattacaaaacgtaacgacgtaaaaaaaaataaaaacgatataaaaacacgaaacaaataatacaaaaaatacgaaaaaaaaaaaaaattatacaataaaaaatattacgaaataaacgataaaaaaaaatacgaaaaaatttataaaaaaaaaaaaaaaaaatattaaaaaaaaaaaataaaaaaaacgaaaataaaacgaaaacgaaaaaaccaaaaaaaataaaaaaacgaaaataaaaaaaacaacgaaaaatcaaaaaaacgaaaccaaccgaaaaaaacgaaaaaaaacgcgtaacgcgaaaaaaaaataaaaaaaaaaccgaacgctaataacacgaaccgaaaaacccaaaaaaaaaaaaaaactaaaaacaaaaaaaacgacgaaaaacgtaanaaaaccaaaaatanacgaaaaaaaaaaaaataaaaaacgaataacaacgccganaacgtaaaacgacgaaaaaaaanaaaacgcgcgaacgatcgaaaaaaaaaaaaaaaaataaaaaaaaataaaaaaaataaaaaaaaaaattaaataacccgaaacgatacgaaacgaaacgaataanacgaaaaactataaatacctataaataacgaaaaaacaattataacgctatacgtaaccgaaccgataataaaaattaaaaattaacaatataaaaaaatccgaaanattataaatacgaaanaaaaaancctaaaaaantaaaaaaaaaanaaatccta

SEQ ID NO: 8865 - DNA, 604 bp, Artificial Sequence
  chemically treated genomic DNA (Homo sapiens) CpG-island No: 8865
agagcgggatgaggtttaaagcgtgaggaatgacgaatgaaagagacgaagcggaaagagagtaagatgaagggggagtggatgagcgagcgtcgaagaagagataaagtggaagagtagtcggggtcgggggacggagcggaggagggtgaggaggtggggggagggcgagaataataatgatcgattaatgatcgggggcgggagtgtgtgttagtgagtggtgttggaatgagggaggcggggagattgtcgagttatgaattggaagtggggcggaagtgtgcgaggtgttcggggatcggtaatgggttcgattcggtcgtgtaggcggttcgaagagaatacggagaagatagcgggataatgggggatacgacgtgcgtcgagcgaggagggagtgacgagtgggttggatatttattgtcgggttagtggaggaggacgatgatggatggcgttgtcgtgtggttagggcggagtgaagacggatggggtgagttgacgggagagcggagacggggacgaggagatattgtttattattagagaggaagagattaggagttcgtgaaataggcgagagagcgtgggagatagcgaa

SEQ ID NO: 8866 - DNA, 604 bp, Artificial Sequence
  chemically treated genomic DNA (Homo sapiens) CpG-island No: 8866
ttcgctatctcccacgctctctcgcctatttcacgaactcctaatctcttcctctctaataataaacaatatctcctcgtccccgtctccgctctcccgtcaactcaccccatccgtcttcactccgccctaaccacacgacaacgccatccatcatcgtcctcctccactaacccgacaataaatatccaacccactcgtcactccctcctcgctcgacgcacgtcgtatcccccattatcccgctatcttctccgtattctcttcgaaccgcctacacgaccgaatcgaacccattaccgatccccgaacacctcgcacacttccgccccacttccaattcataactcgacaatctccccgcctccctcattccaacaccactcactaacacacactcccgcccccgatcattaatcgatcattattattctcgccctccccccacctcctcaccctcctccgctccgtcccccgaccccgactactcttccactttatctcttcttcgacgctcgctcatccactcccccttcatcttactctctttccgcttcgtctctttcattcgtcattcctcacgctttaaacctcatcccgctct

SEQ ID NO: 8867 - DNA, 604 bp, Artificial Sequence
  chemically treated genomic DNA (Homo sapiens) CpG-island No: 8867
ttcgttattttttacgttttttcgtttattttacgagtttttgatttttttttttttaataataaataatattttttcgttttcgttttcgttttttcgttaatttattttattcgtttttatttcgttttgattatacgataacgttatttattatcgtttttttttattggttcgataataaatatttaatttattcgttatttttttttcgttcggcgtacgtcgtattttttattgtttcgttatttttttcgtatttttttcggatcgtttgtacggtcgggtcggatttattatcggttttcggatatttcgtatattttcgttttatttttaatttatggttcgataattttttcgttttttttattttaatattatttattaatatatattttcgttttcggttattggtcggttattgttgttttcgttttttttttatttttttattttttttcgtttcgtttttcggtttcggttgtttttttattttgtttttttttcggcgttcgtttatttattttttttttattttgtttttttttcgtttcgttttttttattcgttattttttacgttttgggttttatttcgtttt

SEQ ID NO: 8868 - DNA, 604 bp, Artificial Sequence
  chemically treated genomic DNA (Homo sapiens) CpG-island No: 8868
aaaacgaaataaaacccaaaacgtaaaaaataacgaataaaaaaaacgaaacgaaaaaaaaacaaaataaaaaaaaaataaataaacgaacgccgaaaaaaaaacaaaataaaaaaacaaccgaaaccgaaaaacgaaacgaaaaaaaataaaaaaataaaaaaaaaacgaaaacaacaataaccgaccaataaccgaaaacgaaaatatatattaataaataatattaaaataaaaaaaacgaaaaaattatcgaaccataaattaaaaataaaacgaaaatatacgaaatatccgaaaaccgataataaatccgacccgaccgtacaaacgatccgaaaaaaatacgaaaaaaataacgaaacaataaaaaatacgacgtacgccgaacgaaaaaaaaataacgaataaattaaatatttattatcgaaccaataaaaaaaaacgataataaataacgttatcgtataatcaaaacgaaataaaaacgaataaaataaattaacgaaaaaacgaaaacgaaaacgaaaaaatattatttattattaaaaaaaaaaaaatcaaaaactcgtaaaataaacgaaaaaacgtaaaaaataacgaa

SEQ ID NO: 8869 - DNA, 510 bp, Artificial Sequence
  chemically treated genomic DNA (Homo sapiens) CpG-island No: 8869
  misc_feature (25)..(25): n is either a, c, g or t
  misc_feature (41)..(41): n is either a, c, g or t
  misc_feature (150)..(150): n is either a, c, g or t
  misc_feature (174)..(174): n is either a, c, g or t
  misc_feature (202)..(202): n is either a, c, g or t
  misc_feature (479)..(479): n is either a, c, g or t
  misc_feature (507)..(507): n is either a, c, g or t
gcggtatagaagacgttcgtagagngagatattagtgaggngggtgttacgagagagagtgatagtgagagtatagcgcggatgtaggtatagaagagtcggtagagttgattgagaaaaagacgggtcgtatgtatgtcgcgttgagangggcgttgttaagattcgcggagnaagggtcgtaagtaggaaggcgtatganaagaagaagaagggaggtttgacgtatcgatcgaatgttgaggggaggagaagaagaaggcgaaggaatataagggagggaggaggaggaagttttttcgtgtatgatgaggatgtagaacggagacgtatgtagagaggaaggcgaggcgcgaggaagaggtaaagatattatgtacgtatagcgaggcgattaggagtattgatgtgagagtggagagagaaggtacgaagatgagaaggatggacggcgaggagagagatgatcgagagggagngagattagattgtagaggacgcgtttantta

SEQ ID NO: 8870 - DNA, 510 bp, Artificial Sequence
  chemically treated genomic DNA (Homo sapiens) CpG-island No: 8870
  misc_feature (4)..(4): n is either a, c, g or t
  misc_feature (32)..(32): n is either a, c, g or t
  misc_feature (309)..(309): n is either a, c, g or t
  misc_feature (337)..(337): n is either a, c, g or t
  misc_feature (361)..(361): n is either a, c, g or t
  misc_feature (470)..(470): n is either a, c, g or t
  misc_feature (486)..(486): n is either a, c, g or t
taantaaacgcgtcctctacaatctaatctcnctccctctcgatcatctctctcctcgccgtccatccttctcatcttcgtaccttctctctccactctcacatcaatactcctaatcgcctcgctatacgtacataatatctttacctcttcctcgcgcctcgccttcctctctacatacgtctccgttctacatcctcatcatacacgaaaaaacttcctcctcctccctcccttatattccttcgccttcttcttctcctcccctcaacattcgatcgatacgtcaaacctcccttcttcttcttntcatacgccttcctacttacgacccttnctccgcgaatcttaacaacgcccntctcaacgcgacatacatacgacccgtctttttctcaatcaactctaccgactcttctatacctacatccgcgctatactctcactatcactctctctcgtaacacccncctcactaatatctcnctctacgaacgtcttctataccgc

SEQ ID NO: 8871 - DNA, 510 bp, Artificial Sequence
  chemically treated genomic DNA (Homo sapiens) CpG-island No: 8871
  misc_feature (4)..(4): n is either a, c, g or t
  misc_feature (32)..(32): n is either a, c, g or t
  misc_feature (309)..(309): n is either a, c, g or t
  misc_feature (337)..(337): n is either a, c, g or t
  misc_feature (361)..(361): n is either a, c, g or t
  misc_feature (470)..(470): n is either a, c, g or t
  misc_feature (486)..(486): n is either a, c, g or t
taantgagcgcgttttttgtagtttaattttnttttttttcgattattttttttttcgtcgtttattttttttattttcgtattttttttttttatttttatattaatatttttggtcgtttcgttatgcgtatatggtgtttttatttttttttcgcgtttcgtttttttttttatatgcgttttcgttttatatttttattatatacgggggagtttttttttttttttttttttatattttttcgtttttttttttttttttttttaatattcggtcgatgcgttaaatttttttttttttttttnttatgcgtttttttatttgcggtttttntttcgcgaattttaataacgtttnttttaacgcgatatatatgcggttcgttttttttttaattaattttgtcggtttttttgtgtttatattcgcgttgtgtttttattattattttttttcgtaatatttnttttattggtattttnttttgcgggcgttttttgtgtcgt

SEQ ID NO: 8872 - DNA, 510 bp, Artificial Sequence
  chemically treated genomic DNA (Homo sapiens) CpG-island No: 8872
  misc_feature (25)..(25): n is either a, c, g or t
  misc_feature (41)..(41): n is either a, c, g or t
  misc_feature (150)..(150): n is either a, c, g or t
  misc_feature (174)..(174): n is either a, c, g or t
  misc_feature (202)..(202): n is either a, c, g or t
  misc_feature (479)..(479): n is either a, c, g or t
  misc_feature (507)..(507): n is either a, c, g or t
acgacacaaaaaacgcccgcaaaanaaaataccaataaaanaaatattacgaaaaaaaataataataaaaacacaacgcgaatataaacacaaaaaaaccgacaaaattaattaaaaaaaaaacgaaccgcatatatatcgcgttaaaanaaacgttattaaaattcgcgaaanaaaaaccgcaaataaaaaaacgcataanaaaaaaaaaaaaaaaaatttaacgcatcgaccgaatattaaaaaaaaaaaaaaaaaaaaacgaaaaaatataaaaaaaaaaaaaaaaaaaaactcccccgtatataataaaaatataaaacgaaaacgcatataaaaaaaaaaacgaaacgcgaaaaaaaaataaaaacaccatatacgcataacgaaacgaccaaaaatattaatataaaaataaaaaaaaaaaatacgaaaataaaaaaaataaacgacgaaaaaaaaaataatcgaaaaaaaanaaaattaaactacaaaaaacgcgctcantta

SEQ ID NO: 8873 - DNA, 522 bp, Artificial Sequence
  chemically treated genomic DNA (Homo sapiens) CpG-island No: 8873
tcgtttgcggtttttcgtgggttcgtttacgtcgcgttgcggttttcgttttcgggtgtttttttgtgttcgggtttcgtttttcgttgttttggttgtgttggtttgcgcgcgtcggtgacgggttcgtgttcgttttttttttcggggtttcgttgttttgggtgttgttggtttttgcgtggtttgttttttcggtgggcggtttttgggttgtttcggtcggttcgttggttcgtttcgcggttgtcggggttcggtttttgttcggtgcgttttcgttcgcgggcgggttcgatttgcgggtgttcggtcgggggtttgtgcgtgcggtcgggtcgtttttgttttggttggtgtttggtgtggcggtttttgtttgcggttgtttgcgggtttggtttgggtggcgggtggtgtcgtttcgttggtggggggtttgtttgtttcggttttggttaaaggttgatttggattcggttggttgtattgtatgttcggcggagggttttggtttaaagt

SEQ ID NO: 8874 - DNA, 522 bp, Artificial Sequence
  chemically treated genomic DNA (Homo sapiens) CpG-island No: 8874
actttaaaccaaaaccctccgccgaacatacaatacaaccaaccgaatccaaatcaacctttaaccaaaaccgaaacaaacaaaccccccaccaacgaaacgacaccacccgccacccaaaccaaacccgcaaacaaccgcaaacaaaaaccgccacaccaaacaccaaccaaaacaaaaacgacccgaccgcacgcacaaacccccgaccgaacacccgcaaatcgaacccgcccgcgaacgaaaacgcaccgaacaaaaaccgaaccccgacaaccgcgaaacgaaccaacgaaccgaccgaaacaacccaaaaaccgcccaccgaaaaaacaaaccacgcaaaaaccaacaacacccaaaacaacgaaaccccgaaaaaaaaaacgaacacgaacccgtcaccgacgcgcgcaaaccaacacaaccaaaacaacgaaaaacgaaacccgaacacaaaaaaacacccgaaaacgaaaaccgcaacgcgacgtaaacgaacccacgaaaaaccgcaaacga

SEQ ID NO: 8875 - DNA, 522 bp, Artificial Sequence
  chemically treated genomic DNA (Homo sapiens) CpG-island No: 8875
attttaagttaagatttttcgtcgaatatatagtgtagttaatcgaatttaaattagtttttagttaaaatcgaaatagataaattttttattaacgaagcgatattattcgttatttagattaaattcgtaaataatcgtaaataaaggtcgttatattaaatattaattaaaataaagacgattcgatcgtacgtataagttttcgatcgggtattcgtaagtcgagttcgttcgcgggcgagagcgtatcgagtagggatcggatttcgatagtcgcgagacggattaacgggtcgatcggaatagtttaaaaatcgtttatcgagagggtagattacgtaagagttaatagtatttaaagtaacgagatttcgaaaggggaggcgggtacggattcgttatcggcgcgcgtaagttaatatagttaaagtagcgagaagcgagattcgagtatagaaagatattcgaaggcggaggtcgtagcgcgacgtgaacgagtttacgaaaaatcgtaagcga

SEQ ID NO: 8876 - DNA, 522 bp, Artificial Sequence
  chemically treated genomic DNA (Homo sapiens) CpG-island No: 8876
tcgcttacgatttttcgtaaactcgttcacgtcgcgctacgacctccgccttcgaatatctttctatactcgaatctcgcttctcgctactttaactatattaacttacgcgcgccgataacgaatccgtacccgcctcccctttcgaaatctcgttactttaaatactattaactcttacgtaatctaccctctcgataaacgatttttaaactattccgatcgacccgttaatccgtctcgcgactatcgaaatccgatccctactcgatacgctctcgcccgcgaacgaactcgacttacgaatacccgatcgaaaacttatacgtacgatcgaatcgtctttattttaattaatatttaatataacgacctttatttacgattatttacgaatttaatctaaataacgaataatatcgcttcgttaataaaaaatttatctatttcgattttaactaaaaactaatttaaattcgattaactacactatatattcgacgaaaaatcttaacttaaaat

SEQ ID NO: 8877 - DNA, 524 bp, Artificial Sequence
  chemically treated genomic DNA (Homo sapiens) CpG-island No: 8877
gattttatggttaatcgttatcgttagcgtcgtatttagacggttgttcgttttatcgatattttcgaattttatcggtagattaaggtgcgtttcggttaggaagttagttttcgcgttgtttggttgttaggttttaaattttagattattacgtatattatcggcgtaattttcgaggatttcgcgtgcggtgttgtcgaacggagtttttatagtttcggattttttattcgatcggagaagtttattagtttggtgttagtatttttatttttcgagatgttttgatattattttacgtcgttagcgaggatcgtcggaacgttatatagggtttcgacgttgttgatataggtcggtttattttatgcgtcggaggttgtcgggaaaggtggtttcgagcgtgggttagtacgacgtttttttagggagttgattaacgttgtttttttttcgtagatgtagcgttttgtttcggtatggacgaatagttcgaaatcgaaatttgtttttataatgtt

SEQ ID NO: 8878 - DNA, 524 bp, Artificial Sequence
  chemically treated genomic DNA (Homo sapiens) CpG-island No: 8878
aacattataaaaacaaatttcgatttcgaactattcgtccataccgaaacaaaacgctacatctacgaaaaaaaaacaacgttaatcaactccctaaaaaaacgtcgtactaacccacgctcgaaaccacctttcccgacaacctccgacgcataaaataaaccgacctatatcaacaacgtcgaaaccctatataacgttccgacgatcctcgctaacgacgtaaaataatatcaaaacatctcgaaaaataaaaatactaacaccaaactaataaacttctccgatcgaataaaaaatccgaaactataaaaactccgttcgacaacaccgcacgcgaaatcctcgaaaattacgccgataatatacgtaataatctaaaatttaaaacctaacaaccaaacaacgcgaaaactaacttcctaaccgaaacgcaccttaatctaccgataaaattcgaaaatatcgataaaacgaacaaccgtctaaatacgacgctaacgataacgattaaccataaaatc

SEQ ID NO: 8879 - DNA, 524 bp, Artificial Sequence
  chemically treated genomic DNA (Homo sapiens) CpG-island No: 8879
aatattatgggaataggtttcgatttcgaattgttcgtttatatcggggtagggcgttatatttgcggggaagaaatagcgttaattaattttttggaaggacgtcgtgttaatttacgttcgaagttatttttttcggtaattttcggcgtatggggtaaatcgatttgtgttaataacgtcgaaattttgtgtaacgtttcggcgattttcgttaacggcgtggagtggtattagaatatttcgaaaagtaaagatgttggtattaagttgatgggttttttcggtcgggtgaaaaattcgggattgtgggaatttcgttcggtaatatcgtacgcgagattttcgaagattacgtcggtggtatgcgtgatggtttgaaatttaaagtttggtagttaggtagcgcggggattgattttttgatcgaagcgtattttgatttgtcgatagaattcgaaagtatcggtaaagcgggtagtcgtttgggtacggcgttggcgatggcggttgattatgagatt

SEQ ID NO: 8880 - DNA, 524 bp, Artificial Sequence
  chemically treated genomic DNA (Homo sapiens) CpG-island No: 8880
aatctcataatcaaccgccatcgccaacgccgtacccaaacgactacccgctttaccgatactttcgaattctatcgacaaatcaaaatacgcttcgatcaaaaaatcaatccccgcgctacctaactaccaaactttaaatttcaaaccatcacgcataccaccgacgtaatcttcgaaaatctcgcgtacgatattaccgaacgaaattcccacaatcccgaatttttcacccgaccgaaaaaacccatcaacttaataccaacatctttacttttcgaaatattctaataccactccacgccgttaacgaaaatcgccgaaacgttacacaaaatttcgacgttattaacacaaatcgatttaccccatacgccgaaaattaccgaaaaaaataacttcgaacgtaaattaacacgacgtccttccaaaaaattaattaacgctatttcttccccgcaaatataacgccctaccccgatataaacgaacaattcgaaatcgaaacctattcccataatatt

SEQ ID NO: 8881 - DNA, 658 bp, Artificial Sequence
  chemically treated genomic DNA (Homo sapiens) CpG-island No: 8881
ttttaggcggttgagcgcgttaatggtatcgacggatggtagtggaatttcgtaggttgcgttgtcgtaagtttcggaagtcggtattatttgttcggaacgggaattttgtttaattatcgtagatttcgttttaagtaaagtttcgacgttgttgatggtattacgggtacgggtgatttcgtagttagtggtatatatgtttattacgaagttttttggcgtaacgttatttaattttaatatatcgagttaagtgtttttcgattaatttttcgtttcgtgcgaaaacgttacgtcgataggggaaaggattagcgttatacgcgtttaaaacggcgggttttttttgtcgttttttttttacgttttcgtggggttaggtgatacgggcgttttttttgtcgtttttttaggtgcgacgtaaaaagaattgcgtttatttcggtttgttaggagatgtttatcgtttttacgattacgaaggtaaagaaggcgtttattttattgtcggagttagcgttacgggtaagttagtaaatatttttatcgtaatattgtcgatatcggtaattaaataggtggtaataaatattattttcgggtttatttgtgtcgcgtcgaggatttgcgggtttataaaaacgatgtatattat

SEQ ID NO: 8882 - DNA, 658 bp, Artificial Sequence
  chemically treated genomic DNA (Homo sapiens) CpG-island No: 8882
ataatatacatcgtttttataaacccgcaaatcctcgacgcgacacaaataaacccgaaaataatatttattaccacctatttaattaccgatatcgacaatattacgataaaaatatttactaacttacccgtaacgctaactccgacaataaaataaacgccttctttaccttcgtaatcgtaaaaacgataaacatctcctaacaaaccgaaataaacgcaattctttttacgtcgcacctaaaaaaacgacaaaaaaaacgcccgtatcacctaaccccacgaaaacgtaaaaaaaaaacgacaaaaaaaacccgccgttttaaacgcgtataacgctaatcctttcccctatcgacgtaacgttttcgcacgaaacgaaaaattaatcgaaaaacacttaactcgatatattaaaattaaataacgttacgccaaaaaacttcgtaataaacatatataccactaactacgaaatcacccgtacccgtaataccatcaacaacgtcgaaactttacttaaaacgaaatctacgataattaaacaaaattcccgttccgaacaaataataccgacttccgaaacttacgacaacgcaacctacgaaattccactaccatccgtcgataccattaacgcgctcaaccgcctaaaa

SEQ ID NO: 8883 - DNA, 658 bp, Artificial Sequence
  chemically treated genomic DNA (Homo sapiens) CpG-island No: 8883
atggtgtatatcgtttttgtgaattcgtaaattttcggcgcggtataaatggattcgaaagtggtgtttgttattatttgtttgattgtcggtatcggtagtattgcgatggggatatttgttaatttattcgtggcgttggtttcggtaatggggtgaacgttttttttgttttcgtggtcgtgggggcgatgggtattttttggtagatcgggatgggcgtaattttttttgcgtcgtatttggaggggcggtaagaaaaacgttcgtattatttgattttacgggagcgtgaaaaaaaaacggtaagaaaaattcgtcgttttggacgcgtatggcgttgatttttttttttatcggcgtggcgttttcgtacggggcgaaagattggtcgaaaagtatttggttcggtatattgggattgagtggcgttgcgttagaaggtttcgtggtgaatatgtatgttattggttacgaaattattcgtattcgtgatgttattaataacgtcgaagttttatttggagcggaatttgcggtggttaaataaggttttcgtttcgaataggtaatatcggttttcgaaatttgcggtaacgtaatttgcggagttttattgttattcgtcgatattattaacgcgtttaatcgtttgaaa

SEQ ID NO: 8884 - DNA, 658 bp, Artificial Sequence
  chemically treated genomic DNA (Homo sapiens) CpG-island No: 8884
tttcaaacgattaaacgcgttaataatatcgacgaataacaataaaactccgcaaattacgttaccgcaaatttcgaaaaccgatattacctattcgaaacgaaaaccttatttaaccaccgcaaattccgctccaaataaaacttcgacgttattaataacatcacgaatacgaataatttcgtaaccaataacatacatattcaccacgaaaccttctaacgcaacgccactcaatcccaatataccgaaccaaatacttttcgaccaatctttcgccccgtacgaaaacgccacgccgataaaaaaaaaaatcaacgccatacgcgtccaaaacgacgaatttttcttaccgtttttttttcacgctcccgtaaaatcaaataatacgaacgtttttcttaccgcccctccaaatacgacgcaaaaaaaattacgcccatcccgatctaccaaaaaatacccatcgcccccacgaccacgaaaacaaaaaaaacgttcaccccattaccgaaaccaacgccacgaataaattaacaaatatccccatcgcaatactaccgataccgacaatcaaacaaataataacaaacaccactttcgaatccatttataccgcgccgaaaatttacgaattcacaaaaacgatatacaccat

SEQ ID NO: 8885 - DNA, 588 bp, Artificial Sequence
  chemically treated genomic DNA (Homo sapiens) CpG-island No: 8885
gcggcggcgatagttatcgttatttttcggtaaagattgttcgttcggttagtagataacgttacgagtgattgagttcgggcgcgggtttttcggtagattcgtattgcgcgatagtaagatattattgatttgatttaataatggtacggtattggtaaagttaaattgattaataacgggcgtgtcgttcggtttgttagtttagattttaatgatatagcgagcgttaattttaatcgtttaggcgttacgatagttatagttggtgttcgttttttatgttagtggggcgacgcgcggtaaggtattattcggtaagggttgcgttttattagttataattcggcgaatgatttacgtcgttttcgacgatattaaaggtcgtttaagtagcggatcgttaggttgtaagcgtaatttgtttgttttgtcgtggcgagtaaacgcggtatacgttgtcgttatattttttagttttgtattagcgtcgtcgagaatgagtgaaagattcggcgtatattcgttgggtaaatataacggtaatttaatattgcgtaattttgtcgtaaatcgtttcggtttata

SEQ ID NO: 8886 - DNA, 588 bp, Artificial Sequence
  chemically treated genomic DNA (Homo sapiens) CpG-island No: 8886
tataaaccgaaacgatttacgacaaaattacgcaatattaaattaccgttatatttacccaacgaatatacgccgaatctttcactcattctcgacgacgctaatacaaaactaaaaaatataacgacaacgtataccgcgtttactcgccacgacaaaacaaacaaattacgcttacaacctaacgatccgctacttaaacgacctttaatatcgtcgaaaacgacgtaaatcattcgccgaattataactaataaaacgcaacccttaccgaataataccttaccgcgcgtcgccccactaacataaaaaacgaacaccaactataactatcgtaacgcctaaacgattaaaattaacgctcgctatatcattaaaatctaaactaacaaaccgaacgacacgcccgttattaatcaatttaactttaccaataccgtaccattattaaatcaaatcaataatatcttactatcgcgcaatacgaatctaccgaaaaacccgcgcccgaactcaatcactcgtaacgttatctactaaccgaacgaacaatctttaccgaaaaataacgataactatcgccgccgc

SEQ ID NO: 8887 - DNA, 588 bp, Artificial Sequence
  chemically treated genomic DNA (Homo sapiens) CpG-island No: 8887
tatggatcgaaacggtttgcggtaaagttacgtaatgttggattgtcgttatatttgtttaacgggtgtgcgtcgaattttttatttattttcggcggcgttggtgtaaaattggaagatatggcggtagcgtatatcgcgtttgttcgttacggtaaggtaggtaaattgcgtttatagtttgacgattcgttgtttgaacggtttttaatgtcgtcgggggcggcgtggattattcgtcggattatggttgatgaagcgtaatttttgtcggatagtgttttgtcgcgcgtcgttttattggtatggaaaacgggtattagttatggttatcgtgacgtttgggcgattggggttaacgttcgttatgttattgggatttggattggtagatcggacggtacgttcgttgttggttagtttggttttgttagtgtcgtattattgttgaattaggttaataatattttattgtcgcgtagtgcgaatttgtcggaagattcgcgttcgaatttagttattcgtggcgttatttgttggtcgggcggatagtttttgtcggaaggtgacggtaattgtcgtcgtcgt

SEQ ID NO: 8888 - DNA, 588 bp, Artificial Sequence
  chemically treated genomic DNA (Homo sapiens) CpG-island No: 8888
acgacgacgacaattaccgtcaccttccgacaaaaactatccgcccgaccaacaaataacgccacgaataactaaattcgaacgcgaatcttccgacaaattcgcactacgcgacaataaaatattattaacctaattcaacaataatacgacactaacaaaaccaaactaaccaacaacgaacgtaccgtccgatctaccaatccaaatcccaataacataacgaacgttaaccccaatcgcccaaacgtcacgataaccataactaatacccgttttccataccaataaaacgacgcgcgacaaaacactatccgacaaaaattacgcttcatcaaccataatccgacgaataatccacgccgcccccgacgacattaaaaaccgttcaaacaacgaatcgtcaaactataaacgcaatttacctaccttaccgtaacgaacaaacgcgatatacgctaccgccatatcttccaattttacaccaacgccgccgaaaataaataaaaaattcgacgcacacccgttaaacaaatataacgacaatccaacattacgtaactttaccgcaaaccgtttcgatccata

SEQ ID NO: 8889 - DNA, 727 bp, Artificial Sequence
  chemically treated genomic DNA (Homo sapiens) CpG-island No: 8889
ttcgattacgatatacgtttagatatattatattagcgtagtaattatcgttgttagtatatatcgagtacgtattttcgcgacgtttatgtattttagatattagattatagttgtattttacgcgtatagcgatttacgtcgatataatatagtttatatacgagagattatttaatatatttgtacgatgtatagatagtatacgttgtttagtgatatgattgatgttttatttacgttaatatttagagattttagagcgcgcgtattgatcgtaatcgtgagatagatatcgcgatcggatatatagacgtttatattgagagttatgcgttatattttatagcgagatatcgttcgatattatagacgtacgtatatattagcgtgtacgtgtattagcgatcgttagcgattataatacgtagcgtatatcgtcgacgaatattgagttattagtattattattagatacgcgttcgtacgagatttagtatgcgtgtacgttgtattagtgagtcgtcgtcgatacgagtttcgagtagttttgttatattatacgttgtagatagcgtagttacgtttacgtagttgaacgatcgtattgatttattatcgtagtatattatagattaatcgtgattagcgattatagattatatcgattgcggttattgtagtttgatttagtagttgtataggttatttgttatattatgtagat

SEQ ID NO: 8890 - DNA, 727 bp, Artificial Sequence
  chemically treated genomic DNA (Homo sapiens) CpG-island No: 8890
atctacataatataacaaataacctatacaactactaaatcaaactacaataaccgcaatcgatataatctataatcgctaatcacgattaatctataatatactacgataataaatcaatacgatcgttcaactacgtaaacgtaactacgctatctacaacgtataatataacaaaactactcgaaactcgtatcgacgacgactcactaatacaacgtacacgcatactaaatctcgtacgaacgcgtatctaataataatactaataactcaatattcgtcgacgatatacgctacgtattataatcgctaacgatcgctaatacacgtacacgctaatatatacgtacgtctataatatcgaacgatatctcgctataaaatataacgcataactctcaatataaacgtctatatatccgatcgcgatatctatctcacgattacgatcaatacgcgcgctctaaaatctctaaatattaacgtaaataaaacatcaatcatatcactaaacaacgtatactatctatacatcgtacaaatatattaaataatctctcgtatataaactatattatatcgacgtaaatcgctatacgcgtaaaatacaactataatctaatatctaaaatacataaacgtcgcgaaaatacgtactcgatatatactaacaacgataattactacgctaatataatatatctaaacgtatatcgtaatcgaa

SEQ ID NO: 8891 - DNA, 727 bp, Artificial Sequence
  chemically treated genomic DNA (Homo sapiens) CpG-island No: 8891
atttgtatgatgtggtagatagtttgtatagttgttagattaggttgtagtagtcgtagtcgatgtggtttatagtcgttagttacggttggtttatagtgtgttacgatgatgagttagtgcgatcgtttagttgcgtgagcgtagttacgttatttgtagcgtgtgatgtgatagagttattcggagttcgtatcgacgacggtttattgatgtagcgtgtacgtatgttgagtttcgtgcgagcgcgtatttaatagtgatgttggtgatttagtattcgtcgacggtatgcgttgcgtgttgtggtcgttagcgatcgttagtgtacgtgtacgttagtatgtgcgtgcgtttgtagtgtcggacgatatttcgttatagagtgtgacgtatagtttttagtgtagacgtttgtgtgttcgatcgcgatgtttgttttacgattacggttagtgcgcgcgttttgaggtttttggatgttgacgtgagtgaagtattagttatgttattggatagcgtatgttgtttgtatatcgtgtaggtgtgttgagtggtttttcgtgtgtggattgtgttgtgtcgacgtgagtcgttgtgcgcgtgggatatagttgtggtttgatatttggagtatatgggcgtcgcgagagtacgtgttcgatgtgtgttggtagcgatggttgttgcgttgatgtgatgtgtttgagcgtgtgtcgtaatcgga

SEQ ID NO: 8892 - DNA, 727 bp, Artificial Sequence
  chemically treated genomic DNA (Homo sapiens) CpG-island No: 8892
tccgattacgacacacgctcaaacacatcacatcaacgcaacaaccatcgctaccaacacacatcgaacacgtactctcgcgacgcccatatactccaaatatcaaaccacaactatatcccacgcgcacaacgactcacgtcgacacaacacaatccacacacgaaaaaccactcaacacacctacacgatatacaaacaacatacgctatccaataacataactaatacttcactcacgtcaacatccaaaaacctcaaaacgcgcgcactaaccgtaatcgtaaaacaaacatcgcgatcgaacacacaaacgtctacactaaaaactatacgtcacactctataacgaaatatcgtccgacactacaaacgcacgcacatactaacgtacacgtacactaacgatcgctaacgaccacaacacgcaacgcataccgtcgacgaatactaaatcaccaacatcactattaaatacgcgctcgcacgaaactcaacatacgtacacgctacatcaataaaccgtcgtcgatacgaactccgaataactctatcacatcacacgctacaaataacgtaactacgctcacgcaactaaacgatcgcactaactcatcatcgtaacacactataaaccaaccgtaactaacgactataaaccacatcgactacgactactacaacctaatctaacaactatacaaactatctaccacatcatacaaat

SEQ ID NO: 8893 - DNA, 600 bp, Artificial Sequence
  chemically treated genomic DNA (Homo sapiens) CpG-island No: 8893
ggtattattagatacgtttcgcgatacgattattttatattatttcgattagtagtagcgatttattaacgtttatatttcgtataatatacgtattacgagtagtataacgtttttatttaagttttatattagtttttttatagtcgtaatttagacgttaatacgttatattagtgtatagttttaatcgatatacgtagcgttacgaataatattagtatgtttttcgtattatttttagtatattatacgtatttgtatatttacgttttgacggatgagagattttacgatatagataagacgcgcgtaatacgtacgattagagatatttaattatttcgacgtagttagttatattttcgaatattttatagcgatttttatattatgttacgttagattattattgcgattatattatattatatcgtagagatattacgatattttttgtacgtatttgttatatattttagttaattagagtatacgaacgtttattattattatacgatagttttattttatacgagatgagattatattagatatatagttatatagacgacgatattattttcgttacgtgttggt

SEQ ID NO: 8894 - DNA, 600 bp, Artificial Sequence
  chemically treated genomic DNA (Homo sapiens) CpG-island No: 8894
accaacacgtaacgaaaataatatcgtcgtctatataactatatatctaatataatctcatctcgtataaaataaaactatcgtataataataataaacgttcgtatactctaattaactaaaatatataacaaatacgtacaaaaaatatcgtaatatctctacgatataatataatataatcgcaataataatctaacgtaacataatataaaaatcgctataaaatattcgaaaatataactaactacgtcgaaataattaaatatctctaatcgtacgtattacgcgcgtcttatctatatcgtaaaatctctcatccgtcaaaacgtaaatatacaaatacgtataatatactaaaaataatacgaaaaacatactaatattattcgtaacgctacgtatatcgattaaaactatacactaatataacgtattaacgtctaaattacgactataaaaaaactaatataaaacttaaataaaaacgttatactactcgtaatacgtatattatacgaaatataaacgttaataaatcgctactactaatcgaaataatataaaataatcgtatcgcgaaacgtatctaataatacc

SEQ ID NO: 8895 - DNA, 600 bp, Artificial Sequence
  chemically treated genomic DNA (Homo sapiens) CpG-island No: 8895
attaatacgtagcggaggtgatgtcgtcgtttgtgtggttgtatgtttggtatggttttatttcgtgtgggatggagttgtcgtgtggtggtggtggacgttcgtgtattttggttggttgaggtatgtggtaggtgcgtgtaagagatgtcgtggtgtttttacggtgtggtgtgatgtgatcgtagtggtgatttgacgtgatatgatgtgggggtcgttgtggagtgttcgagagtgtagttggttacgtcggagtggttggatgtttttagtcgtgcgtgttgcgcgcgttttgtttgtgtcgtggggttttttattcgttagagcgtgagtgtgtaggtgcgtgtggtgtgttaagagtgatacgaggaatatgttgatgttgttcgtagcgttacgtgtgtcgattggagttatgtattagtgtggcgtgttagcgtttgggttgcgattgtgaggagattagtgtgaggtttgggtgaaggcgttgtattgttcgtagtgcgtgtgttgtgcggagtgtgggcgttgatgagtcgttgttgttagtcgagatgatgtaggatagtcgtgtcgcggagcgtgtttggtggtgtt

SEQ ID NO: 8896 - DNA, 600 bp, Artificial Sequence
  chemically treated genomic DNA (Homo sapiens) CpG-island No: 8896
aacaccaccaaacacgctccgcgacacgactatcctacatcatctcgactaacaacaacgactcatcaacgcccacactccgcacaacacacgcactacgaacaatacaacgccttcacccaaacctcacactaatctcctcacaatcgcaacccaaacgctaacacgccacactaatacataactccaatcgacacacgtaacgctacgaacaacatcaacatattcctcgtatcactcttaacacaccacacgcacctacacactcacgctctaacgaataaaaaaccccacgacacaaacaaaacgcgcgcaacacgcacgactaaaaacatccaaccactccgacgtaaccaactacactctcgaacactccacaacgacccccacatcatatcacgtcaaatcaccactacgatcacatcacaccacaccgtaaaaacaccacgacatctcttacacgcacctaccacatacctcaaccaaccaaaatacacgaacgtccaccaccaccacacgacaactccatcccacacgaaataaaaccataccaaacatacaaccacacaaacgacgacatcacctccgctacgtattaat

SEQ ID NO: 8897 - DNA, 509 bp, Artificial Sequence
  chemically treated genomic DNA (Homo sapiens) CpG-island No: 8897
cgatagttaaggttttttcggatcgtacgttggattttgttttttcggtttttaacgggagacgggttgtcgtaaagtttcgttttgtcgattgttgtaaagcgttttacgattgaattcggaatcgatttatggttagtagtcgttttcgttttgttttaaatatttgggttttaggagtcgggcggaggtgattgtcgcgtgtttgcgttgtacgtttatcgttcgaaatacggcggcggttttagggttgttgcggtttcggcgggggtaggtttcggcgttcgttcgtttttcggtttttattattttagggtgtatcgcggcgggcgcgggcgcgcggttatgttgcggtagtttgttgttttttttttgcggaggcgaagggttagttgtggatcgcgaagcgttcggtttcgtttttgttttttgtagtttttttttttttttgtttttcgttattcgtattcgggttcggattaggtacgtcggtttattagttggtttgg

SEQ ID NO: 8898 - DNA, 509 bp, Artificial Sequence
  chemically treated genomic DNA (Homo sapiens) CpG-island No: 8898
ccaaaccaactaataaaccgacgtacctaatccgaacccgaatacgaataacgaaaaacaaaaaaaaaaaaaaactacaaaaaacaaaaacgaaaccgaacgcttcgcgatccacaactaacccttcgcctccgcaaaaaaaaaacaacaaactaccgcaacataaccgcgcgcccgcgcccgccgcgatacaccctaaaataataaaaaccgaaaaacgaacgaacgccgaaacctacccccgccgaaaccgcaacaaccctaaaaccgccgccgtatttcgaacgataaacgtacaacgcaaacacgcgacaatcacctccgcccgactcctaaaacccaaatatttaaaacaaaacgaaaacgactactaaccataaatcgattccgaattcaatcgtaaaacgctttacaacaatcgacaaaacgaaactttacgacaacccgtctcccgttaaaaaccgaaaaaacaaaatccaacgtacgatccgaaaaaaccttaactatcg

SEQ ID NO: 8899 - DNA, 509 bp, Artificial Sequence
  chemically treated genomic DNA (Homo sapiens) CpG-island No: 8899
ttaagttagttggtgggtcgacgtgtttggttcgggttcgggtacgggtgacggaggatagagaagggagggggttgtaggaggtagaggcgaagtcgggcgtttcgcggtttatagttggtttttcgttttcgtaggaagaaaataataaattatcgtaatatggtcgcgcgttcgcgttcgtcgcggtgtattttgggatgatggaggtcgggaggcgggcgggcgtcggggtttgttttcgtcgaggtcgtagtagttttgaggtcgtcgtcgtgtttcgggcggtgggcgtgtaacgtaaatacgcggtagttattttcgttcggtttttgaaatttaaatgtttgaagtagggcggggacgattgttggttataggtcgatttcgggtttagtcgtaaggcgttttgtagtagtcggtaaagcgaagttttacggtagttcgtttttcgttaggagtcggggaggtaaggtttagcgtacggttcgggggaattttaattgtcg

SEQ ID NO: 8900 - DNA, 509 bp, Artificial Sequence
  chemically treated genomic DNA (Homo sapiens) CpG-island No: 8900
cgacaattaaaattcccccgaaccgtacgctaaaccttacctccccgactcctaacgaaaaacgaactaccgtaaaacttcgctttaccgactactacaaaacgccttacgactaaacccgaaatcgacctataaccaacaatcgtccccgccctacttcaaacatttaaatttcaaaaaccgaacgaaaataactaccgcgtatttacgttacacgcccaccgcccgaaacacgacgacgacctcaaaactactacgacctcgacgaaaacaaaccccgacgcccgcccgcctcccgacctccatcatcccaaaatacaccgcgacgaacgcgaacgcgcgaccatattacgataatttattattttcttcctacgaaaacgaaaaaccaactataaaccgcgaaacgcccgacttcgcctctacctcctacaaccccctcccttctctatcctccgtcacccgtacccgaacccgaaccaaacacgtcgacccaccaactaacttaa

SEQ ID NO: 8901 - DNA, 655 bp, Artificial Sequence
  chemically treated genomic DNA (Homo sapiens) CpG-island No: 8901
gttataattacgttgtttttttttatatatatttcgcgtttcgtttttattttttatattgtgattcgttttttcgtttttcgtgttttattgttttatttttttatatattgcgcgatttgcgttttttagcgtcgttttttcgatttgttttttatttttgtcggatgacgttttacgtatttagttttagttttattgtttgtttttttgaggtatcgtgtcggttttttcgaggttttttgtatatttttacgtggcggcgtgtttgttttttcgggttttcgtgtagtttttttcggcgtcgcgtgtacgtttttacggggtatcgtgtaggttttttcgaggtcgcgtgtagatttttacggggtagcgtgtaggtttttacggggtatcgtgtaggtttttacgaggtagcgtgtaggtttttacggggtatcgtgtagttttttacggcgcggcgtgatattttttacggcgcggcgtttaggtttttacggggtatcgtgtcgatttttacggggtagtttgtaggtttttacggggtagcgtgtaggtttttacgaggtatcgtgtaggtttttacgaggtagcgtgtaggtttttgagaggtatcgtgtaggtttttatggggtagtatggaattaattataag

SEQ ID NO: 8902 - DNA, 655 bp, Artificial Sequence
  chemically treated genomic DNA (Homo sapiens) CpG-island No: 8902
cttataattaattccatactaccccataaaaacctacacgatacctctcaaaaacctacacgctacctcgtaaaaacctacacgatacctcgtaaaaacctacacgctaccccgtaaaaacctacaaactaccccgtaaaaatcgacacgataccccgtaaaaacctaaacgccgcgccgtaaaaaatatcacgccgcgccgtaaaaaactacacgataccccgtaaaaacctacacgctacctcgtaaaaacctacacgataccccgtaaaaacctacacgctaccccgtaaaaatctacacgcgacctcgaaaaaacctacacgataccccgtaaaaacgtacacgcgacgccgaaaaaaactacacgaaaacccgaaaaaacaaacacgccgccacgtaaaaatatacaaaaaacctcgaaaaaaccgacacgatacctcaaaaaaacaaacaataaaactaaaactaaatacgtaaaacgtcatccgacaaaaataaaaaacaaatcgaaaaaacgacgctaaaaaacgcaaatcgcgcaatatataaaaaaataaaacaataaaacacgaaaaacgaaaaaacgaatcacaatataaaaaataaaaacgaaacgcgaaatatatataaaaaaaaacaacgtaattataac

SEQ ID NO: 8903 - DNA, 655 bp, Artificial Sequence
  chemically treated genomic DNA (Homo sapiens) CpG-island No: 8903
tttgtgattgattttatgttgttttatgaagatttgtacggtgttttttaaagatttgtacgttgtttcgtgaagatttgtacggtgtttcgtgaagatttgtacgttgtttcgtgaagatttgtaagttgtttcgtgaagatcggtacggtgtttcgtgaagatttggacgtcgcgtcgtgaagagtgttacgtcgcgtcgtggaagattatacggtgtttcgtgaagatttgtacgttgtttcgtgaagatttgtacggtatttcgtgaagatttgtacgttgtttcgtgaagatttgtacgcggtttcgagaagatttgtacggtgtttcgtgaagacgtgtacgcggcgtcgggagagattgtacggagattcgggaggataggtacgtcgttacgtgaggatgtgtagggagtttcgggaagatcgatacggtgttttaggaggataggtagtggggttggagttagatgcgtggagcgttattcggtagaggtagagagtaggtcggaggagcgacgttagagaacgtagatcgcgtagtgtgtagggagatagggtagtaggatacggaagacgggaaagcggattatagtgtaagagatggagacgggacgcgaggtgtgtgtaagaggaagtagcgtgattgtgat

SEQ ID NO: 8904 - DNA, 655 bp, Artificial Sequence
  chemically treated genomic DNA (Homo sapiens) CpG-island No: 8904
atcacaatcacgctacttcctcttacacacacctcgcgtcccgtctccatctcttacactataatccgctttcccgtcttccgtatcctactaccctatctccctacacactacgcgatctacgttctctaacgtcgctcctccgacctactctctacctctaccgaataacgctccacgcatctaactccaaccccactacctatcctcctaaaacaccgtatcgatcttcccgaaactccctacacatcctcacgtaacgacgtacctatcctcccgaatctccgtacaatctctcccgacgccgcgtacacgtcttcacgaaacaccgtacaaatcttctcgaaaccgcgtacaaatcttcacgaaacaacgtacaaatcttcacgaaataccgtacaaatcttcacgaaacaacgtacaaatcttcacgaaacaccgtataatcttccacgacgcgacgtaacactcttcacgacgcgacgtccaaatcttcacgaaacaccgtaccgatcttcacgaaacaacttacaaatcttcacgaaacaacgtacaaatcttcacgaaacaccgtacaaatcttcacgaaacaacgtacaaatctttaaaaaacaccgtacaaatcttcataaaacaacataaaatcaatcacaaa

SEQ ID NO: 8905 - DNA, 849 bp, Artificial Sequence
  chemically treated genomic DNA (Homo sapiens) CpG-island No: 8905
ttcgcgtttagtcggtttcgcgtagttttatttggatgttcgttttcggcggtttgtagggttttgtaggcggtcgttggacggtaggtaggaggcgtggagtggttagtaggcggtcgttgtacgggttttttcgtttggcgtcgaatacgggcgtaatagcgtttttagtagtcgtagtttcggcgttatcgcgttttttggttcggtttcggtattagtatttcgattagcgtcgtttcggtcgtcgtcggtcgcgtacgtttcgtagtatttttcgtagcggcgcgcggttttcgggcggttagcgacgacgcgcggtatagtacgaagattagcggcgagcggatggcgcggtcgtcgtcgtcgcgttttcgtcgttttagtcgttttcgtcgttttttgcgtttcgcgtcgtttcgggtttcgcgttttttgtcgtcgcgtcgttcggtttggtcgcgtttggtttcggcgggaatatcgttcgtgcgaagtttcgtagtagcgcgcgttttgttcgcgtttttatagttcgtttattagtagtatttgttcgcggtttttcgtcgtttttattaacgtttggaagggcggttcggtagggcgcgtaagtcgggtcgttagcgtttttagttcgcgttttatgttggtcgtcggtcgttttttgcgtcgtcgcggtcgggcgtattcgttgttcgtttttcgggcggtggcgtttcggtatagaggatacgttttcgaggtcgagtttagtcggatttttcggtttcggcggggtttttgtgtgtttatttttttgggcgattatatcgcgggttcgggtgggaggaagagggtttttttttt

SEQ ID NO: 8906 - DNA, 849 bp, Artificial Sequence
  chemically treated genomic DNA (Homo sapiens) CpG-island No: 8906
aaaaaaaaaaccctcttcctcccacccgaacccgcgatataatcgcccaaaaaaataaacacacaaaaaccccgccgaaaccgaaaaatccgactaaactcgacctcgaaaacgtatcctctataccgaaacgccaccgcccgaaaaacgaacaacgaatacgcccgaccgcgacgacgcaaaaaacgaccgacgaccaacataaaacgcgaactaaaaacgctaacgacccgacttacgcgccctaccgaaccgcccttccaaacgttaataaaaacgacgaaaaaccgcgaacaaatactactaataaacgaactataaaaacgcgaacaaaacgcgcgctactacgaaacttcgcacgaacgatattcccgccgaaaccaaacgcgaccaaaccgaacgacgcgacgacaaaaaacgcgaaacccgaaacgacgcgaaacgcaaaaaacgacgaaaacgactaaaacgacgaaaacgcgacgacgacgaccgcgccatccgctcgccgctaatcttcgtactataccgcgcgtcgtcgctaaccgcccgaaaaccgcgcgccgctacgaaaaatactacgaaacgtacgcgaccgacgacgaccgaaacgacgctaatcgaaatactaataccgaaaccgaaccaaaaaacgcgataacgccgaaactacgactactaaaaacgctattacgcccgtattcgacgccaaacgaaaaaacccgtacaacgaccgcctactaaccactccacgcctcctacctaccgtccaacgaccgcctacaaaaccctacaaaccgccgaaaacgaacatccaaataaaactacgcgaaaccgactaaacgcgaa

SEQ ID NO: 8907 - DNA, 849 bp, Artificial Sequence
  chemically treated genomic DNA (Homo sapiens) CpG-island No: 8907
gaggagaaagtttttttttttttattcgggttcgcgatgtggtcgtttagaggggtaagtatatagaggtttcgtcggggtcgaggggttcggttgggttcggtttcgggggcgtgttttttgtgtcggggcgttatcgttcgagaggcgggtagcgggtgcgttcggtcgcggcggcgtagagggcggtcggcggttagtatggagcgcgagttggaggcgttggcggttcggtttgcgcgttttgtcgagtcgtttttttaggcgttggtggaagcggcggggggtcgcgggtaggtgttgttggtgggcgagttgtgggagcgcgaatagagcgcgcgttgttgcgggatttcgtacgggcggtgttttcgtcggagttaggcgcggttaagtcgggcggcgcggcggtagagggcgcggggttcggggcggcgcggggcgtagagggcggcgagggcggttggggcggcgggggcgcggcggcggcggtcgcgttattcgttcgtcgttggttttcgtgttgtgtcgcgcgtcgtcgttggtcgttcgggagtcgcgcgtcgttgcgggagatgttgcgggacgtgcgcggtcggcggcggtcggggcggcgttggtcggggtgttggtgtcgaggtcgggttagaggacgcggtggcgtcggggttgcggttgttggaggcgttgttgcgttcgtgttcggcgttaggcgggggggttcgtgtagcggtcgtttattgattattttacgttttttgtttgtcgtttagcggtcgtttgtagggttttgtaagtcgtcggagacgggtatttaggtgagattgcgcggggtcggttgggcgcggg

SEQ ID NO: 8908 - DNA, 849 bp, Artificial Sequence
  chemically treated genomic DNA (Homo sapiens) CpG-island No: 8908
cccgcgcccaaccgaccccgcgcaatctcacctaaatacccgtctccgacgacttacaaaaccctacaaacgaccgctaaacgacaaacaaaaaacgtaaaataatcaataaacgaccgctacacgaacccccccgcctaacgccgaacacgaacgcaacaacgcctccaacaaccgcaaccccgacgccaccgcgtcctctaacccgacctcgacaccaacaccccgaccaacgccgccccgaccgccgccgaccgcgcacgtcccgcaacatctcccgcaacgacgcgcgactcccgaacgaccaacgacgacgcgcgacacaacacgaaaaccaacgacgaacgaataacgcgaccgccgccgccgcgcccccgccgccccaaccgccctcgccgccctctacgccccgcgccgccccgaaccccgcgccctctaccgccgcgccgcccgacttaaccgcgcctaactccgacgaaaacaccgcccgtacgaaatcccgcaacaacgcgcgctctattcgcgctcccacaactcgcccaccaacaacacctacccgcgaccccccgccgcttccaccaacgcctaaaaaaacgactcgacaaaacgcgcaaaccgaaccgccaacgcctccaactcgcgctccatactaaccgccgaccgccctctacgccgccgcgaccgaacgcacccgctacccgcctctcgaacgataacgccccgacacaaaaaacacgcccccgaaaccgaacccaaccgaacccctcgaccccgacgaaacctctatatacttacccctctaaacgaccacatcgcgaacccgaataaaaaaaaaaaaactttctcctc

SEQ ID NO: 8909 - DNA, 637 bp, Artificial Sequence
  chemically treated genomic DNA (Homo sapiens) CpG-island No: 8909
ttaggcggtcgttcggttttgtcgaagaaagatttttggatcgtagcgagaagtggtagtattcggcggcggcggagcgggcgcgtcgggttttttttcggaataagaggttcgtagagtttcggttttttaaacgtatcgttgttttttttagtattaggacggcgggcggagggtggttcggttgtattcggggacgcgtttatttgttgttcggtcgcggatattcgcgttattttagttcggtcgttattttcgtagtcgttattcgggtaatcgtcgtcgttatttcggcgttacgtgggggcggttagtaatcgcgcggggtcgtcgacgcgagagtagatttgggagggaaggtgggcgatttcgaaattttttggcggcggaagtgagggtttatagtttagtagtggtgaaggtttacgcgttggatgatcgcgttttttgtggtttttttattattttattttcgttcgtttatttattcgtttatttttttttcgttgcgttagtcgttgcgtcggttttcgggatgagtcggagtaggtttaattttttgttttaaggagttcgtggtcgcgtagagaatataaattaggatagtgtggtgttcgtggggaaagagttaggtatg

SEQ ID NO: 8910 - DNA, 637 bp, Artificial Sequence
  chemically treated genomic DNA (Homo sapiens) CpG-island No: 8910
catacctaactctttccccacgaacaccacactatcctaatttatattctctacgcgaccacgaactccttaaaacaaaaaattaaacctactccgactcatcccgaaaaccgacgcaacgactaacgcaacgaaaaaaaaataaacgaataaataaacgaacgaaaataaaataataaaaaaaccacaaaaaacgcgatcatccaacgcgtaaaccttcaccactactaaactataaaccctcacttccgccgccaaaaaatttcgaaatcgcccaccttccctcccaaatctactctcgcgtcgacgaccccgcgcgattactaaccgcccccacgtaacgccgaaataacgacgacgattacccgaataacgactacgaaaataacgaccgaactaaaataacgcgaatatccgcgaccgaacaacaaataaacgcgtccccgaatacaaccgaaccaccctccgcccgccgtcctaatactaaaaaaaacaacgatacgtttaaaaaaccgaaactctacgaacctcttattccgaaaaaaaacccgacgcgcccgctccgccgccgccgaatactaccacttctcgctacgatccaaaaatctttcttcgacaaaaccgaacgaccgcctaa

SEQ ID NO: 8911 - DNA, 637 bp, Artificial Sequence
  chemically treated genomic DNA (Homo sapiens) CpG-island No: 8911
tatgtttgattttttttttacggatattatattgttttagtttgtgttttttacgcgattacgagttttttgagataaggggttgagtttgtttcggtttatttcgagagtcggcgtagcgattggcgtaacgaaagggaaatgaacgaatgaatgaacgaacgaaagtggagtggtggagagattatagaagacgcggttatttagcgcgtgaatttttattattgttgggttgtggatttttattttcgtcgttaggaagtttcggggtcgtttatttttttttttaggtttgttttcgcgtcggcggtttcgcgcgattgttggtcgtttttacgtgacgtcggggtggcggcggcggttgttcgggtgacggttgcggaggtggcggtcgggttgggatagcgcgagtgttcgcggtcgagtagtaggtaagcgcgttttcggatgtagtcgggttatttttcgttcgtcgttttggtgttgggaggagtagcggtgcgtttggagggtcgaggttttgcggattttttgtttcgaggaaaaattcgacgcgttcgtttcgtcgtcgtcggatgttattatttttcgttgcggtttagggattttttttcggtaaggtcgagcggtcgtttgg

SEQ ID NO: 8912 - DNA, 637 bp, Artificial Sequence
  chemically treated genomic DNA (Homo sapiens) CpG-island No: 8912
ccaaacgaccgctcgaccttaccgaaaaaaaatccctaaaccgcaacgaaaaataataacatccgacgacgacgaaacgaacgcgtcgaatttttcctcgaaacaaaaaatccgcaaaacctcgaccctccaaacgcaccgctactcctcccaacaccaaaacgacgaacgaaaaataacccgactacatccgaaaacgcgcttacctactactcgaccgcgaacactcgcgctatcccaacccgaccgccacctccgcaaccgtcacccgaacaaccgccgccgccaccccgacgtcacgtaaaaacgaccaacaatcgcgcgaaaccgccgacgcgaaaacaaacctaaaaaaaaaaataaacgaccccgaaacttcctaacgacgaaaataaaaatccacaacccaacaataataaaaattcacgcgctaaataaccgcgtcttctataatctctccaccactccactttcgttcgttcattcattcgttcatttccctttcgttacgccaatcgctacgccgactctcgaaataaaccgaaacaaactcaaccccttatctcaaaaaactcgtaatcgcgtaaaaaacacaaactaaaacaatataatatccgtaaaaaaaaaatcaaacata

SEQ ID NO: 8913 - DNA, 515 bp, Artificial Sequence
  chemically treated genomic DNA (Homo sapiens) CpG-island No: 8913
tcgggtgcgcgcgtttttatagcgttcggttttagtggttcgggttattaatattcggcgtagttaaatttagtaggtatagtagtcgtcgaggaatttgcgggcggacgggcggcgtaggacgcggttcgtgtttaggaggtagtcggcgtcggcggtcgtttgcggggggttgggtcgggacggcgagggttggggcgttcgggggtttcgtgggggttgcgtttcgtcgcgcgttggtcgttttgttttttagttcggtcgatttgtagaggtttcgaatgggcgtatcgcggatacgcgttttttttttttggtagaaatgtgaggtcgttcggcgtcgcgtttcgtcgttttagtttttgttaggtggaaaggatagcgtagacgaattaggggcgttgtttggagggttagcgcggaacgggtggagaggtagaggcggggtttttagtggggttggaaaaatttttttttttaggtgtttgtatcgatagcggtaaaggtagttggga

SEQ ID NO: 8914 - DNA, 515 bp, Artificial Sequence
  chemically treated genomic DNA (Homo sapiens) CpG-island No: 8914
tcccaactacctttaccgctatcgatacaaacacctaaaaaaaaaaatttttccaaccccactaaaaaccccgcctctacctctccacccgttccgcgctaaccctccaaacaacgcccctaattcgtctacgctatcctttccacctaacaaaaactaaaacgacgaaacgcgacgccgaacgacctcacatttctaccaaaaaaaaaaaacgcgtatccgcgatacgcccattcgaaacctctacaaatcgaccgaactaaaaaacaaaacgaccaacgcgcgacgaaacgcaacccccacgaaacccccgaacgccccaaccctcgccgtcccgacccaaccccccgcaaacgaccgccgacgccgactacctcctaaacacgaaccgcgtcctacgccgcccgtccgcccgcaaattcctcgacgactactatacctactaaatttaactacgccgaatattaataacccgaaccactaaaaccgaacgctataaaaacgcgcgcacccga

SEQ ID NO: 8915 - DNA, 515 bp, Artificial Sequence
  chemically treated genomic DNA (Homo sapiens) CpG-island No: 8915
ttttagttgtttttgtcgttgtcgatgtagatatttaaaaaggaggatttttttaattttattgggagtttcgtttttgtttttttattcgtttcgcgttgattttttaggtagcgtttttggttcgtttgcgttgttttttttatttgataaaagttggggcggcggggcgcggcgtcgggcgattttatatttttgttaaaggagagagacgcgtgttcgcggtgcgtttattcggggtttttgtaaatcgatcgagttgaggaataaagcggttagcgcgcggcgagacgtagtttttacggaattttcgagcgttttagttttcgtcgtttcggtttagtttttcgtaagcggtcgtcggcgtcggttgttttttgggtacgagtcgcgttttgcgtcgttcgttcgttcgtaggtttttcggcggttattgtatttgttaaatttagttgcgtcgggtattaatagttcgagttattgggatcgggcgttgtaggggcgcgcgtattcgg

SEQ ID NO: 8916 - DNA, 515 bp, Artificial Sequence
  chemically treated genomic DNA (Homo sapiens) CpG-island No: 8916
ccgaatacgcgcgcccctacaacgcccgatcccaataactcgaactattaatacccgacgcaactaaatttaacaaatacaataaccgccgaaaaacctacgaacgaacgaacgacgcaaaacgcgactcgtacccaaaaaacaaccgacgccgacgaccgcttacgaaaaactaaaccgaaacgacgaaaactaaaacgctcgaaaattccgtaaaaactacgtctcgccgcgcgctaaccgctttattcctcaactcgatcgatttacaaaaaccccgaataaacgcaccgcgaacacgcgtctctctcctttaacaaaaatataaaatcgcccgacgccgcgccccgccgccccaacttttatcaaataaaaaaaacaacgcaaacgaaccaaaaacgctacctaaaaaatcaacgcgaaacgaataaaaaaacaaaaacgaaactcccaataaaattaaaaaaatcctcctttttaaatatctacatcgacaacgacaaaaacaactaaaa

SEQ ID NO: 8917 - DNA, 786 bp, Artificial Sequence
  chemically treated genomic DNA (Homo sapiens) CpG-island No: 8917
agttggagatacgtttttttcgttaatagaaaaaggattttcgcggtcggcgtgcggtttacggtgttatattgcgttagtgcggggagggcggtagggtcgggtttttcgaggggttcgcgcgcggtagaatttgtagtgtttttcgttcgcggcgtttttatttcggggagtaaggtcgggttatttagttttagtaggaacggttatacgtgtgcgcgtttgcgcggggataggggcgattttttattcgttcgtttttatttattatatttaatttcgttcgcgattgtttaagcgtcggggggaataaggagagggaacgtagggtcgcgggggtatttttttgggggcggcggtcgttttttttttcgtagagtttttttttttttagaaagtttcgtttaaattttgttcggtataattagcgtcgagggggcggcgtaggttaggtgggagggggttcgtagcgggcggtcgtattttcgtaaacgttcgtttcgtattcggtgagggagtcgttattgagcggggggcggatgatataacgtagttttcggtcgtaggtttcgtaaatttcgaaggtgtcgtcgtagttttcgtttttttggttggcgtacgtgtagtagtagtcgtagacgttttgtacgatgtttttcgggtagtttttgggtttttcgtatttggattcgttatagggtaggtagattagcgttcgggtgtcggagcgcgttagtagtagtagtagttttagtagcgagattaggaggtgttcgtagtcggtta

SEQ ID NO: 8918 - DNA, 786 bp, Artificial Sequence
  chemically treated genomic DNA (Homo sapiens) CpG-island No: 8918
taaccgactacgaacacctcctaatctcgctactaaaactactactactactaacgcgctccgacacccgaacgctaatctacctaccctataacgaatccaaatacgaaaaacccaaaaactacccgaaaaacatcgtacaaaacgtctacgactactactacacgtacgccaaccaaaaaaacgaaaactacgacgacaccttcgaaatttacgaaacctacgaccgaaaactacgttatatcatccgccccccgctcaataacgactccctcaccgaatacgaaacgaacgtttacgaaaatacgaccgcccgctacgaaccccctcccacctaacctacgccgccccctcgacgctaattataccgaacaaaatttaaacgaaactttctaaaaaaaaaaaaactctacgaaaaaaaaaacgaccgccgcccccaaaaaaatacccccgcgaccctacgttccctctccttattccccccgacgcttaaacaatcgcgaacgaaattaaatataataaataaaaacgaacgaataaaaaatcgcccctatccccgcgcaaacgcgcacacgtataaccgttcctactaaaactaaataacccgaccttactccccgaaataaaaacgccgcgaacgaaaaacactacaaattctaccgcgcgcgaacccctcgaaaaacccgaccctaccgccctccccgcactaacgcaatataacaccgtaaaccgcacgccgaccgcgaaaatcctttttctattaacgaaaaaaacgtatctccaact

SEQ ID NO: 8919 - DNA, 786 bp, Artificial Sequence
  chemically treated genomic DNA (Homo sapiens) CpG-island No: 8919
tggtcggttgcgggtattttttggtttcgttgttggggttgttgttgttgttggcgcgtttcggtattcgggcgttggtttgtttgttttgtgacgagtttaagtgcgaggagtttaggaattgttcggggagtatcgtgtagggcgtttgcggttgttgttatacgtgcgttagttagaggaacgagagttgcggcggtattttcgggatttacggaatttgcgatcgggggttgcgttgtgttattcgtttttcgtttaatggcgatttttttatcgagtacgaagcgggcgtttgcgaaggtacggtcgttcgttgcgggtttttttttatttggtttgcgtcgttttttcggcgttggttgtgtcgaataaagtttgggcgagattttttggaggaaagagggttttgcgggaagaggggcggtcgtcgtttttaggagagtgttttcgcggttttgcgttttttttttttgtttttttcgacgtttaggtagtcgcgggcgaggttgggtatggtgggtgggggcgagcgagtggaggatcgtttttgttttcgcgtagacgcgtatacgtgtggtcgtttttgttgggattgggtggttcggttttgtttttcgaggtgggggcgtcgcgggcggggggtattgtagattttgtcgcgcgcgagtttttcggggagttcggttttatcgtttttttcgtattggcgtagtgtggtatcgtgagtcgtacgtcggtcgcgaaagttttttttttgttggcggaggagacgtgtttttagtt

SEQ ID NO: 8920 - DNA, 786 bp, Artificial Sequence
  chemically treated genomic DNA (Homo sapiens) CpG-island No: 8920
aactaaaaacacgtctcctccgccaacaaaaaaaaaactttcgcgaccgacgtacgactcacgataccacactacgccaatacgaaaaaaacgataaaaccgaactccccgaaaaactcgcgcgcgacaaaatctacaataccccccgcccgcgacgcccccacctcgaaaaacaaaaccgaaccacccaatcccaacaaaaacgaccacacgtatacgcgtctacgcgaaaacaaaaacgatcctccactcgctcgcccccacccaccatacccaacctcgcccgcgactacctaaacgtcgaaaaaaacaaaaaaaaaaaacgcaaaaccgcgaaaacactctcctaaaaacgacgaccgcccctcttcccgcaaaaccctctttcctccaaaaaatctcgcccaaactttattcgacacaaccaacgccgaaaaaacgacgcaaaccaaataaaaaaaaacccgcaacgaacgaccgtaccttcgcaaacgcccgcttcgtactcgataaaaaaatcgccattaaacgaaaaacgaataacacaacgcaacccccgatcgcaaattccgtaaatcccgaaaataccgccgcaactctcgttcctctaactaacgcacgtataacaacaaccgcaaacgccctacacgatactccccgaacaattcctaaactcctcgcacttaaactcgtcacaaaacaaacaaaccaacgcccgaataccgaaacgcgccaacaacaacaacaaccccaacaacgaaaccaaaaaatacccgcaaccgacca

SEQ ID NO: 8921 - DNA, 804 bp, Artificial Sequence
  chemically treated genomic DNA (Homo sapiens) CpG-island No: 8921
  misc_feature (37)..(37): n is either a, c, g or t
  misc_feature (108)..(108): n is either a, c, g or t
  misc_feature (114)..(114): n is either a, c, g or t
  misc_feature (347)..(347): n is either a, c, g or t
  misc_feature (459)..(459): n is either a, c, g or t
  misc_feature (466)..(466): n is either a, c, g or t
  misc_feature (472)..(472): n is either a, c, g or t
  misc_feature (605)..(605): n is either a, c, g or t
cgagtgaggagtttcgaggttattatcgagtatgaancgcgggaacgtttgggaaggaaatttgaggttttgttttgacggttataataaaggttttcgagttaattnggcgtngtttaaatttattacggtttttttcgcgttttttttttcggaaatttgattatttagtttagaaagtcgtagtagtttttttagggacgttattttttattttaaatatttaatcgagaaagtagcgtcgtagcgcgtttttcgttacgtttaggttcgtaggttttcgttcggggcggaaaagaatttttttcgcgtatttttagttaggaggaacgttagaggtttcgttntaatttttgtcgttttattggttttggtgatcggtttttcgaaagtcggttttttattggtcgtcgtggtcgtcgttttgcgtttttatcggggtacgcggcgagcgtgatntacgttnttttancgttcggacgttcggtcgtttttcggggcgcggtaattatcgtttagagggaaggaggtcggtagtgtgaggagttgttatggtgttgagttttttggtagagtcggtcgagttgaggcggtcgcggttatgnaaggtgaggggtcggtggagtcggatagatttttttcgttaattttattttgttagggtatttgaagcgtttttttttttttcgttttagcggttatttagtcgttatttcggagagttgcgttgaggggggtcgtttgttcggttttaggtgttttaatcgagttagggtaggttgtcggattttttcgagttttttt

SEQ ID NO: 8922 - DNA, 804 bp, Artificial Sequence
  chemically treated genomic DNA (Homo sapiens) CpG-island No: 8922
  misc_feature (200)..(200): n is either a, c, g or t
  misc_feature (333)..(333): n is either a, c, g or t
  misc_feature (339)..(339): n is either a, c, g or t
  misc_feature (346)..(346): n is either a, c, g or t
  misc_feature (458)..(458): n is either a, c, g or t
  misc_feature (691)..(691): n is either a, c, g or t
  misc_feature (697)..(697): n is either a, c, g or t
  misc_feature (768)..(768): n is either a, c, g or t
aaaaaaactcgaaaaaatccgacaacctaccctaactcgattaaaacacctaaaaccgaacaaacgacccccctcaacgcaactctccgaaataacgactaaataaccgctaaaacgaaaaaaaaaaaaacgcttcaaataccctaacaaaataaaattaacgaaaaaaatctatccgactccaccgacccctcaccttncataaccgcgaccgcctcaactcgaccgactctaccaaaaaactcaacaccataacaactcctcacactaccgacctccttccctctaaacgataattaccgcgccccgaaaaacgaccgaacgtccgaacgntaaaanaacgtanatcacgctcgccgcgtaccccgataaaaacgcaaaacgacgaccacgacgaccaataaaaaaccgactttcgaaaaaccgatcaccaaaaccaataaaacgacaaaaattanaacgaaacctctaacgttcctcctaactaaaaatacgcgaaaaaaattcttttccgccccgaacgaaaacctacgaacctaaacgtaacgaaaaacgcgctacgacgctactttctcgattaaatatttaaaataaaaaataacgtccctaaaaaaactactacgactttctaaactaaataatcaaatttccgaaaaaaaaaacgcgaaaaaaaccgtaataaatttaaacnacgccnaattaactcgaaaacctttattataaccgtcaaaacaaaacctcaaatttccttcccaaacgttcccgcgnttcatactcgataataacctcgaaactcctcactcg

SEQ ID NO: 8923 - DNA, 804 bp, Artificial Sequence
  chemically treated genomic DNA (Homo sapiens) CpG-island No: 8923
  misc_feature (200)..(200): n is either a, c, g or t
  misc_feature (333)..(333): n is either a, c, g or t
  misc_feature (339)..(339): n is either a, c, g or t
  misc_feature (346)..(346): n is either a, c, g or t
  misc_feature (458)..(458): n is either a, c, g or t
  misc_feature (691)..(691): n is either a, c, g or t
  misc_feature (697)..(697): n is either a, c, g or t
  misc_feature (768)..(768): n is either a, c, g or t
ggaggagttcgagagggttcggtagtttgttttggttcggttggggtatttgaagtcgggtaagcgattttttttagcgtagtttttcgagatgacgattaggtaatcgttaaggcggaaagaaaggaggcgttttaggtgttttggtaggataggattggcgaggagggtttgttcggttttatcggttttttattttntatggtcgcgatcgttttagttcggtcggttttattaggaaatttagtattatagtagttttttatattgtcgatttttttttttttgggcggtgattatcgcgtttcgggaggcgatcgagcgttcggacgntaaggnggcgtgngttacgttcgtcgcgtgtttcggtaaaagcgtagagcggcggttacgacgattaataggaagtcgattttcgggaggtcggttattagagttaatgaagcgatagggattgnggcggggtttttggcgttttttttggttgggagtgcgcggggaggattttttttcgtttcgagcgaagatttgcggatttgggcgtggcggaaggcgcgttgcggcgttgttttttcggttgggtgtttgaaatgggagatagcgtttttgaggaagttgttgcggttttttgggttaggtggttaagttttcggggaggggagcgcgggaagggtcgtggtgaatttgaatnacgttnggttggttcgaaggtttttgttatgatcgttagagtagggttttagattttttttttagacgttttcgcgntttatgttcggtgatgatttcggggttttttattcg

SEQ ID NO: 8924 - DNA, 804 bp, Artificial Sequence
  chemically treated genomic DNA (Homo sapiens) CpG-island No: 8924
  misc_feature (37)..(37): n is either a, c, g or t
  misc_feature (108)..(108): n is either a, c, g or t
  misc_feature (114)..(114): n is either a, c, g or t
  misc_feature (347)..(347): n is either a, c, g or t
  misc_feature (459)..(459): n is either a, c, g or t
  misc_feature (466)..(466): n is either a, c, g or t
  misc_feature (472)..(472): n is either a, c, g or t
  misc_feature (605)..(605): n is either a, c, g or t
cgaataaaaaaccccgaaatcatcaccgaacataaancgcgaaaacgtctaaaaaaaaaatctaaaaccctactctaacgatcataacaaaaaccttcgaaccaaccnaacgtnattcaaattcaccacgacccttcccgcgctcccctccccgaaaacttaaccacctaacccaaaaaaccgcaacaacttcctcaaaaacgctatctcccatttcaaacacccaaccgaaaaaacaacgccgcaacgcgccttccgccacgcccaaatccgcaaatcttcgctcgaaacgaaaaaaaatcctccccgcgcactcccaaccaaaaaaaacgccaaaaaccccgccncaatccctatcgcttcattaactctaataaccgacctcccgaaaatcgacttcctattaatcgtcgtaaccgccgctctacgcttttaccgaaacacgcgacgaacgtaacncacgccnccttancgtccgaacgctcgatcgcctcccgaaacgcgataatcaccgcccaaaaaaaaaaaaatcgacaatataaaaaactactataatactaaatttcctaataaaaccgaccgaactaaaacgatcgcgaccatanaaaataaaaaaccgataaaaccgaacaaaccctcctcgccaatcctatcctaccaaaacacctaaaacgcctcctttctttccgccttaacgattacctaatcgtcatctcgaaaaactacgctaaaaaaaatcgcttacccgacttcaaataccccaaccgaaccaaaacaaactaccgaaccctctcgaactcctcc

SEQ ID NO: 8925 - DNA, 689 bp, Artificial Sequence
  chemically treated genomic DNA (Homo sapiens) CpG-island No: 8925
  misc_feature (75)..(75): n is either a, c, g or t
  misc_feature (98)..(98): n is either a, c, g or t
  misc_feature (131)..(131): n is either a, c, g or t
atattggaggacgggttgaaagcgtcgagttcgatataaaagaggcgttagataaaacgttaagaggttgggganttgggaacgaaggaagaggtttntgttagaggcgatttgttatttgcgcgaggaangcggagtaggacggcggtcgttggtgggcgtggtcgcgttagtttcgcgggagcggtcgttgggcgggtcgttgtttttgcgggcggggcgagttgttaaggaaatgattgttcgtagcgtttggtttcgtcgcgtaggtcgggcggggtttggagcggcgtcgttttcgttttcgtttttttatagttttcgtttcgttatcgttttttggtcggtttcgcgttttttatcggtattttgcgtcggtcgcgtcgcggggtttgtttttgtcgcgcgtattttcggggtttcggtttcggtacgggtcgcgtttagtttttttgtatttgaggtcgtcggttagtcgtcgttatgggtgtttattttttttagtttaatacggtgaagtgtttcggggacggggtcggcgtttcgcgtttgtcgttgttttacggttttttcgttatgtaaggttggcgcgtttttatggaggtgaggaggtaggggtttatacgttggtcgttgcggggcgggaatttgacggagaaagagagcgggggatggggtttttttttggg

SEQ ID NO: 8926 - DNA, 689 bp, Artificial Sequence
  chemically treated genomic DNA (Homo sapiens) CpG-island No: 8926
  misc_feature (559)..(559): n is either a, c, g or t
  misc_feature (592)..(592): n is either a, c, g or t
  misc_feature (615)..(615): n is either a, c, g or t
cccaaaaaaaaaccccatcccccgctctctttctccgtcaaattcccgccccgcaacgaccaacgtataaacccctacctcctcacctccataaaaacgcgccaaccttacataacgaaaaaaccgtaaaacaacgacaaacgcgaaacgccgaccccgtccccgaaacacttcaccgtattaaactaaaaaaaataaacacccataacgacgactaaccgacgacctcaaatacaaaaaaactaaacgcgacccgtaccgaaaccgaaaccccgaaaatacgcgcgacaaaaacaaaccccgcgacgcgaccgacgcaaaataccgataaaaaacgcgaaaccgaccaaaaaacgataacgaaacgaaaactataaaaaaacgaaaacgaaaacgacgccgctccaaaccccgcccgacctacgcgacgaaaccaaacgctacgaacaatcatttccttaacaactcgccccgcccgcaaaaacaacgacccgcccaacgaccgctcccgcgaaactaacgcgaccacgcccaccaacgaccgccgtcctactccgcnttcctcgcgcaaataacaaatcgcctctaacanaaacctcttccttcgttcccaantccccaacctcttaacgttttatctaacgcctcttttatatcgaactcgacgctttcaacccgtcctccaatat

SEQ ID NO: 8927 - DNA, 689 bp, Artificial Sequence
  chemically treated genomic DNA (Homo sapiens) CpG-island No: 8927
  misc_feature (559)..(559): n is either a, c, g or t
  misc_feature (592)..(592): n is either a, c, g or t
  misc_feature (615)..(615): n is either a, c, g or t
tttaggggaggattttatttttcgtttttttttttcgttagattttcgtttcgtagcggttagcgtatgggtttttgtttttttatttttatggagacgcgttagttttgtatggcggagaagtcgtagggtagcggtaggcgcggggcgtcgatttcgttttcggagtattttatcgtgttgggttgggagaggtaggtatttatggcggcggttggtcggcggttttaggtgtaggaaagttgggcgcgattcgtgtcggagtcgaagtttcgggggtgcgcgcggtaggagtaggtttcgcggcgcgatcgacgtaaggtgtcggtgaaaggcgcgaggtcggttaggaggcggtaacgggacgggagttgtgagggagcggaagcggaaacggcgtcgttttagatttcgttcggtttgcgcggcggggttaggcgttgcgggtagttatttttttagtaattcgtttcgttcgtagggataacggttcgtttaacggtcgttttcgcgagattagcgcgattacgtttattaacggtcgtcgttttatttcgtntttttcgcgtaggtggtaggtcgtttttggtangaattttttttttcgtttttagntttttagttttttggcgttttgtttgacgttttttttgtgtcggattcgacgtttttagttcgttttttagtgt

SEQ ID NO: 8928 - DNA, 689 bp, Artificial Sequence
  chemically treated genomic DNA (Homo sapiens) CpG-island No: 8928
  misc_feature (75)..(75): n is either a, c, g or t
  misc_feature (98)..(98): n is either a, c, g or t
  misc_feature (131)..(131): n is either a, c, g or t
acactaaaaaacgaactaaaaacgtcgaatccgacacaaaaaaaacgtcaaacaaaacgccaaaaaactaaaaanctaaaaacgaaaaaaaaaattcntaccaaaaacgacctaccacctacgcgaaaaanacgaaataaaacgacgaccgttaataaacgtaatcgcgctaatctcgcgaaaacgaccgttaaacgaaccgttatccctacgaacgaaacgaattactaaaaaaataactacccgcaacgcctaaccccgccgcgcaaaccgaacgaaatctaaaacgacgccgtttccgcttccgctccctcacaactcccgtcccgttaccgcctcctaaccgacctcgcgcctttcaccgacaccttacgtcgatcgcgccgcgaaacctactcctaccgcgcgcacccccgaaacttcgactccgacacgaatcgcgcccaactttcctacacctaaaaccgccgaccaaccgccgccataaatacctacctctcccaacccaacacgataaaatactccgaaaacgaaatcgacgccccgcgcctaccgctaccctacgacttctccgccatacaaaactaacgcgtctccataaaaataaaaaaacaaaaacccatacgctaaccgctacgaaacgaaaatctaacgaaaaaaaaaaacgaaaaataaaatcctcccctaaa

SEQ ID NO: 8929 - DNA, 656 bp, Artificial Sequence
  chemically treated genomic DNA (Homo sapiens) CpG-island No: 8929
  misc_feature (4)..(4): n is either a, c, g or t
  misc_feature (31)..(31): n is either a, c, g or t
  misc_feature (58)..(58): n is either a, c, g or t
  misc_feature (106)..(106): n is either a, c, g or t
  misc_feature (162)..(162): n is either a, c, g or t
  misc_feature (177)..(177): n is either a, c, g or t
  misc_feature (188)..(188): n is either a, c, g or t
  misc_feature (214)..(214): n is either a, c, g or t
  misc_feature (238)..(238): n is either a, c, g or t
  misc_feature (250)..(250): n is either a, c, g or t
  misc_feature (269)..(269): n is either a, c, g or t
cggnttcgttttgtttatatttattttcgtncggttttcgcggttggttaggtttcgngggggttgttcggtgtttagagggcggtttatcgttcgattcggtggncgttgtttttattttatttcggcgcgggttcggcgacgcgggtagcgcggggtcgnagttgcgggcggagncgggcgcgggntttgcggagtttttagggttcgagtngggttacggagtttgttcgggagntagggggcgttngttcggacgttggtttggngttttcggtgcgggaggtagtgcggcggttttcgttcgtttttgtagcgggatgtgatcgtttcggagagttagtcgtcgttttttgtagcgttggtttcgttcgtttcgtcgtagttcggtcgggacgcgcgggttcgtttcgtttagtcggggttttcgtcgtcgttatttttttttcgtttttttattttcgttttttcggggttttttttacgatttttttaatggcgttttcggagtttttattttttatttttttttttttttagttgaagcggacgagtcggcgggggcgtggggggtgagacgcgggtgttagggttttcggtatttgggagatttttttttttttcgcgtggaagagttaagttgggaagaggaattt

SEQ ID NO: 8930 - DNA, 656 bp, Artificial Sequence
  chemically treated genomic DNA (Homo sapiens) CpG-island No: 8930
  misc_feature (388)..(388): n is either a, c, g or t
  misc_feature (407)..(407): n is either a, c, g or t
  misc_feature (419)..(419): n is either a, c, g or t
  misc_feature (443)..(443): n is either a, c, g or t
  misc_feature (469)..(469): n is either a, c, g or t
  misc_feature (480)..(480): n is either a, c, g or t
  misc_feature (495)..(495): n is either a, c, g or t
  misc_feature (551)..(551): n is either a, c, g or t
  misc_feature (599)..(599): n is either a, c, g or t
  misc_feature (626)..(626): n is either a, c, g or t
  misc_feature (653)..(653): n is either a, c, g or t
aaattcctcttcccaacttaactcttccacgcgaaaaaaaaaaaaatctcccaaataccgaaaaccctaacacccgcgtctcaccccccacgcccccgccgactcgtccgcttcaactaaaaaaaaaaaaaaataaaaaataaaaactccgaaaacgccattaaaaaaatcgtaaaaaaaaccccgaaaaaacgaaaataaaaaaacgaaaaaaaaataacgacgacgaaaaccccgactaaacgaaacgaacccgcgcgtcccgaccgaactacgacgaaacgaacgaaaccaacgctacaaaaaacgacgactaactctccgaaacgatcacatcccgctacaaaaacgaacgaaaaccgccgcactacctcccgcaccgaaaacnccaaaccaacgtccgaacnaacgccccctanctcccgaacaaactccgtaacccnactcgaaccctaaaaactccgcaaancccgcgcccgnctccgcccgcaactncgaccccgcgctacccgcgtcgccgaacccgcgccgaaataaaataaaaacaacgnccaccgaatcgaacgataaaccgccctctaaacaccgaacaacccccncgaaacctaaccaaccgcgaaaaccgnacgaaaataaatataaacaaaacgaanccg

SEQ ID NO: 8931 - DNA, 656 bp, Artificial Sequence
  chemically treated genomic DNA (Homo sapiens) CpG-island No: 8931
  misc_feature (388)..(388): n is either a, c, g or t
  misc_feature (407)..(407): n is either a, c, g or t
  misc_feature (419)..(419): n is either a, c, g or t
  misc_feature (443)..(443): n is either a, c, g or t
  misc_feature (469)..(469): n is either a, c, g or t
  misc_feature (480)..(480): n is either a, c, g or t
  misc_feature (495)..(495): n is either a, c, g or t
  misc_feature (551)..(551): n is either a, c, g or t
  misc_feature (599)..(599): n is either a, c, g or t
  misc_feature (626)..(626): n is either a, c, g or t
  misc_feature (653)..(653): n is either a, c, g or t
gaatttttttttttaatttggtttttttacgcggggaggaaggggattttttaggtgtcggagattttagtattcgcgttttattttttacgttttcgtcgattcgttcgttttagttgggagagagaagggataagggatgggggtttcggaggcgttattgggagggtcgtgggaggagtttcgagaggacgggagtgagggggcgggaggggaatgacggcggcgagaatttcggttgggcggggcgggttcgcgcgtttcggtcgggttgcggcggagcgagcggggttagcgttgtagaaggcggcggttggtttttcgggacggttatatttcgttgtaggggcgggcggaggtcgtcgtattgtttttcgtatcggggatnttaggttagcgttcgggtnaacgttttttgnttttcggatagatttcgtggtttngttcgagttttgggggtttcgtaganttcgcgttcgntttcgttcgtagttncggtttcgcgttgttcgcgtcgtcgggttcgcgtcgggatggggtaggggtagcgnttatcgagtcgggcgatgggtcgttttttgggtatcgagtagtttttncgaggtttgattaatcgcggggatcgngcggaggtgggtgtgggtagggcggantcg

SEQ ID NO: 8932 - DNA, 656 bp, Artificial Sequence
  chemically treated genomic DNA (Homo sapiens) CpG-island No: 8932
  misc_feature (4)..(4): n is either a, c, g or t
  misc_feature (31)..(31): n is either a, c, g or t
  misc_feature (58)..(58): n is either a, c, g or t
  misc_feature (106)..(106): n is either a, c, g or t
  misc_feature (162)..(162): n is either a, c, g or t
  misc_feature (177)..(177): n is either a, c, g or t
  misc_feature (188)..(188): n is either a, c, g or t
  misc_feature (214)..(214): n is either a, c, g or t
  misc_feature (238)..(238): n is either a, c, g or t
  misc_feature (250)..(250): n is either a, c, g or t
  misc_feature (269)..(269): n is either a, c, g or t
cgantccgccctacccacacccacctccgcncgatccccgcgattaatcaaacctcgnaaaaactactcgatacccaaaaaacgacccatcgcccgactcgataancgctacccctaccccatcccgacgcgaacccgacgacgcgaacaacgcgaaaccgnaactacgaacgaaancgaacgcgaantctacgaaacccccaaaactcgaacnaaaccacgaaatctatccgaaaancaaaaaacgttnacccgaacgctaacctaanatccccgatacgaaaaacaatacgacgacctccgcccgcccctacaacgaaatataaccgtcccgaaaaaccaaccgccgccttctacaacgctaaccccgctcgctccgccgcaacccgaccgaaacgcgcgaacccgccccgcccaaccgaaattctcgccgccgtcattcccctcccgccccctcactcccgtcctctcgaaactcctcccacgaccctcccaataacgcctccgaaacccccatcccttatcccttctctctcccaactaaaacgaacgaatcgacgaaaacgtaaaaaataaaacgcgaatactaaaatctccgacacctaaaaaatccccttcctccccgcgtaaaaaaaccaaattaaaaaaaaaaattc

SEQ ID NO: 8933 - DNA, 680 bp, Artificial Sequence
  chemically treated genomic DNA (Homo sapiens) CpG-island No: 8933
  misc_feature (232)..(232): n is either a, c, g or t
  misc_feature (238)..(238): n is either a, c, g or t
  misc_feature (242)..(242): n is either a, c, g or t
  misc_feature (252)..(252): n is either a, c, g or t
  misc_feature (280)..(280): n is either a, c, g or t
  misc_feature (291)..(291): n is either a, c, g or t
  misc_feature (295)..(295): n is either a, c, g or t
  misc_feature (307)..(307): n is either a, c, g or t
  misc_feature (320)..(320): n is either a, c, g or t
  misc_feature (333)..(333): n is either a, c, g or t
  misc_feature (337)..(337): n is either a, c, g or t
  misc_feature (348)..(348): n is either a, c, g or t
  misc_feature (375)..(375): n is either a, c, g or t
gttcgggtcgtttgtcgcgtttattagtagtttcgagtcgatagagatgatattggttacggtgtatttcggcgtgatagcgtcgcggggattggttacgtgtcgtaggacggtgttatgtagtacggtttttagtagtaggtttacgtggtttattaagattagcgcgaggtttatacgtattagtcgtttgggttttcgggcggcgtttgtaaagtacgggggagggtanaggttngagntcggtcgggnaagggaaaagtcggttttcggcgggttnaattcgcgggntagntaggatcgggtnaagggtagttttnagggtaaggagancgangattttagggnttcggaagttatcgaaagcgtagaganttgtagcgttttatttcgttcgtcgcgttagtcgtagggtcgttgtatttgggttcggtttcgttttaatttgggtttcgttttcgtttcgggttttttttttatttgggtttcgttttcgtttcgggttcgttttttttggcgggaaaggcgcgaatatacgacgtttttagtaaaaagtagatttttattatagtagtaattgaggcgaatcgaatggttttttagggttattattgtagtattatttttttttttcgtttcggtcgttttagcgggattgtagaattcggtttttttagtgt

SEQ ID NO: 8934 - DNA, 680 bp, Artificial Sequence
  chemically treated genomic DNA (Homo sapiens) CpG-island No: 8934
  misc_feature (306)..(306): n is either a, c, g or t
  misc_feature (333)..(333): n is either a, c, g or t
  misc_feature (344)..(344): n is either a, c, g or t
  misc_feature (348)..(348): n is either a, c, g or t
  misc_feature (361)..(361): n is either a, c, g or t
  misc_feature (374)..(374): n is either a, c, g or t
  misc_feature (386)..(386): n is either a, c, g or t
  misc_feature (390)..(390): n is either a, c, g or t
  misc_feature (401)..(401): n is either a, c, g or t
  misc_feature (429)..(429): n is either a, c, g or t
  misc_feature (439)..(439): n is either a, c, g or t
  misc_feature (443)..(443): n is either a, c, g or t
  misc_feature (449)..(449): n is either a, c, g or t
acactaaaaaaaccgaattctacaatcccgctaaaacgaccgaaacgaaaaaaaaaaataatactacaataataaccctaaaaaaccattcgattcgcctcaattactactataataaaaatctactttttactaaaaacgtcgtatattcgcgcctttcccgccaaaaaaaacgaacccgaaacgaaaacgaaacccaaataaaaaaaaaacccgaaacgaaaacgaaacccaaattaaaacgaaaccgaacccaaatacaacgaccctacgactaacgcgacgaacgaaataaaacgctacaantctctacgctttcgataacttccgaanccctaaaatcntcgntctccttaccctnaaaactacccttnacccgatcctanctancccgcgaattnaacccgccgaaaaccgacttttcccttncccgaccganctcnaacctntaccctcccccgtactttacaaacgccgcccgaaaacccaaacgactaatacgtataaacctcgcgctaatcttaataaaccacgtaaacctactactaaaaaccgtactacataacaccgtcctacgacacgtaaccaatccccgcgacgctatcacgccgaaatacaccgtaaccaatatcatctctatcgactcgaaactactaataaacgcgacaaacgacccgaac

SEQ ID NO: 8935 - DNA, 680 bp, Artificial Sequence
  chemically treated genomic DNA (Homo sapiens) CpG-island No: 8935
  misc_feature (306)..(306): n is either a, c, g or t
  misc_feature (333)..(333): n is either a, c, g or t
  misc_feature (344)..(344): n is either a, c, g or t
  misc_feature (348)..(348): n is either a, c, g or t
  misc_feature (361)..(361): n is either a, c, g or t
  misc_feature (374)..(374): n is either a, c, g or t
  misc_feature (386)..(386): n is either a, c, g or t
  misc_feature (390)..(390): n is either a, c, g or t
  misc_feature (401)..(401): n is either a, c, g or t
  misc_feature (429)..(429): n is either a, c, g or t
  misc_feature (439)..(439): n is either a, c, g or t
  misc_feature (443)..(443): n is either a, c, g or t
  misc_feature (449)..(449): n is either a, c, g or t
gtattaggggagtcgaattttataatttcgttggggcggtcggggcgggagagaaaggtggtgttgtagtggtggttttggggggttattcgattcgttttagttgttgttgtaataaaagtttattttttgttaaaagcgtcgtgtgttcgcgtttttttcgttagggggagcgggttcggggcggaggcggggtttaggtgggagggggattcgggacggaggcggggtttaggttggggcggggtcgggtttaggtatagcggttttgcggttggcgcggcggacgggatgaggcgttgtagntttttgcgttttcggtaattttcgggnttttggggttntcgntttttttattttnggggttatttttngttcggttttanttgnttcgcgggttnaattcgtcgggagtcggttttttttttnttcggtcgantttnaatttntgttttttttcgtgttttgtagacgtcgttcgggggtttaggcggttgatgcgtgtgggtttcgcgttgattttggtgggttacgtgaatttgttgttgggggtcgtgttgtatggtatcgttttgcggtacgtggttaattttcgcggcgttgttacgtcggagtatatcgtagttaatgttatttttgtcggttcggggttgttggtgagcgcggtaggcgattcgggt

SEQ ID NO: 8936 - DNA, 680 bp, Artificial Sequence
  chemically treated genomic DNA (Homo sapiens) CpG-island No: 8936
  misc_feature (232)..(232): n is either a, c, g or t
  misc_feature (238)..(238): n is either a, c, g or t
  misc_feature (242)..(242): n is either a, c, g or t
  misc_feature (252)..(252): n is either a, c, g or t
  misc_feature (280)..(280): n is either a, c, g or t
  misc_feature (291)..(291): n is either a, c, g or t
  misc_feature (295)..(295): n is either a, c, g or t
  misc_feature (307)..(307): n is either a, c, g or t
  misc_feature (320)..(320): n is either a, c, g or t
  misc_feature (333)..(333): n is either a, c, g or t
  misc_feature (337)..(337): n is either a, c, g or t
  misc_feature (348)..(348): n is either a, c, g or t
  misc_feature (375)..(375): n is either a, c, g or t
acccgaatcgcctaccgcgctcaccaacaaccccgaaccgacaaaaataacattaactacgatatactccgacgtaacaacgccgcgaaaattaaccacgtaccgcaaaacgataccatacaacacgacccccaacaacaaattcacgtaacccaccaaaatcaacgcgaaacccacacgcatcaaccgcctaaacccccgaacgacgtctacaaaacacgaaaaaaaacanaaattnaaantcgaccgaanaaaaaaaaaaccgactcccgacgaattnaacccgcgaancaantaaaaccgaacnaaaaataaccccnaaaataaaaaaancganaaccccaaaancccgaaaattaccgaaaacgcaaaaanctacaacgcctcatcccgtccgccgcgccaaccgcaaaaccgctatacctaaacccgaccccgccccaacctaaaccccgcctccgtcccgaatccccctcccacctaaaccccgcctccgccccgaacccgctccccctaacgaaaaaaacgcgaacacacgacgcttttaacaaaaaataaacttttattacaacaacaactaaaacgaatcgaataaccccccaaaaccaccactacaacaccacctttctctcccgccccgaccgccccaacgaaattataaaattcgactcccctaatac

SEQ ID NO: 8937 - DNA, 619 bp, Artificial Sequence
  chemically treated genomic DNA (Homo sapiens) CpG-island No: 8937
  misc_feature (65)..(65): n is either a, c, g or t
  misc_feature (87)..(87): n is either a, c, g or t
  misc_feature (166)..(166): n is either a, c, g or t
  misc_feature (194)..(194): n is either a, c, g or t
  misc_feature (544)..(544): n is either a, c, g or t
  misc_feature (605)..(605): n is either a, c, g or t
tcgaggcggttgtcgcgtcgcgtcgggatattttttttttcgtttgggtcgacgtaagatggcgngttcggtcgtcgtcgcgtagtncggttttttttttcgcgttttgggcgttttcgacgattcgcgtcggttttaagatttttagtttagcgttttcggagtngaggcggcgtaggtcgcgcgggagggtnttttgtttgttgtagcgtagggcgggcgggggcgggggggcgtttatcgtgagcggagcggatcggtttgattggagttttgaggaggaggagaaagaggaggaggaaaaggaggagtacgaaaaattatattgcggcgacggcggcggtttttattgcggagttggtagtcgagtcgtggaaaggggggggttttcgtgtagtcggcgcgttgttttatgggtaggtttcgggttagttttttcgtgttcgagttttttgttttttcgtcgacgcgggaggcgggtatcggtatgtgcgtcgcgtcgcgggttttcgaagatttacgcgtttcgttacgcgtcggtttnggggcgagggttagggttttgtttttatgtgggtgcgagttgttggttggtgtggtcgggnaggtagttttaaaa

SEQ ID NO: 8938 - DNA, 619 bp, Artificial Sequence
  chemically treated genomic DNA (Homo sapiens) CpG-island No: 8938
  misc_feature (15)..(15): n is either a, c, g or t
  misc_feature (76)..(76): n is either a, c, g or t
  misc_feature (426)..(426): n is either a, c, g or t
  misc_feature (454)..(454): n is either a, c, g or t
  misc_feature (533)..(533): n is either a, c, g or t
  misc_feature (555)..(555): n is either a, c, g or t
ttttaaaactacctncccgaccacaccaaccaacaactcgcacccacataaaaacaaaaccctaaccctcgccccnaaaccgacgcgtaacgaaacgcgtaaatcttcgaaaacccgcgacgcgacgcacataccgatacccgcctcccgcgtcgacgaaaaaacaaaaaactcgaacacgaaaaaactaacccgaaacctacccataaaacaacgcgccgactacacgaaaacccccccctttccacgactcgactaccaactccgcaataaaaaccgccgccgtcgccgcaatataatttttcgtactcctccttttcctcctcctctttctcctcctcctcaaaactccaatcaaaccgatccgctccgctcacgataaacgcccccccgcccccgcccgccctacgctacaacaaacaaaanaccctcccgcgcgacctacgccgcctcnactccgaaaacgctaaactaaaaatcttaaaaccgacgcgaatcgtcgaaaacgcccaaaacgcgaaaaaaaaaaccgnactacgcgacgacgaccgaacncgccatcttacgtcgacccaaacgaaaaaaaaaatatcccgacgcgacgcgacaaccgcctcga

SEQ ID NO: 8939 - DNA, 619 bp, Artificial Sequence
  chemically treated genomic DNA (Homo sapiens) CpG-island No: 8939
  misc_feature (15)..(15): n is either a, c, g or t
  misc_feature (76)..(76): n is either a, c, g or t
  misc_feature (426)..(426): n is either a, c, g or t
  misc_feature (454)..(454): n is either a, c, g or t
  misc_feature (533)..(533): n is either a, c, g or t
  misc_feature (555)..(555): n is either a, c, g or t
ttttggggttgtttnttcggttatattagttagtagttcgtatttatatggaggtagggttttggttttcgttttnggatcggcgcgtggcggggcgcgtgggttttcgagggttcgcgacgcggcgtatatgtcggtgttcgtttttcgcgtcggcgagaagatagggagttcggatacggggaggttgattcggagtttatttatgaggtagcgcgtcggttgtacgagagtttttttttttttacggttcggttgttagtttcgtaatgggagtcgtcgtcgtcgtcgtagtgtagtttttcgtgttttttttttttttttttttttttttttttttttttagggttttagttaggtcgattcgtttcgtttacggtaagcgttttttcgttttcgttcgttttgcgttgtagtaggtagagngttttttcgcgcggtttgcgtcgttttnatttcgggggcgttggattgggggttttgaggtcggcgcgggtcgtcgggagcgtttagagcgcgggggaggagatcgngttgcgcggcggcggtcggatncgttattttgcgtcggtttaggcgggggaggaggtatttcggcgcgacgcggtagtcgtttcgg

SEQ ID NO: 8940 - DNA, 619 bp, Artificial Sequence
  chemically treated genomic DNA (Homo sapiens) CpG-island No: 8940
  misc_feature (65)..(65): n is either a, c, g or t
  misc_feature (87)..(87): n is either a, c, g or t
  misc_feature (166)..(166): n is either a, c, g or t
  misc_feature (194)..(194): n is either a, c, g or t
  misc_feature (544)..(544): n is either a, c, g or t
  misc_feature (605)..(605): n is either a, c, g or t
ccgaaacgactaccgcgtcgcgccgaaatacctcctcccccgcctaaaccgacgcaaaataacgnatccgaccgccgccgcgcaacncgatctcctcccccgcgctctaaacgctcccgacgacccgcgccgacctcaaaacccccaatccaacgcccccgaaatnaaaacgacgcaaaccgcgcgaaaaaacnctctacctactacaacgcaaaacgaacgaaaacgaaaaaacgcttaccgtaaacgaaacgaatcgacctaactaaaaccctaaaaaaaaaaaaaaaaaaaaaaaaaaaaaaaaaaaacacgaaaaactacactacgacgacgacgacgactcccattacgaaactaacaaccgaaccgtaaaaaaaaaaaaactctcgtacaaccgacgcgctacctcataaataaactccgaatcaacctccccgtatccgaactccctatcttctcgccgacgcgaaaaacgaacaccgacatatacgccgcgtcgcgaaccctcgaaaacccacgcgccccgccacgcgccgatccnaaaacgaaaaccaaaaccctacctccatataaatacgaactactaactaatataaccgaanaaacaaccccaaaa

SEQ ID NO: 8941 - DNA, 1080 bp, Artificial Sequence
  chemically treated genomic DNA (Homo sapiens) CpG-island No: 8941
  misc_feature (74)..(74): n is either a, c, g or t
  misc_feature (299)..(299): n is either a, c, g or t
  misc_feature (992)..(992): n is either a, c, g or t
  misc_feature (1079)..(1079): n is either a, c, g or t
gggtgagagagaataggtaataggatgaagtttgagttaaaataagtattagtagagtggagcgagggattcgnaatcgtagagcggtaaaagggaaatagtattcggtttttattacgggattggggaaaggagaattattcgttggggtagggttgacgatcgttgaaatcgaaaagaaggaatttacggcggttaggtttatcgaggttgagagagcgggttgcggggatcgtagagttcgagggcgtagggtcgggggcggaaggggcggcggttgggcgttaggtatcggggantcgcggtttcgagttgagtggtcgtttttaattcgtttcgagttttggcggtcgtggattttcggtttttattcgtcgttcgtttttaaggtttatgggtttcgtcgcggttggaagattcggttcggaggagaaatagggttttaatatttttttcgttttcggttttttttttttagaggttattttttttttttatttcgttggtacggtattttcggtttcgtagggatcggtgtttttcgtatttattcgcgagttcggtgttcgttattatcgtcgtcgttgttatcgtcgtttttcggtagtgtcgttttgttttagagaagtagcgcgcggttttcgtacgttttacgttcgtttcgttgtcgcgcgttttcgttaggcgtcgttcgtttcggagtcggcgcgcggtcgttgtttttagtgtcgggtttcgaatttttttagcgtttttattggttttttagttcgggttcgcgcgacgtttcgcgcggcgtacgtttgttttatttatgcggttcgcgttgtcgcgtttaatttcgtttatttttttatttatttatagtttttatttcgatttcgatttggggcgtgcgcgcgaattttggcgatcgcggcgatttcgcggtttgattggttgtagtaatataacgacgtacgtacgcgagaagacgagagcgcgtacgtaanggtcgtggggttgcggggataattaagagataaggattggtttaatgtataggagttaggaatgaggaaatggttaggcgagttttnt

SEQ ID NO: 8942 - DNA, 1080 bp, Artificial Sequence
  chemically treated genomic DNA (Homo sapiens) CpG-island No: 8942
  misc_feature (2)..(2): n is either a, c, g or t
  misc_feature (89)..(89): n is either a, c, g or t
  misc_feature (782)..(782): n is either a, c, g or t
  misc_feature (1007)..(1007): n is either a, c, g or t
anaaaactcgcctaaccatttcctcattcctaactcctatacattaaaccaatccttatctcttaattatccccgcaaccccacgaccnttacgtacgcgctctcgtcttctcgcgtacgtacgtcgttatattactacaaccaatcaaaccgcgaaatcgccgcgatcgccaaaattcgcgcgcacgccccaaatcgaaatcgaaataaaaactataaataaataaaaaaataaacgaaattaaacgcgacaacgcgaaccgcataaataaaacaaacgtacgccgcgcgaaacgtcgcgcgaacccgaactaaaaaaccaataaaaacgctaaaaaaattcgaaacccgacactaaaaacaacgaccgcgcgccgactccgaaacgaacgacgcctaacgaaaacgcgcgacaacgaaacgaacgtaaaacgtacgaaaaccgcgcgctacttctctaaaacaaaacgacactaccgaaaaacgacgataacaacgacgacgataataacgaacaccgaactcgcgaataaatacgaaaaacaccgatccctacgaaaccgaaaataccgtaccaacgaaataaaaaaaaaaaataacctctaaaaaaaaaaaaccgaaaacgaaaaaaatattaaaaccctatttctcctccgaaccgaatcttccaaccgcgacgaaacccataaaccttaaaaacgaacgacgaataaaaaccgaaaatccacgaccgccaaaactcgaaacgaattaaaaacgaccactcaactcgaaaccgcgantccccgatacctaacgcccaaccgccgccccttccgcccccgaccctacgccctcgaactctacgatccccgcaacccgctctctcaacctcgataaacctaaccgccgtaaattccttcttttcgatttcaacgatcgtcaaccctaccccaacgaataattctcctttccccaatcccgtaataaaaaccgaatactatttcccttttaccgctctacgattncgaatccctcgctccactctactaatacttattttaactcaaacttcatcctattacctattctctctcaccc

SEQ ID NO: 8943 - DNA, 1080 bp, Artificial Sequence
  chemically treated genomic DNA (Homo sapiens) CpG-island No: 8943
  misc_feature (2)..(2): n is either a, c, g or t
  misc_feature (89)..(89): n is either a, c, g or t
  misc_feature (782)..(782): n is either a, c, g or t
  misc_feature (1007)..(1007): n is either a, c, g or t
gnaagattcgtttggttatttttttatttttgatttttgtgtattaggttaatttttgttttttagttgttttcgtaattttacggttnttacgtgcgcgttttcgttttttcgcgtgcgtacgtcgttgtgttgttgtagttaattaggtcgcgaggtcgtcgcggtcgttagggttcgcgcgtacgttttagatcggagtcggggtgggggttatgggtgaatgggagagtgagcggggttgggcgcggtagcgcgagtcgtatgaatgagataaacgtgcgtcgcgcgagacgtcgcgcgagttcggattagggagttaatgggaacgttggaagggttcgagattcggtattgagggtaacggtcgcgcgtcggtttcgagacgagcgacgtttggcgggagcgcgcggtagcggggcgggcgtggagcgtgcgggggtcgcgcgttgtttttttgaggtaggacggtattgtcgggaggcggcggtgataacgacggcggtggtgacgggtatcgggttcgcgggtgagtgcggaggatatcggtttttgcggaatcggaagtgtcgtattagcgaggtgggaggggagggtgatttttagggaagggggatcgaagacggggagggtattaaggttttatttttttttcgggtcgggttttttaatcgcggcgggatttatgggttttggaaacggacgacgagtagaggtcggggatttacgatcgttagggttcggaacgggttagagacggttatttagttcgagatcgcggnttttcggtgtttggcgtttagtcgtcgtttttttcgttttcggttttgcgttttcgggttttgcggttttcgtagttcgtttttttaatttcggtgggtttggtcgtcgtggatttttttttttcggttttagcggtcgttagttttgttttaacgggtgatttttttttttttagtttcgtggtggggatcgggtgttgttttttttttatcgttttgcggttncgagtttttcgttttattttgttgatatttattttggtttaagttttattttgttatttgtttttttttattt

SEQ ID NO: 8944 - DNA, 1080 bp, Artificial Sequence
  chemically treated genomic DNA (Homo sapiens) CpG-island No: 8944
  misc_feature (74)..(74): n is either a, c, g or t
  misc_feature (299)..(299): n is either a, c, g or t
  misc_feature (992)..(992): n is either a, c, g or t
  misc_feature (1079)..(1079): n is either a, c, g or t
aaataaaaaaaaacaaataacaaaataaaacttaaaccaaaataaatatcaacaaaataaaacgaaaaactcgnaaccgcaaaacgataaaaaaaaaacaacacccgatccccaccacgaaactaaaaaaaaaaaaatcacccgttaaaacaaaactaacgaccgctaaaaccgaaaaaaaaaaatccacgacgaccaaacccaccgaaattaaaaaaacgaactacgaaaaccgcaaaacccgaaaacgcaaaaccgaaaacgaaaaaaacgacgactaaacgccaaacaccgaaaanccgcgatctcgaactaaataaccgtctctaacccgttccgaaccctaacgatcgtaaatccccgacctctactcgtcgtccgtttccaaaacccataaatcccgccgcgattaaaaaacccgacccgaaaaaaaaataaaaccttaataccctccccgtcttcgatcccccttccctaaaaatcaccctcccctcccacctcgctaatacgacacttccgattccgcaaaaaccgatatcctccgcactcacccgcgaacccgatacccgtcaccaccgccgtcgttatcaccgccgcctcccgacaataccgtcctacctcaaaaaaacaacgcgcgacccccgcacgctccacgcccgccccgctaccgcgcgctcccgccaaacgtcgctcgtctcgaaaccgacgcgcgaccgttaccctcaataccgaatctcgaacccttccaacgttcccattaactccctaatccgaactcgcgcgacgtctcgcgcgacgcacgtttatctcattcatacgactcgcgctaccgcgcccaaccccgctcactctcccattcacccataacccccaccccgactccgatctaaaacgtacgcgcgaaccctaacgaccgcgacgacctcgcgacctaattaactacaacaacacaacgacgtacgcacgcgaaaaaacgaaaacgcgcacgtaanaaccgtaaaattacgaaaacaactaaaaaacaaaaattaacctaatacacaaaaatcaaaaataaaaaaataaccaaacgaatcttnc

SEQ ID NO: 8945 - DNA, 1497 bp, Artificial Sequence
  chemically treated genomic DNA (Homo sapiens) CpG-island No: 8945
cggacgcgggtttttttcggttcggtacgggtggcgtaggatttcgagttcgtcgataagagagagagcgggagtgggagaaggaagatcgggagaggaggaggtcgggcggtaagagcggaagaagaggaggagaattgaggcggaggagggcgagagggaggagagtcgggcgtaggaaggggaggaaagaaaaaggcggcggaggagcgcggattcgttattttcggttttttttttcgtatttttattcgggtcggttttttttcggtcgtcgtcgtcgtcgtcgtcgtcgtcgtcgtcgtcgtcgtcgtttttttttgtttagtgtttttagtatcgtaaggtattcgttgtttttttcgtattcggttcggttcgtttagcgtcgtcgtcgtcgtattttcgtcgtattttcgcgcgcgttcggttcgcgcgttttcgtcgttcgttttcgcggtttcgcgttcggggtatgcgcggtgggcggtgtcgtttcgggtcgtttttgtcgtcgcgagtaggaagcgcgagcgtcgggtatcgggttgttagtgagtttggggttagcgggcgagttagcggtttcggttttcgttttcgtttcgcgtagtattagttcgatttttttcggttttcgtcgcgttttttcgtcgcgatttcggttatcggttcgcgtttcgcgttcggggtcgtttcgagttcgtatttttttttcgtcgttttcgtttattcggtttttcgcggtcgtagtttttcggcggaggtaagaggtggttgggggggattatggttgacgttttttcgggtaacgattttacggcgttttaggacgtggttaatcgtttcgttcgtaaaggggcgttgaggtagaagaacgtgtacgaggtgaaggattataaatttatcgcgcgtttttttaagtagtttattttttgtagttattgtatcgattttatttggtaggtgtcgggtcgggtatttttgtttcgttttttttcgttttcgggtttcggtattcggcgtttcggcgcgttcgtttcggggttggtttatttcgataatttggaatcggcgggagttcgaatttttcgttcggagtgatacgcgcgttcggttttgatatcggcgggtaggattttcgggacgtcgtcgtttcgttatatatattttttggcgcgagagggaggttggtttcgtacggtggcgaaggggattttttttcgggtcgggttttttattttttcgggcgcgtttattcgtacgtatttagcggagcggtcgtttgtcggggtgtgagtttaggggataggggaggaggagaggttttaagggggtaaaggttttcggagaaacgcgtttcggagtaacgggggagcggcggcgattgtattgcgcgcggtttaagttgttggcgagttaggttgggcgcgttcggggtgggggggttgtgtttgtgttttttatcgggttggattgcgttggtattttgggttt

SEQ ID NO: 8946 - DNA, 1497 bp, Artificial Sequence
  chemically treated genomic DNA (Homo sapiens) CpG-island No: 8946
aaacccaaaataccaacgcaatccaacccgataaaaaacacaaacacaacccccccaccccgaacgcgcccaacctaactcgccaacaacttaaaccgcgcgcaatacaatcgccgccgctcccccgttactccgaaacgcgtttctccgaaaacctttacccccttaaaacctctcctcctcccctatcccctaaactcacaccccgacaaacgaccgctccgctaaatacgtacgaataaacgcgcccgaaaaaataaaaaacccgacccgaaaaaaaatccccttcgccaccgtacgaaaccaacctccctctcgcgccaaaaaatatatataacgaaacgacgacgtcccgaaaatcctacccgccgatatcaaaaccgaacgcgcgtatcactccgaacgaaaaattcgaactcccgccgattccaaattatcgaaataaaccaaccccgaaacgaacgcgccgaaacgccgaataccgaaacccgaaaacgaaaaaaaacgaaacaaaaatacccgacccgacacctaccaaataaaatcgatacaataactacaaaaaataaactacttaaaaaaacgcgcgataaatttataatccttcacctcgtacacgttcttctacctcaacgcccctttacgaacgaaacgattaaccacgtcctaaaacgccgtaaaatcgttacccgaaaaaacgtcaaccataatcccccccaaccacctcttacctccgccgaaaaactacgaccgcgaaaaaccgaataaacgaaaacgacgaaaaaaaaatacgaactcgaaacgaccccgaacgcgaaacgcgaaccgataaccgaaatcgcgacgaaaaaacgcgacgaaaaccgaaaaaaatcgaactaatactacgcgaaacgaaaacgaaaaccgaaaccgctaactcgcccgctaaccccaaactcactaacaacccgatacccgacgctcgcgcttcctactcgcgacgacaaaaacgacccgaaacgacaccgcccaccgcgcataccccgaacgcgaaaccgcgaaaacgaacgacgaaaacgcgcgaaccgaacgcgcgcgaaaatacgacgaaaatacgacgacgacgacgctaaacgaaccgaaccgaatacgaaaaaaacaacgaataccttacgatactaaaaacactaaacaaaaaaaaacgacgacgacgacgacgacgacgacgacgacgacgacgacgaccgaaaaaaaaccgacccgaataaaaatacgaaaaaaaaaaccgaaaataacgaatccgcgctcctccgccgcctttttctttcctccccttcctacgcccgactctcctccctctcgccctcctccgcctcaattctcctcctcttcttccgctcttaccgcccgacctcctcctctcccgatcttccttctcccactcccgctctctctcttatcgacgaactcgaaatcctacgccacccgtaccgaaccgaaaaaaacccgcgtccg

SEQ ID NO: 8947 - DNA, 1497 bp, Artificial Sequence
  chemically treated genomic DNA (Homo sapiens) CpG-island No: 8947
gggtttaagatgttagcgtagtttagttcgatgggaagtataaatataatttttttatttcgaacgcgtttagtttggttcgttagtaatttggatcgcgcgtagtgtaatcgtcgtcgttttttcgttatttcggggcgcgttttttcgggaatttttgtttttttagggttttttttttttttttgttttttgggtttatatttcggtaagcggtcgtttcgttgggtgcgtgcgggtgggcgcgttcggggaggtgaggggttcggttcggagagggatttttttcgttatcgtacggggttagtttttttttcgcgttagggggtgtgtgtggcgggacggcgacgtttcgggagttttgttcgtcggtgttagggtcgggcgcgcgtgttatttcgggcgaagagttcggattttcgtcggttttaagttatcggagtgagttagtttcggggcggacgcgtcggagcgtcgggtgtcgggattcggaggcggggaggagcggggtaggagtgttcggttcggtatttattagatgaagtcggtgtagtggttgtagaaggtgggttgtttgaagaagcgcgcgatgaatttgtggttttttatttcgtgtacgtttttttgttttagcgtttttttgcgggcgaagcggttggttacgttttgagacgtcgtggagtcgttgttcgggaaaacgttagttatggttttttttaattattttttgttttcgtcggggagttgcggtcgcggagggtcgggtgggcgggggcggcgggggagaggtgcgggttcggggcgatttcgggcgcggggcgcgggtcggtggtcgaggtcgcggcgagggggcgcggcgggggtcggggagagtcgggttggtgttgcgcggagcgggagcgggagtcggagtcgttggttcgttcgttggttttaggtttattgatagttcggtgttcggcgttcgcgttttttattcgcggcggtagaggcggttcggagcggtatcgtttatcgcgtatgtttcgagcgcgaggtcgcgaggacgagcggcgggggcgcgcgggtcgggcgcgcgcgggggtgcggcgagggtgcggcggcggcggcgttgagcggatcggatcgagtgcggaggaggtagcgagtgttttgcggtgttgggaatattgggtaaggggaggcggcggcggcggcggcggcggcggcggcggcggcggcggcggtcgggggagggtcggttcgagtggggatgcgggggaggaggtcgggagtggcgggttcgcgttttttcgtcgtttttttttttttttttttttttgcgttcggtttttttttttttcgttttttttcgttttagtttttttttttttttttcgtttttgtcgttcggtttttttttttttcggtttttttttttttattttcgtttttttttttgtcgacgggttcggagttttgcgttattcgtgtcgggtcgagaggagttcgcgttcg

SEQ ID NO: 8948 - DNA, 1497 bp, Artificial Sequence
  chemically treated genomic DNA (Homo sapiens) CpG-island No: 8948
cgaacgcgaactcctctcgacccgacacgaataacgcaaaactccgaacccgtcgacaaaaaaaaaaacgaaaataaaaaaaaaaaaaccgaaaaaaaaaaaaaccgaacgacaaaaacgaaaaaaaaaaaaaaaaactaaaacgaaaaaaaacgaaaaaaaaaaaaaccgaacgcaaaaaaaaaaaaaaaaaaaaaaacgacgaaaaaacgcgaacccgccactcccgacctcctcccccgcatccccactcgaaccgaccctcccccgaccgccgccgccgccgccgccgccgccgccgccgccgccgccgcctccccttacccaatattcccaacaccgcaaaacactcgctacctcctccgcactcgatccgatccgctcaacgccgccgccgccgcaccctcgccgcacccccgcgcgcgcccgacccgcgcgcccccgccgctcgtcctcgcgacctcgcgctcgaaacatacgcgataaacgataccgctccgaaccgcctctaccgccgcgaataaaaaacgcgaacgccgaacaccgaactatcaataaacctaaaaccaacgaacgaaccaacgactccgactcccgctcccgctccgcgcaacaccaacccgactctccccgacccccgccgcgccccctcgccgcgacctcgaccaccgacccgcgccccgcgcccgaaatcgccccgaacccgcacctctcccccgccgcccccgcccacccgaccctccgcgaccgcaactccccgacgaaaacaaaaaataattaaaaaaaaccataactaacgttttcccgaacaacgactccacgacgtctcaaaacgtaaccaaccgcttcgcccgcaaaaaaacgctaaaacaaaaaaacgtacacgaaataaaaaaccacaaattcatcgcgcgcttcttcaaacaacccaccttctacaaccactacaccgacttcatctaataaataccgaaccgaacactcctaccccgctcctccccgcctccgaatcccgacacccgacgctccgacgcgtccgccccgaaactaactcactccgataacttaaaaccgacgaaaatccgaactcttcgcccgaaataacacgcgcgcccgaccctaacaccgacgaacaaaactcccgaaacgtcgccgtcccgccacacacaccccctaacgcgaaaaaaaaactaaccccgtacgataacgaaaaaaatccctctccgaaccgaacccctcacctccccgaacgcgcccacccgcacgcacccaacgaaacgaccgcttaccgaaatataaacccaaaaaacaaaaaaaaaaaaaaaaccctaaaaaaacaaaaattcccgaaaaaacgcgccccgaaataacgaaaaaacgacgacgattacactacgcgcgatccaaattactaacgaaccaaactaaacgcgttcgaaataaaaaaattatatttatacttcccatcgaactaaactacgctaacatcttaaaccc

SEQ ID NO: 8949 - DNA, 511 bp, Artificial Sequence
  chemically treated genomic DNA (Homo sapiens) CpG-island No: 8949
  misc_feature (288)..(288): n is either a, c, g or t
  misc_feature (310)..(310): n is either a, c, g or t
agtacggggattttttatacgcgggtttttggttggaggagttcgtttcggtcgtcgtttgggtttcgcggtttagaggtgcgcgcgattttcgttcggttttgttcgtttagtttggcgttcgtcgtttttggttgtgcgtttcgttggggtcgggagtcgtcgcgcgtttttcggttttatttaggagtagtaggcggtgggtagttttgtaagttaggcgttttttttgtaattgtttttcgatttttttgttggtttcgcgtcgtttttttttatcgacgtttntggtttttcgtcgttttgttgnttgtcgtttaaatattttatgtttgttcgttgggatggacgttaggaagttaggaatgtgcgtaaaaagtaatagagagttggagacgtgtgcggtttttgcgacggttttttttttttttgttgttgaaagagatggtttggttttttcggtgtttttcgatttagagtaggcgttttttttttttttttttgtttatcg

SEQ ID NO: 8950 - DNA, 511 bp, Artificial Sequence
  chemically treated genomic DNA (Homo sapiens) CpG-island No: 8950
  misc_feature (202)..(202): n is either a, c, g or t
  misc_feature (224)..(224): n is either a, c, g or t
cgataaacaaaaaaaaaaaaaaaaaacgcctactctaaatcgaaaaacaccgaaaaaaccaaaccatctctttcaacaacaaaaaaaaaaaaaaccgtcgcaaaaaccgcacacgtctccaactctctattactttttacgcacattcctaacttcctaacgtccatcccaacgaacaaacataaaatatttaaacgacaancaacaaaacgacgaaaaaccanaaacgtcgataaaaaaaaacgacgcgaaaccaacaaaaaaatcgaaaaacaattacaaaaaaaacgcctaacttacaaaactacccaccgcctactactcctaaataaaaccgaaaaacgcgcgacgactcccgaccccaacgaaacgcacaaccaaaaacgacgaacgccaaactaaacgaacaaaaccgaacgaaaatcgcgcgcacctctaaaccgcgaaacccaaacgacgaccgaaacgaactcctccaaccaaaaacccgcgtataaaaaatccccgtact

SEQ ID NO: 8951 - DNA, 511 bp, Artificial Sequence
  chemically treated genomic DNA (Homo sapiens) CpG-island No: 8951
  misc_feature (202)..(202): n is either a, c, g or t
  misc_feature (224)..(224): n is either a, c, g or t
cggtgggtagggggagggagaagaaacgtttgttttgaatcggaaaatatcgaagagattagattattttttttagtagtaggaaagagaggagtcgtcgtaggagtcgtatacgtttttaattttttattgttttttgcgtatatttttaattttttgacgtttattttagcgggtaggtatggggtgtttgggcggtaantagtaagacgacggaagattangggcgtcgatgaaaaagaacgacgcgaggttaataaaaagatcgagaagtagttgtagaaagagcgtttggtttataaggttatttatcgtttgttgtttttgggtaaggtcgaggggcgcgcggcggttttcggttttagcggagcgtatagttaggagcggcgagcgttaggttgggcgggtagggtcgggcgagggtcgcgcgtatttttgggtcgcggagtttagacggcggtcggggcgagtttttttagttaggaattcgcgtgtaggaaattttcgtgtt

SEQ ID NO: 8952 - DNA, 511 bp, Artificial Sequence
  chemically treated genomic DNA (Homo sapiens) CpG-island No: 8952
  misc_feature (288)..(288): n is either a, c, g or t
  misc_feature (310)..(310): n is either a, c, g or t
aacacgaaaatttcctacacgcgaattcctaactaaaaaaactcgccccgaccgccgtctaaactccgcgacccaaaaatacgcgcgaccctcgcccgaccctacccgcccaacctaacgctcgccgctcctaactatacgctccgctaaaaccgaaaaccgccgcgcgcccctcgaccttacccaaaaacaacaaacgataaataaccttataaaccaaacgctctttctacaactacttctcgatctttttattaacctcgcgtcgttctttttcatcgacgcccntaatcttccgtcgtcttactanttaccgcccaaacaccccatacctacccgctaaaataaacgtcaaaaaattaaaaatatacgcaaaaaacaataaaaaattaaaaacgtatacgactcctacgacgactcctctctttcctactactaaaaaaaataatctaatctcttcgatattttccgattcaaaacaaacgtttcttctccctccccctacccaccg

SEQ ID NO: 8953 - DNA, 666 bp, Artificial Sequence
  chemically treated genomic DNA (Homo sapiens) CpG-island No: 8953
  misc_feature (93)..(93): n is either a, c, g or t
  misc_feature (143)..(143): n is either a, c, g or t
  misc_feature (252)..(252): n is either a, c, g or t
  misc_feature (327)..(327): n is either a, c, g or t
gcgtcggttttcgttggagatagtcgaggtggcgtagcgtttcgggttcgttttacgttttttcgttcgtattttaagtttcgtttagttttngtttagcgggttttcgagggggcggcgcgttcggttgggtgtcgggtttntaaatagtcggggtggtggttgagcgtggcgcggaggatagagcgcgttatcggggttttagagggcgacgatgggtatttgtcgggtcggttcgcgttttgttatttntttagtcgtcggacgtgcgttttttttttggtttgggatttcggtgcggggaagggagagggaggttggttttgnggggcggtcgggtcgttggtttcggagttttcggagaggcgttatcgcgttgtaggggttagggagttgattttttacggagttcggtcggttggggcgtttatacgttgatcggtttgggtttcgggttcgtagttttttcgttgcgtcgcggtcgtttggtttttttgtatttcgagtcgggaaagtgcgtttgggcgcgcgtttcgtgttggttcggacgcgtttttgtttttggcgggcgaagattcgcggaggattatgtatattttagtagggaggaggattttttcgaggtttattagttatatcgtttttgttttgtttagtttttagatt

SEQ ID NO: 8954 - DNA, 666 bp, Artificial Sequence
  chemically treated genomic DNA (Homo sapiens) CpG-island No: 8954
  misc_feature (340)..(340): n is either a, c, g or t
  misc_feature (415)..(415): n is either a, c, g or t
  misc_feature (524)..(524): n is either a, c, g or t
  misc_feature (574)..(574): n is either a, c, g or t
aatctaaaaactaaacaaaacaaaaacgatataactaataaacctcgaaaaaatcctcctccctactaaaatatacataatcctccgcgaatcttcgcccgccaaaaacaaaaacgcgtccgaaccaacacgaaacgcgcgcccaaacgcactttcccgactcgaaatacaaaaaaaccaaacgaccgcgacgcaacgaaaaaactacgaacccgaaacccaaaccgatcaacgtataaacgccccaaccgaccgaactccgtaaaaaatcaactccctaacccctacaacgcgataacgcctctccgaaaactccgaaaccaacgacccgaccgccccncaaaaccaacctccctctcccttccccgcaccgaaatcccaaaccaaaaaaaaaacgcacgtccgacgactaaanaaataacaaaacgcgaaccgacccgacaaatacccatcgtcgccctctaaaaccccgataacgcgctctatcctccgcgccacgctcaaccaccaccccgactatttanaaacccgacacccaaccgaacgcgccgccccctcgaaaacccgctaaacnaaaactaaacgaaacttaaaatacgaacgaaaaaacgtaaaacgaacccgaaacgctacgccacctcgactatctccaacgaaaaccgacgc

SEQ ID NO: 8955 - DNA, 666 bp, Artificial Sequence
  chemically treated genomic DNA (Homo sapiens) CpG-island No: 8955
  misc_feature (340)..(340): n is either a, c, g or t
  misc_feature (415)..(415): n is either a, c, g or t
  misc_feature (524)..(524): n is either a, c, g or t
  misc_feature (574)..(574): n is either a, c, g or t
agtttagaagttgagtagaataaaggcggtgtgattggtgagtttcggagggatttttttttttgttagaatatgtatgatttttcgcgagttttcgttcgttaggagtagggacgcgttcgagttaatacggggcgcgcgtttagacgtattttttcggttcggggtgtaagagagttaggcggtcgcggcgtagcggaggggttgcgggttcggaatttaggtcggttagcgtgtaagcgttttagtcggtcgggtttcgtggggggttagttttttgatttttatagcgcggtagcgttttttcgagagtttcgggattagcggttcggtcgttttntaaagttagtttttttttttttttttcgtatcgggattttagattagggagggggcgtacgttcgacggttgagngaatagtagggcgcgagtcggttcggtaggtgtttatcgtcgttttttgggatttcggtggcgcgttttgtttttcgcgttacgtttagttattatttcggttgtttgnggattcggtatttagtcgagcgcgtcgttttttcggggattcgttgggtnggggttgagcgaggtttggagtgcgggcgaagggacgtggggcgaattcggggcgttgcgttatttcggttgtttttagcggagatcggcgt

SEQ ID NO: 8956 - DNA, 666 bp, Artificial Sequence
  chemically treated genomic DNA (Homo sapiens) CpG-island No: 8956
  misc_feature (93)..(93): n is either a, c, g or t
  misc_feature (143)..(143): n is either a, c, g or t
  misc_feature (252)..(252): n is either a, c, g or t
  misc_feature (327)..(327): n is either a, c, g or t
acgccgatctccgctaaaaacaaccgaaataacgcaacgccccgaattcgccccacgtcccttcgcccgcactccaaacctcgctcaaccccnacccaacgaatccccgaaaaaacgacgcgctcgactaaataccgaatccncaaacaaccgaaataataactaaacgtaacgcgaaaaacaaaacgcgccaccgaaatcccaaaaaacgacgataaacacctaccgaaccgactcgcgccctactattcnctcaaccgtcgaacgtacgccccctccctaatctaaaatcccgatacgaaaaaaaaaaaaaaaaactaactttanaaaacgaccgaaccgctaatcccgaaactctcgaaaaaacgctaccgcgctataaaaatcaaaaaactaaccccccacgaaacccgaccgactaaaacgcttacacgctaaccgacctaaattccgaacccgcaacccctccgctacgccgcgaccgcctaactctcttacaccccgaaccgaaaaaatacgtctaaacgcgcgccccgtattaactcgaacgcgtccctactcctaacgaacgaaaactcgcgaaaaatcatacatattctaacaaaaaaaaaaatccctccgaaactcaccaatcacaccgcctttattctactcaacttctaaact

SEQ ID NO: 8957 - DNA, 966 bp, Artificial Sequence
  chemically treated genomic DNA (Homo sapiens) CpG-island No: 8957
tcgtgttattttgtgggagtagaaacggaggttagttttttgttcgtgagggttggggcggggcgcgggttttggtaggtgcgttagttcgtaggggaattcggggttttatttgggcgcggcgaggaagttatattatgtatgggtagttacgttaggggggcgggttcgtagtcgtcggggaacgcgagtcgggtttatttcggtgaaaaggttgtagtcggatttggggagcgtcgttaagttcgggatcgacgggttaaggcggcgcgtttcgggggtggagtttggaggtgatcgcgtcgttgtaacgtttttatttttcgcggtcgtagtggtttagttcgagaattttttatttataaaaagaaaagattcgtacggcgcgggtgagttagaatttagtagtcgtgtatttcgtagagtcgttagtttcgggtatgtttcgagatttcggggaattcggttcgagtttcgggaacggcggcgggtacggcggtttcgcgtattttcggtcgtagcgtaggtagtttagtaggtgagtggggttcgacgtcggtggttttacgggaggatcgcgcgtgggaggtcggggttaattttcgtacgtttcgggattggagcggggaatcggagtcggggtcgggttgggggttggggcgaggattttgttttcgtcgttcggggttagttgtttttcgcgcgtagtagagatcgcgaatttttttttttttagtcgtttttttttttttcgtcgttcgcgttcgttttttcgttttcgtgttcgttttttttttttttgtttatttttgatttttgcgtttattttgttttagaaggggcgtgggcgtagggtggtcgttcgaagttaggagggttttttcgtttcgggttgaatttttgggatttggagtttgggttggggtgagggttttatacgggagggaggcgggattcgtcgggaga

SEQ ID NO: 8958 - DNA, 966 bp, Artificial Sequence
  chemically treated genomic DNA (Homo sapiens) CpG-island No: 8958
tctcccgacgaatcccgcctccctcccgtataaaaccctcaccccaacccaaactccaaatcccaaaaattcaacccgaaacgaaaaaaccctcctaacttcgaacgaccaccctacgcccacgccccttctaaaacaaaataaacgcaaaaatcaaaaataaacaaaaaaaaaaaaaacgaacacgaaaacgaaaaaacgaacgcgaacgacgaaaaaaaaaaaaacgactaaaaaaaaaaaaattcgcgatctctactacgcgcgaaaaacaactaaccccgaacgacgaaaacaaaatcctcgccccaacccccaacccgaccccgactccgattccccgctccaatcccgaaacgtacgaaaattaaccccgacctcccacgcgcgatcctcccgtaaaaccaccgacgtcgaaccccactcacctactaaactacctacgctacgaccgaaaatacgcgaaaccgccgtacccgccgccgttcccgaaactcgaaccgaattccccgaaatctcgaaacatacccgaaactaacgactctacgaaatacacgactactaaattctaactcacccgcgccgtacgaatcttttctttttataaataaaaaattctcgaactaaaccactacgaccgcgaaaaataaaaacgttacaacgacgcgatcacctccaaactccacccccgaaacgcgccgccttaacccgtcgatcccgaacttaacgacgctccccaaatccgactacaaccttttcaccgaaataaacccgactcgcgttccccgacgactacgaacccgcccccctaacgtaactacccatacataatataacttcctcgccgcgcccaaataaaaccccgaattcccctacgaactaacgcacctaccaaaacccgcgccccgccccaaccctcacgaacaaaaaactaacctccgtttctactcccacaaaataacacga

SEQ ID NO: 8959 - DNA, 966 bp, Artificial Sequence
  chemically treated genomic DNA (Homo sapiens) CpG-island No: 8959
tttttcgacggatttcgtttttttttcgtgtgggatttttattttagtttagattttagattttaggaatttagttcgaagcggagagatttttttagtttcgagcgattattttacgtttacgttttttttgaagtagggtggacgtagaagttagaggtgggtaggaggagagaaagcgggtacggagacggagggacggacgcggacggcgagggagaagggggcggttgggagaaggggagttcgcggtttttgttgcgcgcggggggtaattggtttcggacggcgagggtaggattttcgttttagtttttagttcggtttcgatttcggtttttcgttttagtttcggagcgtgcgggagttgatttcggttttttacgcgcggttttttcgtgggattatcggcgtcgggttttatttatttgttgggttgtttgcgttgcggtcgggggtgcgcggggtcgtcgtattcgtcgtcgttttcggagttcgggtcgggtttttcgaagtttcggaatatgttcggggttggcggttttgcggggtatacggttgttgggttttgatttattcgcgtcgtgcgagttttttttttttatgaatgaaaagttttcgggttgaattattgcgatcgcggggggtgggggcgttgtagcggcgcggttatttttaggttttattttcgagacgcgtcgttttggttcgtcggtttcgaatttggcgacgttttttaagttcggttgtagtttttttatcgggatgggttcggttcgcgtttttcggcggttgcgggttcgtttttttgacgtagttgtttatatatggtgtaattttttcgtcgcgtttaggtggagtttcgggtttttttgcggattgacgtatttgttagagttcgcgtttcgttttagtttttacgagtaaagggttaattttcgtttttgtttttataaaatagtacga

SEQ ID NO: 8960 - DNA, 966 bp, Artificial Sequence
  chemically treated genomic DNA (Homo sapiens) CpG-island No: 8960
tcgtactattttataaaaacaaaaacgaaaattaaccctttactcgtaaaaactaaaacgaaacgcgaactctaacaaatacgtcaatccgcaaaaaaacccgaaactccacctaaacgcgacgaaaaaattacaccatatataaacaactacgtcaaaaaaacgaacccgcaaccgccgaaaaacgcgaaccgaacccatcccgataaaaaaactacaaccgaacttaaaaaacgtcgccaaattcgaaaccgacgaaccaaaacgacgcgtctcgaaaataaaacctaaaaataaccgcgccgctacaacgcccccaccccccgcgatcgcaataattcaacccgaaaacttttcattcataaaaaaaaaaaactcgcacgacgcgaataaatcaaaacccaacaaccgtataccccgcaaaaccgccaaccccgaacatattccgaaacttcgaaaaacccgacccgaactccgaaaacgacgacgaatacgacgaccccgcgcacccccgaccgcaacgcaaacaacccaacaaataaataaaacccgacgccgataatcccacgaaaaaaccgcgcgtaaaaaaccgaaatcaactcccgcacgctccgaaactaaaacgaaaaaccgaaatcgaaaccgaactaaaaactaaaacgaaaatcctaccctcgccgtccgaaaccaattaccccccgcgcgcaacaaaaaccgcgaactccccttctcccaaccgcccccttctccctcgccgtccgcgtccgtccctccgtctccgtacccgctttctctcctcctacccacctctaacttctacgtccaccctacttcaaaaaaaacgtaaacgtaaaataatcgctcgaaactaaaaaaatctctccgcttcgaactaaattcctaaaatctaaaatctaaactaaaataaaaatcccacacgaaaaaaaaacgaaatccgtcgaaaaa

SEQ ID NO: 8961 - DNA, 585 bp, Artificial Sequence
  chemically treated genomic DNA (Homo sapiens) CpG-island No: 8961
tttttcgcgtgttcgttcgtttgtttgtttttcgttttttcgtcgttaagtttttatcgtttttcggtttggggagtttaggggggttcgggtagtggaatttgttaggttttcggagatcggttttcgatttttttgtcgaatgcgggaatagagatttcgaggtttcgggacgtgcgcggggttaggttgcgggcgattttcgcgattttatttttagtttttaacggcgttcgttgttcgtcggggtattcgggaggttgtaggtgtttattttttgtcgaggggttgcgagtacgtgtcgataggggagggaaggaggggcgttcgttcgagttatcggttcgagttacggcggttgagttattcggggcgtttttttttttttgtttggagcggtcgggtcgggagtgggagatgtcgtcgcggtgtttcggattcggaattggggttattgggacgtcgggttcgtagcgtttgggttcggttatcgttgtcgggatttgtttgggtttgtgggcgtttttcggacgattgggcgtttatatttagggtttagcggtagagttagaatttatttttttt

SEQ ID NO: 8962 - DNA, 585 bp, Artificial Sequence
  chemically treated genomic DNA (Homo sapiens) CpG-island No: 8962
aaaaaaaataaattctaactctaccgctaaaccctaaatataaacgcccaatcgtccgaaaaacgcccacaaacccaaacaaatcccgacaacgataaccgaacccaaacgctacgaacccgacgtcccaataaccccaattccgaatccgaaacaccgcgacgacatctcccactcccgacccgaccgctccaaacaaaaaaaaaaaaacgccccgaataactcaaccgccgtaactcgaaccgataactcgaacgaacgcccctccttccctcccctatcgacacgtactcgcaacccctcgacaaaaaataaacacctacaacctcccgaataccccgacgaacaacgaacgccgttaaaaactaaaaataaaatcgcgaaaatcgcccgcaacctaaccccgcgcacgtcccgaaacctcgaaatctctattcccgcattcgacaaaaaaatcgaaaaccgatctccgaaaacctaacaaattccactacccgaacccccctaaactccccaaaccgaaaaacgataaaaacttaacgacgaaaaaacgaaaaacaaacaaacgaacgaacacgcgaaaaa

SEQ ID NO: 8963 - DNA, 585 bp, Artificial Sequence
  chemically treated genomic DNA (Homo sapiens) CpG-island No: 8963
gggagaagtgggttttagttttgtcgttgggttttgggtgtgggcgtttaatcgttcgggaagcgtttataagtttaggtaagtttcgatagcggtagtcgagtttaagcgttgcgggttcggcgttttagtgattttagtttcgggttcgaggtatcgcggcggtattttttattttcggttcggtcgttttaggtaggaagggagggacgtttcgggtgatttagtcgtcgtgattcgggtcgatgattcgaacggacgttttttttttttttttttgtcgatacgtgttcgtagtttttcgataggaaatgggtatttgtagtttttcgggtgtttcggcgggtagcgggcgtcgttaggggttgagagtggggtcgcgagagtcgttcgtagtttgatttcgcgtacgtttcggaatttcgaggtttttattttcgtattcggtaaagggatcgagggtcggttttcggggatttggtaggttttattgttcggatttttttggattttttaggtcgagaaacgatagggatttggcgacggaggggcgaaggatagatagacggacggatacgcggaggg

SEQ ID NO: 8964 - DNA, 585 bp, Artificial Sequence
  chemically treated genomic DNA (Homo sapiens) CpG-island No: 8964
ccctccgcgtatccgtccgtctatctatccttcgcccctccgtcgccaaatccctatcgtttctcgacctaaaaaatccaaaaaaatccgaacaataaaacctaccaaatccccgaaaaccgaccctcgatccctttaccgaatacgaaaataaaaacctcgaaattccgaaacgtacgcgaaatcaaactacgaacgactctcgcgaccccactctcaacccctaacgacgcccgctacccgccgaaacacccgaaaaactacaaatacccatttcctatcgaaaaactacgaacacgtatcgacaaaaaaaaaaaaaaaaaacgtccgttcgaatcatcgacccgaatcacgacgactaaatcacccgaaacgtccctcccttcctacctaaaacgaccgaaccgaaaataaaaaataccgccgcgatacctcgaacccgaaactaaaatcactaaaacgccgaacccgcaacgcttaaactcgactaccgctatcgaaacttacctaaacttataaacgcttcccgaacgattaaacgcccacacccaaaacccaacgacaaaactaaaacccacttctccc

SEQ ID NO: 8965 - DNA, 578 bp, Artificial Sequence
  chemically treated genomic DNA (Homo sapiens) CpG-island No: 8965
aagtataacgtcggttttcgtcggtgagtacgtgtagagttcggtaggagtgggttcggttttcgggtggtttgggtttagttatcgttgggtaggcggggcgtcgcggtgttcggggtttggacgtttcgttttttttatgtttttttcgcgttcgtgtttttcgttttttttttcgggatgttttttttttttttagtatttttttagggacggtggcgacggggtttgaattttgtttttttatcgtaggcgcggattaagaagattatgtagacggacgaagagattgggaaggtggcggcgcggtgtttgttattatttgtatttgtcgggggcggatcgggtcgaggggcgtgggggagggaggtagcgggtttttttttttgtttcggagttttttttgacgttttttagttcgggcgttcgagttttttttagagtcgttgttgaagaaggtttgttaggtgatttagtcgcggaagcgaagattatgattatattttatttgtgagcgggaggagcgggaggggtcggcgggtttggtcggggagtttatatattgaggaaggtagagt

SEQ ID NO: 8966 - DNA, 578 bp, Artificial Sequence
  chemically treated genomic DNA (Homo sapiens) CpG-island No: 8966
actctaccttcctcaatatataaactccccgaccaaacccgccgacccctcccgctcctcccgctcacaaataaaatataatcataatcttcgcttccgcgactaaatcacctaacaaaccttcttcaacaacgactctaaaaaaaactcgaacgcccgaactaaaaaacgtcaaaaaaaactccgaaacaaaaaaaaaaacccgctacctccctcccccacgcccctcgacccgatccgcccccgacaaatacaaataataacaaacaccgcgccgccaccttcccaatctcttcgtccgtctacataatcttcttaatccgcgcctacgataaaaaaacaaaattcaaaccccgtcgccaccgtccctaaaaaaatactaaaaaaaaaaaaaacatcccgaaaaaaaaaacgaaaaacacgaacgcgaaaaaaacataaaaaaaacgaaacgtccaaaccccgaacaccgcgacgccccgcctacccaacgataactaaacccaaaccacccgaaaaccgaacccactcctaccgaactctacacgtactcaccgacgaaaaccgacgttatactt

SEQ ID NO: 8967 - DNA, 578 bp, Artificial Sequence
  chemically treated genomic DNA (Homo sapiens) CpG-island No: 8967
gttttgttttttttagtgtgtgaatttttcggttaaattcgtcggtttttttcgtttttttcgtttataggtgggatgtggttatggttttcgttttcgcgattgggttatttggtaggttttttttaatagcgattttaggaagagttcgagcgttcgggttgaggagcgttaaggagaatttcggggtaggagaggggattcgttgttttttttttttacgtttttcgattcggttcgttttcggtagatatagatgatgataggtatcgcgtcgttatttttttaattttttcgttcgtttgtatgatttttttgattcgcgtttgcggtgggggagtagagtttagatttcgtcgttatcgtttttaagggggtgttgggggaggaaggggtatttcgagaaagggggcgggggatacggacgcggggagggtatggagggggcggggcgtttaggtttcgaatatcgcggcgtttcgtttgtttagcggtaattgggtttaagttattcgggagtcgggtttatttttgtcgggttttgtacgtgtttatcggcgggaatcggcgttgtattt

SEQ ID NO: 8968 - DNA, 578 bp, Artificial Sequence
  chemically treated genomic DNA (Homo sapiens) CpG-island No: 8968
aaatacaacgccgattcccgccgataaacacgtacaaaacccgacaaaaataaacccgactcccgaataacttaaacccaattaccgctaaacaaacgaaacgccgcgatattcgaaacctaaacgccccgccccctccataccctccccgcgtccgtatcccccgccccctttctcgaaataccccttcctcccccaacacccccttaaaaacgataacgacgaaatctaaactctactcccccaccgcaaacgcgaatcaaaaaaatcatacaaacgaacgaaaaaattaaaaaaataacgacgcgatacctatcatcatctatatctaccgaaaacgaaccgaatcgaaaaacgtaaaaaaaaaaaacaacgaatcccctctcctaccccgaaattctccttaacgctcctcaacccgaacgctcgaactcttcctaaaatcgctattaaaaaaaacctaccaaataacccaatcgcgaaaacgaaaaccataaccacatcccacctataaacgaaaaaaacgaaaaaaaccgacgaatttaaccgaaaaattcacacactaaaaaaaacaaaac

SEQ ID NO: 8969 - DNA, 1129 bp, Artificial Sequence
  chemically treated genomic DNA (Homo sapiens) CpG-island No: 8969
aggagcggaggaggggagcgaataggacgaggaacggggcggagggggttgggaggacggagggggttgtttcgcgttcggggagcggagggggaacgaggggttttgagcgggggaaaggtgagcggaggaggggtcgcgaattagggggaagcgggaggtcggcggagtatgagagggggcggcgggaggcgagcggggggtttttcggaggttttaataattttttagttttgcggggatttcgagtttcgaataaaggcggttacgaaggtcggcgtatagcgttttgtttcgtttttcggcgtttttcgtagggcgaataaaggtttagcggttttcgcgtttaggtttttttacgttttttttcggaggtttttttttgcgttttaagtttttaggtttttcgcgcgttcgatgttttttttatttttcgcgttttttattttcgattatttttgcgttttcggatttttacgaagtttcggatttcgcgttttcggcgtttttcgcggtatttataggatggaggtttgcggcgttacggcgggtacggtttttagtagtagatgtatgtagcgtacggtggtgcggaagtataggtagcggttcggatattttgcgttcggtttttgggttattacggttagcgttttttaggcgtagaatagtacgagcgttaataggtagcggcgttcggggtttttggagcgtttggttatggtcgacggcgcggacggacgttcggacgtacggagttattacggtcggttttcgattgcgttcgttcggtcgcggtttacgttttagttgtgcgcggggggcggggggcgttagttgtgtatatgcgcgaggtttttttcggtttttttgaattttcgagggcggggcggggcgagaattcggggttttagcgttcggtttgagcgtttttatttcggtggggcggttcgtatggttaaggcgagcgttcgggggcgcggaggagagtattggtatttttgattttgcgttcgagattcggggttcgggattttggggtttacgcgaagtttttttattttttttattcgtggtttttgtttgcgtttattacgggttttttagttggcgttttaatgtttgtaat

SEQ ID NO: 8970 - DNA, 1129 bp, Artificial Sequence
  chemically treated genomic DNA (Homo sapiens) CpG-island No: 8970
attacaaacattaaaacgccaactaaaaaacccgtaataaacgcaaacaaaaaccacgaataaaaaaaataaaaaaacttcgcgtaaaccccaaaatcccgaaccccgaatctcgaacgcaaaatcaaaaataccaatactctcctccgcgcccccgaacgctcgccttaaccatacgaaccgccccaccgaaataaaaacgctcaaaccgaacgctaaaaccccgaattctcgccccgccccgccctcgaaaattcaaaaaaaccgaaaaaaacctcgcgcatatacacaactaacgccccccgccccccgcgcacaactaaaacgtaaaccgcgaccgaacgaacgcaatcgaaaaccgaccgtaataactccgtacgtccgaacgtccgtccgcgccgtcgaccataaccaaacgctccaaaaaccccgaacgccgctacctattaacgctcgtactattctacgcctaaaaaacgctaaccgtaataacccaaaaaccgaacgcaaaatatccgaaccgctacctatacttccgcaccaccgtacgctacatacatctactactaaaaaccgtacccgccgtaacgccgcaaacctccatcctataaataccgcgaaaaacgccgaaaacgcgaaatccgaaacttcgtaaaaatccgaaaacgcaaaaataatcgaaaataaaaaacgcgaaaaataaaaaaaacatcgaacgcgcgaaaaacctaaaaacttaaaacgcaaaaaaaaacctccgaaaaaaaacgtaaaaaaacctaaacgcgaaaaccgctaaacctttattcgccctacgaaaaacgccgaaaaacgaaacaaaacgctatacgccgaccttcgtaaccgcctttattcgaaactcgaaatccccgcaaaactaaaaaattattaaaacctccgaaaaaccccccgctcgcctcccgccgccccctctcatactccgccgacctcccgcttccccctaattcgcgacccctcctccgctcacctttcccccgctcaaaacccctcgttccccctccgctccccgaacgcgaaacaaccccctccgtcctcccaaccccctccgccccgttcctcgtcctattcgctcccctcctccgctcct

SEQ ID NO: 8971 - DNA, 1129 bp, Artificial Sequence
  chemically treated genomic DNA (Homo sapiens) CpG-island No: 8971
gttataaatattaaggcgttaattaaaaaattcgtagtgagcgtaggtagaaattacgggtaagagaagtggagaagtttcgcgtaggttttagggtttcgagtttcgagtttcgagcgtagaattaggggtgttaatgttttttttcgcgttttcgagcgttcgttttggttatgcgggtcgttttatcgggatgagggcgtttaggtcggacgttggggtttcgggttttcgtttcgtttcgttttcggggatttagaggggtcgggaggagtttcgcgtatgtgtatagttggcgtttttcgtttttcgcgtatagttgggacgtgggtcgcggtcgggcgggcgtagtcgggagtcggtcgtggtggtttcgtgcgttcgagcgttcgttcgcgtcgtcggttatggttaagcgttttaggggtttcgggcgtcgttgtttgttggcgttcgtgttgttttgcgtttgggggacgttggtcgtggtggtttagaagtcgggcgtagggtgttcgagtcgttgtttgtgttttcgtattatcgtgcgttgtatgtatttgttgttggaggtcgtgttcgtcgtggcgtcgtagatttttattttgtgagtgtcgcgggggacgtcgggggcgcggggttcggggtttcgtggagattcgggagcgtaggggtgatcggaggtggggggcgcggagggtggagggggtatcgggcgcgcggggggtttggggatttgggacgtagaagggaattttcgaagggggacgtggggggatttgggcgcggggatcgttgggtttttgttcgttttgcgggagacgtcgaggggcggaatagagcgttgtgcgtcggttttcgtagtcgtttttgttcggaattcggaattttcgtaggattgggaagttgttggagttttcgggaaatttttcgttcgtttttcgtcgtttttttttatgtttcgtcggtttttcgtttttttttggttcgcggtttttttttcgtttatttttttttcgtttaggatttttcgtttttttttcgtttttcgagcgcggagtagtttttttcgtttttttagtttttttcgtttcgtttttcgttttgttcgtttttttttttcgttttt

SEQ ID NO: 8972 - DNA, 1129 bp, Artificial Sequence
  chemically treated genomic DNA (Homo sapiens) CpG-island No: 8972
aaaaacgaaaaaaaaaaacgaacaaaacgaaaaacgaaacgaaaaaaactaaaaaaacgaaaaaaactactccgcgctcgaaaaacgaaaaaaaaacgaaaaatcctaaacgaaaaaaaaataaacgaaaaaaaaaccgcgaaccaaaaaaaaacgaaaaaccgacgaaacataaaaaaaaacgacgaaaaacgaacgaaaaatttcccgaaaactccaacaacttcccaatcctacgaaaattccgaattccgaacaaaaacgactacgaaaaccgacgcacaacgctctattccgcccctcgacgtctcccgcaaaacgaacaaaaacccaacgatccccgcgcccaaatccccccacgtcccccttcgaaaattcccttctacgtcccaaatccccaaaccccccgcgcgcccgataccccctccaccctccgcgccccccacctccgatcacccctacgctcccgaatctccacgaaaccccgaaccccgcgcccccgacgtcccccgcgacactcacaaaataaaaatctacgacgccacgacgaacacgacctccaacaacaaatacatacaacgcacgataatacgaaaacacaaacaacgactcgaacaccctacgcccgacttctaaaccaccacgaccaacgtcccccaaacgcaaaacaacacgaacgccaacaaacaacgacgcccgaaacccctaaaacgcttaaccataaccgacgacgcgaacgaacgctcgaacgcacgaaaccaccacgaccgactcccgactacgcccgcccgaccgcgacccacgtcccaactatacgcgaaaaacgaaaaacgccaactatacacatacgcgaaactcctcccgacccctctaaatccccgaaaacgaaacgaaacgaaaacccgaaaccccaacgtccgacctaaacgccctcatcccgataaaacgacccgcataaccaaaacgaacgctcgaaaacgcgaaaaaaaacattaacacccctaattctacgctcgaaactcgaaactcgaaaccctaaaacctacgcgaaacttctccacttctcttacccgtaatttctacctacgctcactacgaattttttaattaacgccttaatatttataac

SEQ ID NO: 8973 - DNA, 722 bp, Artificial Sequence
  chemically treated genomic DNA (Homo sapiens) CpG-island No: 8973
tgtgatttcgatttttaggagaacgtttcggtcgcgaagttatttcggttatttaggcggtaggttcgcgtcgttcggatcgtatttgtacgcgtacgtgttcggtcgagtttcgttttcggttttcgttcggttttgttcgcggtataaagcgtagtttaggtcggtttagacgtttagcgatttcgagtcgcgggtcgattttggcgtcgtttcgagtcggtcgtataaagcgtcgtattttcggtttggacgcgtagtcgttcgttgttcgtttttatttatcgcgtcggcggcgatttgggttttagtgattagcgtacgtcggttcgcggcgggtttggtcgtggggcgaaataaggggggcgtgtcgaggagatttgttacgataagaggttgatttttcgagtttcgcgttttcgtcgtttttcggacgtcgcgttttcgttcgttcggtttcgtttggttcggttcgttttttcgtagttcgcgtttttcgtcgacgttgcgtagttatcggagtcgtcgattttattttcgtttgagcgcgtcgcgacgggggcgcgtcgggtacgtgattgcgtagcgtgttcgttttcgtcggcgttttcgagacgttcggatggacgagcgcgacgagcgcggagtgggtcggttttagttggcgaaagggtcgggtgtagttgtagtttttttattaattgtttgtgaaaaaagtattt

SEQ ID NO: 8974 - DNA, 722 bp, Artificial Sequence
  chemically treated genomic DNA (Homo sapiens) CpG-island No: 8974
aaatacttttttcacaaacaattaataaaaaaactacaactacacccgaccctttcgccaactaaaaccgacccactccgcgctcgtcgcgctcgtccatccgaacgtctcgaaaacgccgacgaaaacgaacacgctacgcaatcacgtacccgacgcgcccccgtcgcgacgcgctcaaacgaaaataaaatcgacgactccgataactacgcaacgtcgacgaaaaacgcgaactacgaaaaaacgaaccgaaccaaacgaaaccgaacgaacgaaaacgcgacgtccgaaaaacgacgaaaacgcgaaactcgaaaaatcaacctcttatcgtaacaaatctcctcgacacgccccccttatttcgccccacgaccaaacccgccgcgaaccgacgtacgctaatcactaaaacccaaatcgccgccgacgcgataaataaaaacgaacaacgaacgactacgcgtccaaaccgaaaatacgacgctttatacgaccgactcgaaacgacgccaaaatcgacccgcgactcgaaatcgctaaacgtctaaaccgacctaaactacgctttataccgcgaacaaaaccgaacgaaaaccgaaaacgaaactcgaccgaacacgtacgcgtacaaatacgatccgaacgacgcgaacctaccgcctaaataaccgaaataacttcgcgaccgaaacgttctcctaaaaatcgaaatcaca

SEQ ID NO: 8975 - DNA, 722 bp, Artificial Sequence
  chemically treated genomic DNA (Homo sapiens) CpG-island No: 8975
aaatattttttttatagatagttaataaaaaaattatagttatattcggttttttcgttaattgggatcggtttatttcgcgttcgtcgcgttcgtttattcgggcgtttcgagggcgtcggcgggagcgagtacgttgcgtagttacgtgttcggcgcgttttcgtcgcggcgcgtttaggcggaagtgaggtcggcggtttcggtggttgcgtagcgtcggcggggagcgcgggttgcggagaggcgggtcgggttaagcggagtcgagcgagcgggagcgcggcgttcgggaggcggcggagacgcggggttcggagggttagttttttatcgtagtaggttttttcggtacgttttttttgtttcgttttacggttaagttcgtcgcgggtcggcgtgcgttggttattgaggtttaggtcgtcgtcggcgcggtgagtgggggcgggtagcgggcgattgcgcgtttaggtcggaagtgcggcgttttgtgcggtcggttcggggcggcgttaaggtcggttcgcggttcggggtcgttgggcgtttggatcggtttgggttgcgttttgtgtcgcgggtaaggtcgggcgggggtcgggggcggagttcggtcggatacgtacgcgtgtaggtgcggttcgggcggcgcgggtttgtcgtttaggtggtcgaggtggtttcgcggtcggggcgtttttttaaaggtcggggttata

SEQ ID NO: 8976 - DNA, 722 bp, Artificial Sequence
  chemically treated genomic DNA (Homo sapiens) CpG-island No: 8976
tataaccccgacctttaaaaaaacgccccgaccgcgaaaccacctcgaccacctaaacgacaaacccgcgccgcccgaaccgcacctacacgcgtacgtatccgaccgaactccgcccccgacccccgcccgaccttacccgcgacacaaaacgcaacccaaaccgatccaaacgcccaacgaccccgaaccgcgaaccgaccttaacgccgccccgaaccgaccgcacaaaacgccgcacttccgacctaaacgcgcaatcgcccgctacccgcccccactcaccgcgccgacgacgacctaaacctcaataaccaacgcacgccgacccgcgacgaacttaaccgtaaaacgaaacaaaaaaaacgtaccgaaaaaacctactacgataaaaaactaaccctccgaaccccgcgtctccgccgcctcccgaacgccgcgctcccgctcgctcgactccgcttaacccgacccgcctctccgcaacccgcgctccccgccgacgctacgcaaccaccgaaaccgccgacctcacttccgcctaaacgcgccgcgacgaaaacgcgccgaacacgtaactacgcaacgtactcgctcccgccgacgccctcgaaacgcccgaataaacgaacgcgacgaacgcgaaataaaccgatcccaattaacgaaaaaaccgaatataactataatttttttattaactatctataaaaaaaatattt

SEQ ID NO: 8977 - DNA, 593 bp, Artificial Sequence
  chemically treated genomic DNA (Homo sapiens) CpG-island No: 8977
cgttcgagtcgtcgcggtttttttgagtttttttagttcgtcgtcgtcgtcgttttcgttcgtatagtcggtttggttgttagggttgttagggtttggggtttgggaggcgtcgcgcgacggcgtcgcgtcgcgggaggagttttaggttcgcgagcgtaggcgtttcgttttttttcgggcgttgcgggttatcgttcggttttgtgcggcgggatttcggggtcgtacggagcgggaggtcgggcgttatggtatgggtttcgtagtttcggcgcgtttcgcgcgtcggggaaacgttttggcgttttgttgtttgtaatttgtttttcggcgtttagcgttggtggttttcgtcgtgttgggtttttggtttttattaacgtcgtattgatttttttgttggtttttcgttgagcgtcgcgtagggtcgcggtcggggtgagtggcgcggcgacggtattttagtcgttgttattcgcggttttcgtattggtcgcggagggaaggtttttttttattttatgtgtttattattagggtttggttcgggggtgtcgtcgagcgggtgtttgaggggcgtggtggtacgt

SEQ ID NO: 8978 - DNA, 593 bp, Artificial Sequence
  chemically treated genomic DNA (Homo sapiens) CpG-island No: 8978
acgtaccaccacgcccctcaaacacccgctcgacgacacccccgaaccaaaccctaataataaacacataaaataaaaaaaaaccttccctccgcgaccaatacgaaaaccgcgaataacaacgactaaaataccgtcgccgcgccactcaccccgaccgcgaccctacgcgacgctcaacgaaaaaccaacaaaaaaatcaatacgacgttaataaaaaccaaaaacccaacacgacgaaaaccaccaacgctaaacgccgaaaaacaaattacaaacaacaaaacgccaaaacgtttccccgacgcgcgaaacgcgccgaaactacgaaacccataccataacgcccgacctcccgctccgtacgaccccgaaatcccgccgcacaaaaccgaacgataacccgcaacgcccgaaaaaaaacgaaacgcctacgctcgcgaacctaaaactcctcccgcgacgcgacgccgtcgcgcgacgcctcccaaaccccaaaccctaacaaccctaacaaccaaaccgactatacgaacgaaaacgacgacgacgacgaactaaaaaaactcaaaaaaaccgcgacgactcgaacg

SEQ ID NO: 8979 - DNA, 593 bp, Artificial Sequence
  chemically treated genomic DNA (Homo sapiens) CpG-island No: 8979
acgtgttattacgttttttaggtattcgttcggcgatattttcggattaggttttggtagtgagtatatggggtggaaggaggtttttttttcgcgattagtgcggaggtcgcgggtggtaacggttggagtgtcgtcgtcgcgttatttatttcggtcgcggttttgcgcggcgtttagcggaaggttagtaggaagattagtacgacgttgatgagaattaggagtttagtacggcggagattattaacgttgggcgtcggggggtaggttgtaggtagtagggcgttagggcgttttttcggcgcgcggggcgcgtcggggttgcggggtttatgttatggcgttcggtttttcgtttcgtgcggtttcgagatttcgtcgtatagggtcgagcggtggttcgtagcgttcggggagaggcggggcgtttgcgttcgcgggtttggggtttttttcgcgacgcggcgtcgtcgcgcggcgttttttaggttttaagttttggtaattttggtaattaagtcggttgtgcgggcgggggcggcggcggcggcgggttggagaggtttagagggatcgcggcggttcgggcg

SEQ ID NO: 8980 - DNA, 593 bp, Artificial Sequence
  chemically treated genomic DNA (Homo sapiens) CpG-island No: 8980
cgcccgaaccgccgcgatccctctaaacctctccaacccgccgccgccgccgcccccgcccgcacaaccgacttaattaccaaaattaccaaaacttaaaacctaaaaaacgccgcgcgacgacgccgcgtcgcgaaaaaaaccccaaacccgcgaacgcaaacgccccgcctctccccgaacgctacgaaccaccgctcgaccctatacgacgaaatctcgaaaccgcacgaaacgaaaaaccgaacgccataacataaaccccgcaaccccgacgcgccccgcgcgccgaaaaaacgccctaacgccctactacctacaacctaccccccgacgcccaacgttaataatctccgccgtactaaactcctaattctcatcaacgtcgtactaatcttcctactaaccttccgctaaacgccgcgcaaaaccgcgaccgaaataaataacgcgacgacgacactccaaccgttaccacccgcgacctccgcactaatcgcgaaaaaaaaacctccttccaccccatatactcactaccaaaacctaatccgaaaatatcgccgaacgaatacctaaaaaacgtaataacacgt

SEQ ID NO: 8981 - DNA, 620 bp, Artificial Sequence
  chemically treated genomic DNA (Homo sapiens) CpG-island No: 8981
cggcggttgcgggcgtcggagtcgttatttttcggtttaggatttgcgtgggtggcgtggtggggggagttggtcggttagtttttagttttgcgtttcgtatattttgcgggttttcgaggttcggttttcgtcgttgcgcgtagggcgcggggcgttgtttcgagggatgcggggtattgatcggttacgtatggtttgtagttgagggtgaattaggacgagttcgcggatgacgacgtttttttggtcgggaatagcggagcggaggacggcggggcggaggcgtagagtagtaaggattagatgcggattaacgttattaacgagatttttagtattgagcgggattatattaagtatttgcgcgatatttgcgaggtgaggttcggtcggcgggcggtgattggggattcggtcgggggaggtttaattacgttcgcgtagggttacgttcggtagtgcgttaagcgcgtagatatgtttagcgaggagtagttgcgtattattttcgggaatatcgaggatatttatcgttgttagaaggttttcgtgaaggttttggagtagaggtttaatcgcgagcgtttatatttgagcgagttgggtgtttgtttttt

SEQ ID NO: 8982 - DNA, 620 bp, Artificial Sequence
  chemically treated genomic DNA (Homo sapiens) CpG-island No: 8982
aaaaaacaaacacccaactcgctcaaatataaacgctcgcgattaaacctctactccaaaaccttcacgaaaaccttctaacaacgataaatatcctcgatattcccgaaaataatacgcaactactcctcgctaaacatatctacgcgcttaacgcactaccgaacgtaaccctacgcgaacgtaattaaacctcccccgaccgaatccccaatcaccgcccgccgaccgaacctcacctcgcaaatatcgcgcaaatacttaatataatcccgctcaatactaaaaatctcgttaataacgttaatccgcatctaatccttactactctacgcctccgccccgccgtcctccgctccgctattcccgaccaaaaaaacgtcgtcatccgcgaactcgtcctaattcaccctcaactacaaaccatacgtaaccgatcaataccccgcatccctcgaaacaacgccccgcgccctacgcgcaacgacgaaaaccgaacctcgaaaacccgcaaaatatacgaaacgcaaaactaaaaactaaccgaccaactccccccaccacgccacccacgcaaatcctaaaccgaaaaataacgactccgacgcccgcaaccgccg

SEQ ID NO: 8983 - DNA, 620 bp, Artificial Sequence
  chemically treated genomic DNA (Homo sapiens) CpG-island No: 8983
aggaagtaggtatttagttcgtttaggtgtgggcgttcgcggttgaatttttgttttagggtttttacgaaggttttttggtagcggtagatgttttcgatgttttcgaagatggtacgtagttgtttttcgttgaatatgtttgcgcgtttggcgtattgtcggacgtagttttgcgcggacgtggttaggtttttttcgatcgggtttttagttatcgttcgtcggtcgggttttatttcgtagatgtcgcgtaggtgtttgatgtagtttcgtttagtgttgaggatttcgttgatgacgttggttcgtatttggtttttgttgttttgcgttttcgtttcgtcgtttttcgtttcgttgttttcggttagaggggcgtcgttattcgcgggttcgttttgatttatttttagttgtaggttatgcgtggtcggttagtgtttcgtatttttcggagtaacgtttcgcgttttgcgcgtagcggcgggaatcgggtttcggaggttcgtagggtgtacggggcgtagggttgaggattggtcggttagttttttttattacgttatttacgtaagttttggatcgaggaatgacgatttcgacgttcgtagtcgtcg

SEQ ID NO: 8984 - DNA, 620 bp, Artificial Sequence
  chemically treated genomic DNA (Homo sapiens) CpG-island No: 8984
cgacgactacgaacgtcgaaatcgtcattcctcgatccaaaacttacgtaaataacgtaataaaaaaaactaaccgaccaatcctcaaccctacgccccgtacaccctacgaacctccgaaacccgattcccgccgctacgcgcaaaacgcgaaacgttactccgaaaaatacgaaacactaaccgaccacgcataacctacaactaaaaataaatcaaaacgaacccgcgaataacgacgcccctctaaccgaaaacaacgaaacgaaaaacgacgaaacgaaaacgcaaaacaacaaaaaccaaatacgaaccaacgtcatcaacgaaatcctcaacactaaacgaaactacatcaaacacctacgcgacatctacgaaataaaacccgaccgacgaacgataactaaaaacccgatcgaaaaaaacctaaccacgtccgcgcaaaactacgtccgacaatacgccaaacgcgcaaacatattcaacgaaaaacaactacgtaccatcttcgaaaacatcgaaaacatctaccgctaccaaaaaaccttcgtaaaaaccctaaaacaaaaattcaaccgcgaacgcccacacctaaacgaactaaatacctacttcct

SEQ ID NO: 8985 - DNA, 767 bp, Artificial Sequence
  chemically treated genomic DNA (Homo sapiens) CpG-island No: 8985
cgcgatttggaaacgggtcgtgttcggtttagttcgtatttattcgttcggttatagtttagttatagtttagggattttgaggcgttcgcgtttttttgtcgcggtatttttagtttaagtaggtcggacgtcgaggtttcgcggtatcgagttttcgttcgtttcgttttttcgttttttatttcgtttcgttttcgtttttttatttttttttcgttttcgtttcgttttttcgataattttttcgcgttttcggttcggtacgcgcgttgcgttcggtcgtcgttgtcgtcgtcgtcgtcgtcgtcgttgtcgtcgagcgttttttcgttgcgtttggtttttagtttcgggtcggaatcggaagtttggggggcggagttcggcggaggttaggagatcgaaaacgcggtcgagttcggagttcggagttggagttagagtttggattagaatttggtcgtcgtttgtatcgtcgtcgtcgttgtcgttcgtcgtttttttttcgcgtcgtagtcgtttcgtcgttatcgtcgcgagttcggtcgttagtggttttcggattttaggtgtttgggttgaaggtcggttcggatatcggatttagttagtttttagattgttcgggcggtagcggacgtcgttgtcgtcgtcgttttttcgtcgttttagtttggcgttttgtttcgagagacgggagaggcgagcggagttgatagtgattttgatagtgatttaaattcgtttttgttgttgttggttttt

SEQ ID NO: 8986 - DNA, 767 bp, Artificial Sequence
  chemically treated genomic DNA (Homo sapiens) CpG-island No: 8986
aaaaaccaacaacaacaaaaacgaatttaaatcactatcaaaatcactatcaactccgctcgcctctcccgtctctcgaaacaaaacgccaaactaaaacgacgaaaaaacgacgacgacaacgacgtccgctaccgcccgaacaatctaaaaactaactaaatccgatatccgaaccgaccttcaacccaaacacctaaaatccgaaaaccactaacgaccgaactcgcgacgataacgacgaaacgactacgacgcgaaaaaaaaacgacgaacgacaacgacgacgacgatacaaacgacgaccaaattctaatccaaactctaactccaactccgaactccgaactcgaccgcgttttcgatctcctaacctccgccgaactccgccccccaaacttccgattccgacccgaaactaaaaaccaaacgcaacgaaaaaacgctcgacgacaacgacgacgacgacgacgacgacaacgacgaccgaacgcaacgcgcgtaccgaaccgaaaacgcgaaaaaattatcgaaaaaacgaaacgaaaacgaaaaaaaaataaaaaaacgaaaacgaaacgaaataaaaaacgaaaaaacgaaacgaacgaaaactcgataccgcgaaacctcgacgtccgacctacttaaactaaaaataccgcgacaaaaaaacgcgaacgcctcaaaatccctaaactataactaaactataaccgaacgaataaatacgaactaaaccgaacacgacccgtttccaaatcgcg

SEQ ID NO: 8987 - DNA, 767 bp, Artificial Sequence
  chemically treated genomic DNA (Homo sapiens) CpG-island No: 8987
aaaagttaataataataaaagcgggtttaaattattgttaaaattattgttagtttcgttcgtttttttcgtttttcggaataaaacgttaggttgaggcgacgaagaggcggcggcggtagcggcgttcgttgtcgttcggatagtttgggaattgattgggttcgatgttcggatcgatttttaatttagatatttaaagttcgaggattattggcggtcgagttcgcggcggtggcggcgaggcggttgcggcgcggggaaggggcggcgggcggtagcggcggcggcggtgtaggcggcggttaagttttggtttaggttttggttttagtttcgggtttcgggttcggtcgcgttttcggttttttggttttcgtcgggtttcgttttttaaattttcggtttcggttcgaagttggaagttaggcgtagcggaggaacgttcggcggtagcggcggcggcggcggcggcggtagcggcggtcgggcgtagcgcgcgtgtcgggtcgggagcgcgaggagattgtcggggaagcgaggcgggagcgggggaggggtgagagagcgagggcggggcggagtggagggcgaggaggcggggcggacggaggttcgatatcgcgaggtttcggcgttcggtttgtttgggttagagatatcgcgataaaggggcgcgggcgttttaaagtttttaagttgtggttgggttgtggtcgggcgagtagatgcgggttaggtcgggtacgattcgtttttaaatcgcg

SEQ ID NO: 8988 - DNA, 767 bp, Artificial Sequence
  chemically treated genomic DNA (Homo sapiens) CpG-island No: 8988
cgcgatttaaaaacgaatcgtacccgacctaacccgcatctactcgcccgaccacaacccaaccacaacttaaaaactttaaaacgcccgcgcccctttatcgcgatatctctaacccaaacaaaccgaacgccgaaacctcgcgatatcgaacctccgtccgccccgcctcctcgccctccactccgccccgccctcgctctctcacccctcccccgctcccgcctcgcttccccgacaatctcctcgcgctcccgacccgacacgcgcgctacgcccgaccgccgctaccgccgccgccgccgccgccgctaccgccgaacgttcctccgctacgcctaacttccaacttcgaaccgaaaccgaaaatttaaaaaacgaaacccgacgaaaaccaaaaaaccgaaaacgcgaccgaacccgaaacccgaaactaaaaccaaaacctaaaccaaaacttaaccgccgcctacaccgccgccgccgctaccgcccgccgccccttccccgcgccgcaaccgcctcgccgccaccgccgcgaactcgaccgccaataatcctcgaactttaaatatctaaattaaaaatcgatccgaacatcgaacccaatcaattcccaaactatccgaacgacaacgaacgccgctaccgccgccgcctcttcgtcgcctcaacctaacgttttattccgaaaaacgaaaaaaacgaacgaaactaacaataattttaacaataatttaaacccgcttttattattattaactttt

SEQ ID NO: 8989 - DNA, 718 bp, Artificial Sequence
  chemically treated genomic DNA (Homo sapiens) CpG-island No: 8989
acgggttttcgaaatgacgtattttcgcgcgtcgtaagttttgatgttaaggggttagtcgcgaggtaaaggaggggtttttgaagtgggcgtggcgtcgttggaggttatttaggcgcgggattcgttttcgaggcgggatatgaggtgcggggtggggtttttaatcgtgtagttcgtttttgacgtcgtcggtaattgcgatagtcggggtcggtgcggtttgttaagtggtcggtttttggagttgcggttttttgttagtttgattcgtagttttagttttcgtcgtttttttaggtttcggggtcgtttttgattcgtagtcgtcgcggggcgtagagttatgaggcgcgggtattcgtcgttttcggggcggtcgtttgtttcggagcgtttcgagttggcgcggtatgggcgcggtatgagcgtggagtcgtcgtcggagttggaggagaaggcggcgtcggagttcgaggcgggagtatgtcggagaagcgcgcgggcgtgttcgcgggggaggtatttgggtgagcggcgggtcgtggtttcgcggcgttggaatgtcggggtagcgtgggtggggtcgtatttaggttacgcgagttttcgtttcgggtaggggtttcggtttttggaaagtcggtttttttttgggggggaggcgaatttattacgaatataggttttttttagtgtacgtttatcgtagataaaa

SEQ ID NO: 8990 - DNA, 718 bp, Artificial Sequence
  chemically treated genomic DNA (Homo sapiens) CpG-island No: 8990
ttttatctacgataaacgtacactaaaaaaaacctatattcgtaataaattcgcctcccccccaaaaaaaaaccgactttccaaaaaccgaaacccctacccgaaacgaaaactcgcgtaacctaaatacgaccccacccacgctaccccgacattccaacgccgcgaaaccacgacccgccgctcacccaaatacctcccccgcgaacacgcccgcgcgcttctccgacatactcccgcctcgaactccgacgccgccttctcctccaactccgacgacgactccacgctcataccgcgcccataccgcgccaactcgaaacgctccgaaacaaacgaccgccccgaaaacgacgaatacccgcgcctcataactctacgccccgcgacgactacgaatcaaaaacgaccccgaaacctaaaaaaacgacgaaaactaaaactacgaatcaaactaacaaaaaaccgcaactccaaaaaccgaccacttaacaaaccgcaccgaccccgactatcgcaattaccgacgacgtcaaaaacgaactacacgattaaaaaccccaccccgcacctcatatcccgcctcgaaaacgaatcccgcgcctaaataacctccaacgacgccacgcccacttcaaaaacccctcctttacctcgcgactaaccccttaacatcaaaacttacgacgcgcgaaaatacgtcatttcgaaaacccgt

SEQ ID NO: 8991 - DNA, 718 bp, Artificial Sequence
  chemically treated genomic DNA (Homo sapiens) CpG-island No: 8991
ttttgtttgcgatgagcgtatattaggaaaaatttgtattcgtgatgaattcgttttttttttagaaaaggatcgattttttaagagtcgaagtttttgttcggagcgggggttcgcgtggtttgggtgcgattttatttacgttatttcggtattttagcgtcgcgggattacggttcgtcgtttatttaggtgtttttttcgcggatacgttcgcgcgttttttcggtatgttttcgtttcgggtttcgacgtcgtttttttttttagtttcggcggcggttttacgtttatgtcgcgtttatgtcgcgttagttcggggcgtttcgggatagacggtcgtttcggaggcggcgggtgttcgcgttttatggttttgcgtttcgcggcggttgcgggttaagggcggtttcgaggtttgaggaggcggcggaggttgaagttgcggattaggttagtagaagatcgtagttttaggaatcgattatttagtaaatcgtatcgatttcgattgtcgtagttatcggcggcgttaggggcgggttgtacggttggaggttttatttcgtattttatgtttcgtttcgagaacgagtttcgcgtttgagtagtttttagcgacgttacgtttattttagagattttttttttatttcgcgattggttttttggtattaggatttgcggcgcgcggaagtacgttatttcgagagttcgt

SEQ ID NO: 8992 - DNA, 718 bp, Artificial Sequence
  chemically treated genomic DNA (Homo sapiens) CpG-island No: 8992
acgaactctcgaaataacgtacttccgcgcgccgcaaatcctaataccaaaaaaccaatcgcgaaataaaaaaaaaatctctaaaataaacgtaacgtcgctaaaaactactcaaacgcgaaactcgttctcgaaacgaaacataaaatacgaaataaaacctccaaccgtacaacccgcccctaacgccgccgataactacgacaatcgaaatcgatacgatttactaaataatcgattcctaaaactacgatcttctactaacctaatccgcaacttcaacctccgccgcctcctcaaacctcgaaaccgcccttaacccgcaaccgccgcgaaacgcaaaaccataaaacgcgaacacccgccgcctccgaaacgaccgtctatcccgaaacgccccgaactaacgcgacataaacgcgacataaacgtaaaaccgccgccgaaactaaaaaaaaaaacgacgtcgaaacccgaaacgaaaacataccgaaaaaacgcgcgaacgtatccgcgaaaaaaacacctaaataaacgacgaaccgtaatcccgcgacgctaaaataccgaaataacgtaaataaaatcgcacccaaaccacgcgaacccccgctccgaacaaaaacttcgactcttaaaaaatcgatccttttctaaaaaaaaaacgaattcatcacgaatacaaatttttcctaatatacgctcatcgcaaacaaaa

SEQ ID NO: 8993 - DNA, 623 bp, Artificial Sequence
  chemically treated genomic DNA (Homo sapiens) CpG-island No: 8993
gagtgcggttgtaggcgtttcggtgttattgattttaaaagggagcgagaggggaggggatagaagaggggttgcgtggagaaagagttagaagtttttaaatgggcgtcgtcggatatttcgtttgtttcgagttcggttttcgggggttttcggtcggtaggtaattcgggtttttttgttattttaaagtagtcggcgatgtgtagaatcgtcgtatttttagttattttgtgtgtgtgttttcggcgtggatttggatgagtattcgggttgttaaggtgcggagttgtagcgttagggttttcgacgcgatttttaggtcggttttcgaatcgtagacggggcggaggagttcgcggtagtttgtgtagttttcggggagtttacggcggcgatttagttttaacgcgttagaagttaaataaaaagagaaaggaaataagtacgggtttatcggttggcgacgtacggtagttagaattcgcgttgtattttttttttttggtggaaagggtggggggcgtgtaaggggggggtgcgggagagggtagttatttacgttttaattgtagatggcgtttgaggtttttttaagatcgcgagttttttaaaaattaaat

SEQ ID NO: 8994 - DNA, 623 bp, Artificial Sequence
  chemically treated genomic DNA (Homo sapiens) CpG-island No: 8994
atttaatttttaaaaaactcgcgatcttaaaaaaacctcaaacgccatctacaattaaaacgtaaataactaccctctcccgcaccccccccttacacgccccccaccctttccaccaaaaaaaaaaaatacaacgcgaattctaactaccgtacgtcgccaaccgataaacccgtacttatttcctttctctttttatttaacttctaacgcgttaaaactaaatcgccgccgtaaactccccgaaaactacacaaactaccgcgaactcctccgccccgtctacgattcgaaaaccgacctaaaaatcgcgtcgaaaaccctaacgctacaactccgcaccttaacaacccgaatactcatccaaatccacgccgaaaacacacacacaaaataactaaaaatacgacgattctacacatcgccgactactttaaaataacaaaaaaacccgaattacctaccgaccgaaaacccccgaaaaccgaactcgaaacaaacgaaatatccgacgacgcccatttaaaaacttctaactctttctccacgcaacccctcttctatcccctcccctctcgctcccttttaaaatcaataacaccgaaacgcctacaaccgcactc

SEQ ID NO: 8995 - DNA, 623 bp, Artificial Sequence
  chemically treated genomic DNA (Homo sapiens) CpG-island No: 8995
gtttaatttttggagagttcgcgattttggaaaagttttagacgttatttatagttaaaacgtaggtaattgttttttttcgtattttttttttatacgttttttattttttttattaaaaaaagggggtgtagcgcggattttggttgtcgtgcgtcgttagtcggtagattcgtgtttgttttttttttttttttgtttggtttttaacgcgttgggattgagtcgtcgtcgtgagtttttcgaagattgtataaattatcgcgggttttttcgtttcgtttgcgattcggaagtcggtttgggggtcgcgtcgggagttttggcgttgtagtttcgtattttagtagttcgggtatttatttagatttacgtcggggatatatatatagagtaattaaaagtgcggcgattttgtatatcgtcgattgttttggggtaataaaaagattcgagttgtttgtcgatcgaggattttcgggagtcgggttcggagtagacgaggtattcggcggcgtttatttgggggtttttaattttttttttacgtagttttttttttgtttttttttttttcgtttttttttaaaattagtggtatcgaggcgtttgtagtcgtattt

SEQ ID NO: 8996 - DNA, 623 bp, Artificial Sequence
  chemically treated genomic DNA (Homo sapiens) CpG-island No: 8996
aaatacgactacaaacgcctcgataccactaattttaaaaaaaaacgaaaaaaaaaaaaacaaaaaaaaaactacgtaaaaaaaaaattaaaaacccccaaataaacgccgccgaatacctcgtctactccgaacccgactcccgaaaatcctcgatcgacaaacaactcgaatctttttattaccccaaaacaatcgacgatatacaaaatcgccgcacttttaattactctatatatatatccccgacgtaaatctaaataaatacccgaactactaaaatacgaaactacaacgccaaaactcccgacgcgacccccaaaccgacttccgaatcgcaaacgaaacgaaaaaacccgcgataatttatacaatcttcgaaaaactcacgacgacgactcaatcccaacgcgttaaaaaccaaacaaaaaaaaaaaaaaaacaaacacgaatctaccgactaacgacgcacgacaaccaaaatccgcgctacaccccctttttttaataaaaaaaataaaaaacgtataaaaaaaaaatacgaaaaaaaacaattacctacgttttaactataaataacgtctaaaacttttccaaaatcgcgaactctccaaaaattaaac

SEQ ID NO: 8997 - DNA, 638 bp, Artificial Sequence
  chemically treated genomic DNA (Homo sapiens) CpG-island No: 8997
cggtgttcgaggttaattttcgcgtttagtacgttcgtatttttcggcgaggcggtattaatagttatttacgtggtcggggatttcggagcgagcggggtcgtgagtgcgcgtgtgcgcgcgcgcgtttcgttcgcgttcggtttttttatttaatgttatcgatatatttttacggagttttcgtttttttttcgtcgttttcgcgattggtttagtttagagtcggtttcgtttcgttttcgttcgggttttttttattgcgtcgggcgtttattaattagtttcgtcgttgttagttttcgggcggtttttcgcgtcgttgttattgtagtttcgtgtcgggggcgttagtatcggtttcgtagttttttcgttcggtcggggaggtaaataaagtgaaatattttttcgcggttcggggtttcgggcgtagtattttgggtgtcggttgcgagtcggttgcgagtttagttgcgggcggttgggtcggggttattagtagcgattttcgagtcgttttttatacgttgttttcgtagcgttcgttttagtttttcgtagttcgtttatgtttttggcgtttttttttagaaagttaggtacgttttgagtattgggtttttaggtttagatgt

SEQ ID NO: 8998 - DNA, 638 bp, Artificial Sequence
  chemically treated genomic DNA (Homo sapiens) CpG-island No: 8998
acatctaaacctaaaaacccaatactcaaaacgtacctaactttctaaaaaaaaacgccaaaaacataaacgaactacgaaaaactaaaacgaacgctacgaaaacaacgtataaaaaacgactcgaaaatcgctactaataaccccgacccaaccgcccgcaactaaactcgcaaccgactcgcaaccgacacccaaaatactacgcccgaaaccccgaaccgcgaaaaaatatttcactttatttacctccccgaccgaacgaaaaaactacgaaaccgatactaacgcccccgacacgaaactacaataacaacgacgcgaaaaaccgcccgaaaactaacaacgacgaaactaattaataaacgcccgacgcaataaaaaaaacccgaacgaaaacgaaacgaaaccgactctaaactaaaccaatcgcgaaaacgacgaaaaaaaaacgaaaactccgtaaaaatatatcgataacattaaataaaaaaaccgaacgcgaacgaaacgcgcgcgcgcacacgcgcactcacgaccccgctcgctccgaaatccccgaccacgtaaataactattaataccgcctcgccgaaaaatacgaacgtactaaacgcgaaaattaacctcgaacaccg

SEQ ID NO: 8999 - DNA, 638 bp, Artificial Sequence
  chemically treated genomic DNA (Homo sapiens) CpG-island No: 8999
atatttgagtttgggggtttaatgtttagagcgtgtttggttttttggggaaaagcgttaggaatatgaacgagttacgaagagttggagcgggcgttgcgggagtagcgtgtggggaacggttcgggagtcgttgttggtaatttcggtttagtcgttcgtagttgggttcgtagtcggttcgtagtcgatatttagggtgttgcgttcggggtttcgggtcgcggaaggatattttattttgtttattttttcggtcgggcgagggagttgcgaggtcggtgttggcgttttcggtacggagttgtaatggtagcggcgcggggagtcgttcgaggattggtagcggcggggttgattgatgggcgttcggcgtaatgaggggggttcgggcgggggcggggcggggtcggttttgggttgagttagtcgcgggggcggcggggggggggcggaggtttcgtggaaatgtgtcggtgatattgaatggggagatcgagcgcgagcgaggcgcgcgcgcgtatacgcgtatttacggtttcgttcgtttcgagattttcggttacgtaagtaattattaatatcgtttcgtcgggggatgcgggcgtgttgagcgcggggattggtttcgggtatcg

SEQ ID NO: 9000 - DNA, 638 bp, Artificial Sequence
  chemically treated genomic DNA (Homo sapiens) CpG-island No: 9000
cgatacccgaaaccaatccccgcgctcaacacgcccgcatcccccgacgaaacgatattaataattacttacgtaaccgaaaatctcgaaacgaacgaaaccgtaaatacgcgtatacgcgcgcgcgcctcgctcgcgctcgatctccccattcaatatcaccgacacatttccacgaaacctccgccccccccccgccgcccccgcgactaactcaacccaaaaccgaccccgccccgcccccgcccgaacccccctcattacgccgaacgcccatcaatcaaccccgccgctaccaatcctcgaacgactccccgcgccgctaccattacaactccgtaccgaaaacgccaacaccgacctcgcaactccctcgcccgaccgaaaaaataaacaaaataaaatatccttccgcgacccgaaaccccgaacgcaacaccctaaatatcgactacgaaccgactacgaacccaactacgaacgactaaaccgaaattaccaacaacgactcccgaaccgttccccacacgctactcccgcaacgcccgctccaactcttcgtaactcgttcatattcctaacgcttttccccaaaaaaccaaacacgctctaaacattaaacccccaaactcaaatat

SEQ ID NO: 9001 - DNA, 1026 bp, Artificial Sequence
  chemically treated genomic DNA (Homo sapiens) CpG-island No: 9001
taaggaggagtgtggggaggcggagttggggaagagttgtgaggggttggttgggggttcgggtcgcggcggggtcgggcgggtaggggcggtttagttgtgcgagtagaagttatagtagtcgttaatgtttttggcgtagtttttttcgtagtttcgttgggttagtatttcgtttttgagcggggacgaattttcggatacgggcgtgtcggtcggcgagattcgttttcgtttggtttgttcgtaaattttcgagtcgttggagtcgatggatttgatcgaggagggcgtttcgatttagttggaatcggataggtttttgggtttggcgttttcggcggcgcgggcggtagcggcgagcgttcggcggttaggttttcggttttttcgtttaggtagggattggcgtcggttatgcgcgcggcggtcgcggcgttgttgggttagtagggagtatcgagttcgatttggtgtcgtagtattgcgggggattgcgggcgttttagttcgacgggtcggcgtagtagtcgagcgggcggttagtgtagtttgtagtttgtagcgtagcgtttttacgttcgtcgtcgcgtaagagagtagcgtggtcgcgttgttcgcgaagttcgtggtcgtgttataggtcgaggtcgcgaagtttagtcggttgttggtcggcgttataaattagcgttgcggcgaggcgcgttcgggttttcggtttgttgcggcgatagtagttcgttggtgtgcggtacgttgcggttcgtattcggttcgggttcgcgtcgcgttcgggtggaagcgggttttggcgtagttgtttacgaattggttttgtaggaaagagtcggttatggcgtagcgggtttcgggtacgatttgcgagcgcggcgagtcgttgggcgagggggttaggcggtttatgttatagtcggtgtagattttgcggggtagggagagagagagagagagtcgaggggtggcgcggaggttttttggggtgggggtgggggtagaagggaa

SEQ ID NO: 9002 - DNA, 1026 bp, Artificial Sequence
  chemically treated genomic DNA (Homo sapiens) CpG-island No: 9002
ttcccttctacccccacccccaccccaaaaaacctccgcgccacccctcgactctctctctctctctccctaccccgcaaaatctacaccgactataacataaaccgcctaaccccctcgcccaacgactcgccgcgctcgcaaatcgtacccgaaacccgctacgccataaccgactctttcctacaaaaccaattcgtaaacaactacgccaaaacccgcttccacccgaacgcgacgcgaacccgaaccgaatacgaaccgcaacgtaccgcacaccaacgaactactatcgccgcaacaaaccgaaaacccgaacgcgcctcgccgcaacgctaatttataacgccgaccaacaaccgactaaacttcgcgacctcgacctataacacgaccacgaacttcgcgaacaacgcgaccacgctactctcttacgcgacgacgaacgtaaaaacgctacgctacaaactacaaactacactaaccgcccgctcgactactacgccgacccgtcgaactaaaacgcccgcaatcccccgcaatactacgacaccaaatcgaactcgatactccctactaacccaacaacgccgcgaccgccgcgcgcataaccgacgccaatccctacctaaacgaaaaaaccgaaaacctaaccgccgaacgctcgccgctaccgcccgcgccgccgaaaacgccaaacccaaaaacctatccgattccaactaaatcgaaacgccctcctcgatcaaatccatcgactccaacgactcgaaaatttacgaacaaaccaaacgaaaacgaatctcgccgaccgacacgcccgtatccgaaaattcgtccccgctcaaaaacgaaatactaacccaacgaaactacgaaaaaaactacgccaaaaacattaacgactactataacttctactcgcacaactaaaccgcccctacccgcccgaccccgccgcgacccgaacccccaaccaacccctcacaactcttccccaactccgcctccccacactcctcctta

SEQ ID NO: 9003 - DNA, 1026 bp, Artificial Sequence
  chemically treated genomic DNA (Homo sapiens) CpG-island No: 9003
tttttttttgtttttatttttattttaagggattttcgcgttatttttcggttttttttttttttttttttatttcgtaggatttatatcggttgtgatatggatcgtttgattttttcgtttaacgattcgtcgcgttcgtagatcgtgttcggggttcgttacgttatggtcggtttttttttgtaggattagttcgtgagtaattacgttaaggttcgtttttattcgggcgcggcgcgggttcgggtcgggtacggatcgtagcgtgtcgtatattaacgggttgttgtcgtcgtagtaggtcgaggattcgggcgcgtttcgtcgtaacgttggtttgtgacgtcggttaataatcggttggatttcgcggtttcggtttatgatacggttacggatttcgcgggtaacgcggttacgttgtttttttacgcggcggcgggcgtgaaggcgttgcgttgtaggttgtaggttgtattggtcgttcgttcggttattacgtcgattcgtcgggttggggcgttcgtagtttttcgtagtattgcggtattaagtcgggttcggtgttttttgttggtttaatagcgtcgcggtcgtcgcgcgtatggtcggcgttaatttttatttgggcgaggaggtcgagggtttggtcgtcgagcgttcgtcgttgtcgttcgcgtcgtcgaggacgttaagtttaaggatttgttcgattttagttggatcgagacgtttttttcgattaagtttatcgattttagcgattcggggatttacgagtaggttaagcggaggcggatttcgtcggtcgatacgttcgtgttcgagagttcgttttcgtttaagagcgaggtgttggtttagcgggattgcgagaagaattgcgttaaggatattagcggttattatggtttttattcgtatagttaggtcgtttttgttcgttcggtttcgtcgcggttcggatttttagttagttttttatagtttttttttagtttcgtttttttatatttttttttg

SEQ ID NO: 9004 - DNA, 1026 bp, Artificial Sequence
  chemically treated genomic DNA (Homo sapiens) CpG-island No: 9004
caaaaaaaaatataaaaaaacgaaactaaaaaaaaactataaaaaactaactaaaaatccgaaccgcgacgaaaccgaacgaacaaaaacgacctaactatacgaataaaaaccataataaccgctaatatccttaacgcaattcttctcgcaatcccgctaaaccaacacctcgctcttaaacgaaaacgaactctcgaacacgaacgtatcgaccgacgaaatccgcctccgcttaacctactcgtaaatccccgaatcgctaaaatcgataaacttaatcgaaaaaaacgtctcgatccaactaaaatcgaacaaatccttaaacttaacgtcctcgacgacgcgaacgacaacgacgaacgctcgacgaccaaaccctcgacctcctcgcccaaataaaaattaacgccgaccatacgcgcgacgaccgcgacgctattaaaccaacaaaaaacaccgaacccgacttaataccgcaatactacgaaaaactacgaacgccccaacccgacgaatcgacgtaataaccgaacgaacgaccaatacaacctacaacctacaacgcaacgccttcacgcccgccgccgcgtaaaaaaacaacgtaaccgcgttacccgcgaaatccgtaaccgtatcataaaccgaaaccgcgaaatccaaccgattattaaccgacgtcacaaaccaacgttacgacgaaacgcgcccgaatcctcgacctactacgacgacaacaacccgttaatatacgacacgctacgatccgtacccgacccgaacccgcgccgcgcccgaataaaaacgaaccttaacgtaattactcacgaactaatcctacaaaaaaaaaccgaccataacgtaacgaaccccgaacacgatctacgaacgcgacgaatcgttaaacgaaaaaatcaaacgatccatatcacaaccgatataaatcctacgaaataaaaaaaaaaaaaaaaaaaaccgaaaaataacgcgaaaatcccttaaaataaaaataaaaacaaaaaaaaa

SEQ ID NO: 9005 - DNA, 742 bp, Artificial Sequence
  chemically treated genomic DNA (Homo sapiens) CpG-island No: 9005
tatcgttacggcgtatatttgggcggtttcggggttttttattcgtcgttttttttttttttttaaatttttttttaatttttcgatttgttttattcggtgttttttttcgttttttttatgaattatttagtagcgtgacgtttaattagcgcgttcggggtttattcgcggagttttcgcgttgggagagttgttttcgtttttcgcgcgtttttttttttcgggttcggcgtcgttcgtttagttttagcgtagtttagtttttgttcggttcggttcgttcggtttcgcgtcgtagtttttttttttttcgtttcgttttcgttcgggtttttattattttcgttcgcgaggagagtattcggttcggcggcgcgagtagagttattttagggagggggggagatcgcgagcggtcggtttagttttcgttattcggggcggatttcgaggttcggagggattttaattttagttacgttttgttgcgcgttcgttcggcgttattgttagtacgtttcgggttcgtcgttcgcgcgcggtatagacgcggggttatatttggcgtcgtcgttcgtgtttcgtacgttcgtatgggttcgcgttgagggtttcgacgaggagtttcgcgcggagtatcggcgtttattcgtttagggagagttagatttgggggggcgagggttttttaaatttagttcggattttattcgagtgaggcggcgttatggagtttcgg

SEQ ID NO: 9006 - DNA, 742 bp, Artificial Sequence
  chemically treated genomic DNA (Homo sapiens) CpG-island No: 9006
ccgaaactccataacgccgcctcactcgaataaaatccgaactaaatttaaaaaaccctcgcccccccaaatctaactctccctaaacgaataaacgccgatactccgcgcgaaactcctcgtcgaaaccctcaacgcgaacccatacgaacgtacgaaacacgaacgacgacgccaaatataaccccgcgtctataccgcgcgcgaacgacgaacccgaaacgtactaacaataacgccgaacgaacgcgcaacaaaacgtaactaaaattaaaatccctccgaacctcgaaatccgccccgaataacgaaaactaaaccgaccgctcgcgatctccccccctccctaaaataactctactcgcgccgccgaaccgaatactctcctcgcgaacgaaaataataaaaacccgaacgaaaacgaaacgaaaaaaaaaaaaactacgacgcgaaaccgaacgaaccgaaccgaacaaaaactaaactacgctaaaactaaacgaacgacgccgaacccgaaaaaaaaaaacgcgcgaaaaacgaaaacaactctcccaacgcgaaaactccgcgaataaaccccgaacgcgctaattaaacgtcacgctactaaataattcataaaaaaaacgaaaaaaaacaccgaataaaacaaatcgaaaaattaaaaaaaaatttaaaaaaaaaaaaaaaacgacgaataaaaaaccccgaaaccgcccaaatatacgccgtaacgata

SEQ ID NO: 9007 - DNA, 742 bp, Artificial Sequence
  chemically treated genomic DNA (Homo sapiens) CpG-island No: 9007
tcggagttttatggcgtcgttttattcgggtaggattcgaattgagtttggggggttttcgtttttttaggtttgattttttttgggcgggtggacgtcgatatttcgcgcgggatttttcgtcggggtttttagcgcgggtttatgcgagcgtgcggggtacgggcggcggcgttaagtgtggtttcgcgtttgtgtcgcgcgcgggcggcgggttcggagcgtgttggtagtggcgtcgggcgggcgcgtagtaagacgtggttggagttggggttttttcgggtttcggggttcgtttcgggtggcgggggttgagtcggtcgttcgcggtttttttttttttttggagtggttttgttcgcgtcgtcgggtcgagtgtttttttcgcgggcggggatggtgggagttcgagcggggacggagcgggagggagggagattgcggcgcggagtcgggcgggtcgggtcgggtaggggttgagttgcgttggaattgggcgggcggcgtcgggttcgggagggaggggcgcgcggggggcgggggtagtttttttaacgcgggggtttcgcgagtgagtttcgggcgcgttgattggacgttacgttattgaataatttatgagggaagcggagaggggtatcgagtggagtaggtcgggaagttgagagaaagtttggagaagggggaggggcggcgggtgaggaatttcgggatcgtttagatgtgcgtcgtggcggtg

SEQ ID NO: 9008 - DNA, 742 bp, Artificial Sequence
  chemically treated genomic DNA (Homo sapiens) CpG-island No: 9008
caccgccacgacgcacatctaaacgatcccgaaattcctcacccgccgcccctcccccttctccaaactttctctcaacttcccgacctactccactcgatacccctctccgcttccctcataaattattcaataacgtaacgtccaatcaacgcgcccgaaactcactcgcgaaacccccgcgttaaaaaaactacccccgccccccgcgcgcccctccctcccgaacccgacgccgcccgcccaattccaacgcaactcaacccctacccgacccgacccgcccgactccgcgccgcaatctccctccctcccgctccgtccccgctcgaactcccaccatccccgcccgcgaaaaaaacactcgacccgacgacgcgaacaaaaccactccaaaaaaaaaaaaaaaccgcgaacgaccgactcaacccccgccacccgaaacgaaccccgaaacccgaaaaaaccccaactccaaccacgtcttactacgcgcccgcccgacgccactaccaacacgctccgaacccgccgcccgcgcgcgacacaaacgcgaaaccacacttaacgccgccgcccgtaccccgcacgctcgcataaacccgcgctaaaaaccccgacgaaaaatcccgcgcgaaatatcgacgtccacccgcccaaaaaaaatcaaacctaaaaaaacgaaaaccccccaaactcaattcgaatcctacccgaataaaacgacgccataaaactccga

SEQ ID NO: 9009 - DNA, 730 bp, Artificial Sequence
  chemically treated genomic DNA (Homo sapiens) CpG-island No: 9009
tttttatacgttatattaattatatatatttatatatattacgtattcgtattatatagtaataatagtttattttatttatatataacgataattgttcgaatcgggtatttattttttttattaatataaataatataggaacgtttattatcgagagttatatatattatatatacgtttttaatcgttatttatttatagtataacgtacgataaattattttattattattatataattattagttcgtattatttaagtttttatttgtttatcggtttcggttcgtagtatagttatcggtaggatcgatttcgtacgatcggggacgcgtcgagttcgcgagttagagaagcgtcggagttagcggcgggcgttagcgaggatttttttcgtttttttttcgaggtcgtcgtagttcggtgcgttttttcgttttttcgttagtttcggtttattatcgtcgtcgggatttttttttagagtaggttacgtatcggggaggtttcgggaggtcggcgttcggtatttaggcgatcgttcgtttttttcgtatttggcgtttttttttgaagggtagtcgttttttcgggtcggcgcgttgttttttattttcgcgtttttaacggtcgttttcgggtttttgttaagttttgttttgggtcgtttggggttttcgattttagcgttttagggtggtcgggtttcgcgtttttcggagttttt

SEQ ID NO: 9010 - DNA, 730 bp, Artificial Sequence
  chemically treated genomic DNA (Homo sapiens) CpG-island No: 9010
aaaaactccgaaaaacgcgaaacccgaccaccctaaaacgctaaaatcgaaaaccccaaacgacccaaaacaaaacttaacaaaaacccgaaaacgaccgttaaaaacgcgaaaataaaaaacaacgcgccgacccgaaaaaacgactacccttcaaaaaaaaacgccaaatacgaaaaaaacgaacgatcgcctaaataccgaacgccgacctcccgaaacctccccgatacgtaacctactctaaaaaaaaatcccgacgacgataataaaccgaaactaacgaaaaaacgaaaaaacgcaccgaactacgacgacctcgaaaaaaaaacgaaaaaaatcctcgctaacgcccgccgctaactccgacgcttctctaactcgcgaactcgacgcgtccccgatcgtacgaaatcgatcctaccgataactatactacgaaccgaaaccgataaacaaataaaaacttaaataatacgaactaataattatataataataataaaataatttatcgtacgttatactataaataaataacgattaaaaacgtatatataatatatataactctcgataataaacgttcctatattatttatattaataaaaaaaataaatacccgattcgaacaattatcgttatatataaataaaataaactattattactatataatacgaatacgtaatatatataaatatatataattaatataacgtataaaaa

SEQ ID NO: 9011 - DNA, 730 bp, Artificial Sequence
  chemically treated genomic DNA (Homo sapiens) CpG-island No: 9011
gagaatttcgggaagcgcggggttcggttattttaggacgttagggtcgggggttttaggcggtttagggtagggtttggtaggggttcgggggcgatcgttaggagcgcgggggtggaaggtagcgcgtcggttcgggaggacggttgttttttagggaggggcgttaggtgcgaggggggcgagcggtcgtttgaatgtcgggcgtcggtttttcggggttttttcgatgcgtggtttgttttgggggagggtttcggcggcggtgatgggtcggagttggcgggagagcgggaggacgtatcgggttgcggcggtttcggggaggagacgggggaggttttcgttggcgttcgtcgttggtttcggcgtttttttagttcgcgggttcggcgcgttttcggtcgtacggggtcggttttgtcggtggttgtgttgcgggtcggggtcgatgggtaggtgggggtttaggtggtgcgggttagtggttgtgtggtggtggtgaggtggtttgtcgtgcgttgtgttgtgagtggatggcggttgagagcgtgtgtatggtgtgtgtggttttcggtggtgggcgtttttgtgttgtttgtgttggtaggaagagtgggtgttcggttcgagtagttgtcgttgtgtgtgggtggggtgggttgttgttgttatgtggtgcgggtgcgtggtgtgtgtaggtgtgtgtgattggtgtgacgtgtgagga

SEQ ID NO: 9012 - DNA, 730 bp, Artificial Sequence
  chemically treated genomic DNA (Homo sapiens) CpG-island No: 9012
tcctcacacgtcacaccaatcacacacacctacacacaccacgcacccgcaccacataacaacaacaacccaccccacccacacacaacgacaactactcgaaccgaacacccactcttcctaccaacacaaacaacacaaaaacgcccaccaccgaaaaccacacacaccatacacacgctctcaaccgccatccactcacaacacaacgcacgacaaaccacctcaccaccaccacacaaccactaacccgcaccacctaaacccccacctacccatcgaccccgacccgcaacacaaccaccgacaaaaccgaccccgtacgaccgaaaacgcgccgaacccgcgaactaaaaaaacgccgaaaccaacgacgaacgccaacgaaaacctcccccgtctcctccccgaaaccgccgcaacccgatacgtcctcccgctctcccgccaactccgacccatcaccgccgccgaaaccctcccccaaaacaaaccacgcatcgaaaaaaccccgaaaaaccgacgcccgacattcaaacgaccgctcgcccccctcgcacctaacgcccctccctaaaaaacaaccgtcctcccgaaccgacgcgctaccttccacccccgcgctcctaacgatcgcccccgaacccctaccaaaccctaccctaaaccgcctaaaacccccgaccctaacgtcctaaaataaccgaaccccgcgcttcccgaaattctc

SEQ ID NO: 9013 - DNA, 606 bp, Artificial Sequence
  chemically treated genomic DNA (Homo sapiens) CpG-island No: 9013
gagatcgtttttaatcggttatttggatcgtagttttgttttttaatacgtgaattttgcggtcgttttttcgtttgttttaacgtagtttaggggtatcgcgttttttttcgttttcgtcggtttatttggcgggtgggtagggtagggtggcgggaagcggcggtcgggtaggcgttggacgtgggttaggcgttaggtgtaggtggcggcggttgcgatttcggttgtgtcgttatagttgcggtttagtagagtttttttttcgtcgtcgttttttgtttttcgttgggtttttcgcgttgtttggagaggtagaatcgaggttcggtttttatttggagttttttaggtgagttttagtttgcgacgtcggtagggcgaggttttatttttcggttgcgcgttagtttttcgtttcgttttagttttatttgagcgttttaggtgagaattttggatcgcgcgcgtagggtgggggcgtcgttcggttaagtttgcgtgatgcgcggtttttttttgagtggtcggcgaggttgtttttcgcgtaagttgtgttttcggtttatttatattggaggaattttgtattgatttggtggtagt

SEQ ID NO: 9014 - DNA, 606 bp, Artificial Sequence
  chemically treated genomic DNA (Homo sapiens) CpG-island No: 9014
actaccaccaaatcaatacaaaattcctccaatataaataaaccgaaaacacaacttacgcgaaaaacaacctcgccgaccactcaaaaaaaaaccgcgcatcacgcaaacttaaccgaacgacgcccccaccctacgcgcgcgatccaaaattctcacctaaaacgctcaaataaaactaaaacgaaacgaaaaactaacgcgcaaccgaaaaataaaacctcgccctaccgacgtcgcaaactaaaactcacctaaaaaactccaaataaaaaccgaacctcgattctacctctccaaacaacgcgaaaaacccaacgaaaaacaaaaaacgacgacgaaaaaaaaactctactaaaccgcaactataacgacacaaccgaaatcgcaaccgccgccacctacacctaacgcctaacccacgtccaacgcctacccgaccgccgcttcccgccaccctaccctacccacccgccaaataaaccgacgaaaacgaaaaaaaacgcgatacccctaaactacgttaaaacaaacgaaaaaacgaccgcaaaattcacgtattaaaaaacaaaactacgatccaaataaccgattaaaaacgatctc

SEQ ID NO: 9015 - DNA, 606 bp, Artificial Sequence
  chemically treated genomic DNA (Homo sapiens) CpG-island No: 9015
attgttattaggttagtgtaggatttttttaatgtagatgggtcgggagtataatttgcgcggagagtagtttcgtcgattatttagagagaagtcgcgtattacgtaggtttggtcggacggcgtttttattttgcgcgcgcgatttaaggtttttatttggagcgtttaggtagggttggggcggggcgggaggttggcgcgtagtcggaaagtggggtttcgttttgtcgacgtcgtaggttggagtttatttgggagattttaagtggaagtcgagtttcggttttgtttttttaggtaacgcgggaggtttagcggaaggtaggaggcggcggcggaggaggagttttattgagtcgtaattgtggcgatataatcggagtcgtagtcgtcgttatttgtatttggcgtttagtttacgtttagcgtttgttcggtcgtcgtttttcgttattttgttttgtttattcgttaggtaagtcggcggaggcggagggagacgcggtatttttgggttgcgttagagtaggcgggaggacggtcgtagggtttacgtgttgggggatagggttacggtttaggtggtcggttggagacggtttt

SEQ ID NO: 9016 - DNA, 606 bp, Artificial Sequence
  chemically treated genomic DNA (Homo sapiens) CpG-island No: 9016
aaaaccgtctccaaccgaccacctaaaccgtaaccctatcccccaacacgtaaaccctacgaccgtcctcccgcctactctaacgcaacccaaaaataccgcgtctccctccgcctccgccgacttacctaacgaataaacaaaacaaaataacgaaaaacgacgaccgaacaaacgctaaacgtaaactaaacgccaaatacaaataacgacgactacgactccgattatatcgccacaattacgactcaataaaactcctcctccgccgccgcctcctaccttccgctaaacctcccgcgttacctaaaaaaacaaaaccgaaactcgacttccacttaaaatctcccaaataaactccaacctacgacgtcgacaaaacgaaaccccactttccgactacgcgccaacctcccgccccgccccaaccctacctaaacgctccaaataaaaaccttaaatcgcgcgcgcaaaataaaaacgccgtccgaccaaacctacgtaatacgcgacttctctctaaataatcgacgaaactactctccgcgcaaattatactcccgacccatctacattaaaaaaatcctacactaacctaataacaat

SEQ ID NO: 9017 - DNA, 581 bp, Artificial Sequence
  chemically treated genomic DNA (Homo sapiens) CpG-island No: 9017
agtcggtggaaatagtagcggagaaattgcgttcgggtaagcgggggatttcggagttgttgcgtggaggcgttcgtttcgtcgttttttcgtttttcgtcgttgtttattttcgtcggtcggtgcggttttttgttgtggtggtcggaaggttggggtggttttcggggtttcgagtggagtttgggggaggaggatacggagatgtgtcgttttgggtgggaggtggggggtgcggttttaggagaacgtaaattttatttttagaagtcggtgcgggatttcgttggagtagggtcgtgggttgtgttttcggtcgggtaggcgttgtcgtcgcgagttcgtcgtttttgtgtcggtcgttttggtttcgcgtttttttttttttttttttcggtttttagcgtttaggtcgtcgttaatagttttgttttttaaaaaataatttttgttagcgttgcgatggtcgtttttatttcggaatattcgttgtttttttattttttgtcggggtagtttttggattattttttattttcgttcgttttttgttgtttttttttgttttcgttttttttttt

SEQ ID NO: 9018 - DNA, 581 bp, Artificial Sequence
  chemically treated genomic DNA (Homo sapiens) CpG-island No: 9018
aaaaaaaaaaacgaaaacaaaaaaaaacaacaaaaaacgaacgaaaataaaaaataatccaaaaactaccccgacaaaaaataaaaaaacaacgaatattccgaaataaaaacgaccatcgcaacgctaacaaaaattattttttaaaaaacaaaactattaacgacgacctaaacgctaaaaaccgaaaaaaaaaaaaaaaaaaacgcgaaaccaaaacgaccgacacaaaaacgacgaactcgcgacgacaacgcctacccgaccgaaaacacaacccacgaccctactccaacgaaatcccgcaccgacttctaaaaataaaatttacgttctcctaaaaccgcaccccccacctcccacccaaaacgacacatctccgtatcctcctcccccaaactccactcgaaaccccgaaaaccaccccaaccttccgaccaccacaacaaaaaaccgcaccgaccgacgaaaataaacaacgacgaaaaacgaaaaaacgacgaaacgaacgcctccacgcaacaactccgaaatcccccgcttacccgaacgcaatttctccgctactatttccaccgact

SEQ ID NO: 9019 - DNA, 581 bp, Artificial Sequence
  chemically treated genomic DNA (Homo sapiens) CpG-island No: 9019
ggaagagggggcggaggtaaaaaagggtagtaggaggcggacgggggtggggggtgatttagaaattatttcggtagggagtgggggagtagcggatatttcggggtaggaacggttatcgtaacgttgatagaggttgttttttaagaagtaaaattgttggcggcgatttgagcgttggaagtcgaaggggaagaggaaggagacgcgaagttagggcggtcggtataaaggcggcggattcgcggcggtagcgtttgttcggtcgggagtataatttacggttttattttagcgaagtttcgtatcggtttttaggaataaagtttacgtttttttgaggtcgtattttttattttttatttaggacggtatattttcgtgttttttttttttaaattttattcgggatttcgagaattattttagtttttcggttattataataaagagtcgtatcgatcggcgaggataaatagcggcggagggcgagagggcggcggggcgagcgtttttacgtagtaatttcggagtttttcgtttgttcgagcgtagttttttcgttgttgtttttatcggtt

SEQ ID NO: 9020 - DNA, 581 bp, Artificial Sequence
  chemically treated genomic DNA (Homo sapiens) CpG-island No: 9020
aaccgataaaaacaacaacgaaaaaactacgctcgaacaaacgaaaaactccgaaattactacgtaaaaacgctcgccccgccgccctctcgccctccgccgctatttatcctcgccgatcgatacgactctttattataataaccgaaaaactaaaataattctcgaaatcccgaataaaatttaaaaaaaaaaaacacgaaaatataccgtcctaaataaaaaataaaaaatacgacctcaaaaaaacgtaaactttattcctaaaaaccgatacgaaacttcgctaaaataaaaccgtaaattatactcccgaccgaacaaacgctaccgccgcgaatccgccgcctttataccgaccgccctaacttcgcgtctccttcctcttccccttcgacttccaacgctcaaatcgccgccaacaattttacttcttaaaaaacaacctctatcaacgttacgataaccgttcctaccccgaaatatccgctactcccccactccctaccgaaataatttctaaatcaccccccacccccgtccgcctcctactacccttttttacctccgccccctcttcc

SEQ ID NO: 9021 - DNA, 749 bp, Artificial Sequence
  chemically treated genomic DNA (Homo sapiens) CpG-island No: 9021
  misc_feature (197)..(197): n is either a, c, g or t
tcggtttttatttaggtcgaggtggttcggttttatgtatcgcgacgtaacgcgggggaggtagataaggtataggggcggcgtttataatttatgtttatttcgttttatgtgttcgtcgaggcggtataaatcgtcgtgacgattagcggtttaatgatcgaagttaggttggtaagagtcgcgagcgattttgnaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatgatgaattattg

SEQ ID NO: 9022 - DNA, 749 bp, Artificial Sequence
  chemically treated genomic DNA (Homo sapiens) CpG-island No: 9022
  misc_feature (553)..(553): n is either a, c, g or t
caataattcatcatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttncaaaatcgctcgcgactcttaccaacctaacttcgatcattaaaccgctaatcgtcacgacgatttataccgcctcgacgaacacataaaacgaaataaacataaattataaacgccgcccctataccttatctacctcccccgcgttacgtcgcgatacataaaaccgaaccacctcgacctaaataaaaaccga

SEQ ID NO: 9023 - DNA, 749 bp, Artificial Sequence
  chemically treated genomic DNA (Homo sapiens) CpG-island No: 9023
  misc_feature (553)..(553): n is either a, c, g or t
tagtagtttattatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagtttntaggatcgttcgcggtttttattagtttaatttcgattattggatcgttgatcgttacggcgatttatgtcgtttcggcgagtatatggaacggggtgggtatggattgtaggcgtcgtttttatattttgtttgtttttttcgcgttgcgtcgcggtgtatggagtcgggttatttcgatttgaatggaagtcgg

SEQ ID NO: 9024 - DNA, 749 bp, Artificial Sequence
  chemically treated genomic DNA (Homo sapiens) CpG-island No: 9024
  misc_feature (197)..(197): n is either a, c, g or t
ccgacttccattcaaatcgaaataacccgactccatacaccgcgacgcaacgcgaaaaaaacaaacaaaatataaaaacgacgcctacaatccatacccaccccgttccatatactcgccgaaacgacataaatcgccgtaacgatcaacgatccaataatcgaaattaaactaataaaaaccgcgaacgatcctanaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataataaactacta

SEQ ID NO: 9025 - DNA, 902 bp, Artificial Sequence
  chemically treated genomic DNA (Homo sapiens) CpG-island No: 9025
cgtcgttttttttttcgcgcgggtttaggagttagttttcgcgggtttcgtcggcgttgatgaagtttagtattagtcgtaggttcggcgcgttgaggtcgcgtagttgttgtattttcgggtcgtcggttttttggtttagggtttcgcgtatgtcggagcggtagagggcgcggaagtagtcgttttgttcgatgagtttttttttgtttatcgggtagtagcggttttttaggcggatttgtattattttttcggtcgatatggttgggggtttcggggcggtagcgtttatcgttagatttgcgcgtcggttttttagtttttacgcgcgcgtcggtttcgggcggggcgtcgagggatggcggttcgggaggagcggcgaggtgagggtcgttcgcgttcgttcggttttttcggcggttttttttttcggggttcgttttcgcgaggcggcggttttgtttttttttttttttttagcgttaaaaaagggtcggcggagcgcggcgggcgttttcgcgcgggttttttcgggcggcgttaggcgggaagggaattttagtttttagttagtagttttttttttcgtcgttttttttattttcgttcgcgggattttagtcgtcggtttgatttgtcggttggattcggttttcggggaggttcgggaagttgcgggttcgggcgtttcggttgcggacgcgtagttgcgggaggcggagggcgcgcgttttcgtagttttttcgttcgttcggggcgcgtcggtttcgtcgtttgttgggggttgtagtgatgtttcggggtattttagggagaagaaattcgtttttttttttacgttgttttatacgggttaaagaaaaagaaatgagcgtgggaggaaagggaaggatggagt

SEQ ID NO: 9026 - DNA, 902 bp, Artificial Sequence
  chemically treated genomic DNA (Homo sapiens) CpG-island No: 9026
actccatccttccctttcctcccacgctcatttctttttctttaacccgtataaaacaacgtaaaaaaaaaaacgaatttcttctccctaaaataccccgaaacatcactacaacccccaacaaacgacgaaaccgacgcgccccgaacgaacgaaaaaactacgaaaacgcgcgccctccgcctcccgcaactacgcgtccgcaaccgaaacgcccgaacccgcaacttcccgaacctccccgaaaaccgaatccaaccgacaaatcaaaccgacgactaaaatcccgcgaacgaaaataaaaaaaacgacgaaaaaaaaaactactaactaaaaactaaaattcccttcccgcctaacgccgcccgaaaaaacccgcgcgaaaacgcccgccgcgctccgccgacccttttttaacgctaaaaaaaaaaaaaaaaacaaaaccgccgcctcgcgaaaacgaaccccgaaaaaaaaaaccgccgaaaaaaccgaacgaacgcgaacgaccctcacctcgccgctcctcccgaaccgccatccctcgacgccccgcccgaaaccgacgcgcgcgtaaaaactaaaaaaccgacgcgcaaatctaacgataaacgctaccgccccgaaacccccaaccatatcgaccgaaaaaataatacaaatccgcctaaaaaaccgctactacccgataaacaaaaaaaaactcatcgaacaaaacgactacttccgcgccctctaccgctccgacatacgcgaaaccctaaaccaaaaaaccgacgacccgaaaatacaacaactacgcgacctcaacgcgccgaacctacgactaatactaaacttcatcaacgccgacgaaacccgcgaaaactaactcctaaacccgcgcgaaaaaaaaaacgacg

SEQ ID NO: 9027 - DNA, 902 bp, Artificial Sequence
  chemically treated genomic DNA (Homo sapiens) CpG-island No: 9027
attttatttttttttttttttttacgtttatttttttttttttagttcgtgtaaagtagcgtgggagagaaaacgaattttttttttttggggtatttcggagtattattgtagtttttaataagcggcggagtcggcgcgtttcgggcgggcggagaggttgcggggacgcgcgtttttcgtttttcgtagttgcgcgttcgtagtcgaggcgttcgggttcgtagtttttcgggttttttcgagagtcggatttagtcggtaggttaggtcggcggttggggtttcgcgggcggaagtgagaagggcggcgggggaggaggttgttggttgggagttggaatttttttttcgtttggcgtcgttcgggagagttcgcgcgaggacgttcgtcgcgtttcgtcggtttttttttggcgttgagggaaaggagaagggtagggtcgtcgtttcgcgggagcgggtttcgggaggaggggtcgtcggagaggtcgggcgagcgcgggcggtttttatttcgtcgtttttttcgggtcgttatttttcggcgtttcgttcggaatcggcgcgcgcgtaggggttgggaggtcggcgcgtagatttggcggtgagcgttgtcgtttcggggtttttagttatgtcggtcgaggagatggtgtagattcgtttggaggatcgttgttattcggtgagtaagaggaagtttatcgagtagagcgattattttcgcgttttttatcgtttcggtatgcgcgaggttttgagttaggaggtcggcggttcggaggtgtagtagttgcgcggttttagcgcgtcgggtttgcggttggtgttggattttattaacgtcggcggggttcgcgaaggttggtttttgggttcgcgcggggaaaagggcggcg

SEQ ID NO: 9028 - DNA, 902 bp, Artificial Sequence
  chemically treated genomic DNA (Homo sapiens) CpG-island No: 9028
cgccgcccttttccccgcgcgaacccaaaaaccaaccttcgcgaaccccgccgacgttaataaaatccaacaccaaccgcaaacccgacgcgctaaaaccgcgcaactactacacctccgaaccgccgacctcctaactcaaaacctcgcgcataccgaaacgataaaaaacgcgaaaataatcgctctactcgataaacttcctcttactcaccgaataacaacgatcctccaaacgaatctacaccatctcctcgaccgacataactaaaaaccccgaaacgacaacgctcaccgccaaatctacgcgccgacctcccaacccctacgcgcgcgccgattccgaacgaaacgccgaaaaataacgacccgaaaaaaacgacgaaataaaaaccgcccgcgctcgcccgacctctccgacgacccctcctcccgaaacccgctcccgcgaaacgacgaccctacccttctcctttccctcaacgccaaaaaaaaaccgacgaaacgcgacgaacgtcctcgcgcgaactctcccgaacgacgccaaacgaaaaaaaaattccaactcccaaccaacaacctcctcccccgccgcccttctcacttccgcccgcgaaaccccaaccgccgacctaacctaccgactaaatccgactctcgaaaaaacccgaaaaactacgaacccgaacgcctcgactacgaacgcgcaactacgaaaaacgaaaaacgcgcgtccccgcaacctctccgcccgcccgaaacgcgccgactccgccgcttattaaaaactacaataatactccgaaataccccaaaaaaaaaaaattcgttttctctcccacgctactttacacgaactaaaaaaaaaaaaataaacgtaaaaaaaaaaaaaaaaataaaat

SEQ ID NO: 9029 - DNA, 550 bp, Artificial Sequence
  chemically treated genomic DNA (Homo sapiens) CpG-island No: 9029
ggcgatttattaatataattatacgcgcggcgcgtttttaattattttttaattttaatttcgtttcgtcgggggcggtgtttatcgtcgtattattttggacgagagggggcgttcgcgtttttttttggcgttcgcgtgttttttgttttttttaatttatgttcgatttttttatattttattttcgtgttatcgttttttcgcggcgtatgtatatcgcgttacgttatcgtttcgttagtaattgttttatgacgttttttattgttacgttttttgtcgtattggtattgcgtatagtatttatcgaattttttagttttattttttcgtaatcgatcgacgttttttcgttttatatattagtcgtatttatagtttcgtttattatgtcgtatgttgtacggaatgttaattaatttacgttttttcgtgagagcgttatgcgtttatatttttattattcggacgcgttaatatttatgcgacgtcgatgttatatttcgttcgtaaattttcgtaacgttattttatatatattacgttt

SEQ ID NO: 9030 - DNA, 550 bp, Artificial Sequence
  chemically treated genomic DNA (Homo sapiens) CpG-island No: 9030
aaacgtaatatatataaaataacgttacgaaaatttacgaacgaaatataacatcgacgtcgcataaatattaacgcgtccgaataataaaaatataaacgcataacgctctcacgaaaaaacgtaaattaattaacattccgtacaacatacgacataataaacgaaactataaatacgactaatatataaaacgaaaaaacgtcgatcgattacgaaaaaataaaactaaaaaattcgataaatactatacgcaataccaatacgacaaaaaacgtaacaataaaaaacgtcataaaacaattactaacgaaacgataacgtaacgcgatatacatacgccgcgaaaaaacgataacacgaaaataaaatataaaaaaatcgaacataaattaaaaaaaacaaaaaacacgcgaacgccaaaaaaaaacgcgaacgccccctctcgtccaaaataatacgacgataaacaccgcccccgacgaaacgaaattaaaattaaaaaataattaaaaacgcgccgcgcgtataattatattaataaatcgcc

SEQ ID NO: 9031 - DNA, 550 bp, Artificial Sequence
  chemically treated genomic DNA (Homo sapiens) CpG-island No: 9031
gagcgtgatatatgtggaatagcgttgcgagggtttacggacgggatatgatatcgacgtcgtatgggtattggcgcgttcgaatagtggggatgtgagcgtatgacgtttttacgagggggcgtgggttagttagtatttcgtatagtatacgatatggtgaacgaagttgtgaatgcggttagtgtataaggcgagaagacgtcgatcggttgcggaggggtggagttggagggttcgatgagtgttatgcgtagtgttagtacggtaggaagcgtagtagtgaaggacgttataagatagttattgacggagcggtgacgtggcgcggtatatatgcgtcgcgagaagacggtagtacggaggtggggtgtggggaggtcggatatgagttggagagggtagaggatacgcgggcgttaggaagaggcgcggacgttttttttcgtttaaagtggtacggcggtggatatcgttttcggcgggacgagattgagattaagaggtggttaggggcgcgtcgcgcgtgtggttgtgttggtagatcgtt

SEQ ID NO: 9032 - DNA, 550 bp, Artificial Sequence
  chemically treated genomic DNA (Homo sapiens) CpG-island No: 9032
aacgatctaccaacacaaccacacgcgcgacgcgcccctaaccacctcttaatctcaatctcgtcccgccgaaaacgatatccaccgccgtaccactttaaacgaaaaaaaacgtccgcgcctcttcctaacgcccgcgtatcctctaccctctccaactcatatccgacctccccacaccccacctccgtactaccgtcttctcgcgacgcatatataccgcgccacgtcaccgctccgtcaataactatcttataacgtccttcactactacgcttcctaccgtactaacactacgcataacactcatcgaaccctccaactccacccctccgcaaccgatcgacgtcttctcgccttatacactaaccgcattcacaacttcgttcaccatatcgtatactatacgaaatactaactaacccacgccccctcgtaaaaacgtcatacgctcacatccccactattcgaacgcgccaatacccatacgacgtcgatatcatatcccgtccgtaaaccctcgcaacgctattccacatatatcacgctc

SEQ ID NO: 9033 - DNA, 512 bp, Artificial Sequence
  chemically treated genomic DNA (Homo sapiens) CpG-island No: 9033
  misc_feature (269)..(269): n is either a, c, g or t
  misc_feature (429)..(429): n is either a, c, g or t
  misc_feature (476)..(476): n is either a, c, g or t
  misc_feature (481)..(481): n is either a, c, g or t
atgcgttagtatcgtattcggtacgatttttaaaatttggcgtttatttggttttgttcgttataatttcgataatttgtcgattcgtttgttgtatcgaatggtttgttaacgtatataggttggtaatcgattgtttaatattatgcgttataatttttttattgtcggttacggcggtattatttagcgttattaatatcgttttttacgtagtcgaagtattggtcgaaatttttatcgcgtagttgttcgacgtattatcgtanattatgtcgttgatatcgtcgattatattgttgatcgttatcgagatggttttataacgtttatttattagttatgttatttcggcggcggtttttattgttgcggtcgttgcggtatatagcgtagataaacgcgggtattggggtatggatgtaaatngcgtttaaatgcgaaagtattagcgtacgcgttagtcggttattatncggtncgaagtgttttgttattatttatataggtat

SEQ ID NO: 9034 - DNA, 512 bp, Artificial Sequence
  chemically treated genomic DNA (Homo sapiens) CpG-island No: 9034
  misc_feature (32)..(32): n is either a, c, g or t
  misc_feature (37)..(37): n is either a, c, g or t
  misc_feature (84)..(84): n is either a, c, g or t
  misc_feature (244)..(244): n is either a, c, g or t
atacctatataaataataacaaaacacttcgnaccgnataataaccgactaacgcgtacgctaatactttcgcatttaaacgcnatttacatccataccccaatacccgcgtttatctacgctatataccgcaacgaccgcaacaataaaaaccgccgccgaaataacataactaataaataaacgttataaaaccatctcgataacgatcaacaatataatcgacgatatcaacgacataatntacgataatacgtcgaacaactacgcgataaaaatttcgaccaatacttcgactacgtaaaaaacgatattaataacgctaaataataccgccgtaaccgacaataaaaaaattataacgcataatattaaacaatcgattaccaacctatatacgttaacaaaccattcgatacaacaaacgaatcgacaaattatcgaaattataacgaacaaaaccaaataaacgccaaattttaaaaatcgtaccgaatacgatactaacgcat

SEQ ID NO: 9035 - DNA, 512 bp, Artificial Sequence
  chemically treated genomic DNA (Homo sapiens) CpG-island No: 9035
  misc_feature (32)..(32): n is either a, c, g or t
  misc_feature (37)..(37): n is either a, c, g or t
  misc_feature (84)..(84): n is either a, c, g or t
  misc_feature (244)..(244): n is either a, c, g or t
atgtttgtgtgggtggtagtagaatatttcgnatcgnatgatgatcggttggcgcgtgcgttgatgttttcgtatttgagcgtnatttatatttatattttagtattcgcgtttgtttgcgttgtgtgtcgtaacgatcgtagtaatgggggtcgtcgtcgggatggtatggttggtggatgggcgttatgaaattatttcgatggcgattagtagtatgatcggcgatgttagcggtatgatntgcgatggtgcgtcgaatagttgcgcgatgaaggtttcgattagtgtttcggttgcgtggaaagcggtgttaatggcgttggatgatatcgtcgtgatcggtaatgaagggattgtggcgtatgatgttgagtagtcgattgttaatttgtgtgcgttagtaagttattcgatgtagtaaacggatcggtagattatcgagattatggcgagtaaggttagataaacgttaggttttggggatcgtgtcggatgcgatgttggcgtat

SEQ ID NO: 9036 - DNA, 512 bp, Artificial Sequence
  chemically treated genomic DNA (Homo sapiens) CpG-island No: 9036
  misc_feature (269)..(269): n is either a, c, g or t
  misc_feature (429)..(429): n is either a, c, g or t
  misc_feature (476)..(476): n is either a, c, g or t
  misc_feature (481)..(481): n is either a, c, g or t
atacgccaacatcgcatccgacacgatccccaaaacctaacgtttatctaaccttactcgccataatctcgataatctaccgatccgtttactacatcgaataacttactaacgcacacaaattaacaatcgactactcaacatcatacgccacaatcccttcattaccgatcacgacgatatcatccaacgccattaacaccgctttccacgcaaccgaaacactaatcgaaaccttcatcgcgcaactattcgacgcaccatcgcanatcataccgctaacatcgccgatcatactactaatcgccatcgaaataatttcataacgcccatccaccaaccataccatcccgacgacgacccccattactacgatcgttacgacacacaacgcaaacaaacgcgaatactaaaatataaatataaatnacgctcaaatacgaaaacatcaacgcacgcgccaaccgatcatcatncgatncgaaatattctactaccacccacacaaacat

SEQ ID NO: 9037 - DNA, 851 bp, Artificial Sequence
  chemically treated genomic DNA (Homo sapiens) CpG-island No: 9037
taaaggcgtttttgagttttaatattttttttttttttacgtttttaatgttcggttttgtcgggtcgtttattcgttttttttaggtaattttcgtcgttcgcgggggagtaggtgttcgcgtaataggtgttaggagggagggttcgggcggcggcgcggggtatcgagaggatttcgggagggagcgtaggataaagttacgtcgaagggaaggaggtcgggggcggacgtagaggaagatagttcgggggataaggatgtcgtcgtttgttttcgtttttcgcgcgattttcgtttcggcggttttatttataatttttaggtagacgaaggcgttcgagtaggttcgtaggatgtcggggtcggcgggtagggtgattcggggcggcgggaaggatacggcggggttcgggggcggcgggattgacgtttcgtcggtcgatatgttgtcgttgtcgttgttgcgttttcgcgcgtcgtcgtcgtttttcgttttcgtttttcgggtttttgtcgtcgtcgtcgtcgtcgtttagtttcgcgggtttcgggcgcgtcgcgcgggaggaggcgtggtcgtggggtttttcgagtttcgtttcgttacgtgggtttaggtgagcgtcgtttcgttttggcgttcgagtcgttcgcgattacgtgtataggtgcggttattgtagtcgttaggcgcggtttttttagtttcgtcgattttattttttgtttcgttggttagcgttagcgtttcgcgggcgtttttatgcgtatttttatatttttgatcgttatttttattttttagttttttttttagtttgtatttgtgttttttatttgtttttttt

SEQ ID NO: 9038 - DNA, 851 bp, Artificial Sequence
  chemically treated genomic DNA (Homo sapiens) CpG-island No: 9038
aaaaaaaacaaataaaaaacacaaatacaaactaaaaaaaaaactaaaaaataaaaataacgatcaaaaatataaaaatacgcataaaaacgcccgcgaaacgctaacgctaaccaacgaaacaaaaaataaaatcgacgaaactaaaaaaaccgcgcctaacgactacaataaccgcacctatacacgtaatcgcgaacgactcgaacgccaaaacgaaacgacgctcacctaaacccacgtaacgaaacgaaactcgaaaaaccccacgaccacgcctcctcccgcgcgacgcgcccgaaacccgcgaaactaaacgacgacgacgacgacgacaaaaacccgaaaaacgaaaacgaaaaacgacgacgacgcgcgaaaacgcaacaacgacaacgacaacatatcgaccgacgaaacgtcaatcccgccgcccccgaaccccgccgtatccttcccgccgccccgaatcaccctacccgccgaccccgacatcctacgaacctactcgaacgccttcgtctacctaaaaattataaataaaaccgccgaaacgaaaatcgcgcgaaaaacgaaaacaaacgacgacatccttatcccccgaactatcttcctctacgtccgcccccgacctccttcccttcgacgtaactttatcctacgctccctcccgaaatcctctcgataccccgcgccgccgcccgaaccctccctcctaacacctattacgcgaacacctactcccccgcgaacgacgaaaattacctaaaaaaaacgaataaacgacccgacaaaaccgaacattaaaaacgtaaaaaaaaaaaaaatattaaaactcaaaaacgccttta

SEQ ID NO: 9039 - DNA, 851 bp, Artificial Sequence
  chemically treated genomic DNA (Homo sapiens) CpG-island No: 9039
ggagaagataggtggagagtataggtgtaaattaaggggagggttagaaggtaaaaatagcgattaggggtatgggggtgcgtatggagacgttcgcggagcgttggcgttggttagcggagtaggaggtgaggtcggcggagttgggaggatcgcgtttggcggttgtaatagtcgtatttgtgtacgtgatcgcgagcggttcgggcgttagggcggagcggcgtttatttgggtttacgtgacggggcggggttcgaggagttttacggttacgttttttttcgcgcggcgcgttcggagttcgcggagttgagcggcggcggcggcggcggtaggagttcgggaggcggaggcgggaggcggcggcggcgcgcggagacgtagtagcggtagcggtagtatgtcggtcggcggagcgttagtttcgtcgttttcgaatttcgtcgtgtttttttcgtcgtttcgggttattttgttcgtcggtttcgatattttgcggatttattcgggcgttttcgtttgtttggagattgtaagtggggtcgtcggagcgagggtcgcgcggggagcgaggataggcggcggtatttttgtttttcgggttgtttttttttgcgttcgttttcggttttttttttttcgacgtggttttgttttgcgttttttttcggggttttttcggtgtttcgcgtcgtcgttcgggtttttttttttagtatttgttacgcgggtatttgttttttcgcgggcgacggaaattgtttggggagggcgagtaggcggttcggtagggtcgaatattggggacgtggaggaaagaaaggtgttggggtttagaggcgttttta

SEQ ID NO: 9040 - DNA, 851 bp, Artificial Sequence
  chemically treated genomic DNA (Homo sapiens) CpG-island No: 9040
taaaaacgcctctaaaccccaacacctttctttcctccacgtccccaatattcgaccctaccgaaccgcctactcgccctccccaaacaatttccgtcgcccgcgaaaaaacaaatacccgcgtaacaaatactaaaaaaaaaaacccgaacgacgacgcgaaacaccgaaaaaaccccgaaaaaaaacgcaaaacaaaaccacgtcgaaaaaaaaaaaaccgaaaacgaacgcaaaaaaaaacaacccgaaaaacaaaaataccgccgcctatcctcgctccccgcgcgaccctcgctccgacgaccccacttacaatctccaaacaaacgaaaacgcccgaataaatccgcaaaatatcgaaaccgacgaacaaaataacccgaaacgacgaaaaaaacacgacgaaattcgaaaacgacgaaactaacgctccgccgaccgacatactaccgctaccgctactacgtctccgcgcgccgccgccgcctcccgcctccgcctcccgaactcctaccgccgccgccgccgccgctcaactccgcgaactccgaacgcgccgcgcgaaaaaaaacgtaaccgtaaaactcctcgaaccccgccccgtcacgtaaacccaaataaacgccgctccgccctaacgcccgaaccgctcgcgatcacgtacacaaatacgactattacaaccgccaaacgcgatcctcccaactccgccgacctcacctcctactccgctaaccaacgccaacgctccgcgaacgtctccatacgcacccccatacccctaatcgctatttttaccttctaaccctccccttaatttacacctatactctccacctatcttctcc

SEQ ID NO: 9041 - DNA, 582 bp, Artificial Sequence
  chemically treated genomic DNA (Homo sapiens) CpG-island No: 9041
  misc_feature (464)..(464): n is either a, c, g or t
  misc_feature (506)..(506): n is either a, c, g or t
atttcgttgattatcgtcggtgttagcggtgacgatattcgtcgtcgggtgtcggcggcgttggataaagtcgggttattggataaagcgaagaatttttttatttagttttcgggcggtgaataatagcgtgttggtattgttcgcgcggtggtgaataagttcgcggtattgttggcggacgaatcgattggtaatttggacgacgcgttgtcggaaggtattttacgtttgtttgaagagtttaatcgcgttggggtaatcgtattgatggtaacgtacgatattaatttgatttcgcggcgtttttatcgtatgtttattttgagcgatggttatttgtatggaggcgtgggttatgaataagcgcgatgtaattaattatattcggtagtttggcgggcgttttgatcgttttcgtaaatcggtcggcggtttaggcgacggcggtcgtaacgtattanaacgcgcgaaattttcgttaaatcggtaaatcgttaaattancgtttttaacgaataggtgcgttatgttttttacggcgtattgtaggatttgaaaagtaaatcgttcgttacgttt

SEQ ID NO: 9042 - DNA, 582 bp, Artificial Sequence
  chemically treated genomic DNA (Homo sapiens) CpG-island No: 9042
  misc_feature (77)..(77): n is either a, c, g or t
  misc_feature (119)..(119): n is either a, c, g or t
aaacgtaacgaacgatttacttttcaaatcctacaatacgccgtaaaaaacataacgcacctattcgttaaaaacgntaatttaacgatttaccgatttaacgaaaatttcgcgcgttntaatacgttacgaccgccgtcgcctaaaccgccgaccgatttacgaaaacgatcaaaacgcccgccaaactaccgaatataattaattacatcgcgcttattcataacccacgcctccatacaaataaccatcgctcaaaataaacatacgataaaaacgccgcgaaatcaaattaatatcgtacgttaccatcaatacgattaccccaacgcgattaaactcttcaaacaaacgtaaaataccttccgacaacgcgtcgtccaaattaccaatcgattcgtccgccaacaataccgcgaacttattcaccaccgcgcgaacaataccaacacgctattattcaccgcccgaaaactaaataaaaaaattcttcgctttatccaataacccgactttatccaacgccgccgacacccgacgacgaatatcgtcaccgctaacaccgacgataatcaacgaaat

SEQ ID NO: 9043 - DNA, 582 bp, Artificial Sequence
  chemically treated genomic DNA (Homo sapiens) CpG-island No: 9043
  misc_feature (77)..(77): n is either a, c, g or t
  misc_feature (119)..(119): n is either a, c, g or t
aaacgtggcgaacggtttgttttttagattttgtaatgcgtcgtggaaggtatagcgtatttgttcgttgaaaacgntggtttggcgatttatcggtttggcgaggatttcgcgcgttntggtgcgttacgatcgtcgtcgtttgagtcgtcgatcgatttacggaagcgattaagacgttcgttaaattgtcgaatatgattgattgtatcgcgtttatttatggtttacgtttttatgtaagtgattatcgtttagggtgagtatgcgataggaacgtcgcgagattaggttgatgtcgtgcgttgttattaatacggttattttaacgcggttaaattttttaaatagacgtaaaatgtttttcgatagcgcgtcgtttaggttattagtcggttcgttcgttagtagtatcgcgggtttgtttattatcgcgcgggtaatgttaatacgttgttgtttatcgttcgaaagttgaatagggaagtttttcgttttgtttagtagttcgattttatttagcgtcgtcgatattcggcgacgaatatcgttatcgttggtatcggcgataattagcgggat

SEQ ID NO: 9044 - DNA, 582 bp, Artificial Sequence
  chemically treated genomic DNA (Homo sapiens) CpG-island No: 9044
  misc_feature (464)..(464): n is either a, c, g or t
  misc_feature (506)..(506): n is either a, c, g or t
atcccgctaattatcgccgataccaacgataacgatattcgtcgccgaatatcgacgacgctaaataaaatcgaactactaaacaaaacgaaaaacttccctattcaactttcgaacgataaacaacaacgtattaacattacccgcgcgataataaacaaacccgcgatactactaacgaacgaaccgactaataacctaaacgacgcgctatcgaaaaacattttacgtctatttaaaaaatttaaccgcgttaaaataaccgtattaataacaacgcacgacatcaacctaatctcgcgacgttcctatcgcatactcaccctaaacgataatcacttacataaaaacgtaaaccataaataaacgcgatacaatcaatcatattcgacaatttaacgaacgtcttaatcgcttccgtaaatcgatcgacgactcaaacgacgacgatcgtaacgcaccanaacgcgcgaaatcctcgccaaaccgataaatcgccaaaccancgttttcaacgaacaaatacgctataccttccacgacgcattacaaaatctaaaaaacaaaccgttcgccacgttt

SEQ ID NO: 9045 - DNA, 543 bp, Artificial Sequence
  chemically treated genomic DNA (Homo sapiens) CpG-island No: 9045
cgaattcgtggtgattatcgggtcgttcggtttcggtaaatcgattttgttgcgttgtattaataattggaagaaattattttcggcgatttgattgtcgatggtttgaaggttaacgattcgaaagttgacgagcgtttgattcgttaggaagtaggtatggtgttttagtagttttattttttttcgtatttgatagcgttggaaaacgttatgtttggttcgttacgcgtgcgtggcgcgaataaagaagaggcggaaaaattggtacgtgagttgttggcgaaagtcggtttggtagaacgtgtatattattattttttcgaattttttggtggttaatagtagcgtgtggcgattgttcgcgcgttggcggtgaagtcgaaaatgatgttgtttgatgaatcgattttcgtttttgattcggaattgcgttatgaagtgttgaaggttatgtaggatttggttgaagaagggatgacgatggtgatcgtgatttacgaaatcggttttgtcgagaaagtagtttcgcggttgattttt

SEQ ID NO: 9046 - DNA, 543 bp, Artificial Sequence
  chemically treated genomic DNA (Homo sapiens) CpG-island No: 9046
aaaaatcaaccgcgaaactactttctcgacaaaaccgatttcgtaaatcacgatcaccatcgtcatcccttcttcaaccaaatcctacataaccttcaacacttcataacgcaattccgaatcaaaaacgaaaatcgattcatcaaacaacatcattttcgacttcaccgccaacgcgcgaacaatcgccacacgctactattaaccaccaaaaaattcgaaaaaataataatatacacgttctaccaaaccgactttcgccaacaactcacgtaccaatttttccgcctcttctttattcgcgccacgcacgcgtaacgaaccaaacataacgttttccaacgctatcaaatacgaaaaaaaataaaactactaaaacaccatacctacttcctaacgaatcaaacgctcgtcaactttcgaatcgttaaccttcaaaccatcgacaatcaaatcgccgaaaataatttcttccaattattaatacaacgcaacaaaatcgatttaccgaaaccgaacgacccgataatcaccacgaattcg

SEQ ID NO: 9047 - DNA, 543 bp, Artificial Sequence
  chemically treated genomic DNA (Homo sapiens) CpG-island No: 9047
aaagattagtcgcgaagttattttttcggtaaaatcgatttcgtgggttacgattattatcgttattttttttttagttagattttgtataatttttagtattttatggcgtagtttcgggttaagagcggaagtcggtttattaaatagtattattttcggttttatcgttagcgcgcgggtaatcgttatacgttgttgttgattattagaaagttcggaagggtagtgatgtgtacgttttgttagatcgattttcgttagtagtttacgtgttagttttttcgttttttttttgttcgcgttacgtacgcgtagcgggttaaatatgacgttttttagcgttgttagatgcgggaagaggtaaaattgttggaatattatatttgttttttggcgaattaggcgttcgttaattttcggatcgttaatttttaggttatcgataattagatcgtcggaggtgattttttttagttgttgatgtagcgtagtagggtcgatttatcggaatcggacggttcgataattattacgagttcg

SEQ ID NO: 9048 - DNA, 543 bp, Artificial Sequence
  chemically treated genomic DNA (Homo sapiens) CpG-island No: 9048
cgaactcgtaataattatcgaaccgtccgattccgataaatcgaccctactacgctacatcaacaactaaaaaaaatcacctccgacgatctaattatcgataacctaaaaattaacgatccgaaaattaacgaacgcctaattcgccaaaaaacaaatataatattccaacaattttacctcttcccgcatctaacaacgctaaaaaacgtcatatttaacccgctacgcgtacgtaacgcgaacaaaaaaaaaacgaaaaaactaacacgtaaactactaacgaaaatcgatctaacaaaacgtacacatcactacccttccgaactttctaataatcaacaacaacgtataacgattacccgcgcgctaacgataaaaccgaaaataatactatttaataaaccgacttccgctcttaacccgaaactacgccataaaatactaaaaattatacaaaatctaactaaaaaaaaaataacgataataatcgtaacccacgaaatcgattttaccgaaaaaataacttcgcgactaatcttt

SEQ ID NO: 9049 - DNA, 549 bp, Artificial Sequence
  chemically treated genomic DNA (Homo sapiens) CpG-island No: 9049
ttcgggcgcgattttttttaagattataaagtttaatttcgttttgtttagaatttttatacgttaaattatcgtaatcgtttatacgtagaaacgttcgttagcgtaaaaggtataatagttcgtaacggttttttcgtttaagtcggttgaattttcgatattcgtttttatatcgtaacgtaggatttagatcgcgtatattcggatatttttttacgcgtcgcgtcgatgaaacgcgtattatatttagtttataatacgcgtatcgacgcgcgcgacgtcgtcgcgaatattttagttaagaatttttcgttattcgttttcgcgcgatagtttacgttcgtgttttttatattcgcgtgtagtatcgtggcgttaattatcgttttaattgtatcgtcgcggatagagttttcgtaattatcgtttgtatcgaaggtcgtttttttcggcggtaaatattggcgtgtttttatgtttattacgattgttatttttttattcgttttataagcgcgtttaattacggtcgtttgcgtcgtcgat

SEQ ID NO: 9050 - DNA, 549 bp, Artificial Sequence
  chemically treated genomic DNA (Homo sapiens) CpG-island No: 9050
atcgacgacgcaaacgaccgtaattaaacgcgcttataaaacgaataaaaaaataacaatcgtaataaacataaaaacacgccaatatttaccgccgaaaaaaacgaccttcgatacaaacgataattacgaaaactctatccgcgacgatacaattaaaacgataattaacgccacgatactacacgcgaatataaaaaacacgaacgtaaactatcgcgcgaaaacgaataacgaaaaattcttaactaaaatattcgcgacgacgtcgcgcgcgtcgatacgcgtattataaactaaatataatacgcgtttcatcgacgcgacgcgtaaaaaaatatccgaatatacgcgatctaaatcctacgttacgatataaaaacgaatatcgaaaattcaaccgacttaaacgaaaaaaccgttacgaactattataccttttacgctaacgaacgtttctacgtataaacgattacgataatttaacgtataaaaattctaaacaaaacgaaattaaactttataatcttaaaaaaaatcgcgcccgaa

SEQ ID NO: 9051 - DNA, 549 bp, Artificial Sequence
  chemically treated genomic DNA (Homo sapiens) CpG-island No: 9051
gtcggcgacgtaggcggtcgtggttaagcgcgtttgtggggcggataaggaggtgatagtcgtggtgggtatgagggtacgttagtatttgtcgtcggaaggagcggttttcggtgtagacggtagttgcgagggttttgttcgcggcggtgtagttggggcgatggttagcgttacggtgttatacgcggatgtagagggtacggacgtgagttgtcgcgcgggggcgagtagcgagagatttttgattgaagtgttcgcggcggcgtcgcgcgcgtcggtgcgcgtgttgtaggttagatataatgcgcgttttatcgacgcggcgcgtgaggaggtgttcgggtatgcgcggtttgggttttacgttgcggtgtgagagcgagtgtcgggagtttaatcgatttaagcgggaaggtcgttacgggttgttatgttttttgcgttgacgggcgtttttgcgtatgagcggttgcggtggtttggcgtgtggggattttgagtaaagcggaattgagttttgtagttttagggagaatcgcgttcggg

SEQ ID NO: 9052 - DNA, 549 bp, Artificial Sequence
  chemically treated genomic DNA (Homo sapiens) CpG-island No: 9052
cccgaacgcgattctccctaaaactacaaaactcaattccgctttactcaaaatccccacacgccaaaccaccgcaaccgctcatacgcaaaaacgcccgtcaacgcaaaaaacataacaacccgtaacgaccttcccgcttaaatcgattaaactcccgacactcgctctcacaccgcaacgtaaaacccaaaccgcgcatacccgaacacctcctcacgcgccgcgtcgataaaacgcgcattatatctaacctacaacacgcgcaccgacgcgcgcgacgccgccgcgaacacttcaatcaaaaatctctcgctactcgcccccgcgcgacaactcacgtccgtaccctctacatccgcgtataacaccgtaacgctaaccatcgccccaactacaccgccgcgaacaaaaccctcgcaactaccgtctacaccgaaaaccgctccttccgacgacaaatactaacgtaccctcatacccaccacgactatcacctccttatccgccccacaaacgcgcttaaccacgaccgcctacgtcgccgac

SEQ ID NO: 9053 - DNA, 506 bp, Artificial Sequence
  chemically treated genomic DNA (Homo sapiens) CpG-island No: 9053
  misc_feature (7)..(8): n is either a, c, g or t
  misc_feature (58)..(60): n is either a, c, g or t
  misc_feature (80)..(80): n is either a, c, g or t
  misc_feature (226)..(226): n is either a, c, g or t
  misc_feature (320)..(320): n is either a, c, g or t
  misc_feature (386)..(387): n is either a, c, g or t
  misc_feature (470)..(470): n is either a, c, g or t
ggcggtnngggggggggggcggcgtttcgttcgcgtcgggggcgcgggcgcgcgcgtnnncggttttcgcgcgggggggnggttcgcggggcgcgcgcggcgcggcggcgcggggggtcggcgtttttcgggcggcgggggcggttcggggggcgggggttcgggttttatcgttttcgggcgggcggcgtttcggcgggcggcgcggggttcgtcggttcgggtncggggcgtcggggcgggcgcgtcgggggggggtcggttcgggttcggcgcggcgcggggcgcggcggcgggcgtcgcggtcgcgcgcgcgcgtncgcgttaaggttcgggttcggtcgtcgcggaggcgcggcgggggcgggcggagggcgtcgcggggnntcgcgggcgcggcggcggcggcgggcgcgcggtatacgcgcgagttcgtcgtcgttcgtcggtcgcgcgtcgttagcggcggncgttagttcgtacggtagaggcgcgcgcgcggacgt

SEQ ID NO: 9054 - DNA, 506 bp, Artificial Sequence
  chemically treated genomic DNA (Homo sapiens) CpG-island No: 9054
  misc_feature (37)..(37): n is either a, c, g or t
  misc_feature (120)..(121): n is either a, c, g or t
  misc_feature (187)..(187): n is either a, c, g or t
  misc_feature (281)..(281): n is either a, c, g or t
  misc_feature (427)..(427): n is either a, c, g or t
  misc_feature (447)..(449): n is either a, c, g or t
  misc_feature (499)..(500): n is either a, c, g or t
acgtccgcgcgcgcgcctctaccgtacgaactaacgnccgccgctaacgacgcgcgaccgacgaacgacgacgaactcgcgcgtataccgcgcgcccgccgccgccgccgcgcccgcgannccccgcgacgccctccgcccgcccccgccgcgcctccgcgacgaccgaacccgaaccttaacgcgnacgcgcgcgcgcgaccgcgacgcccgccgccgcgccccgcgccgcgccgaacccgaaccgacccccccccgacgcgcccgccccgacgccccgnacccgaaccgacgaaccccgcgccgcccgccgaaacgccgcccgcccgaaaacgataaaacccgaacccccgccccccgaaccgcccccgccgcccgaaaaacgccgaccccccgcgccgccgcgccgcgcgcgccccgcgaaccncccccccgcgcgaaaaccgnnnacgcgcgcgcccgcgcccccgacgcgaacgaaacgccgcccccccccccnnaccgcc

SEQ ID NO: 9055 - DNA, 506 bp, Artificial Sequence
  chemically treated genomic DNA (Homo sapiens) CpG-island No: 9055
  misc_feature (37)..(37): n is either a, c, g or t
  misc_feature (120)..(121): n is either a, c, g or t
  misc_feature (187)..(187): n is either a, c, g or t
  misc_feature (281)..(281): n is either a, c, g or t
  misc_feature (427)..(427): n is either a, c, g or t
  misc_feature (447)..(449): n is either a, c, g or t
  misc_feature (499)..(500): n is either a, c, g or t
gcgttcgcgcgcgcgtttttgtcgtgcgggttggcgntcgtcgttggcggcgcgcggtcggcgggcggcggcgggttcgcgcgtgtgtcgcgcgttcgtcgtcgtcgtcgcgttcgcggnntttcgcggcgtttttcgttcgttttcgtcgcgttttcgcggcggtcgggttcgggttttggcgcgngcgcgcgcgcgcggtcgcggcgttcgtcgtcgcgtttcgcgtcgcgtcgggttcgggtcggttttttttcggcgcgttcgtttcggcgtttcgngttcgggtcggcgggtttcgcgtcgttcgtcggggcgtcgttcgttcgggggcggtggggttcgggttttcgtttttcgggtcgttttcgtcgttcggggggcgtcggtttttcgcgtcgtcgcgtcgcgcgcgtttcgcgggttnttttttcgcgcgggggtcgnnngcgcgcgcgttcgcgttttcggcgcgggcggggcgtcgtttttttttttnngtcgtt

SEQ ID NO: 9056 - DNA, 506 bp, Artificial Sequence
  chemically treated genomic DNA (Homo sapiens) CpG-island No: 9056
  misc_feature (7)..(8): n is either a, c, g or t
  misc_feature (58)..(60): n is either a, c, g or t
  misc_feature (80)..(80): n is either a, c, g or t
  misc_feature (226)..(226): n is either a, c, g or t
  misc_feature (320)..(320): n is either a, c, g or t
  misc_feature (386)..(387): n is either a, c, g or t
  misc_feature (470)..(470): n is either a, c, g or t
aacgacnnaaaaaaaaaaacgacgccccgcccgcgccgaaaacgcgaacgcgcgcgcnnncgacccccgcgcgaaaaaanaacccgcgaaacgcgcgcgacgcgacgacgcgaaaaaccgacgccccccgaacgacgaaaacgacccgaaaaacgaaaacccgaaccccaccgcccccgaacgaacgacgccccgacgaacgacgcgaaacccgccgacccgaacncgaaacgccgaaacgaacgcgccgaaaaaaaaccgacccgaacccgacgcgacgcgaaacgcgacgacgaacgccgcgaccgcgcgcgcgcgcncgcgccaaaacccgaacccgaccgccgcgaaaacgcgacgaaaacgaacgaaaaacgccgcgaaannccgcgaacgcgacgacgacgacgaacgcgcgacacacgcgcgaacccgccgccgcccgccgaccgcgcgccgccaacgacgancgccaacccgcacgacaaaaacgcgcgcgcgaacgc

SEQ ID NO: 9057 - DNA, 820 bp, Artificial Sequence
  chemically treated genomic DNA (Homo sapiens) CpG-island No: 9057
  misc_feature (19)..(19): n is either a, c, g or t
  misc_feature (55)..(55): n is either a, c, g or t
  misc_feature (58)..(58): n is either a, c, g or t
  misc_feature (114)..(115): n is either a, c, g or t
  misc_feature (179)..(179): n is either a, c, g or t
  misc_feature (198)..(199): n is either a, c, g or t
  misc_feature (222)..(222): n is either a, c, g or t
  misc_feature (247)..(247): n is either a, c, g or t
  misc_feature (251)..(251): n is either a, c, g or t
  misc_feature (308)..(308): n is either a, c, g or t
  misc_feature (334)..(335): n is either a, c, g or t
  misc_feature (340)..(340): n is either a, c, g or t
  misc_feature (344)..(344): n is either a, c, g or t
  misc_feature (350)..(350): n is either a, c, g or t
  misc_feature (353)..(355): n is either a, c, g or t
  misc_feature (362)..(362): n is either a, c, g or t
  misc_feature (366)..(366): n is either a, c, g or t
  misc_feature (369)..(369): n is either a, c, g or t
  misc_feature (375)..(375): n is either a, c, g or t
  misc_feature (565)..(565): n is either a, c, g or t
  misc_feature (629)..(629): n is either a, c, g or t
  misc_feature (656)..(656): n is either a, c, g or t
  misc_feature (681)..(681): n is either a, c, g or t
  misc_feature (693)..(694): n is either a, c, g or t
  misc_feature (736)..(736): n is either a, c, g or t
  misc_feature (762)..(762): n is either a, c, g or t
cggcggtcgcgcgggagtnggtcgtcggggggggggggtcggggggcggcgtcgncgnggggggatcgaaaaaaaaaaaaaaaaaaattttggttgtttatcggggggggggtnntaatagtttcgtcggtcgcgtcgtatatttttttttttcgtttcgtcgcgcgggcgcgggcggngcgggggcgttcgcgggtnngggcggcgtcgttcgttcgcggncgcgtcgttttttttcgtttcgcgngcgngaaagtagaaattagcggcgggcgcgcgcggggcgggggcggcggtttcgttcgggncgggcgcggtcgcgcgcgtcgcgttnntcggncggngcggtngtnnntcgtcgngcgncgngcggtncggtcgcgcgcgcgcgcggcgcgtttcggtcgttcggcgcgtttcgttcggtcgtcgttcgttttcgtttttcgtttcgcggtcgggtcgtcgttcgtcgtcgcgcgggttcgtcgcgttcggcgtttcgttcggcgttcgtcgttttcgtcgggggcgtcggcgtcgtttcggtcgcgcgttcgcgggncgcggcggcgggtttcggcgggggggggcggcggttcgttcggggttcggcgcgcgggcgggtngcgggcggtcgggggttcgcgcgtttnggcgcgcgcgcggtcgtcgttcggncgcgttcgcgtnncgcgttcgcgtcggtacggcggttcgtcggagttcgcgcgtnggcgtttacgatcgttcgacgacgtntttcggttttcgcgcgttcggcgtcggtcgtcgtcgtttcgcggtcggcgcgcgttcg

SEQ ID NO: 9058 - DNA, 820 bp, Artificial Sequence
  chemically treated genomic DNA (Homo sapiens) CpG-island No: 9058
  misc_feature (59)..(59): n is either a, c, g or t
  misc_feature (85)..(85): n is either a, c, g or t
  misc_feature (127)..(128): n is either a, c, g or t
  misc_feature (140)..(140): n is either a, c, g or t
  misc_feature (165)..(165): n is either a, c, g or t
  misc_feature (192)..(192): n is either a, c, g or t
  misc_feature (256)..(256): n is either a, c, g or t
  misc_feature (446)..(446): n is either a, c, g or t
  misc_feature (452)..(452): n is either a, c, g or t
  misc_feature (455)..(455): n is either a, c, g or t
  misc_feature (459)..(459): n is either a, c, g or t
  misc_feature (466)..(468): n is either a, c, g or t
  misc_feature (471)..(471): n is either a, c, g or t
  misc_feature (477)..(477): n is either a, c, g or t
  misc_feature (481)..(481): n is either a, c, g or t
  misc_feature (486)..(487): n is either a, c, g or t
  misc_feature (513)..(513): n is either a, c, g or t
  misc_feature (570)..(570): n is either a, c, g or t
  misc_feature (574)..(574): n is either a, c, g or t
  misc_feature (599)..(599): n is either a, c, g or t
  misc_feature (622)..(623): n is either a, c, g or t
  misc_feature (642)..(642): n is either a, c, g or t
  misc_feature (706)..(707): n is either a, c, g or t
  misc_feature (763)..(763): n is either a, c, g or t
  misc_feature (766)..(766): n is either a, c, g or t
  misc_feature (802)..(802): n is either a, c, g or t
cgaacgcgcgccgaccgcgaaacgacgacgaccgacgccgaacgcgcgaaaaccgaaanacgtcgtcgaacgatcgtaaacgccnacgcgcgaactccgacgaaccgccgtaccgacgcgaacgcgnnacgcgaacgcgnccgaacgacgaccgcgcgcgcgccnaaacgcgcgaacccccgaccgcccgcnacccgcccgcgcgccgaaccccgaacgaaccgccgcccccccccgccgaaacccgccgccgcgncccgcgaacgcgcgaccgaaacgacgccgacgcccccgacgaaaacgacgaacgccgaacgaaacgccgaacgcgacgaacccgcgcgacgacgaacgacgacccgaccgcgaaacgaaaaacgaaaacgaacgacgaccgaacgaaacgcgccgaacgaccgaaacgcgccgcgcgcgcgcgcgaccgnaccgcncgncgcncgacgannnacnaccgcnccgnccgannaacgcgacgcgcgcgaccgcgcccgncccgaacgaaaccgccgcccccgccccgcgcgcgcccgccgctaatttctactttcncgcncgcgaaacgaaaaaaaacgacgcgnccgcgaacgaacgacgccgcccnnacccgcgaacgcccccgcnccgcccgcgcccgcgcgacgaaacgaaaaaaaaaaatatacgacgcgaccgacgaaactattannaccccccccccgataaacaaccaaaatttttttttttttttttttcgatccccccncgncgacgccgccccccgaccccccccccccgacgaccnactcccgcgcgaccgccg

SEQ ID NO: 9059 - DNA, 820 bp, Artificial Sequence
  chemically treated genomic DNA (Homo sapiens) CpG-island No: 9059
  misc_feature (59)..(59): n is either a, c, g or t
  misc_feature (85)..(85): n is either a, c, g or t
  misc_feature (127)..(128): n is either a, c, g or t
  misc_feature (140)..(140): n is either a, c, g or t
  misc_feature (165)..(165): n is either a, c, g or t
  misc_feature (192)..(192): n is either a, c, g or t
  misc_feature (256)..(256): n is either a, c, g or t
  misc_feature (446)..(446): n is either a, c, g or t
  misc_feature (452)..(452): n is either a, c, g or t
  misc_feature (455)..(455): n is either a, c, g or t
  misc_feature (459)..(459): n is either a, c, g or t
  misc_feature (466)..(468): n is either a, c, g or t
  misc_feature (471)..(471): n is either a, c, g or t
  misc_feature (477)..(477): n is either a, c, g or t
  misc_feature (481)..(481): n is either a, c, g or t
  misc_feature (486)..(487): n is either a, c, g or t
  misc_feature (513)..(513): n is either a, c, g or t
  misc_feature (570)..(570): n is either a, c, g or t
  misc_feature (574)..(574): n is either a, c, g or t
  misc_feature (599)..(599): n is either a, c, g or t
  misc_feature (622)..(623): n is either a, c, g or t
  misc_feature (642)..(642): n is either a, c, g or t
  misc_feature (706)..(707): n is either a, c, g or t
  misc_feature (763)..(763): n is either a, c, g or t
  misc_feature (766)..(766): n is either a, c, g or t
  misc_feature (802)..(802): n is either a, c, g or t
cgggcgcgcgtcggtcgcggggcggcggcggtcggcgtcgggcgcgcgggggtcggggngcgtcgtcgggcggtcgtggacgttngcgcgcgagtttcggcgggtcgtcgtgtcggcgcgggcgcgnngcgcgggcgcgntcgggcggcggtcgcgcgcgcgttngggcgcgcgggttttcggtcgttcgtngttcgttcgcgcgtcgggtttcgggcgggtcgtcgttttttttcgtcggggttcgtcgtcgcgnttcgcgggcgcgcggtcggggcggcgtcggcgttttcggcgggggcggcgggcgtcgggcggggcgtcgggcgcggcgggttcgcgcggcggcgggcggcggttcggtcgcggggcggggggcgggggcgggcggcggtcgggcggggcgcgtcgggcggtcggggcgcgtcgcgcgcgcgcgcggtcgngtcgtncgncgtncggcggnnngtngtcgtntcgntcggnnggcgcggcgcgcgcggtcgcgttcgnttcgggcggggtcgtcgttttcgtttcgcgcgcgttcgtcgttggtttttgtttttncgtncgcggggcgggggggggcggcgcgntcgcgggcgggcggcgtcgtttnngttcgcgggcgttttcgtntcgttcgcgttcgcgcggcggggcgagagagaaaggtgtgcggcgcggtcggcggggttgttgnngtttttttttcggtgagtagttagggtttttttttttttttttttcggtttttttncgncggcgtcgtttttcggtttttttttttcggcggttngttttcgcgcggtcgtcg

SEQ ID NO: 9060 - DNA, 820 bp, Artificial Sequence
  chemically treated genomic DNA (Homo sapiens) CpG-island No: 9060
  misc_feature (19)..(19): n is either a, c, g or t
  misc_feature (55)..(55): n is either a, c, g or t
  misc_feature (58)..(58): n is either a, c, g or t
  misc_feature (114)..(115): n is either a, c, g or t
  misc_feature (179)..(179): n is either a, c, g or t
  misc_feature (198)..(199): n is either a, c, g or t
  misc_feature (222)..(222): n is either a, c, g or t
  misc_feature (247)..(247): n is either a, c, g or t
  misc_feature (251)..(251): n is either a, c, g or t
  misc_feature (308)..(308): n is either a, c, g or t
  misc_feature (334)..(335): n is either a, c, g or t
  misc_feature (340)..(340): n is either a, c, g or t
  misc_feature (344)..(344): n is either a, c, g or t
  misc_feature (350)..(350): n is either a, c, g or t
  misc_feature (353)..(355): n is either a, c, g or t
  misc_feature (362)..(362): n is either a, c, g or t
  misc_feature (366)..(366): n is either a, c, g or t
  misc_feature (369)..(369): n is either a, c, g or t
  misc_feature (375)..(375): n is either a, c, g or t
  misc_feature (565)..(565): n is either a, c, g or t
  misc_feature (629)..(629): n is either a, c, g or t
  misc_feature (656)..(656): n is either a, c, g or t
  misc_feature (681)..(681): n is either a, c, g or t
  misc_feature (693)..(694): n is either a, c, g or t
  misc_feature (736)..(736): n is either a, c, g or t
  misc_feature (762)..(762): n is either a, c, g or t
cgacgaccgcgcgaaaacnaaccgccgaaaaaaaaaaaccgaaaaacgacgccgncgnaaaaaaaccgaaaaaaaaaaaaaaaaaaaccctaactactcaccgaaaaaaaaacnncaacaaccccgccgaccgcgccgcacacctttctctctcgccccgccgcgcgaacgcgaacganacgaaaacgcccgcgaacnnaaacgacgccgcccgcccgcgancgcgccgcccccccccgccccgcgnacgnaaaaacaaaaaccaacgacgaacgcgcgcgaaacgaaaacgacgaccccgcccgaancgaacgcgaccgcgcgcgccgcgccnnccgancganacgacnacnnnccgccgnacgncgnacgacncgaccgcgcgcgcgcgcgacgcgccccgaccgcccgacgcgccccgcccgaccgccgcccgcccccgccccccgccccgcgaccgaaccgccgcccgccgccgcgcgaacccgccgcgcccgacgccccgcccgacgcccgccgcccccgccgaaaacgccgacgccgccccgaccgcgcgcccgcgaancgcgacgacgaaccccgacgaaaaaaaacgacgacccgcccgaaacccgacgcgcgaacgaacnacgaacgaccgaaaacccgcgcgcccnaacgcgcgcgcgaccgccgcccgancgcgcccgcgcnncgcgcccgcgccgacacgacgacccgccgaaactcgcgcgcnaacgtccacgaccgcccgacgacgcnccccgacccccgcgcgcccgacgccgaccgccgccgccccgcgaccgacgcgcgcccg

SEQ ID NO: 9061 - DNA, 557 bp, Artificial Sequence
  chemically treated genomic DNA (Homo sapiens) CpG-island No: 9061
  misc_feature (5)..(5): n is either a, c, g or t
  misc_feature (21)..(21): n is either a, c, g or t
  misc_feature (27)..(27): n is either a, c, g or t
  misc_feature (59)..(59): n is either a, c, g or t
tcgtncggaatttattagagngagatnatatcgggacgggtttacggagattttatttnaagaattaggtcgaacgttttagtcgcgggggtcgtaataatttagaagggacgttattgttaaggtcgtcgttagagcgtcgtatttttttcggatcggtattaataaattataaagcgtataaaatgttattatttcgttgcgggatttattattaaggagttatatagttatacggaatcgcgttcgttcgattagaggaatcggattagtacggttttttttaggttttattttttagcgaggttgtacgttacgtcggatagttatattttttcgggggtattaatcgcgagaatcgtttcgaattttatagataaaaaagattagttttttcgattcggggcgggtcgattagagttataatttatagcgtcggggaggggagatcggaaaaaagagtatcgggttatttaaacggttacgagagcgtaatttcggataggtaagtatacgttaattattcgaggggtttttcgtcggttttacggtatatt

SEQ ID NO: 9062 - DNA, 557 bp, Artificial Sequence
  chemically treated genomic DNA (Homo sapiens) CpG-island No: 9062
  misc_feature (499)..(499): n is either a, c, g or t
  misc_feature (531)..(531): n is either a, c, g or t
  misc_feature (537)..(537): n is either a, c, g or t
  misc_feature (553)..(553): n is either a, c, g or t
aatataccgtaaaaccgacgaaaaacccctcgaataattaacgtatacttacctatccgaaattacgctctcgtaaccgtttaaataacccgatactcttttttccgatctcccctccccgacgctataaattataactctaatcgacccgccccgaatcgaaaaaactaatcttttttatctataaaattcgaaacgattctcgcgattaatacccccgaaaaaatataactatccgacgtaacgtacaacctcgctaaaaaataaaacctaaaaaaaaccgtactaatccgattcctctaatcgaacgaacgcgattccgtataactatataactccttaataataaatcccgcaacgaaataataacattttatacgctttataatttattaataccgatccgaaaaaaatacgacgctctaacgacgaccttaacaataacgtcccttctaaattattacgacccccgcgactaaaacgttcgacctaattcttnaaataaaatctccgtaaacccgtcccgatatnatctcnctctaataaattccgnacga

SEQ ID NO: 9063 - DNA, 557 bp, Artificial Sequence
  chemically treated genomic DNA (Homo sapiens) CpG-island No: 9063
  misc_feature (499)..(499): n is either a, c, g or t
  misc_feature (531)..(531): n is either a, c, g or t
  misc_feature (537)..(537): n is either a, c, g or t
  misc_feature (553)..(553): n is either a, c, g or t
ggtgtgtcgtggggtcggcggggggtttttcgggtggttggcgtgtgtttgtttgttcggggttgcgttttcgtggtcgtttgggtggttcggtgttttttttttcggtttttttttttcggcgttgtgggttgtggttttggtcggttcgtttcgggtcgggggggttggttttttttgtttgtggggttcggggcggttttcgcggttggtgttttcgggggagtgtggttgttcggcgtgacgtgtagtttcgttggggggtggggtttggggggggtcgtgttggttcggtttttttggtcgggcgggcgcggtttcgtgtggttgtgtggttttttggtggtaggtttcgtaacggggtggtggtattttgtgcgttttgtggtttgttagtgtcggttcggggggggtgcggcgttttggcggcggttttagtagtggcgttttttttgggttgttgcgattttcgcgattggaacgttcggtttggtttttngggtggggttttcgtgggttcgtttcggtgtngttttnttttggtgggtttcgngcgg

SEQ ID NO: 9064 - DNA, 557 bp, Artificial Sequence
  chemically treated genomic DNA (Homo sapiens) CpG-island No: 9064
  misc_feature (5)..(5): n is either a, c, g or t
  misc_feature (21)..(21): n is either a, c, g or t
  misc_feature (27)..(27): n is either a, c, g or t
  misc_feature (59)..(59): n is either a, c, g or t
ccgcncgaaacccaccaaaanaaaacnacaccgaaacgaacccacgaaaaccccacccnaaaaaccaaaccgaacgttccaatcgcgaaaatcgcaacaacccaaaaaaaacgccactactaaaaccgccgccaaaacgccgcaccccccccgaaccgacactaacaaaccacaaaacgcacaaaataccaccaccccgttacgaaacctaccaccaaaaaaccacacaaccacacgaaaccgcgcccgcccgaccaaaaaaaccgaaccaacacgaccccccccaaaccccaccccccaacgaaactacacgtcacgccgaacaaccacactcccccgaaaacaccaaccgcgaaaaccgccccgaaccccacaaacaaaaaaaaccaacccccccgacccgaaacgaaccgaccaaaaccacaacccacaacgccgaaaaaaaaaaaccgaaaaaaaaaacaccgaaccacccaaacgaccacgaaaacgcaaccccgaacaaacaaacacacgccaaccacccgaaaaaccccccgccgaccccacgacacacc

SEQ ID NO: 9065 - DNA, 1050 bp, Artificial Sequence
  chemically treated genomic DNA (Homo sapiens) CpG-island No: 9065
taaggttattacgcgtcgtggcgggggcgatcggtggcggtatgggttgtggcgcggtcgaggcggtttcgtgaagtcgaagatttgcgggtgtagattagaagttttaataagttttatttttcgggttcggagtagcgatttttagattgattcggcgttgaggtgtacggcgagaagttcgtttatttttataatttttcggtaagaggtaatttgcgaggggtttcgatcgttttcgttagtttttttcgaattcggcgtaattcgttgcgtatttagttattaggattttcgtcgcgacgttcgattttcgtgtttcgtttggtttttttcgtaggtgatttgtttcggcgttttcggtcgggggcgggcgcgtcgtttatttatttcgttttgtagtgggaattatttttcgtggggaaggaaagttaggttgcgggagggtcgcggggcgttaaggggtagcgggaaacgtagaggatgggggtttcgtttttagcgcgttcgtagtcggttcgtagggttcggggcgttacgcggaggtgtagttgtatttcggggatggggcggttaaggagtcgagaggttcggcgtttattagtcggggttttttatttacgttgtattgcgaggaggcggcggcggtagcgaaggaggaggaggcggcgttcggtcgttttcgtttagagttcggtagttatcgagtggtcgttcgcgttttcgtaggattcgttttttcggtttcgtagagcggtatatagggcgcgtcgcgttcgttcggtacgggtagtttagtcggttttacgtcgtcgttcgtaatagtagtcgcgggcggggtgtagttattttcgtgagcgtcgtagtcgttttattcggggcggggttcgcgggtatcggagagcggacggtcgagtacgaggggcgtgcgcgtagtttcgggtagggatttcgtttgtatcggggtggtttgtaagattgtcggggtaggtagtggggaggagaacgtttatatcgtttcgtgtttggcgtttgatgaattatttgtat

SEQ ID NO: 9066 - DNA, 1050 bp, Artificial Sequence
  chemically treated genomic DNA (Homo sapiens) CpG-island No: 9066
atacaaataattcatcaaacgccaaacacgaaacgatataaacgttctcctccccactacctaccccgacaatcttacaaaccaccccgatacaaacgaaatccctacccgaaactacgcgcacgcccctcgtactcgaccgtccgctctccgatacccgcgaaccccgccccgaataaaacgactacgacgctcacgaaaataactacaccccgcccgcgactactattacgaacgacgacgtaaaaccgactaaactacccgtaccgaacgaacgcgacgcgccctatataccgctctacgaaaccgaaaaaacgaatcctacgaaaacgcgaacgaccactcgataactaccgaactctaaacgaaaacgaccgaacgccgcctcctcctccttcgctaccgccgccgcctcctcgcaatacaacgtaaataaaaaaccccgactaataaacgccgaacctctcgactccttaaccgccccatccccgaaatacaactacacctccgcgtaacgccccgaaccctacgaaccgactacgaacgcgctaaaaacgaaacccccatcctctacgtttcccgctaccccttaacgccccgcgaccctcccgcaacctaactttccttccccacgaaaaataattcccactacaaaacgaaataaataaacgacgcgcccgcccccgaccgaaaacgccgaaacaaatcacctacgaaaaaaaccaaacgaaacacgaaaatcgaacgtcgcgacgaaaatcctaataactaaatacgcaacgaattacgccgaattcgaaaaaaactaacgaaaacgatcgaaacccctcgcaaattacctcttaccgaaaaattataaaaataaacgaacttctcgccgtacacctcaacgccgaatcaatctaaaaatcgctactccgaacccgaaaaataaaacttattaaaacttctaatctacacccgcaaatcttcgacttcacgaaaccgcctcgaccgcgccacaacccataccgccaccgatcgcccccgccacgacgcgtaataacctta

SEQ ID NO: 9067 - DNA, 1050 bp, Artificial Sequence
  chemically treated genomic DNA (Homo sapiens) CpG-island No: 9067
gtataagtagtttattaagcgttagatacggaacggtgtgagcgtttttttttttattgtttatttcggtaattttgtaggttatttcggtgtagacggggtttttgttcggagttgcgcgtacgtttttcgtgttcggtcgttcgtttttcggtgttcgcgggtttcgtttcgagtggggcggttgcggcgtttacggaggtggttgtatttcgttcgcggttgttgttgcggacggcggcgtgaggtcggttgagttgttcgtgtcgagcgagcgcggcgcgttttgtgtgtcgttttgcggagtcgaggaggcgggttttgcggggacgcgggcggttattcggtggttgtcgggttttgggcggggacggtcgggcgtcgtttttttttttttcgttgtcgtcgtcgttttttcgtagtgtagcgtgagtagggagtttcggttggtggacgtcgagtttttcggttttttggtcgttttattttcgaggtgtagttgtattttcgcgtggcgtttcgagttttgcgagtcggttgcggacgcgttgaggacggagtttttattttttgcgtttttcgttgttttttaacgtttcgcgattttttcgtagtttggttttttttttttacggaaaatggtttttattgtagggcgaggtgagtgggcggcgcgttcgttttcggtcgggggcgtcggggtaggttatttgcgggggaggttaggcggagtacggaggtcgggcgtcgcggcggggattttgatagttgggtgcgtagcgggttgcgtcggattcgggagaagttgacgggggcggtcggggtttttcgtaggttgttttttgtcgggagattgtgaaggtgagcgggtttttcgtcgtgtattttagcgtcgggttagtttgggagtcgttgtttcgggttcgagggatggggtttgttggggtttttggtttatattcgtaggttttcggttttacgaagtcgtttcggtcgcgttatagtttatatcgttatcggtcgttttcgttacggcgcgtggtgattttg

SEQ ID NO: 9068 - DNA, 1050 bp, Artificial Sequence
  chemically treated genomic DNA (Homo sapiens) CpG-island No: 9068
caaaatcaccacgcgccgtaacgaaaacgaccgataacgatataaactataacgcgaccgaaacgacttcgtaaaaccgaaaacctacgaatataaaccaaaaaccccaacaaaccccatccctcgaacccgaaacaacgactcccaaactaacccgacgctaaaatacacgacgaaaaacccgctcaccttcacaatctcccgacaaaaaacaacctacgaaaaaccccgaccgcccccgtcaacttctcccgaatccgacgcaacccgctacgcacccaactatcaaaatccccgccgcgacgcccgacctccgtactccgcctaacctcccccgcaaataacctaccccgacgcccccgaccgaaaacgaacgcgccgcccactcacctcgccctacaataaaaaccattttccgtaaaaaaaaaaaaccaaactacgaaaaaatcgcgaaacgttaaaaaacaacgaaaaacgcaaaaaataaaaactccgtcctcaacgcgtccgcaaccgactcgcaaaactcgaaacgccacgcgaaaatacaactacacctcgaaaataaaacgaccaaaaaaccgaaaaactcgacgtccaccaaccgaaactccctactcacgctacactacgaaaaaacgacgacgacaacgaaaaaaaaaaaaacgacgcccgaccgtccccgcccaaaacccgacaaccaccgaataaccgcccgcgtccccgcaaaacccgcctcctcgactccgcaaaacgacacacaaaacgcgccgcgctcgctcgacacgaacaactcaaccgacctcacgccgccgtccgcaacaacaaccgcgaacgaaatacaaccacctccgtaaacgccgcaaccgccccactcgaaacgaaacccgcgaacaccgaaaaacgaacgaccgaacacgaaaaacgtacgcgcaactccgaacaaaaaccccgtctacaccgaaataacctacaaaattaccgaaataaacaataaaaaaaaaaacgctcacaccgttccgtatctaacgcttaataaactacttatac

SEQ ID NO: 9069 - DNA, 729 bp, Artificial Sequence
  chemically treated genomic DNA (Homo sapiens) CpG-island No: 9069
gtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgaggtttttgggttggtgatcggatttgttgcgggttgcgggtcgtatcgggttttgtgtttttcggttatggttggtagttggttgcggaattggtttggggtttttatcggttttttttcggtgttttttgttgttttttaaggagtttgtttcg

SEQ ID NO: 9070 - DNA, 729 bp, Artificial Sequence
  chemically treated genomic DNA (Homo sapiens) CpG-island No: 9070
cgaaacaaactccttaaaaaacaacaaaaaacaccgaaaaaaaaccgataaaaaccccaaaccaattccgcaaccaactaccaaccataaccgaaaaacacaaaacccgatacgacccgcaacccgcaacaaatccgatcaccaacccaaaaacctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgac

SEQ ID NO: 9071 - DNA, 729 bp, Artificial Sequence
  chemically treated genomic DNA (Homo sapiens) CpG-island No: 9071
cggaataagttttttaaaaggtagtagggaatatcgggaaaaggtcggtaaaagttttaggttaatttcgtagttaattattaattatgatcggaaaatataaaattcgatgcggttcgtagttcgtaatagattcggttattaatttagaagttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggt

SEQ ID NO: 9072 - DNA, 729 bp, Artificial Sequence
  chemically treated genomic DNA (Homo sapiens) CpG-island No: 9072
accgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaacttctaaattaataaccgaatctattacgaactacgaaccgcatcgaattttatattttccgatcataattaataattaactacgaaattaacctaaaacttttaccgaccttttcccgatattccctactaccttttaaaaaacttattccg

SEQ ID NO: 9073 - DNA, 1065 bp, Artificial Sequence
  chemically treated genomic DNA (Homo sapiens) CpG-island No: 9073
tttgcgtcgtttttttaagggttcgcggggcgtgttatacgttattttcggggcggggcgagtaaggcggaggcggggtcggggtcggcgggggaggggagcgttaggttcgcgtaggttcgtcgggatcgtagtcgtcgagtcgagcgtttgattatatatggttaaagttgggggcgagtcgcgcgcgggatcgcgttttcgggttcggggcgttcgtaattatagcgcgtagggtaggcgcgagttggtttttgagtttcggtttcggatcgtttattttattttcggtacgttcggtgtcgtttttcggttttagttttcgggttcggtttcggcgaggtgtaattcgtagcgcgggtcggtttcggaggttttcggcgagcgcggcgcggtaataagtgggcgaggatgtcgtacgagattagtaagtgtcgcggcgcggggttttcgagcggtcgtcgcgttgtttcggtttcggttttcggtttttaggcgtcgtgcgggtggcgggggagttttcggcgcgggggaggggtgcgggcgtcggtcggaggcgtggcggggtcgttttcggtggtgtagggcgggattttcgacggggggtgcgtttttaagttggcgtcgtgggtcgagtcggaggagtttcgttgtttttaagggtttggttcggggcgcggattaggaagtcgcgcggtttttggcgttcgtggaaagtggaggtcgttttttcggcgtagttaataggtgatcggtcgagatcggttcggggtttttttttttttttgttttcgtcgttttcgttttgttttgatatgtttcgtcgtatttgtgttttcgtagagaaggtgttcgttagtttttcgtaggtggagaggggcgtttttaagattatcggcggcgattttaagggtaataattttttgtatattaatggaaagtgcgttattttaaggaatatcgacgtgagtattttttatttcgggcgcggttttgtttcggagttattttgggatgggataattcgtttttttttttattttttattttttgtttattggttcg

SEQ ID NO: 9074 - DNA, 1065 bp, Artificial Sequence
  chemically treated genomic DNA (Homo sapiens) CpG-island No: 9074
cgaaccaataaacaaaaaataaaaaataaaaaaaaaaacgaattatcccatcccaaaataactccgaaacaaaaccgcgcccgaaataaaaaatactcacgtcgatattccttaaaataacgcactttccattaatatacaaaaaattattacccttaaaatcgccgccgataatcttaaaaacgcccctctccacctacgaaaaactaacgaacaccttctctacgaaaacacaaatacgacgaaacatatcaaaacaaaacgaaaacgacgaaaacaaaaaaaaaaaaaaaccccgaaccgatctcgaccgatcacctattaactacgccgaaaaaacgacctccactttccacgaacgccaaaaaccgcgcgacttcctaatccgcgccccgaaccaaacccttaaaaacaacgaaactcctccgactcgacccacgacgccaacttaaaaacgcaccccccgtcgaaaatcccgccctacaccaccgaaaacgaccccgccacgcctccgaccgacgcccgcacccctcccccgcgccgaaaactcccccgccacccgcacgacgcctaaaaaccgaaaaccgaaaccgaaacaacgcgacgaccgctcgaaaaccccgcgccgcgacacttactaatctcgtacgacatcctcgcccacttattaccgcgccgcgctcgccgaaaacctccgaaaccgacccgcgctacgaattacacctcgccgaaaccgaacccgaaaactaaaaccgaaaaacgacaccgaacgtaccgaaaataaaataaacgatccgaaaccgaaactcaaaaaccaactcgcgcctaccctacgcgctataattacgaacgccccgaacccgaaaacgcgatcccgcgcgcgactcgcccccaactttaaccatatataatcaaacgctcgactcgacgactacgatcccgacgaacctacgcgaacctaacgctcccctcccccgccgaccccgaccccgcctccgccttactcgccccgccccgaaaataacgtataacacgccccgcgaacccttaaaaaaacgacgcaaa

SEQ ID NO: 9075 - DNA, 1065 bp, Artificial Sequence
  chemically treated genomic DNA (Homo sapiens) CpG-island No: 9075
cgggttaatgggtaggaggtgagaagtggagaggaaggcgaattattttattttaaggtggtttcggagtagaatcgcgttcggggtagggggtatttacgtcgatgttttttaggatgacgtattttttattggtgtatagaaaattgttgtttttagggtcgtcgtcgatgattttggagacgtttttttttatttgcgggaggttggcgaatattttttttgcggagatataaatgcggcggggtatgttagggtagggcggggacggcggggatagaagggagaaggagtttcggatcggtttcggtcggttatttgttgattgcgtcgggagggcggtttttattttttacgagcgttaggaatcgcgcgattttttggttcgcgtttcgggttaggtttttgggggtagcggggttttttcggttcggtttacggcgttaatttgggggcgtatttttcgtcgggggtttcgttttgtattatcgagggcggtttcgttacgttttcggtcggcgttcgtatttttttttcgcgtcgaggattttttcgttattcgtacggcgtttaggggtcggggatcggggtcggggtagcgcggcggtcgttcgggggtttcgcgtcgcggtatttattgatttcgtacggtattttcgtttatttgttatcgcgtcgcgttcgtcgagagttttcggggtcggttcgcgttgcgaattatatttcgtcgaggtcgagttcggggattggagtcggaaggcggtatcgggcgtgtcgggagtggagtgggcggttcgaggtcggggtttagaggttagttcgcgtttgttttgcgcgttgtggttgcggacgtttcgaattcggaagcgcggtttcgcgcgcggttcgtttttagttttgattatatatagttaagcgttcggttcggcggttgcggtttcggcgagtttgcgcggatttggcgtttttttttttcgtcggtttcggtttcgttttcgttttgttcgtttcgtttcggaagtgacgtatagtacgtttcgcgggtttttgaaaaggcggcgtaga

SEQ ID NO: 9076 - DNA, 1065 bp, Artificial Sequence
  chemically treated genomic DNA (Homo sapiens) CpG-island No: 9076
tctacgccgccttttcaaaaacccgcgaaacgtactatacgtcacttccgaaacgaaacgaacaaaacgaaaacgaaaccgaaaccgacgaaaaaaaaaaacgccaaatccgcgcaaactcgccgaaaccgcaaccgccgaaccgaacgcttaactatatataatcaaaactaaaaacgaaccgcgcgcgaaaccgcgcttccgaattcgaaacgtccgcaaccacaacgcgcaaaacaaacgcgaactaacctctaaaccccgacctcgaaccgcccactccactcccgacacgcccgataccgccttccgactccaatccccgaactcgacctcgacgaaatataattcgcaacgcgaaccgaccccgaaaactctcgacgaacgcgacgcgataacaaataaacgaaaataccgtacgaaatcaataaataccgcgacgcgaaacccccgaacgaccgccgcgctaccccgaccccgatccccgacccctaaacgccgtacgaataacgaaaaaatcctcgacgcgaaaaaaaaatacgaacgccgaccgaaaacgtaacgaaaccgccctcgataatacaaaacgaaacccccgacgaaaaatacgcccccaaattaacgccgtaaaccgaaccgaaaaaaccccgctacccccaaaaacctaacccgaaacgcgaaccaaaaaatcgcgcgattcctaacgctcgtaaaaaataaaaaccgccctcccgacgcaatcaacaaataaccgaccgaaaccgatccgaaactccttctcccttctatccccgccgtccccgccctaccctaacataccccgccgcatttatatctccgcaaaaaaaatattcgccaacctcccgcaaataaaaaaaaacgtctccaaaatcatcgacgacgaccctaaaaacaacaattttctatacaccaataaaaaatacgtcatcctaaaaaacatcgacgtaaataccccctaccccgaacgcgattctactccgaaaccaccttaaaataaaataattcgccttcctctccacttctcacctcctacccattaacccg

SEQ ID NO: 9077 - DNA, 635 bp, Artificial Sequence
  chemically treated genomic DNA (Homo sapiens) CpG-island No: 9077
acgtcggaatagatggttggtgtcgttgttttggtggggatggtggtagtagaaaatatcgattttttcgatcgtatgtaattggaatacgttatcgttatttgtcgttaggtaaagtcgtttttcgtagtcggacgttagttttttgacgtttcgcgttaggtaaagttagcgttaatgacgcggatcggttacgtaaatatttggcgcgttttggtttgacgtgggaagtcgtgtaggattagtatagttttagttgaatatggtggttcgttagtatttgtattacgtttattggcggcggggcgtcggtgtagacggtatttattatgttgatgttgtttatattgattatcgcgttacggttaaatttcgagtgatcgataattagtataacgtggcgcgagtttttaataatggcgcgtttggtgcgaatttcgtggtaatcgaattttagtagcgagtcgtcgttatcgatgtcgtttatttttagaatgtcgaaattaaggcggaattgggagataaaatcgagcgtcgtttcgttaatgatttcgttatcgcggttgcgtaattcgttatcggcgagaatgatgcgaaaatttttttttattattaattttacgatttaataagga

SEQ ID NO: 9078 - DNA, 635 bp, Artificial Sequence
  chemically treated genomic DNA (Homo sapiens) CpG-island No: 9078
tccttattaaatcgtaaaattaataataaaaaaaaattttcgcatcattctcgccgataacgaattacgcaaccgcgataacgaaatcattaacgaaacgacgctcgattttatctcccaattccgccttaatttcgacattctaaaaataaacgacatcgataacgacgactcgctactaaaattcgattaccacgaaattcgcaccaaacgcgccattattaaaaactcgcgccacgttatactaattatcgatcactcgaaatttaaccgtaacgcgataatcaatataaacaacatcaacataataaataccgtctacaccgacgccccgccgccaataaacgtaatacaaatactaacgaaccaccatattcaactaaaactatactaatcctacacgacttcccacgtcaaaccaaaacgcgccaaatatttacgtaaccgatccgcgtcattaacgctaactttacctaacgcgaaacgtcaaaaaactaacgtccgactacgaaaaacgactttacctaacgacaaataacgataacgtattccaattacatacgatcgaaaaaatcgatattttctactaccaccatccccaccaaaacaacgacaccaaccatctattccgacgt

SEQ ID NO: 9079 - DNA, 635 bp, Artificial Sequence
  chemically treated genomic DNA (Homo sapiens) CpG-island No: 9079
tttttgttgaatcgtgaggttgatggtaaaagaagattttcgtattattttcgtcggtggcgaattacgtagtcgcgatggcgggattattggcgaagcgacgttcgattttattttttagtttcgttttgatttcggtattttggggataagcggtatcgatagcgacggttcgttgttggagttcgattattacgaagttcgtattaaacgcgttattattgagaattcgcgttacgttatgttggttgtcgattattcgaaatttggtcgtaacgcgatggttaatatgggtagtattagtatggtagatgtcgtttatatcgacgtttcgtcgttagtaagcgtgatgtaggtgttgacggattattatatttaattggagttgtgttgattttgtacggttttttacgttagattaaaacgcgttaggtatttgcgtagtcgattcgcgttattgacgttggttttgtttggcgcgaaacgttaaaaagttggcgttcggttgcggaaagcgattttgtttggcggtagatagcgataacgtgttttagttgtatacggtcgaagagatcgatgttttttattgttattatttttattaaaatagcgatattagttatttgtttcggcgt

SEQ ID NO: 9080 - DNA, 635 bp, Artificial Sequence
  chemically treated genomic DNA (Homo sapiens) CpG-island No: 9080
acgccgaaacaaataactaatatcgctattttaataaaaataataacaataaaaaacatcgatctcttcgaccgtatacaactaaaacacgttatcgctatctaccgccaaacaaaatcgctttccgcaaccgaacgccaactttttaacgtttcgcgccaaacaaaaccaacgtcaataacgcgaatcgactacgcaaatacctaacgcgttttaatctaacgtaaaaaaccgtacaaaatcaacacaactccaattaaatataataatccgtcaacacctacatcacgcttactaacgacgaaacgtcgatataaacgacatctaccatactaatactacccatattaaccatcgcgttacgaccaaatttcgaataatcgacaaccaacataacgtaacgcgaattctcaataataacgcgtttaatacgaacttcgtaataatcgaactccaacaacgaaccgtcgctatcgataccgcttatccccaaaataccgaaatcaaaacgaaactaaaaaataaaatcgaacgtcgcttcgccaataatcccgccatcgcgactacgtaattcgccaccgacgaaaataatacgaaaatcttcttttaccatcaacctcacgattcaacaaaaa

SEQ ID NO: 9081 - DNA, 522 bp, Artificial Sequence
  chemically treated genomic DNA (Homo sapiens) CpG-island No: 9081
aagtgcgtgtgttggggcgagcgggagcgtgcgaggatgggtataggatagaggtagagttatttacgtcgtcgcggttttacgttgggcgatagagtttttagtttttttttaatggtggcgggtcgtcggagttttgattttcgggaatttttgtcgttgttgttttgcgattttaagtaggttcgtaaagttttttgggttggcgtcgcgtttcgattcgttgatttcggcgcggtaagggagggggtcgggattggggtcgggaggacgtcgtttgtttcgggggatttcgggcgtcgcggagatatttttgtttttttttgggggcgcgcggtttcggcgggggtggtttcgcgttcgtagggtgaaggttcggtacgtcgggcgttttgtagtttgggagttttatttcggggatgtcggatttgaattgaatttaagaaagggttttgaagtttcgtttttcgatgtaattaaggtttcggttcggaagtttttaaaaatttataagggtttttg

SEQ ID NO: 9082 - DNA, 522 bp, Artificial Sequence
  chemically treated genomic DNA (Homo sapiens) CpG-island No: 9082
caaaaacccttataaatttttaaaaacttccgaaccgaaaccttaattacatcgaaaaacgaaacttcaaaaccctttcttaaattcaattcaaatccgacatccccgaaataaaactcccaaactacaaaacgcccgacgtaccgaaccttcaccctacgaacgcgaaaccacccccgccgaaaccgcgcgcccccaaaaaaaaacaaaaatatctccgcgacgcccgaaatcccccgaaacaaacgacgtcctcccgaccccaatcccgaccccctcccttaccgcgccgaaatcaacgaatcgaaacgcgacgccaacccaaaaaactttacgaacctacttaaaatcgcaaaacaacaacgacaaaaattcccgaaaatcaaaactccgacgacccgccaccattaaaaaaaaactaaaaactctatcgcccaacgtaaaaccgcgacgacgtaaataactctacctctatcctatacccatcctcgcacgctcccgctcgccccaacacacgcactt

SEQ ID NO: 9083 - DNA, 522 bp, Artificial Sequence
  chemically treated genomic DNA (Homo sapiens) CpG-island No: 9083
tagaagtttttgtaaatttttgggggttttcggatcggggttttggttatatcggggggcggaattttaaggtttttttttaggtttaatttaaattcggtattttcgaagtgagatttttaaattgtagagcgttcgacgtgtcgaatttttattttgcgagcgcggggttattttcgtcggagtcgcgcgtttttaggaggaaataaaagtgttttcgcggcgttcggagtttttcggagtagacggcgttttttcggttttagtttcggtttttttttttgtcgcgtcgaggttagcgagtcggggcgcggcgttagtttaggaaattttacgaatttgtttggggtcgtaggatagtagcggtaagggttttcggagattagagtttcggcgattcgttattattgaaggggaattggaggttttgtcgtttagcgtggggtcgcggcggcgtgggtggttttgtttttattttgtgtttattttcgtacgttttcgttcgttttagtatacgtattt

SEQ ID NO: 9084 - DNA, 522 bp, Artificial Sequence
  chemically treated genomic DNA (Homo sapiens) CpG-island No: 9084
aaatacgtatactaaaacgaacgaaaacgtacgaaaataaacacaaaataaaaacaaaaccacccacgccgccgcgaccccacgctaaacgacaaaacctccaattccccttcaataataacgaatcgccgaaactctaatctccgaaaacccttaccgctactatcctacgaccccaaacaaattcgtaaaatttcctaaactaacgccgcgccccgactcgctaacctcgacgcgacaaaaaaaaaaaccgaaactaaaaccgaaaaaacgccgtctactccgaaaaactccgaacgccgcgaaaacacttttatttcctcctaaaaacgcgcgactccgacgaaaataaccccgcgctcgcaaaataaaaattcgacacgtcgaacgctctacaatttaaaaatctcacttcgaaaataccgaatttaaattaaacctaaaaaaaaaccttaaaattccgccccccgatataaccaaaaccccgatccgaaaacccccaaaaatttacaaaaacttcta

SEQ ID NO: 9085 - DNA, 606 bp, Artificial Sequence
  chemically treated genomic DNA (Homo sapiens) CpG-island No: 9085
gggggtagcgaggttgcgggcgtgatttcggaagatttaaatcgttaaggtgatcggagtaatttgaaaaaggaaataaatttttttcgagtcgtgttcgcgtggttttggggcggacggttgcgttcgaaagggtattttttaaaagaagggttttaggaacgtaggggtgtgggttttttcgggaggcgcgcggtcggggtagtgtcgtaaagcggttattagttcgttttgtattcgcggttaagcgcggttttagagtttcggcggcggttagagtttaggttatattttttttgtagtgagattcgcggtcgttgattggcgtatcgtggattaatgggcgcgtcggggcggtttcggttgttagcgcgcgtcgtagtagcgtcggtagtagtttgtttttttttgcgttgagtttcgtagttagcgtagttttttcgggaagcgcggcggtcgttttcgagcgtagttttgttcggttcgttagtcgcgcgtttcggcgttcgcgttttacggttatagttttgtttttatttagtttacggagtatgtgtagattcgtaggcgttaaggtgtttttagttcgggggttttttgggtagt

SEQ ID NO: 9086 - DNA, 606 bp, Artificial Sequence
  chemically treated genomic DNA (Homo sapiens) CpG-island No: 9086
actacccaaaaaacccccgaactaaaaacaccttaacgcctacgaatctacacatactccgtaaactaaataaaaacaaaactataaccgtaaaacgcgaacgccgaaacgcgcgactaacgaaccgaacaaaactacgctcgaaaacgaccgccgcgcttcccgaaaaaactacgctaactacgaaactcaacgcaaaaaaaaacaaactactaccgacgctactacgacgcgcgctaacaaccgaaaccgccccgacgcgcccattaatccacgatacgccaatcaacgaccgcgaatctcactacaaaaaaaatataacctaaactctaaccgccgccgaaactctaaaaccgcgcttaaccgcgaatacaaaacgaactaataaccgctttacgacactaccccgaccgcgcgcctcccgaaaaaacccacacccctacgttcctaaaacccttcttttaaaaaataccctttcgaacgcaaccgtccgccccaaaaccacgcgaacacgactcgaaaaaaatttatttcctttttcaaattactccgatcaccttaacgatttaaatcttccgaaatcacgcccgcaacctcgctaccccc

SEQ ID NO: 9087 - DNA, 606 bp, Artificial Sequence
  chemically treated genomic DNA (Homo sapiens) CpG-island No: 9087
gttgtttagaaggttttcggattgagagtattttagcgtttgcgggtttgtatatgtttcgtgagttagatagaggtaaggttgtggtcgtggggcgcgggcgtcgggacgcgcggttggcgggtcgggtagggttgcgttcgggagcggtcgtcgcgtttttcgggaaggttgcgttggttgcggggtttagcgtaggggaggataggttgttgtcggcgttgttgcggcgcgcgttgatagtcggggtcgtttcggcgcgtttattggtttacggtgcgttaattagcggtcgcgggttttattgtaaagagggtgtggtttaaattttggtcgtcgtcgaaattttggggtcgcgtttggtcgcgagtataaagcgggttggtggtcgttttgcggtattgtttcggtcgcgcgtttttcgggggggtttatatttttgcgtttttgaaattttttttttgaaaaatgttttttcgaacgtaatcgttcgttttagagttacgcgggtacggttcgagggaagtttgtttttttttttaaattgtttcggttattttaacggtttgagtttttcggagttacgttcgtagtttcgttgttttt

SEQ ID NO: 9088 - DNA, 606 bp, Artificial Sequence
  chemically treated genomic DNA (Homo sapiens) CpG-island No: 9088
aaaaacaacgaaactacgaacgtaactccgaaaaactcaaaccgttaaaataaccgaaacaatttaaaaaaaaaaacaaacttccctcgaaccgtacccgcgtaactctaaaacgaacgattacgttcgaaaaaacatttttcaaaaaaaaaatttcaaaaacgcaaaaatataaacccccccgaaaaacgcgcgaccgaaacaataccgcaaaacgaccaccaacccgctttatactcgcgaccaaacgcgaccccaaaatttcgacgacgaccaaaatttaaaccacaccctctttacaataaaacccgcgaccgctaattaacgcaccgtaaaccaataaacgcgccgaaacgaccccgactatcaacgcgcgccgcaacaacgccgacaacaacctatcctcccctacgctaaaccccgcaaccaacgcaaccttcccgaaaaacgcgacgaccgctcccgaacgcaaccctacccgacccgccaaccgcgcgtcccgacgcccgcgccccacgaccacaaccttacctctatctaactcacgaaacatatacaaacccgcaaacgctaaaatactctcaatccgaaaaccttctaaacaac

SEQ ID NO: 9089 - DNA, 544 bp, Artificial Sequence
  chemically treated genomic DNA (Homo sapiens) CpG-island No: 9089
aaatagttaagtatttttttattaatttcgattattttttttttttcgcgtttatcggcggtagtggcgaagggtttattgaagcgtcgggtgttacgcggggcggttcgcgggttagttagggggcggggaatttattagtcgtcgatttttttttttatttcgttttcggtcgtcgcggttttagcggttttcgcgttgcgaggagcgggcgtttggatatagggcgagttgtttgatttggcggaggcggggaggtcggcggggagcgagcgagggaggtacgagagttgggtagcgcgggcgtcggtttttagggtagggttttcgcgcgtagtagcggtttcggggcgggggcgaggcgatcgcgggcgtcggggatgtttggaggggtcgcggtcgagaggagattcgggattggacggttagatttgtcgggcgcgcgggtaggtgtttcggttttttttttttttttttttttttttttttttttgtttttttttttttcgttttgaagtaagatgagcgtgatgttgtggcgttg

SEQ ID NO: 9090 - DNA, 544 bp, Artificial Sequence
  chemically treated genomic DNA (Homo sapiens) CpG-island No: 9090
caacgccacaacatcacgctcatcttacttcaaaacgaaaaaaaaaaaaacaaaaaaaaaaaaaaaaaaaaaaaaaaaaaaaaaaccgaaacacctacccgcgcgcccgacaaatctaaccgtccaatcccgaatctcctctcgaccgcgacccctccaaacatccccgacgcccgcgatcgcctcgcccccgccccgaaaccgctactacgcgcgaaaaccctaccctaaaaaccgacgcccgcgctacccaactctcgtacctccctcgctcgctccccgccgacctccccgcctccgccaaatcaaacaactcgccctatatccaaacgcccgctcctcgcaacgcgaaaaccgctaaaaccgcgacgaccgaaaacgaaataaaaaaaaaaatcgacgactaataaattccccgccccctaactaacccgcgaaccgccccgcgtaacacccgacgcttcaataaacccttcgccactaccgccgataaacgcgaaaaaaaaaaaataatcgaaattaataaaaaaatacttaactattt

SEQ ID NO: 9091 - DNA, 544 bp, Artificial Sequence
  chemically treated genomic DNA (Homo sapiens) CpG-island No: 9091
tagcgttatagtattacgtttattttattttagggcgaggaaggaaggggtagaggaaaaaggaggaggggaaaaaaaaaaaaagtcgaagtatttgttcgcgcgttcggtaggtttggtcgtttagtttcgggttttttttcggtcgcggtttttttaggtattttcggcgttcgcggtcgtttcgttttcgtttcggggtcgttgttgcgcgcggggattttattttggagatcggcgttcgcgttgtttagttttcgtgtttttttcgttcgtttttcgtcggttttttcgttttcgttaaattaaataattcgttttgtgtttaagcgttcgtttttcgtagcgcggaggtcgttggggtcgcggcggtcgagggcggggtgggggggggggtcggcggttggtgagtttttcgttttttagttggttcgcgggtcgtttcgcgtggtattcggcgttttagtgggtttttcgttattgtcgtcggtgggcgcgaagggggaaagatggtcggagttggtgggaggatatttaattattt

SEQ ID NO: 9092 - DNA, 544 bp, Artificial Sequence
  chemically treated genomic DNA (Homo sapiens) CpG-island No: 9092
aaataattaaatatcctcccaccaactccgaccatctttcccccttcgcgcccaccgacgacaataacgaaaaacccactaaaacgccgaataccacgcgaaacgacccgcgaaccaactaaaaaacgaaaaactcaccaaccgccgacccccccccccaccccgccctcgaccgccgcgaccccaacgacctccgcgctacgaaaaacgaacgcttaaacacaaaacgaattatttaatttaacgaaaacgaaaaaaccgacgaaaaacgaacgaaaaaaacacgaaaactaaacaacgcgaacgccgatctccaaaataaaatccccgcgcgcaacaacgaccccgaaacgaaaacgaaacgaccgcgaacgccgaaaatacctaaaaaaaccgcgaccgaaaaaaaacccgaaactaaacgaccaaacctaccgaacgcgcgaacaaatacttcgactttttttttttttcccctcctcctttttcctctaccccttccttcctcgccctaaaataaaataaacgtaatactataacgcta

SEQ ID NO: 9093 - DNA, 502 bp, Artificial Sequence
  chemically treated genomic DNA (Homo sapiens) CpG-island No: 9093
gcggcggttgtttcgtggtatttcggaaatttgcgttagtttttggcgagtacgcgtttcgtgcgcgtttaggtttacgtttaggtttagagattatttcgcgtagggtcgttagggcggtttttcgttagtagagggcgtcgggtagcgtcgtttttcggggcgcgcgcggacgtttttttagtatgtttcgttttcgtcgacgtcgattcggaagttgtcgtcggcggtcggtcggcggttagtttttatataggttcggttgcggagcgtagtcgtttaggtttacggcggtagagggtcgaggttttcggagaggatcgcgatgagtttattttaggtcggggttgagtgtgggcgcgcggttttcggcggcgtgtgatttagttttcgtcggtcgttgttcgttgcgtgtgtaagtgttcgtgggttttagggttttgtagcgttcgtttcgaggtttcgaagaggtttttcgtttggggtagtgtgaaggttatag

SEQ ID NO: 9094 - DNA, 502 bp, Artificial Sequence
  chemically treated genomic DNA (Homo sapiens) CpG-island No: 9094
ctataaccttcacactaccccaaacgaaaaacctcttcgaaacctcgaaacgaacgctacaaaaccctaaaacccacgaacacttacacacgcaacgaacaacgaccgacgaaaactaaatcacacgccgccgaaaaccgcgcgcccacactcaaccccgacctaaaataaactcatcgcgatcctctccgaaaacctcgaccctctaccgccgtaaacctaaacgactacgctccgcaaccgaacctatataaaaactaaccgccgaccgaccgccgacgacaacttccgaatcgacgtcgacgaaaacgaaacatactaaaaaaacgtccgcgcgcgccccgaaaaacgacgctacccgacgccctctactaacgaaaaaccgccctaacgaccctacgcgaaataatctctaaacctaaacgtaaacctaaacgcgcacgaaacgcgtactcgccaaaaactaacgcaaatttccgaaataccacgaaacaaccgccgc

SEQ ID NO: 9095 - DNA, 502 bp, Artificial Sequence
  chemically treated genomic DNA (Homo sapiens) CpG-island No: 9095
ttgtggtttttatattgttttaggcggaaggttttttcggggtttcggggcgggcgttgtaaggttttggggtttacggatatttatatacgtagcgggtagcggtcggcgaagattgggttatacgtcgtcgggaatcgcgcgtttatatttagtttcgatttgaagtggatttatcgcggtttttttcgggagtttcggttttttgtcgtcgtaaatttgggcgattgcgtttcgtagtcgggtttgtgtgaaggttgatcgtcggtcggtcgtcggcgatagttttcgggtcgacgtcgacgggagcgaggtatgttgggagagcgttcgcgcgcgtttcgaggagcggcgttgttcggcgttttttgttggcgaggagtcgttttgacggttttgcgcgaggtagtttttgagtttgagcgtgagtttgagcgcgtacggggcgcgtgttcgttaagagttggcgtagattttcgaagtgttacgaaatagtcgtcgt

SEQ ID NO: 9096 - DNA, 502 bp, Artificial Sequence
  chemically treated genomic DNA (Homo sapiens) CpG-island No: 9096
acgacgactatttcgtaacacttcgaaaatctacgccaactcttaacgaacacgcgccccgtacgcgctcaaactcacgctcaaactcaaaaactacctcgcgcaaaaccgtcaaaacgactcctcgccaacaaaaaacgccgaacaacgccgctcctcgaaacgcgcgcgaacgctctcccaacatacctcgctcccgtcgacgtcgacccgaaaactatcgccgacgaccgaccgacgatcaaccttcacacaaacccgactacgaaacgcaatcgcccaaatttacgacgacaaaaaaccgaaactcccgaaaaaaaccgcgataaatccacttcaaatcgaaactaaatataaacgcgcgattcccgacgacgtataacccaatcttcgccgaccgctacccgctacgtatataaatatccgtaaaccccaaaaccttacaacgcccgccccgaaaccccgaaaaaaccttccgcctaaaacaatataaaaaccacaa

SEQ ID NO: 9097 - DNA, 950 bp, Artificial Sequence
  chemically treated genomic DNA (Homo sapiens) CpG-island No: 9097
  misc_feature (26)..(26): n is either a, c, g or t
  misc_feature (386)..(386): n is either a, c, g or t
  misc_feature (433)..(433): n is either a, c, g or t
  misc_feature (471)..(471): n is either a, c, g or t
  misc_feature (768)..(768): n is either a, c, g or t
  misc_feature (860)..(860): n is either a, c, g or t
  misc_feature (915)..(915): n is either a, c, g or t
  misc_feature (919)..(919): n is either a, c, g or t
gtttcgttttttacggtttagaagtngggtcgtatttttcgattagagttggggtattttaggaaatgcgggtgatcgtagttttttagattaaatttgttttttttattaacgagttggcgtatttatcgttttcgagtgtttcggtaagttagcgggagagtggcgtcgggttgcgagttttttgttttatcgagtgggggtagaaagtggttagaggcgcgtttcgcggggcgttgtaaatagattagagagcgttgcggaaagattattcgagaaaagagacggaaggcgggcgttcgggcgagggttcggggcgcgggagggtaagttcggtcggggcgggttagtagagtaataattgttatttatttgttcgtaaaggnaatcgcggggtcgcggcgtaggtacgtatttatttttcgtttttcgntttttcgtttttcgtttcgggaggaagcggaggggcgncggtgtaaatagagcggcggtcgtgatgttagtcggttatatggagttttttatggttcgggatggttttcggcgggcgggtagttgcggtagttgttgttgtggttcgggcggcggcggcgcggcggcggtagagggggtttcggggtcggattattcgttttttttgcgtttttcgtatcgcggtttaaatgatgtattttgtgatcgtagcgatgaaaggtgagttcgggcgtttcgtcggggtcgggtgggttggcggtttcggggggcggggaggagggcgcgtaggggganggggtgggcgcgtttgttcgaacgtacgtattgttcggggttcggcgcgggggttttgttagggttttttgggttatcgtcgcggcgttatnttgagttcggttacgggatcggtttgttttcgattggggggtaaaggcgtacggnggtnggatttttttttgttgtttttttcggttttt

SEQ ID NO: 9098 - DNA, 950 bp, Artificial Sequence
  chemically treated genomic DNA (Homo sapiens) CpG-island No: 9098
  misc_feature (32)..(32): n is either a, c, g or t
  misc_feature (36)..(36): n is either a, c, g or t
  misc_feature (91)..(91): n is either a, c, g or t
  misc_feature (183)..(183): n is either a, c, g or t
  misc_feature (480)..(480): n is either a, c, g or t
  misc_feature (518)..(518): n is either a, c, g or t
  misc_feature (565)..(565): n is either a, c, g or t
  misc_feature (925)..(925): n is either a, c, g or t
aaaaaccgaaaaaaacaacaaaaaaaaatccnaccnccgtacgcctttaccccccaatcgaaaacaaaccgatcccgtaaccgaactcaanataacgccgcgacgataacccaaaaaaccctaacaaaacccccgcgccgaaccccgaacaatacgtacgttcgaacaaacgcgcccaccccntccccctacgcgccctcctccccgccccccgaaaccgccaacccacccgaccccgacgaaacgcccgaactcacctttcatcgctacgatcacaaaatacatcatttaaaccgcgatacgaaaaacgcaaaaaaaacgaataatccgaccccgaaaccccctctaccgccgccgcgccgccgccgcccgaaccacaacaacaactaccgcaactacccgcccgccgaaaaccatcccgaaccataaaaaactccatataaccgactaacatcacgaccgccgctctatttacaccgncgcccctccgcttcctcccgaaacgaaaaacgaaaaancgaaaaacgaaaaataaatacgtacctacgccgcgaccccgcgattncctttacgaacaaataaataacaattattactctactaacccgccccgaccgaacttaccctcccgcgccccgaaccctcgcccgaacgcccgccttccgtctcttttctcgaataatctttccgcaacgctctctaatctatttacaacgccccgcgaaacgcgcctctaaccactttctacccccactcgataaaacaaaaaactcgcaacccgacgccactctcccgctaacttaccgaaacactcgaaaacgataaatacgccaactcgttaataaaaaaaacaaatttaatctaaaaaactacgatcacccgcatttcctaaaataccccaactctaatcgaaaaatacgacccnacttctaaaccgtaaaaaacgaaac

SEQ ID NO: 9099 - DNA, 950 bp, Artificial Sequence
  chemically treated genomic DNA (Homo sapiens) CpG-island No: 9099
  misc_feature (32)..(32): n is either a, c, g or t
  misc_feature (36)..(36): n is either a, c, g or t
  misc_feature (91)..(91): n is either a, c, g or t
  misc_feature (183)..(183): n is either a, c, g or t
  misc_feature (480)..(480): n is either a, c, g or t
  misc_feature (518)..(518): n is either a, c, g or t
  misc_feature (565)..(565): n is either a, c, g or t
  misc_feature (925)..(925): n is either a, c, g or t
aggagtcggagggggtagtagagggggatttnattntcgtgcgtttttgttttttaatcggaggtaggtcgatttcgtggtcgggtttagngtggcgtcgcggcggtggtttagaaggttttggtagggttttcgcgtcgagtttcgggtagtacgtgcgttcgggtaggcgcgtttattttntttttttgcgcgttttttttttcgtttttcggagtcgttagtttattcggtttcggcggggcgttcgggtttattttttatcgttgcgattataaaatatattatttaagtcgcggtgcggagagcgtagggagagcggatggttcgatttcggagttttttttgtcgtcgtcgcgtcgtcgtcgttcgagttatagtagtagttgtcgtagttgttcgttcgtcgagagttatttcgagttataagaggttttatgtgatcggttgatattacggtcgtcgttttgtttatatcgncgttttttcgttttttttcggggcgggaggcgggaggncgggaggcgggaggtaggtgcgtgtttgcgtcgcggtttcgcggttntttttgcgggtaggtgagtagtagttgttgttttgttggttcgtttcggtcgggtttgttttttcgcgtttcgggttttcgttcgggcgttcgtttttcgttttttttttcgagtaattttttcgtagcgttttttagtttgtttgtagcgtttcgcggaacgcgtttttgattattttttgtttttattcggtggggtaagaggttcgtaattcgacgttattttttcgttggtttgtcggagtattcgggggcgataaatgcgttagttcgttggtggaaaagataggtttggtttggggagttacggttattcgtattttttagagtgttttagttttaatcggaaggtacggtttnatttttgggtcgtggagaacgaagt

SEQ ID NO: 9100 - DNA, 950 bp, Artificial Sequence
  chemically treated genomic DNA (Homo sapiens) CpG-island No: 9100
  misc_feature (26)..(26): n is either a, c, g or t
  misc_feature (386)..(386): n is either a, c, g or t
  misc_feature (433)..(433): n is either a, c, g or t
  misc_feature (471)..(471): n is either a, c, g or t
  misc_feature (768)..(768): n is either a, c, g or t
  misc_feature (860)..(860): n is either a, c, g or t
  misc_feature (915)..(915): n is either a, c, g or t
  misc_feature (919)..(919): n is either a, c, g or t
acttcgttctccacgacccaaaaatnaaaccgtaccttccgattaaaactaaaacactctaaaaaatacgaataaccgtaactccccaaaccaaacctatcttttccaccaacgaactaacgcatttatcgcccccgaatactccgacaaaccaacgaaaaaataacgtcgaattacgaacctcttaccccaccgaataaaaacaaaaaataatcaaaaacgcgttccgcgaaacgctacaaacaaactaaaaaacgctacgaaaaaattactcgaaaaaaaaaacgaaaaacgaacgcccgaacgaaaacccgaaacgcgaaaaaacaaacccgaccgaaacgaaccaacaaaacaacaactactactcacctacccgcaaaaanaaccgcgaaaccgcgacgcaaacacgcacctacctcccgcctcccgncctcccgcctcccgccccgaaaaaaaacgaaaaaacgncgatataaacaaaacgacgaccgtaatatcaaccgatcacataaaacctcttataactcgaaataactctcgacgaacgaacaactacgacaactactactataactcgaacgacgacgacgcgacgacgacaaaaaaaactccgaaatcgaaccatccgctctccctacgctctccgcaccgcgacttaaataatatattttataatcgcaacgataaaaaataaacccgaacgccccgccgaaaccgaataaactaacgactccgaaaaacgaaaaaaaaaacgcgcaaaaaaanaaaataaacgcgcctacccgaacgcacgtactacccgaaactcgacgcgaaaaccctaccaaaaccttctaaaccaccgccgcgacgccacnctaaacccgaccacgaaatcgacctacctccgattaaaaaacaaaaacgcacganaatnaaatccccctctactaccccctccgactcct

SEQ ID NO: 9101 - DNA, 602 bp, Artificial Sequence
  chemically treated genomic DNA (Homo sapiens) CpG-island No: 9101
  misc_feature (360)..(360): n is either a, c, g or t
  misc_feature (435)..(435): n is either a, c, g or t
  misc_feature (453)..(453): n is either a, c, g or t
  misc_feature (461)..(461): n is either a, c, g or t
  misc_feature (474)..(474): n is either a, c, g or t
  misc_feature (480)..(480): n is either a, c, g or t
  misc_feature (507)..(507): n is either a, c, g or t
  misc_feature (516)..(516): n is either a, c, g or t
  misc_feature (528)..(528): n is either a, c, g or t
  misc_feature (550)..(550): n is either a, c, g or t
  misc_feature (574)..(574): n is either a, c, g or t
  misc_feature (592)..(592): n is either a, c, g or t
agtcgtcgcgtttcggaaaggaaggggagggtttgcggagtttagaggaagtcggggacgttcgcggtcggtttttagggttcgtattcgggatagtttcggtttaggtcggggaggcgtcgcggtcgggtagggtcgtgcgtgcgcgttgtcgcgatgttattttcggggattggttagcgttttaggttttgcgttttgtttttgcgttttcgagcgttttagcggtcgtcggtcgggtaagtgtcgtaggttcgcgttgtgtttcgcgttgtgtttcgtcgcggttattttcgaaagcgcgcgggtcggagcgagacgggcgtttcgagcgtgttaagacgttttgggcggtttagnggagtcgcggcgtatttcgtttgatattttggttggtggatggaggtggggaggaattcggtagtttacgggatntcgcgggtaggggcgganggttagantcgtggtgagggntcgatngggcgcgggttagtcgcggttaatttntgtcgggtnggttcggttttntcgtttttattaggatttcgtnattcgggtcgggggcgggaggggnagggggatttggttggangggaggattg

SEQ ID NO: 9102 - DNA, 602 bp, Artificial Sequence
  chemically treated genomic DNA (Homo sapiens) CpG-island No: 9102
  misc_feature (11)..(11): n is either a, c, g or t
  misc_feature (29)..(29): n is either a, c, g or t
  misc_feature (53)..(53): n is either a, c, g or t
  misc_feature (75)..(75): n is either a, c, g or t
  misc_feature (87)..(87): n is either a, c, g or t
  misc_feature (96)..(96): n is either a, c, g or t
  misc_feature (123)..(123): n is either a, c, g or t
  misc_feature (129)..(129): n is either a, c, g or t
  misc_feature (142)..(142): n is either a, c, g or t
  misc_feature (150)..(150): n is either a, c, g or t
  misc_feature (168)..(168): n is either a, c, g or t
  misc_feature (243)..(243): n is either a, c, g or t
caatcctcccntccaaccaaatccccctncccctcccgcccccgacccgaatnacgaaatcctaataaaaacganaaaaccgaaccnacccgacanaaattaaccgcgactaacccgcgcccnatcganccctcaccacgantctaaccntccgcccctacccgcganatcccgtaaactaccgaattcctccccacctccatccaccaaccaaaatatcaaacgaaatacgccgcgactccnctaaaccgcccaaaacgtcttaacacgctcgaaacgcccgtctcgctccgacccgcgcgctttcgaaaataaccgcgacgaaacacaacgcgaaacacaacgcgaacctacgacacttacccgaccgacgaccgctaaaacgctcgaaaacgcaaaaacaaaacgcaaaacctaaaacgctaaccaatccccgaaaataacatcgcgacaacgcgcacgcacgaccctacccgaccgcgacgcctccccgacctaaaccgaaactatcccgaatacgaaccctaaaaaccgaccgcgaacgtccccgacttcctctaaactccgcaaaccctccccttcctttccgaaacgcgacgact

SEQ ID NO: 9103 - DNA, 602 bp, Artificial Sequence
  chemically treated genomic DNA (Homo sapiens) CpG-island No: 9103
  misc_feature (11)..(11): n is either a, c, g or t
  misc_feature (29)..(29): n is either a, c, g or t
  misc_feature (53)..(53): n is either a, c, g or t
  misc_feature (75)..(75): n is either a, c, g or t
  misc_feature (87)..(87): n is either a, c, g or t
  misc_feature (96)..(96): n is either a, c, g or t
  misc_feature (123)..(123): n is either a, c, g or t
  misc_feature (129)..(129): n is either a, c, g or t
  misc_feature (142)..(142): n is either a, c, g or t
  misc_feature (150)..(150): n is either a, c, g or t
  misc_feature (168)..(168): n is either a, c, g or t
  misc_feature (243)..(243): n is either a, c, g or t
tagtttttttntttaattaaatttttttntttttttcgttttcggttcgggtnacggagttttgatgagggcggnaaggtcgggttngttcggtanggattggtcgcgattaattcgcgtttngtcggntttttattacggntttaattnttcgtttttgttcgcggnatttcgtgggttgtcgagtttttttttatttttatttattagttaaagtgttaagcggggtgcgtcgcggttttnttgggtcgtttagagcgttttggtacgttcgaggcgttcgtttcgtttcggttcgcgcgttttcggaagtggtcgcggcgggatatagcgcgggatatagcgcggatttgcggtatttgttcggtcggcggtcgttgaggcgttcggggacgtaggggtagggcgtaaggtttggggcgttgattagttttcggggatgatatcgcgataacgcgtacgtacggttttgttcggtcgcggcgttttttcgatttaggtcggagttgtttcgggtgcgggttttggggatcggtcgcgggcgttttcggttttttttgaatttcgtagattttttttttttttttcgaagcgcggcgatt

SEQ ID NO: 9104 - DNA, 602 bp, Artificial Sequence
  chemically treated genomic DNA (Homo sapiens) CpG-island No: 9104
  misc_feature (360)..(360): n is either a, c, g or t
  misc_feature (435)..(435): n is either a, c, g or t
  misc_feature (453)..(453): n is either a, c, g or t
  misc_feature (461)..(461): n is either a, c, g or t
  misc_feature (474)..(474): n is either a, c, g or t
  misc_feature (480)..(480): n is either a, c, g or t
  misc_feature (507)..(507): n is either a, c, g or t
  misc_feature (516)..(516): n is either a, c, g or t
  misc_feature (528)..(528): n is either a, c, g or t
  misc_feature (550)..(550): n is either a, c, g or t
  misc_feature (574)..(574): n is either a, c, g or t
  misc_feature (592)..(592): n is either a, c, g or t
aatcgccgcgcttcgaaaaaaaaaaaaaaaatctacgaaattcaaaaaaaaccgaaaacgcccgcgaccgatccccaaaacccgcacccgaaacaactccgacctaaatcgaaaaaacgccgcgaccgaacaaaaccgtacgtacgcgttatcgcgatatcatccccgaaaactaatcaacgccccaaaccttacgccctacccctacgtccccgaacgcctcaacgaccgccgaccgaacaaataccgcaaatccgcgctatatcccgcgctatatcccgccgcgaccacttccgaaaacgcgcgaaccgaaacgaaacgaacgcctcgaacgtaccaaaacgctctaaacgacccaanaaaaccgcgacgcaccccgcttaacactttaactaataaataaaaataaaaaaaaactcgacaacccacgaaatnccgcgaacaaaaacgaanaattaaanccgtaataaaaanccgacnaaacgcgaattaatcgcgaccaatccntaccgaacnaacccgaccttnccgccctcatcaaaactccgtnacccgaaccgaaaacgaaaaaaanaaaaaaatttaattaaanaaaaaaacta

SEQ ID NO: 9105 - DNA, 841 bp, Artificial Sequence
  chemically treated genomic DNA (Homo sapiens) CpG-island No: 9105
gttttcgtcgagttagtgggggttttcgagaaggcgtatttcgcggcgtcgggaattaggtagtcgcgttgttgtgggtagggagacgcgcgtagttttttggggttttttagttttcgggggtcggtttggaggttttacggaagcgtagaggagagtcgggcgttcgcggggaggggttgtttatttggggcggtggtaggaggtaggatttgaaggtgggtttgggcggtttgagggagaatatggtgtcgtcgttttttcgtttcgttttcgtcgcgggttagtggtagcgtcgacgttttcgggcgtaaagtttttagtgcggtcgtttaggttttttttgcggttagtcgagtcgggcggattgacgggcggggatacggcgtagcgttcgttcgagcggggaggggtcgggtatagttaggtcgacgcgggcgtcggggtttattttcggaaggggttcggtgtttcgtttcgagagacggcgcgcgtaaggtcgcggttcgtcgttttttgatcgtgtttcgtgttagtgtcggaacgtagcggtggcgttaggtgttcgttggcgggtttttagtcggggcgtcgcggggagcggagttcgacggttattttaagagcgcggtttttggagggtttttttacggcggttcgtaggggttaggcggttcgcgggggtttacggcggtttgcgggggttacggcggtagcggtggttgtttgggacggcggcgcggggcgttttttggtcgggttgtagttttgggatagtttttttgatttatatatgggtcgatttcgtttttcggtttgggcgagtattgttttgaagttt

SEQ ID NO: 9106 - DNA, 841 bp, Artificial Sequence
  chemically treated genomic DNA (Homo sapiens) CpG-island No: 9106
aaacttcaaaacaatactcgcccaaaccgaaaaacgaaatcgacccatatataaatcaaaaaaactatcccaaaactacaacccgaccaaaaaacgccccgcgccgccgtcccaaacaaccaccgctaccgccgtaacccccgcaaaccgccgtaaacccccgcgaaccgcctaacccctacgaaccgccgtaaaaaaaccctccaaaaaccgcgctcttaaaataaccgtcgaactccgctccccgcgacgccccgactaaaaacccgccaacgaacacctaacgccaccgctacgttccgacactaacacgaaacacgatcaaaaaacgacgaaccgcgaccttacgcgcgccgtctctcgaaacgaaacaccgaaccccttccgaaaataaaccccgacgcccgcgtcgacctaactatacccgacccctccccgctcgaacgaacgctacgccgtatccccgcccgtcaatccgcccgactcgactaaccgcaaaaaaaacctaaacgaccgcactaaaaactttacgcccgaaaacgtcgacgctaccactaacccgcgacgaaaacgaaacgaaaaaacgacgacaccatattctccctcaaaccgcccaaacccaccttcaaatcctacctcctaccaccgccccaaataaacaacccctccccgcgaacgcccgactctcctctacgcttccgtaaaacctccaaaccgacccccgaaaactaaaaaaccccaaaaaactacgcgcgtctccctacccacaacaacgcgactacctaattcccgacgccgcgaaatacgccttctcgaaaacccccactaactcgacgaaaac

SEQ ID NO: 9107 - DNA, 841 bp, Artificial Sequence
  chemically treated genomic DNA (Homo sapiens) CpG-island No: 9107
gagttttaaaataatgttcgtttaggtcggagggcgaagtcggtttatgtgtaagttaagggaattgttttaggattgtagttcggttagaagacgtttcgcgtcgtcgttttaggtagttatcgttgtcgtcgtggttttcgtaggtcgtcgtaggttttcgcgggtcgtttgatttttgcgggtcgtcgtagaaggattttttagaggtcgcgtttttgagatggtcgtcgggtttcgtttttcgcggcgtttcggttgagggttcgttagcgggtatttggcgttatcgttgcgtttcggtattagtacgggatacggttagggagcggcgggtcgcggttttgcgcgcgtcgtttttcggggcggggtatcgggtttttttcggggatgggtttcggcgttcgcgtcggtttggttgtgttcggttttttttcgttcgggcgggcgttgcgtcgtattttcgttcgttagttcgttcggttcggttggtcgtagaaagggtttgggcggtcgtattgagagttttacgttcggaggcgtcggcgttgttattggttcgcgacgggaacggggcgaaaaggcggcggtattatgtttttttttaagtcgtttaaatttatttttaggttttattttttgttatcgttttaggtaaataattttttttcgcgagcgttcgatttttttttgcgttttcgtggagtttttaggtcgattttcgggaattggaggattttaggaggttgcgcgcgtttttttgtttatagtagcgcggttgtttgattttcggcgtcgcgaaatgcgttttttcgggagtttttattggttcggcgaaaat

SEQ ID NO: 9108 - DNA, 841 bp, Artificial Sequence
  chemically treated genomic DNA (Homo sapiens) CpG-island No: 9108
attttcgccgaaccaataaaaactcccgaaaaaacgcatttcgcgacgccgaaaatcaaacaaccgcgctactataaacaaaaaaacgcgcgcaacctcctaaaatcctccaattcccgaaaatcgacctaaaaactccacgaaaacgcaaaaaaaaatcgaacgctcgcgaaaaaaaattatttacctaaaacgataacaaaaaataaaacctaaaaataaatttaaacgacttaaaaaaaaacataataccgccgccttttcgccccgttcccgtcgcgaaccaataacaacgccgacgcctccgaacgtaaaactctcaatacgaccgcccaaaccctttctacgaccaaccgaaccgaacgaactaacgaacgaaaatacgacgcaacgcccgcccgaacgaaaaaaaaccgaacacaaccaaaccgacgcgaacgccgaaacccatccccgaaaaaaacccgataccccgccccgaaaaacgacgcgcgcaaaaccgcgacccgccgctccctaaccgtatcccgtactaataccgaaacgcaacgataacgccaaatacccgctaacgaaccctcaaccgaaacgccgcgaaaaacgaaacccgacgaccatctcaaaaacgcgacctctaaaaaatccttctacgacgacccgcaaaaatcaaacgacccgcgaaaacctacgacgacctacgaaaaccacgacgacaacgataactacctaaaacgacgacgcgaaacgtcttctaaccgaactacaatcctaaaacaattcccttaacttacacataaaccgacttcgccctccgacctaaacgaacattattttaaaactc

SEQ ID NO: 9109 - DNA, 619 bp, Artificial Sequence
  chemically treated genomic DNA (Homo sapiens) CpG-island No: 9109
  misc_feature (487)..(487): n is either a, c, g or t
  misc_feature (509)..(509): n is either a, c, g or t
  misc_feature (541)..(541): n is either a, c, g or t
gtttttttcgttttagcgtcggttggggcgtcgggaatttcgttttgtagttttttagttgatagttcgaggggtttttcgagtttcgggtagggtggggacggaggcgcggcgggtattgtgttcgggttgcggggattttaattcgtcggcgttcgttcgggattttcgagcgagattagagttcgatttatatcgcgtatttattcggttcggtgcgggagtaatacggcgaggaaaggtagagttagtatttatcgcggtttggcgttttagttgtttcggcggtcgtcggttttttagtggcgttcgggggtgtatcgttcgttagcggtagttcgggtttttggagtttcgcgatttcggtgttgttttgaggtcgtatttcgcggtacgcgttttattagcggtcggtgtcgtttggcgttagtagtagcgtttgggttgtcgttttttcggcgggcgatggcgtttatgcgtatgcgtngttcggtttattcgtatttttnttttaaggagatcgcgcgcgtttttcgttggnttttttaatttggggagattcgttgtttttttggtcgggttgtggtgtttatagttggttttaaggcgtttaattttt

SEQ ID NO: 9110 - DNA, 619 bp, Artificial Sequence
  chemically treated genomic DNA (Homo sapiens) CpG-island No: 9110
  misc_feature (79)..(79): n is either a, c, g or t
  misc_feature (111)..(111): n is either a, c, g or t
  misc_feature (133)..(133): n is either a, c, g or t
aaaaattaaacgccttaaaaccaactataaacaccacaacccgaccaaaaaaacaacgaatctccccaaattaaaaaanccaacgaaaaacgcgcgcgatctccttaaaanaaaaatacgaataaaccgaacnacgcatacgcataaacgccatcgcccgccgaaaaaacgacaacccaaacgctactactaacgccaaacgacaccgaccgctaataaaacgcgtaccgcgaaatacgacctcaaaacaacaccgaaatcgcgaaactccaaaaacccgaactaccgctaacgaacgatacacccccgaacgccactaaaaaaccgacgaccgccgaaacaactaaaacgccaaaccgcgataaatactaactctacctttcctcgccgtattactcccgcaccgaaccgaataaatacgcgatataaatcgaactctaatctcgctcgaaaatcccgaacgaacgccgacgaattaaaatccccgcaacccgaacacaatacccgccgcgcctccgtccccaccctacccgaaactcgaaaaacccctcgaactatcaactaaaaaactacaaaacgaaattcccgacgccccaaccgacgctaaaacgaaaaaaac

SEQ ID NO: 9111 - DNA, 619 bp, Artificial Sequence
  chemically treated genomic DNA (Homo sapiens) CpG-island No: 9111
  misc_feature (79)..(79): n is either a, c, g or t
  misc_feature (111)..(111): n is either a, c, g or t
  misc_feature (133)..(133): n is either a, c, g or t
gagggttggacgttttagagttagttgtgggtattatagttcgattagggaggtagcgggtttttttaggttaagaggnttagcggaggacgcgcgcggtttttttggggngagggtgcgggtgggtcgggtngcgtatgcgtatgggcgttatcgttcgtcggaagagcggtagtttaggcgttgttgttggcgttagacggtatcggtcgttggtagagcgcgtgtcgcgagatgcggttttaggatagtatcggggtcgcggagttttaggagttcgggttgtcgttaacggacgatgtattttcgggcgttattgaggagtcggcggtcgtcgaggtagttggggcgttagatcgcggtaggtgttggttttgttttttttcgtcgtgttgttttcgtatcgagtcgggtgagtgcgcggtgtggatcgggttttggtttcgttcgggggtttcgagcgggcgtcggcgggttggggttttcgtaattcgggtatagtgttcgtcgcgttttcgtttttattttgttcggggttcgggaaatttttcgagttgttagttggggggttgtaaagcggaattttcggcgttttagtcggcgttaagacggaagaaat

SEQ ID NO: 9112 - DNA, 619 bp, Artificial Sequence
  chemically treated genomic DNA (Homo sapiens) CpG-island No: 9112
  misc_feature (487)..(487): n is either a, c, g or t
  misc_feature (509)..(509): n is either a, c, g or t
  misc_feature (541)..(541): n is either a, c, g or t
atttcttccgtcttaacgccgactaaaacgccgaaaattccgctttacaaccccccaactaacaactcgaaaaatttcccgaaccccgaacaaaataaaaacgaaaacgcgacgaacactatacccgaattacgaaaaccccaacccgccgacgcccgctcgaaacccccgaacgaaaccaaaacccgatccacaccgcgcactcacccgactcgatacgaaaacaacacgacgaaaaaaaacaaaaccaacacctaccgcgatctaacgccccaactacctcgacgaccgccgactcctcaataacgcccgaaaatacatcgtccgttaacgacaacccgaactcctaaaactccgcgaccccgatactatcctaaaaccgcatctcgcgacacgcgctctaccaacgaccgataccgtctaacgccaacaacaacgcctaaactaccgctcttccgacgaacgataacgcccatacgcatacgcnacccgacccacccgcaccctcnccccaaaaaaaccgcgcgcgtcctccgctaancctcttaacctaaaaaaacccgctacctccctaatcgaactataatacccacaactaactctaaaacgtccaaccctc

SEQ ID NO: 9113 - DNA, 566 bp, Artificial Sequence
  chemically treated genomic DNA (Homo sapiens) CpG-island No: 9113
ttggcggcggtggttgcggggtttattttcgtttttttttagtttcgtcgagtagtgggagggtaagtgttcgagacgttgttttttgtttcggtagtattcggttagaaggcgttttcgtcgttatttaggcgttgtatggtgagggtttagcggttagtttttttggggcgtttggcggtttttttcgtttcgcggcgttttgcgtttttcgttttattttcgttttttttcgttgtttttcggtcgttttttatttgtgttgtatttcgtgttatttttttgatacgtttacgtcgacgattaacgatcgttgtaggttcgggtcgttgtttggtcgttgtagggttcgcgcgttttttggaggttttggacgtcgtttggggcgtttcgacggttgggtgagatttagtagtttggttttagaattgaatttaggttgggtgagttttagcgggtttttagtcgtttgcgtggagttttagtcgggattgagtttcgaattttattttgtttttgtttttttgtttttttttcgagtatttcgtgtgtgttgggttgtgggt

SEQ ID NO: 9114 - DNA, 566 bp, Artificial Sequence
  chemically treated genomic DNA (Homo sapiens) CpG-island No: 9114
acccacaacccaacacacacgaaatactcgaaaaaaaaacaaaaaaacaaaaacaaaataaaattcgaaactcaatcccgactaaaactccacgcaaacgactaaaaacccgctaaaactcacccaacctaaattcaattctaaaaccaaactactaaatctcacccaaccgtcgaaacgccccaaacgacgtccaaaacctccaaaaaacgcgcgaaccctacaacgaccaaacaacgacccgaacctacaacgatcgttaatcgtcgacgtaaacgtatcaaaaaaataacacgaaatacaacacaaataaaaaacgaccgaaaaacaacgaaaaaaaacgaaaataaaacgaaaaacgcaaaacgccgcgaaacgaaaaaaaccgccaaacgccccaaaaaaactaaccgctaaaccctcaccatacaacgcctaaataacgacgaaaacgccttctaaccgaatactaccgaaacaaaaaacaacgtctcgaacacttaccctcccactactcgacgaaactaaaaaaaaacgaaaataaaccccgcaaccaccgccgccaa

SEQ ID NO: 9115 - DNA, 566 bp, Artificial Sequence
  chemically treated genomic DNA (Homo sapiens) CpG-island No: 9115
gtttatagtttagtatatacgaggtattcggggaagaaatagggagataaaggtaaagtaaagttcgaggtttagtttcggttagaattttacgtaaacgattaggagttcgttaaagtttatttagtttgaatttaattttgaaattagattgttgaattttatttagtcgtcgggacgttttagacggcgtttaaagtttttaggggacgcgcggattttataacggttaggtagcggttcgggtttgtagcggtcgttggtcgtcggcgtaagcgtgttaggaaaataatacgaaatgtagtataggtgggaagcggtcggaaggtagcgggggagagcggaaataaggcggagagcgtagggcgtcgcggggcggaagaggtcgttagacgttttaaagagattggtcgttgggtttttattatgtagcgtttgggtgacggcgagggcgttttttggtcggatgttgtcggggtaggaagtagcgtttcggatatttgtttttttattgttcgacggggttggggaaggacgagggtgaatttcgtagttatcgtcgttag

SEQ ID NO: 9116 - DNA, 566 bp, Artificial Sequence
  chemically treated genomic DNA (Homo sapiens) CpG-island No: 9116
ctaacgacgataactacgaaattcaccctcgtccttccccaaccccgtcgaacaataaaaaaacaaatatccgaaacgctacttcctaccccgacaacatccgaccaaaaaacgccctcgccgtcacccaaacgctacataataaaaacccaacgaccaatctctttaaaacgtctaacgacctcttccgccccgcgacgccctacgctctccgccttatttccgctctcccccgctaccttccgaccgcttcccacctatactacatttcgtattattttcctaacacgcttacgccgacgaccaacgaccgctacaaacccgaaccgctacctaaccgttataaaatccgcgcgtcccctaaaaactttaaacgccgtctaaaacgtcccgacgactaaataaaattcaacaatctaatttcaaaattaaattcaaactaaataaactttaacgaactcctaatcgtttacgtaaaattctaaccgaaactaaacctcgaactttactttacctttatctccctatttcttccccgaatacctcgtatatactaaactataaac

SEQ ID NO: 9117 - DNA, 518 bp, Artificial Sequence
  chemically treated genomic DNA (Homo sapiens) CpG-island No: 9117
  misc_feature (126)..(126): n is either a, c, g or t
  misc_feature (461)..(461): n is either a, c, g or t
gggcgtttgtttacgggtttgtacgggagcgtatcgtcgttcggttcgggggcgttcgtggcgttgggagcgagagtttcggcggcggttgcgggtagggcgcgcggagcgggttgtaggtgcggngcggaggtcggcggggggcgtcgggggcgttgcgcggtttttggcggcgggggcgcgcggggtggcgggggaggtcgaggcgtcggtagtttcgcgtcggcggttggaagcgggcgggttgtacgggcggttcgagtgcggggattttagtttttcgttttcgtgagcgtcgtttttgttatttgttgttaagttatcggattggggatgcggggggcggggtgcggggagaggaaagcgtcgcgggtggtacggtgtttttggcgatagagtagatggattcgaaagagattcgaggtgatttcgggttgggtaggatattttcgggagttgtntagcggtttttagcgggcgtttttaggattttttgttattgcgagtagcgtttgttt

SEQ ID NO: 9118 - DNA, 518 bp, Artificial Sequence
  chemically treated genomic DNA (Homo sapiens) CpG-island No: 9118
  misc_feature (58)..(58): n is either a, c, g or t
  misc_feature (393)..(393): n is either a, c, g or t
aaacaaacgctactcgcaataacaaaaaatcctaaaaacgcccgctaaaaaccgctanacaactcccgaaaatatcctacccaacccgaaatcacctcgaatctctttcgaatccatctactctatcgccaaaaacaccgtaccacccgcgacgctttcctctccccgcaccccgccccccgcatccccaatccgataacttaacaacaaataacaaaaacgacgctcacgaaaacgaaaaactaaaatccccgcactcgaaccgcccgtacaacccgcccgcttccaaccgccgacgcgaaactaccgacgcctcgacctcccccgccaccccgcgcgcccccgccgccaaaaaccgcgcaacgcccccgacgccccccgccgacctccgcnccgcacctacaacccgctccgcgcgccctacccgcaaccgccgccgaaactctcgctcccaacgccacgaacgcccccgaaccgaacgacgatacgctcccgtacaaacccgtaaacaaacgccc

SEQ ID NO: 9119 - DNA, 518 bp, Artificial Sequence
  chemically treated genomic DNA (Homo sapiens) CpG-island No: 9119
  misc_feature (58)..(58): n is either a, c, g or t
  misc_feature (393)..(393): n is either a, c, g or t
gagtaggcgttgttcgtagtgataaggggttttagaggcgttcgttgagagtcgttgngtaattttcgggggtgttttgtttagttcgaagttatttcgggtttttttcgggtttatttattttgtcgttagaggtatcgtgttattcgcggcgttttttttttttcgtatttcgtttttcgtatttttagttcggtgatttggtagtaggtggtaggggcggcgtttacgagggcgaggggttggggttttcgtattcgagtcgttcgtgtagttcgttcgtttttagtcgtcggcgcgaagttgtcggcgtttcggtttttttcgttatttcgcgcgttttcgtcgttaagggtcgcgtagcgttttcggcgtttttcgtcggttttcgtntcgtatttgtagttcgtttcgcgcgttttgttcgtagtcgtcgtcgaagttttcgtttttagcgttacggacgttttcgggtcgagcggcggtgcgttttcgtgtagattcgtggatagacgttt

SEQ ID NO: 9120 - DNA, 518 bp, Artificial Sequence
  chemically treated genomic DNA (Homo sapiens) CpG-island No: 9120
  misc_feature (126)..(126): n is either a, c, g or t
  misc_feature (461)..(461): n is either a, c, g or t
aaacgtctatccacgaatctacacgaaaacgcaccgccgctcgacccgaaaacgtccgtaacgctaaaaacgaaaacttcgacgacgactacgaacaaaacgcgcgaaacgaactacaaatacganacgaaaaccgacgaaaaacgccgaaaacgctacgcgacccttaacgacgaaaacgcgcgaaataacgaaaaaaaccgaaacgccgacaacttcgcgccgacgactaaaaacgaacgaactacacgaacgactcgaatacgaaaaccccaacccctcgccctcgtaaacgccgcccctaccacctactaccaaatcaccgaactaaaaatacgaaaaacgaaatacgaaaaaaaaaaaacgccgcgaataacacgatacctctaacgacaaaataaataaacccgaaaaaaacccgaaataacttcgaactaaacaaaacacccccgaaaattacncaacgactctcaacgaacgcctctaaaaccccttatcactacgaacaacgcctactc

SEQ ID NO: 9121 - DNA, 840 bp, Artificial Sequence
  chemically treated genomic DNA (Homo sapiens) CpG-island No: 9121
  misc_feature (21)..(21): n is either a, c, g or t
  misc_feature (221)..(221): n is either a, c, g or t
  misc_feature (275)..(275): n is either a, c, g or t
  misc_feature (286)..(286): n is either a, c, g or t
  misc_feature (373)..(373): n is either a, c, g or t
  misc_feature (435)..(435): n is either a, c, g or t
  misc_feature (456)..(456): n is either a, c, g or t
  misc_feature (463)..(463): n is either a, c, g or t
  misc_feature (490)..(490): n is either a, c, g or t
  misc_feature (592)..(593): n is either a, c, g or t
  misc_feature (607)..(607): n is either a, c, g or t
  misc_feature (609)..(609): n is either a, c, g or t
  misc_feature (612)..(612): n is either a, c, g or t
  misc_feature (633)..(633): n is either a, c, g or t
  misc_feature (655)..(655): n is either a, c, g or t
  misc_feature (657)..(657): n is either a, c, g or t
  misc_feature (662)..(662): n is either a, c, g or t
  misc_feature (667)..(667): n is either a, c, g or t
  misc_feature (698)..(698): n is either a, c, g or t
  misc_feature (705)..(705): n is either a, c, g or t
  misc_feature (707)..(707): n is either a, c, g or t
  misc_feature (716)..(716): n is either a, c, g or t
  misc_feature (742)..(742): n is either a, c, g or t
  misc_feature (750)..(750): n is either a, c, g or t
  misc_feature (754)..(754): n is either a, c, g or t
  misc_feature (776)..(776): n is either a, c, g or t
  misc_feature (800)..(800): n is either a, c, g or t
  misc_feature (812)..(812): n is either a, c, g or t
tcggggcgtttttttttcgtntcgttttttcgtttttttcgttttcgcgtttcgtttcgttttcgcgtttttcgttttttttcgttttttttttttttttttttttgtcgtttttttagttaacgattttttttttttcgtttcgtttttttttttttttcgttttttttttttcgtgttcggggtcgttatttttttttttttttttcgttcgcgcgttntgtttttttttttttttttatcgtttttagcggttagcgattcgttatcgattntttcgattttngttcgttgtttgggtttggtcgtcgttcgttcgttttcgttgtgtggcgtttttcgtatatatacgtgcgcgcgttcggttcgtcgntgcgttcggtatttgcgggacgtttttttcgtcgttttttcgtcggttttttcgcgatattntttttacgtcgtttttttcgntcgtttntcgtattcgttacgaaaatacgtacgntagttgttttttttttttcggggttttcgtcgtgttcgttcgtgtcgcgttcgtttcgtaagttaattcgcgtatcgtagtatagagcgatacgttatattnncgaagaaagtttgngncgncgcgtagtgagtgcgacgagntagtttttttggtgatttaatntnttgtncgatnttttttcgcgtacgagcggcggtagtttttntaggtgntntcgtttcgnttttatcgtaacgcggcgtttcgcgngaatttantggntcgttagcgatatttttatatntatattaatgtagagattattgtnttttcgcgtttnttcgcgttcgcgaggtagtttttagtta

SEQ ID NO: 9122 - DNA, 840 bp, Artificial Sequence
  chemically treated genomic DNA (Homo sapiens) CpG-island No: 9122
  misc_feature (29)..(29): n is either a, c, g or t
  misc_feature (41)..(41): n is either a, c, g or t
  misc_feature (65)..(65): n is either a, c, g or t
  misc_feature (87)..(87): n is either a, c, g or t
  misc_feature (91)..(91): n is either a, c, g or t
  misc_feature (99)..(99): n is either a, c, g or t
  misc_feature (125)..(125): n is either a, c, g or t
  misc_feature (134)..(134): n is either a, c, g or t
  misc_feature (136)..(136): n is either a, c, g or t
  misc_feature (143)..(143): n is either a, c, g or t
  misc_feature (174)..(174): n is either a, c, g or t
  misc_feature (179)..(179): n is either a, c, g or t
  misc_feature (184)..(184): n is either a, c, g or t
  misc_feature (186)..(186): n is either a, c, g or t
  misc_feature (208)..(208): n is either a, c, g or t
  misc_feature (229)..(229): n is either a, c, g or t
  misc_feature (232)..(232): n is either a, c, g or t
  misc_feature (234)..(234): n is either a, c, g or t
  misc_feature (248)..(249): n is either a, c, g or t
  misc_feature (351)..(351): n is either a, c, g or t
  misc_feature (378)..(378): n is either a, c, g or t
  misc_feature (385)..(385): n is either a, c, g or t
  misc_feature (406)..(406): n is either a, c, g or t
  misc_feature (468)..(468): n is either a, c, g or t
  misc_feature (555)..(555): n is either a, c, g or t
  misc_feature (566)..(566): n is either a, c, g or t
  misc_feature (620)..(620): n is either a, c, g or t
  misc_feature (820)..(820): n is either a, c, g or t
taactaaaaactacctcgcgaacgcgaanaaacgcgaaaanacaataatctctacattaatatanatataaaaatatcgctaacganccantaaattcncgcgaaacgccgcgttacgataaaancgaaacganancacctanaaaaactaccgccgctcgtacgcgaaaaaanatcgnacaananattaaatcaccaaaaaaactanctcgtcgcactcactacgcgncgncncaaactttcttcgnnaatataacgtatcgctctatactacgatacgcgaattaacttacgaaacgaacgcgacacgaacgaacacgacgaaaaccccgaaaaaaaaaaaacaactancgtacgtattttcgtaacgaatacganaaacgancgaaaaaaacgacgtaaaaanaatatcgcgaaaaaaccgacgaaaaaacgacgaaaaaaacgtcccgcaaataccgaacgcancgacgaaccgaacgcgcgcacgtatatatacgaaaaacgccacacaacgaaaacgaacgaacgacgaccaaacccaaacaacgaacnaaaatcgaaanaatcgataacgaatcgctaaccgctaaaaacgataaaaaaaaaaaaaaaaacanaacgcgcgaacgaaaaaaaaaaaaaaaaataacgaccccgaacacgaaaaaaaaaaaacgaaaaaaaaaaaaaaacgaaacgaaaaaaaaaaaatcgttaactaaaaaaacgacaaaaaaaaaaaaaaaaaaaaaacgaaaaaaaacgaaaaacgcgaaaacgaaacgaaacgcgaaaacgaaaaaaacgaaaaaacganacgaaaaaaaaacgccccga

SEQ ID NO: 9123 - DNA, 840 bp, Artificial Sequence
  chemically treated genomic DNA (Homo sapiens) CpG-island No: 9123
  misc_feature (29)..(29): n is either a, c, g or t
  misc_feature (41)..(41): n is either a, c, g or t
  misc_feature (65)..(65): n is either a, c, g or t
  misc_feature (87)..(87): n is either a, c, g or t
  misc_feature (91)..(91): n is either a, c, g or t
  misc_feature (99)..(99): n is either a, c, g or t
  misc_feature (125)..(125): n is either a, c, g or t
  misc_feature (134)..(134): n is either a, c, g or t
  misc_feature (136)..(136): n is either a, c, g or t
  misc_feature (143)..(143): n is either a, c, g or t
  misc_feature (174)..(174): n is either a, c, g or t
  misc_feature (179)..(179): n is either a, c, g or t
  misc_feature (184)..(184): n is either a, c, g or t
  misc_feature (186)..(186): n is either a, c, g or t
  misc_feature (208)..(208): n is either a, c, g or t
  misc_feature (229)..(229): n is either a, c, g or t
  misc_feature (232)..(232): n is either a, c, g or t
  misc_feature (234)..(234): n is either a, c, g or t
  misc_feature (248)..(249): n is either a, c, g or t
  misc_feature (351)..(351): n is either a, c, g or t
  misc_feature (378)..(378): n is either a, c, g or t
  misc_feature (385)..(385): n is either a, c, g or t
  misc_feature (406)..(406): n is either a, c, g or t
  misc_feature (468)..(468): n is either a, c, g or t
  misc_feature (555)..(555): n is either a, c, g or t
  misc_feature (566)..(566): n is either a, c, g or t
  misc_feature (620)..(620): n is either a, c, g or t
  misc_feature (820)..(820): n is either a, c, g or t
tgattgggggttgtttcgcgggcgcggangggcgcggaagngtagtagtttttgtattagtgtgngtgtgggggtgtcgttggcggnttantagatttncgcggggcgtcgcgttacgatggagncggagcganantatttgngggggttgtcgtcgttcgtgcgcgggaggangtcgngtaangngttgggttattaggagagttanttcgtcgtatttattgcgcgncgntntagatttttttcgnnggtgtggcgtgtcgttttatgttgcgatgcgcgggttaatttgcgagacgaacgcggtacgagcgagtacggcggagatttcgggggagaggaggtaattgncgtgcgtattttcgtgacgggtacganagacggncgggggaggcgacgtggagangatgtcgcgagagggtcggcggagaggcggcggaaggggcgtttcgtaggtgtcgagcgtancggcgggtcgggcgcgcgtacgtatgtgtgcgggaggcgttatatagcgggggcgggcgagcggcggttaggtttaggtagcggatnaggatcgaagnaatcggtggcgggtcgttggtcgttagagacggtggggagagaggggggggtanggcgcgcgagcgggaggagggaggaagagtggcggtttcgggtacggggaggggggggcggggaagggggggggacgaggcgagggggaggaggtcgttggttgggagggcggtaggaggggggaaggggggggggcgaggaggaacgaggaacgcgggaacggggcggggcgcgggggcgggaggaacgggggggcganacgggggggggacgtttcgg

SEQ ID NO: 9124 - DNA, 840 bp, Artificial Sequence
  chemically treated genomic DNA (Homo sapiens) CpG-island No: 9124
  misc_feature (21)..(21): n is either a, c, g or t
  misc_feature (221)..(221): n is either a, c, g or t
  misc_feature (275)..(275): n is either a, c, g or t
  misc_feature (286)..(286): n is either a, c, g or t
  misc_feature (373)..(373): n is either a, c, g or t
  misc_feature (435)..(435): n is either a, c, g or t
  misc_feature (456)..(456): n is either a, c, g or t
  misc_feature (463)..(463): n is either a, c, g or t
  misc_feature (490)..(490): n is either a, c, g or t
  misc_feature (592)..(593): n is either a, c, g or t
  misc_feature (607)..(607): n is either a, c, g or t
  misc_feature (609)..(609): n is either a, c, g or t
  misc_feature (612)..(612): n is either a, c, g or t
  misc_feature (633)..(633): n is either a, c, g or t
  misc_feature (655)..(655): n is either a, c, g or t
  misc_feature (657)..(657): n is either a, c, g or t
  misc_feature (662)..(662): n is either a, c, g or t
  misc_feature (667)..(667): n is either a, c, g or t
  misc_feature (698)..(698): n is either a, c, g or t
  misc_feature (705)..(705): n is either a, c, g or t
  misc_feature (707)..(707): n is either a, c, g or t
  misc_feature (716)..(716): n is either a, c, g or t
  misc_feature (742)..(742): n is either a, c, g or t
  misc_feature (750)..(750): n is either a, c, g or t
  misc_feature (754)..(754): n is either a, c, g or t
  misc_feature (776)..(776): n is either a, c, g or t
  misc_feature (800)..(800): n is either a, c, g or t
  misc_feature (812)..(812): n is either a, c, g or t
ccgaaacgtcccccccccgtntcgcccccccgttcctcccgcccccgcgccccgccccgttcccgcgttcctcgttcctcctcgccccccccccttcccccctcctaccgccctcccaaccaacgacctcctccccctcgcctcgtcccccccccttccccgcccccccctccccgtacccgaaaccgccactcttcctccctcctcccgctcgcgcgccntacccccccctctctccccaccgtctctaacgaccaacgacccgccaccgattncttcgatcctnatccgctacctaaacctaaccgccgctcgcccgcccccgctatataacgcctcccgcacacatacgtacgcgcgcccgacccgccgntacgctcgacacctacgaaacgccccttccgccgcctctccgccgaccctctcgcgacatcntctccacgtcgcctcccccgnccgtctntcgtacccgtcacgaaaatacgcacgncaattacctcctctcccccgaaatctccgccgtactcgctcgtaccgcgttcgtctcgcaaattaacccgcgcatcgcaacataaaacgacacgccacaccnncgaaaaaaatctanancgncgcgcaataaatacgacgaantaactctcctaataacccaacncnttacncgacntcctcccgcgcacgaacgacgacaacccccncaaatantntcgctccgnctccatcgtaacgcgacgccccgcgnaaatctantaanccgccaacgacacccccacacncacactaatacaaaaactactacncttccgcgcccntccgcgcccgcgaaacaacccccaatca

SEQ ID NO: 9125 - DNA, 1057 bp, Artificial Sequence
  chemically treated genomic DNA (Homo sapiens) CpG-island No: 9125
  misc_feature (89)..(89): n is either a, c, g or t
ggttttcggcgcgggcggacgggcggtttatttggaggcgttggtttcggttagtcggttgtttatgatgtttagcgcgtttacgtcgntcgagaagtcgttttggcgcgtgttgacgtatacgttgcgcgggtagtcgttggtcgttttcgatagttgtttttgtagtagcgttagcgatattttgttggaggtcgtgaggtcgcgtatggagatgagttcgttcgagaggcggcggttttcggcgtcgttgtcgcggttcgcggggtcggtatcgagcgcggttaggcggcgcgtagtcgtgagtttggggtgatggtattgcgtcgggttaggggcgcgttaggagtcgggtagtagcgcgcgtagtagcggtagtttagtttgcgtagtatttagttgagtatttgtttgatgaggatggagatgacgttgaagagcgagtaaatgtagtatacgtcgagtaggatgaagaggaagttgtttaggcggtagagtttttggtttcggtaggcggcgtgttggttgtttattaggttttcgaagtcgatggtgttgaaggtgacgaagtagaagtagagcgagtttacgtagttttagttttttacgttggtgtatatggtcgaggcgtagtaggatagtagtacggcgaataggtttaggatgagtagtacgtggtatatcgagggtttttagttcgttaggttgtcggttttcgagagcgcggagtcgcggcggaaggtggcgggtagtaggtcgttgcggcgtagttggcgttttcggtaggcgcgtatgatgaaggttagtagcgagatgatgcgttttaggaagaggttgaagaataggatggttttagcgtagtcgaatagttcgtaggcgatgaggaaggttttttcgtttatcgtcgcgggggtggttatgtcgaaatttgtggagatagggtagggttagcgcggttttggtcgcgtaggtggtttttattgggcgagggtggggggtgtgggggcgggtgtatgtaggttttgcgcggtttttatttcgagtggtattatttagg

SEQ ID NO: 9126 - DNA, 1057 bp, Artificial Sequence
  chemically treated genomic DNA (Homo sapiens) CpG-island No: 9126
  misc_feature (969)..(969): n is either a, c, g or t
cctaaataataccactcgaaataaaaaccgcgcaaaacctacatacacccgcccccacaccccccaccctcgcccaataaaaaccacctacgcgaccaaaaccgcgctaaccctaccctatctccacaaatttcgacataaccacccccgcgacgataaacgaaaaaaccttcctcatcgcctacgaactattcgactacgctaaaaccatcctattcttcaacctcttcctaaaacgcatcatctcgctactaaccttcatcatacgcgcctaccgaaaacgccaactacgccgcaacgacctactacccgccaccttccgccgcgactccgcgctctcgaaaaccgacaacctaacgaactaaaaaccctcgatataccacgtactactcatcctaaacctattcgccgtactactatcctactacgcctcgaccatatacaccaacgtaaaaaactaaaactacgtaaactcgctctacttctacttcgtcaccttcaacaccatcgacttcgaaaacctaataaacaaccaacacgccgcctaccgaaaccaaaaactctaccgcctaaacaacttcctcttcatcctactcgacgtatactacatttactcgctcttcaacgtcatctccatcctcatcaaacaaatactcaactaaatactacgcaaactaaactaccgctactacgcgcgctactacccgactcctaacgcgcccctaacccgacgcaataccatcaccccaaactcacgactacgcgccgcctaaccgcgctcgataccgaccccgcgaaccgcgacaacgacgccgaaaaccgccgcctctcgaacgaactcatctccatacgcgacctcacgacctccaacaaaatatcgctaacgctactacaaaaacaactatcgaaaacgaccaacgactacccgcgcaacgtatacgtcaacacgcgccaaaacgacttctcgancgacgtaaacgcgctaaacatcataaacaaccgactaaccgaaaccaacgcctccaaataaaccgcccgtccgcccgcgccgaaaacc

SEQ ID NO: 9127 - DNA, 1057 bp, Artificial Sequence
  chemically treated genomic DNA (Homo sapiens) CpG-island No: 9127
  misc_feature (969)..(969): n is either a, c, g or t
tttgagtggtgttattcgagataggagtcgcgtaagatttgtatgtattcgtttttatattttttattttcgtttagtgaggattatttgcgcggttaggatcgcgttgattttgttttgtttttataggtttcggtatgattattttcgcgacggtgggcgggaaggttttttttatcgtttacgggttgttcggttgcgttgggattattttgttttttaatttttttttggagcgtattatttcgttgttggtttttattatgcgcgtttgtcgggagcgttagttgcgtcgtagcggtttgttgttcgttatttttcgtcgcggtttcgcgttttcggaggtcgatagtttggcgggttggaagttttcggtgtattacgtgttgtttattttgggtttgttcgtcgtgttgttgttttgttgcgtttcggttatgtatattagcgtggagggttgggattacgtggattcgttttatttttgtttcgttatttttagtattatcggtttcggggatttggtgagtagttagtacgtcgtttatcggaattaggggttttatcgtttgggtaattttttttttattttgttcggcgtgtgttgtatttattcgttttttaacgttatttttatttttattaagtaggtgtttaattggatgttgcgtaagttgagttgtcgttgttgcgcgcgttgttgttcggtttttggcgcgtttttggttcggcgtaatgttattattttaggtttacggttgcgcgtcgtttggtcgcgttcggtgtcgatttcgcgggtcgcgatagcgacgtcgagggtcgtcgtttttcgggcgagtttatttttatgcgcgattttacggtttttaataaggtgtcgttggcgttgttgtagaagtagttgtcggagacggttaacggttattcgcgtagcgtgtgcgttaatacgcgttagaacggtttttcggncggcgtgggcgcgttgggtattatgaataatcggttggtcgagattagcgtttttaggtagatcgttcgttcgttcgcgtcggggatt

SEQ ID NO: 9128 - DNA, 1057 bp, Artificial Sequence
  chemically treated genomic DNA (Homo sapiens) CpG-island No: 9128
  misc_feature (89)..(89): n is either a, c, g or t
aatccccgacgcgaacgaacgaacgatctacctaaaaacgctaatctcgaccaaccgattattcataatacccaacgcgcccacgccgnccgaaaaaccgttctaacgcgtattaacgcacacgctacgcgaataaccgttaaccgtctccgacaactacttctacaacaacgccaacgacaccttattaaaaaccgtaaaatcgcgcataaaaataaactcgcccgaaaaacgacgaccctcgacgtcgctatcgcgacccgcgaaatcgacaccgaacgcgaccaaacgacgcgcaaccgtaaacctaaaataataacattacgccgaaccaaaaacgcgccaaaaaccgaacaacaacgcgcgcaacaacgacaactcaacttacgcaacatccaattaaacacctacttaataaaaataaaaataacgttaaaaaacgaataaatacaacacacgccgaacaaaataaaaaaaaaattacccaaacgataaaacccctaattccgataaacgacgtactaactactcaccaaatccccgaaaccgataatactaaaaataacgaaacaaaaataaaacgaatccacgtaatcccaaccctccacgctaatatacataaccgaaacgcaacaaaacaacaacacgacgaacaaacccaaaataaacaacacgtaatacaccgaaaacttccaacccgccaaactatcgacctccgaaaacgcgaaaccgcgacgaaaaataacgaacaacaaaccgctacgacgcaactaacgctcccgacaaacgcgcataataaaaaccaacaacgaaataatacgctccaaaaaaaaattaaaaaacaaaataatcccaacgcaaccgaacaacccgtaaacgataaaaaaaaccttcccgcccaccgtcgcgaaaataatcataccgaaacctataaaaacaaaacaaaatcaacgcgatcctaaccgcgcaaataatcctcactaaacgaaaataaaaaatataaaaacgaatacatacaaatcttacgcgactcctatctcgaataacaccactcaaa

SEQ ID NO: 9129 - DNA, 1307 bp, Artificial Sequence
  chemically treated genomic DNA (Homo sapiens) CpG-island No: 9129
tttcgtttcgggcgttagtgatttcgtttttttttgtcgggcggtttttcggttggagttgagaaaggagcgttttttcggattcggttcggtttcgaggttttgaagtcgacgtcgttagtttagtttcgggggcgggagtaggattgttcgtatagttcgtatttaggaggcgtcgatttcgaacgttttatgggacgttttcgggggttttttttacgttttgttgtcgcgtttcggttttaggcgttcgggatttacggtttatttcgttcgtagttcgcggtttgtttggagaggagtatgaggttcggggtttcgcggacgtcggttatcgggcggtaggggtttagttgcggagtttcgcgttcgagagcggcgggtaaggagtcgcgggagtcggcgaggcgtcggggcgcgtagaggagcgtttttgttcgggtattcgttgggttacgggattcgcgtgtggtttgagcgtcggggaggaggcggaggcgtttttttgttcgggttttgggaaggcgacgagggggttttgcgaaggcggcgagggcgttcgcggcggtttcggatttttggttattatttttacgtttttgttttcgtcggggggatgtcgtggttcgggtttcgagcgtcgttttggtttcggggttgagtttcggattatgttttttcgtagttttcggttttcgtttcgtcgtagtcgtcgtcgtttgtcgcgttttttttgttgttgttgttgttgtcgtcgttcgtattttaacgaggatatcggtcgtttcgtgttgttggcggcgtttatcggtttttattttggtggcgggtgttatagttttttcggcgttcgagagtttcggcgaggcggaggcgcgggcgcgttggggcgttatcgtgcgtaattttaagcgtgcgtacggcgtggtcgagttagtagtgcgcgttttttttcggtattacgaggtcgcgttggtcgtcggcgttcgcgtcgacgcgtgcgttcgcgttgggattttttcggcgttttttatttcgtgggtatcgtggtgttaattataggtgagcggcgcgtttttcgcgtattttttttttttgtgttttttatttgtcgttttttttattgttcggtcgttcggttcgcgtttttcggttttgtttttttttttaatgtttttttgtttattttcgtttcgttttttttttcgtcggttttcgttttttttttttttttttttttcggtttttagtgagggaagaaagtttatttttggcgtttatttcgggtcgtttgtgttttaatattg

SEQ ID NO: 9130 - DNA, 1307 bp, Artificial Sequence
  chemically treated genomic DNA (Homo sapiens) CpG-island No: 9130
caatattaaaacacaaacgacccgaaataaacgccaaaaataaactttcttccctcactaaaaaccgaaaaaaaaaaaaaaaaaaaaaacgaaaaccgacgaaaaaaaaaacgaaacgaaaataaacaaaaaaacattaaaaaaaaaaacaaaaccgaaaaacgcgaaccgaacgaccgaacaataaaaaaaacgacaaataaaaaacacaaaaaaaaaaaatacgcgaaaaacgcgccgctcacctataattaacaccacgatacccacgaaataaaaaacgccgaaaaaatcccaacgcgaacgcacgcgtcgacgcgaacgccgacgaccaacgcgacctcgtaataccgaaaaaaaacgcgcactactaactcgaccacgccgtacgcacgcttaaaattacgcacgataacgccccaacgcgcccgcgcctccgcctcgccgaaactctcgaacgccgaaaaaactataacacccgccaccaaaataaaaaccgataaacgccgccaacaacacgaaacgaccgatatcctcgttaaaatacgaacgacgacaacaacaacaacaacaaaaaaaacgcgacaaacgacgacgactacgacgaaacgaaaaccgaaaactacgaaaaaacataatccgaaactcaaccccgaaaccaaaacgacgctcgaaacccgaaccacgacatccccccgacgaaaacaaaaacgtaaaaataataaccaaaaatccgaaaccgccgcgaacgccctcgccgccttcgcaaaaccccctcgtcgccttcccaaaacccgaacaaaaaaacgcctccgcctcctccccgacgctcaaaccacacgcgaatcccgtaacccaacgaatacccgaacaaaaacgctcctctacgcgccccgacgcctcgccgactcccgcgactccttacccgccgctctcgaacgcgaaactccgcaactaaacccctaccgcccgataaccgacgtccgcgaaaccccgaacctcatactcctctccaaacaaaccgcgaactacgaacgaaataaaccgtaaatcccgaacgcctaaaaccgaaacgcgacaacaaaacgtaaaaaaaacccccgaaaacgtcccataaaacgttcgaaatcgacgcctcctaaatacgaactatacgaacaatcctactcccgcccccgaaactaaactaacgacgtcgacttcaaaacctcgaaaccgaaccgaatccgaaaaaacgctcctttctcaactccaaccgaaaaaccgcccgacaaaaaaaaacgaaatcactaacgcccgaaacgaaa

SEQ ID NO: 9131 - DNA, 1307 bp, Artificial Sequence
  chemically treated genomic DNA (Homo sapiens) CpG-island No: 9131
tagtgttggagtataggcggttcggggtgagcgttagaggtgggttttttttttttattgaaagtcgggagggagagagagagagagaacgggggtcggcggagaagagggcgagacgaaagtaagtaaagggatattagaagggaaggtagagtcgagggacgcggatcgagcggtcgagtagtggaaagggcggtaggtgaaaggtatagagaggaaagatgcgcgggggacgcgtcgtttatttatggttgatattacggtgtttacgaagtagaaggcgtcggggaagttttagcgcgggcgtacgcgtcggcgcggacgtcggcggttagcgcggtttcgtagtgtcggaggaaggcgcgtattattggttcggttacgtcgtgcgtacgtttgaagttgcgtacgatggcgttttagcgcgttcgcgttttcgtttcgtcggggttttcgagcgtcgagaagattgtggtattcgttattaaggtagaggtcgatgagcgtcgttagtagtacgaagcggtcggtgttttcgttgaggtgcgaacggcggtagtagtagtagtagtaggaggggcgcggtaggcggcggcggttacggcggggcgggggtcgggggttgcgggaggatatggttcggagtttagtttcggggttagggcggcgttcggggttcgggttacgatattttttcggcgggagtaggagcgtgaggatggtggttaggggttcggggtcgtcgcggacgttttcgtcgttttcgtagagttttttcgtcgtttttttagagttcggatagaggggcgttttcgtttttttttcggcgtttaggttatacgcgagtttcgtggtttagcgggtgttcgggtaggggcgtttttttgcgcgtttcgacgtttcgtcggttttcgcggttttttattcgtcgttttcgggcgcggggtttcgtagttaggtttttgtcgttcggtggtcggcgttcgcggggtttcgggttttatatttttttttagataggtcgcgggttgcgggcggggtgggtcgtggatttcgggcgtttaggatcgggacgcggtagtaaggcgtggagagagttttcgggggcgttttatgaggcgttcgggatcggcgttttttaggtgcgggttgtgcgggtagttttgttttcgttttcggggttgagttggcggcgtcggttttagagtttcggagtcgagtcgagttcggggaagcgttttttttttagttttagtcgaagagtcgttcggtagggagaggcggagttattggcgttcggggcgggg

SEQ ID NO: 9132 - DNA, 1307 bp, Artificial Sequence
  chemically treated genomic DNA (Homo sapiens) CpG-island No: 9132
ccccgccccgaacgccaataactccgcctctccctaccgaacgactcttcgactaaaactaaaaaaaaaacgcttccccgaactcgactcgactccgaaactctaaaaccgacgccgccaactcaaccccgaaaacgaaaacaaaactacccgcacaacccgcacctaaaaaacgccgatcccgaacgcctcataaaacgcccccgaaaactctctccacgccttactaccgcgtcccgatcctaaacgcccgaaatccacgacccaccccgcccgcaacccgcgacctatctaaaaaaaaatataaaacccgaaaccccgcgaacgccgaccaccgaacgacaaaaacctaactacgaaaccccgcgcccgaaaacgacgaataaaaaaccgcgaaaaccgacgaaacgtcgaaacgcgcaaaaaaacgcccctacccgaacacccgctaaaccacgaaactcgcgtataacctaaacgccgaaaaaaaaacgaaaacgcccctctatccgaactctaaaaaaacgacgaaaaaactctacgaaaacgacgaaaacgtccgcgacgaccccgaacccctaaccaccatcctcacgctcctactcccgccgaaaaaatatcgtaacccgaaccccgaacgccgccctaaccccgaaactaaactccgaaccatatcctcccgcaacccccgacccccgccccgccgtaaccgccgccgcctaccgcgcccctcctactactactactactaccgccgttcgcacctcaacgaaaacaccgaccgcttcgtactactaacgacgctcatcgacctctaccttaataacgaataccacaatcttctcgacgctcgaaaaccccgacgaaacgaaaacgcgaacgcgctaaaacgccatcgtacgcaacttcaaacgtacgcacgacgtaaccgaaccaataatacgcgccttcctccgacactacgaaaccgcgctaaccgccgacgtccgcgccgacgcgtacgcccgcgctaaaacttccccgacgccttctacttcgtaaacaccgtaatatcaaccataaataaacgacgcgtcccccgcgcatctttcctctctatacctttcacctaccgccctttccactactcgaccgctcgatccgcgtccctcgactctaccttcccttctaatatccctttacttactttcgtctcgccctcttctccgccgacccccgttctctctctctctctccctcccgactttcaataaaaaaaaaaaacccacctctaacgctcaccccgaaccgcctatactccaacacta

SEQ ID NO: 9133 - DNA, 754 bp, Artificial Sequence
  chemically treated genomic DNA (Homo sapiens) CpG-island No: 9133
agaggtacgggttttagggttgaggggggcgttttttcggagttaagtagaatttggggacggcggaattcgtataagtattaacgtttcgttttcgtgttttcgtattggagaggttgtttatcgtttattttttgaggcgggaaaggagtcgcgttataaggtttcgggtttttttttagtacgcgtcgtttcggtttttatttgtcggttttatgtatttgattattttttgggttttgaatatttttcgggcggttagtagcgcgttttcgtcgtgcgtcgtatagaagtcgtttcggtcgaaaaggcgtattgtggtggtcggttttttcggtatgtattgaaagaagcgtacgaagtcgatttcggtcgcgttttttaattgtagcgtttttttcggttgtatcgttatgtcgaaatttttttaattttttggttgaagaaaatgcgcgattttatatttattaagttgtttttcgtttttttttttacgtttttcgagcggcgttcggttacgggcgattatatttaattagtttttagggttgcgtttcggtggtgggagtttgtcgcgtatattaattataagtagacgcgttttagtttttcgcgtacgttggtgattttagttattgcgtatgtttgcgtttaggtcgcgcggaaattcgtagacgcgtatttttagtagagtttttttttgtgtttatttagttgtaaggtttgaagtttttgggtggggtgtatgtaaggg

SEQ ID NO: 9134 - DNA, 754 bp, Artificial Sequence
  chemically treated genomic DNA (Homo sapiens) CpG-island No: 9134
cccttacatacaccccacccaaaaacttcaaaccttacaactaaataaacacaaaaaaaaactctactaaaaatacgcgtctacgaatttccgcgcgacctaaacgcaaacatacgcaataactaaaatcaccaacgtacgcgaaaaactaaaacgcgtctacttataattaatatacgcgacaaactcccaccaccgaaacgcaaccctaaaaactaattaaatataatcgcccgtaaccgaacgccgctcgaaaaacgtaaaaaaaaaaacgaaaaacaacttaataaatataaaatcgcgcattttcttcaaccaaaaaattaaaaaaatttcgacataacgatacaaccgaaaaaaacgctacaattaaaaaacgcgaccgaaatcgacttcgtacgcttctttcaatacataccgaaaaaaccgaccaccacaatacgccttttcgaccgaaacgacttctatacgacgcacgacgaaaacgcgctactaaccgcccgaaaaatattcaaaacccaaaaaataatcaaatacataaaaccgacaaataaaaaccgaaacgacgcgtactaaaaaaaaacccgaaaccttataacgcgactcctttcccgcctcaaaaaataaacgataaacaacctctccaatacgaaaacacgaaaacgaaacgttaatacttatacgaattccgccgtccccaaattctacttaactccgaaaaaacgcccccctcaaccctaaaacccgtacctct

SEQ ID NO: 9135 - DNA, 754 bp, Artificial Sequence
  chemically treated genomic DNA (Homo sapiens) CpG-island No: 9135
tttttgtatatattttatttaggggttttaagttttgtagttgagtaaatatagaaaggagttttattaaggatgcgcgtttgcgggttttcgcgcgatttaggcgtaggtatgcgtagtagttaaagttattagcgtgcgcgggaagttggggcgcgtttgtttatgattggtatgcgcggtagatttttattatcgaaacgtagttttggaagttgattgggtgtggtcgttcgtggtcggacgtcgttcgggggacgtgggaggggaagcgggaaatagtttagtgggtgtagggtcgcgtattttttttaattaggaagttgaggaggtttcgatatggcggtgtagtcgaaggagacgttgtagttggagagcgcggtcgaggtcggtttcgtgcgttttttttagtgtatgtcggagaagtcgattattatagtgcgttttttcgatcggggcgatttttatacggcgtacggcgaggacgcgttgttggtcgttcgggaggtgtttaagatttagggggtgattaagtatatggggtcggtaggtgagggtcgggacggcgcgtgttggggagggattcggggttttgtggcgcggtttttttttcgttttagagagtgggcggtgagtagtttttttagtgcggaggtacgggggcggaacgttggtgtttgtgcggatttcgtcgtttttaggttttgtttggtttcggagggacgttttttttagttttgaaattcgtgttttt

SEQ ID NO: 9136 - DNA, 754 bp, Artificial Sequence
  chemically treated genomic DNA (Homo sapiens) CpG-island No: 9136
aaaaacacgaatttcaaaactaaaaaaaacgtccctccgaaaccaaacaaaacctaaaaacgacgaaatccgcacaaacaccaacgttccgcccccgtacctccgcactaaaaaaactactcaccgcccactctctaaaacgaaaaaaaaaccgcgccacaaaaccccgaatccctccccaacacgcgccgtcccgaccctcacctaccgaccccatatacttaatcaccccctaaatcttaaacacctcccgaacgaccaacaacgcgtcctcgccgtacgccgtataaaaatcgccccgatcgaaaaaacgcactataataatcgacttctccgacatacactaaaaaaaacgcacgaaaccgacctcgaccgcgctctccaactacaacgtctccttcgactacaccgccatatcgaaacctcctcaacttcctaattaaaaaaaatacgcgaccctacacccactaaactatttcccgcttcccctcccacgtcccccgaacgacgtccgaccacgaacgaccacacccaatcaacttccaaaactacgtttcgataataaaaatctaccgcgcataccaatcataaacaaacgcgccccaacttcccgcgcacgctaataactttaactactacgcatacctacgcctaaatcgcgcgaaaacccgcaaacgcgcatccttaataaaactcctttctatatttactcaactacaaaacttaaaacccctaaataaaatatatacaaaaa

SEQ ID NO: 9137 - DNA, 733 bp, Artificial Sequence
  chemically treated genomic DNA (Homo sapiens) CpG-island No: 9137
atttacgttcgggagaggttcggagtttcggtcgcgggcggcgggggatttttgtaggaaggggtaggaaggtaagtagttcggcgcgttttggcggtttcgagggatttgggttcgggtttgcggtcgcgtcgtttgggttttttttgggttgggagcgcgtcgggttttcgttttgtacgttgttatcgcgggagacgtttcggtttcgtcgcgcgtagaggggacgcgcggagaggttggtttttgggcgagcggagagttttgtttattaagttgtcggaagaagttaaattaaaaagttaatttttaagtttttaaacggaacgttattcgtattagttgggagatagcgtcgtattgattgataagtcgcgtatattattttcgcgcgcggaggggagatttttagaacgtttttcgattagtagcgaggaagtcgagttcgtatttcgtatttcgtatttcgtatttagagttttcgagggacgaatttagatttaatttttgtttcgcggttatttattttagtcgttggagtttggcgttcgcgtttttcggtcggtagtacgttaaaacggcggcgcgttttgatttggatttcgtcgagttgggagttttaggtagtaggcgggcgcgcggtatcggttttttttttgtttttaggagacgttgtttgtaatttcgaaattaagtttttattaaatatatttgtggtttttaaatatagtag

SEQ ID NO: 9138 - DNA, 733 bp, Artificial Sequence
  chemically treated genomic DNA (Homo sapiens) CpG-island No: 9138
ctactatatttaaaaaccacaaatatatttaataaaaacttaatttcgaaattacaaacaacgtctcctaaaaacaaaaaaaaaaccgataccgcgcgcccgcctactacctaaaactcccaactcgacgaaatccaaatcaaaacgcgccgccgttttaacgtactaccgaccgaaaaacgcgaacgccaaactccaacgactaaaataaataaccgcgaaacaaaaattaaatctaaattcgtccctcgaaaactctaaatacgaaatacgaaatacgaaatacgaactcgacttcctcgctactaatcgaaaaacgttctaaaaatctcccctccgcgcgcgaaaataatatacgcgacttatcaatcaatacgacgctatctcccaactaatacgaataacgttccgtttaaaaacttaaaaattaactttttaatttaacttcttccgacaacttaataaacaaaactctccgctcgcccaaaaaccaacctctccgcgcgtcccctctacgcgcgacgaaaccgaaacgtctcccgcgataacaacgtacaaaacgaaaacccgacgcgctcccaacccaaaaaaaacccaaacgacgcgaccgcaaacccgaacccaaatccctcgaaaccgccaaaacgcgccgaactacttaccttcctaccccttcctacaaaaatcccccgccgcccgcgaccgaaactccgaacctctcccgaacgtaaat

SEQ ID NO: 9139 - DNA, 733 bp, Artificial Sequence
  chemically treated genomic DNA (Homo sapiens) CpG-island No: 9139
ttgttatatttaaaaattatagatgtgtttggtggagatttaatttcggaattgtaggtagcgttttttgaggataaggggaaagtcggtgtcgcgcgttcgtttgttgtttggagtttttaattcggcggaatttaggttaggacgcgtcgtcgttttgacgtgttgtcggtcgggaggcgcgggcgttaggttttaacgattagggtgggtggtcgcggggtaggggttggatttgaattcgtttttcgggggttttggatgcgggatgcgggatgcgggatgcgggttcgattttttcgttgttggtcgaggagcgttttgagagtttttttttcgcgcgcgaggataatatgcgcggtttgttagttagtgcggcgttgttttttagttgatacgggtgacgtttcgtttggaggtttggagattggttttttgatttggtttttttcggtagtttaatgggtaaagtttttcgttcgtttagaaattagttttttcgcgcgttttttttgcgcgcggcgaggtcgagacgtttttcgcggtgatagcgtgtaaggcggagattcggcgcgtttttagtttagggaaagtttaggcgacgcgatcgtaagttcgagtttaggtttttcggagtcgttagggcgcgtcgggttgtttgtttttttgtttttttttgtaggaatttttcgtcgttcgcggtcgggatttcgggtttttttcgggcgtagat

SEQ ID NO: 9140 - DNA, 733 bp, Artificial Sequence
  chemically treated genomic DNA (Homo sapiens) CpG-island No: 9140
atctacgcccgaaaaaaacccgaaatcccgaccgcgaacgacgaaaaattcctacaaaaaaaaacaaaaaaacaaacaacccgacgcgccctaacgactccgaaaaacctaaactcgaacttacgatcgcgtcgcctaaactttccctaaactaaaaacgcgccgaatctccgccttacacgctatcaccgcgaaaaacgtctcgacctcgccgcgcgcaaaaaaaacgcgcgaaaaaactaatttctaaacgaacgaaaaactttacccattaaactaccgaaaaaaaccaaatcaaaaaaccaatctccaaacctccaaacgaaacgtcacccgtatcaactaaaaaacaacgccgcactaactaacaaaccgcgcatattatcctcgcgcgcgaaaaaaaaactctcaaaacgctcctcgaccaacaacgaaaaaatcgaacccgcatcccgcatcccgcatcccgcatccaaaacccccgaaaaacgaattcaaatccaacccctaccccgcgaccacccaccctaatcgttaaaacctaacgcccgcgcctcccgaccgacaacacgtcaaaacgacgacgcgtcctaacctaaattccgccgaattaaaaactccaaacaacaaacgaacgcgcgacaccgactttccccttatcctcaaaaaacgctacctacaattccgaaattaaatctccaccaaacacatctataatttttaaatataacaa

SEQ ID NO: 9141 - DNA, 658 bp, Artificial Sequence
  chemically treated genomic DNA (Homo sapiens) CpG-island No: 9141
  misc_feature (393)..(393): n is either a, c, g or t
gggatagcgttgtagtttatggtgtggagcgcggttgggggattagggggaggtggggagaggggagcgtggaggggagcgtggaggggggcgcgcgaaggggttgcggggcgtaggaggcgggttgggttcggttggagatcggatttcggtgttggtttatagtatagggagtcggtcgaatgcgcgtgattattggacggcgttgttttgggagagagtcggggttagatttggcgcggcggtgaggcggttgcgggataagtagaggcgcgcgggcgtgggtaagggtttggggcgttttggagcggtttgttgggttagtgaggtgttagggagagcgggtgtttgtcgggtagtgtgttcgggttgtacgttttagcgcgggggcgnatagcggcggcgcgggcgggcggtttggaataatgataaatatatttggttttgagtgaagaagtcgtcgtcgtttcgttttttagtaattgggatttgaggaatttcgaatcgtatattaaggggtttttattgtgtttcgtggttttcgttttcgtttgttttttcgcgtttttttttcggtggaattatttttgtattgttcgggggttttgttttcgtttatttttggtcgtaggtagaaaaaaaggaaaggtttttagga

SEQ ID NO: 9142 - DNA, 658 bp, Artificial Sequence
  chemically treated genomic DNA (Homo sapiens) CpG-island No: 9142
  misc_feature (266)..(266): n is either a, c, g or t
tcctaaaaacctttcctttttttctacctacgaccaaaaataaacgaaaacaaaacccccgaacaatacaaaaataattccaccgaaaaaaaaacgcgaaaaaacaaacgaaaacgaaaaccacgaaacacaataaaaaccccttaatatacgattcgaaattcctcaaatcccaattactaaaaaacgaaacgacgacgacttcttcactcaaaaccaaatatatttatcattattccaaaccgcccgcccgcgccgccgctatncgcccccgcgctaaaacgtacaacccgaacacactacccgacaaacacccgctctccctaacacctcactaacccaacaaaccgctccaaaacgccccaaacccttacccacgcccgcgcgcctctacttatcccgcaaccgcctcaccgccgcgccaaatctaaccccgactctctcccaaaacaacgccgtccaataatcacgcgcattcgaccgactccctatactataaaccaacaccgaaatccgatctccaaccgaacccaacccgcctcctacgccccgcaaccccttcgcgcgcccccctccacgctcccctccacgctcccctctccccacctccccctaatcccccaaccgcgctccacaccataaactacaacgctatccc

SEQ ID NO: 9143 - DNA, 658 bp, Artificial Sequence
  chemically treated genomic DNA (Homo sapiens) CpG-island No: 9143
  misc_feature (266)..(266): n is either a, c, g or t
ttttggagattttttttttttttttgtttgcggttagaagtgagcgaaagtagagttttcgggtaatgtagaaatgattttatcgaggagggggcgcgggaagataggcgggggcgggggttacggagtataatgagggttttttggtgtgcggttcgaaattttttaaattttagttgttggaaggcgaggcgacgacgatttttttatttagggttaaatgtgtttgttattattttagatcgttcgttcgcgtcgtcgttgtncgttttcgcgttagggcgtgtaattcgagtatattgttcggtaggtattcgttttttttggtattttattgatttaataaatcgttttagagcgttttaaatttttgtttacgttcgcgcgtttttgtttgtttcgtagtcgttttatcgtcgcgttaaatttggtttcgatttttttttagagtagcgtcgtttagtaattacgcgtattcggtcggttttttgtgttgtaggttaatatcgaggttcggtttttagtcgagtttagttcgttttttgcgtttcgtaattttttcgcgcgtttttttttacgtttttttttacgtttttttttttttatttttttttggttttttagtcgcgttttatattatgggttgtagcgttgtttt

SEQ ID NO: 9144 - DNA, 658 bp, Artificial Sequence
  chemically treated genomic DNA (Homo sapiens) CpG-island No: 9144
  misc_feature (393)..(393): n is either a, c, g or t
aaaacaacgctacaacccataatataaaacgcgactaaaaaaccaaaaaaaaataaaaaaaaaaaaacgtaaaaaaaaacgtaaaaaaaaacgcgcgaaaaaattacgaaacgcaaaaaacgaactaaactcgactaaaaaccgaacctcgatattaacctacaacacaaaaaaccgaccgaatacgcgtaattactaaacgacgctactctaaaaaaaaatcgaaaccaaatttaacgcgacgataaaacgactacgaaacaaacaaaaacgcgcgaacgtaaacaaaaatttaaaacgctctaaaacgatttattaaatcaataaaataccaaaaaaaacgaatacctaccgaacaatatactcgaattacacgccctaacgcgaaaacgnacaacgacgacgcgaacgaacgatctaaaataataacaaacacatttaaccctaaataaaaaaatcgtcgtcgcctcgccttccaacaactaaaatttaaaaaatttcgaaccgcacaccaaaaaaccctcattatactccgtaacccccgcccccgcctatcttcccgcgccccctcctcgataaaatcatttctacattacccgaaaactctactttcgctcacttctaaccgcaaacaaaaaaaaaaaaaaaatctccaaaa

SEQ ID NO: 9145 - DNA, 513 bp, Artificial Sequence
  chemically treated genomic DNA (Homo sapiens) CpG-island No: 9145
  misc_feature (152)..(152): n is either a, c, g or t
  misc_feature (195)..(195): n is either a, c, g or t
cgagtgcgaggggattggggagattttgttcgggaagttcggggttcgggaatgaaagcgggcgtatttttttagcgagttttaaagcgtttgggagacgatcgtttcgtttttgggagcggtatttggtggggttgggcggagggaggttnttgtaagagaaattcggagttcgggaaatttagtaggtacggntgattattgaaggattcgttttcgttgagtagggcgttggttgcgggatgggggatggagggtgttgggttcggtgggcgtggttattgcggttgttaaggaacgcgcggttttcgttttgttagcgtgtttggcgttagtcgttgggttttggatacgttagtttcgtttattttttaaggttttttacgcggttcgggattggtttttttgtgttgatcgattattcgcggtcgtttatttgttagtgtagttttttgggttttgtcgtttttttttggggtttttttttttatggtatttttttttatttttttt

SEQ ID NO: 9146 - DNA, 513 bp, Artificial Sequence
  chemically treated genomic DNA (Homo sapiens) CpG-island No: 9146
  misc_feature (319)..(319): n is either a, c, g or t
  misc_feature (362)..(362): n is either a, c, g or t
aaaaaaaataaaaaaaaataccataaaaaaaaaaaccccaaaaaaaaacgacaaaacccaaaaaactacactaacaaataaacgaccgcgaataatcgatcaacacaaaaaaaccaatcccgaaccgcgtaaaaaaccttaaaaaataaacgaaactaacgtatccaaaacccaacgactaacgccaaacacgctaacaaaacgaaaaccgcgcgttccttaacaaccgcaataaccacgcccaccgaacccaacaccctccatcccccatcccgcaaccaacgccctactcaacgaaaacgaatccttcaataatcanccgtacctactaaatttcccgaactccgaatttctcttacaanaacctccctccgcccaaccccaccaaataccgctcccaaaaacgaaacgatcgtctcccaaacgctttaaaactcgctaaaaaaatacgcccgctttcattcccgaaccccgaacttcccgaacaaaatctccccaatcccctcgcactcg

SEQ ID NO: 9147 - DNA, 513 bp, Artificial Sequence
  chemically treated genomic DNA (Homo sapiens) CpG-island No: 9147
  misc_feature (319)..(319): n is either a, c, g or t
  misc_feature (362)..(362): n is either a, c, g or t
aaaaagagtgaagaggagtattatgggaaagggggttttaaaagggaacggtagaatttagagagttgtattgataagtaagcggtcgcgagtaatcggttagtataaaggagttaatttcgagtcgcgtggaagattttgggaggtgggcgggattaacgtgtttagggtttagcggttggcgttagatacgttggtagggcgggaatcgcgcgttttttagtaatcgtaatggttacgtttatcgaatttagtattttttattttttatttcgtagttagcgttttatttaacgggaacgggttttttagtgattantcgtatttattgggtttttcggatttcgggttttttttgtagnagttttttttcgtttagttttattaagtgtcgtttttagggacggaacgatcgttttttaaacgttttagggttcgttaaagaggtgcgttcgtttttattttcggatttcgagtttttcgggtagggtttttttaattttttcgtattcg

SEQ ID NO: 9148 - DNA, 513 bp, Artificial Sequence
  chemically treated genomic DNA (Homo sapiens) CpG-island No: 9148
  misc_feature (152)..(152): n is either a, c, g or t
  misc_feature (195)..(195): n is either a, c, g or t
cgaatacgaaaaaattaaaaaaaccctacccgaaaaactcgaaatccgaaaataaaaacgaacgcacctctttaacgaaccctaaaacgtttaaaaaacgatcgttccgtccctaaaaacgacacttaataaaactaaacgaaaaaaaactnctacaaaaaaaacccgaaatccgaaaaacccaataaatacgantaatcactaaaaaacccgttcccgttaaataaaacgctaactacgaaataaaaaataaaaaatactaaattcgataaacgtaaccattacgattactaaaaaacgcgcgattcccgccctaccaacgtatctaacgccaaccgctaaaccctaaacacgttaatcccgcccacctcccaaaatcttccacgcgactcgaaattaactcctttatactaaccgattactcgcgaccgcttacttatcaatacaactctctaaattctaccgttcccttttaaaaccccctttcccataatactcctcttcactcttttt

SEQ ID NO: 9149 - DNA, 750 bp, Artificial Sequence
  chemically treated genomic DNA (Homo sapiens) CpG-island No: 9149
gttataattattagggaagtgatatagtcgggaaatttcgttttttatattttcgcgcgttcgcgtcggtcgtagttttatagttcgtttcggtcgtagttttatagttcgtttcgttttttttttttcggaaataattttcgcgcgggcggaaggcggggtcggttttggtttcgtttatattatttttttttttcggtttagcgtttatagcgcgtagtttcggtagggtggttttacggtcggaggagagggtgggttttagatttgaggtaggaggtcgagttgaggggcggggaagaggttttttgcggtaggacgtaagtgacggcgaaggcggtgcgatagtagttggagggtagaggaggcgggtttgtgtttttcgggtcgaatcgggttgtggggggcgcggggtttgggttaggcggtagttaaggttcgcggtgatagtatgggtgaaggggagcggggtagaggaggttttgggttgttttcggcggcgggtgggggcgaggggttggcgggttagagtttcgggtttaggtcggggttttgattcgcggttggtgttttttcgatttcgtagcgcggggtgttttgttttcgttatgaggtcgtagtaggcgtcggtgttcggaaaggtgtttatttagcgagattatagtagtggtatacgttgttagttttagattaagttttttgcggagttggagaatcgggtacgtaatttggttttttacgtttgttttg

SEQ ID NO: 9150 - DNA, 750 bp, Artificial Sequence
  chemically treated genomic DNA (Homo sapiens) CpG-island No: 9150
caaaacaaacgtaaaaaaccaaattacgtacccgattctccaactccgcaaaaaacttaatctaaaactaacaacgtataccactactataatctcgctaaataaacacctttccgaacaccgacgcctactacgacctcataacgaaaacaaaacaccccgcgctacgaaatcgaaaaaacaccaaccgcgaatcaaaaccccgacctaaacccgaaactctaacccgccaacccctcgcccccacccgccgccgaaaacaacccaaaacctcctctaccccgctccccttcacccatactatcaccgcgaaccttaactaccgcctaacccaaaccccgcgccccccacaacccgattcgacccgaaaaacacaaacccgcctcctctaccctccaactactatcgcaccgccttcgccgtcacttacgtcctaccgcaaaaaacctcttccccgcccctcaactcgacctcctacctcaaatctaaaacccaccctctcctccgaccgtaaaaccaccctaccgaaactacgcgctataaacgctaaaccgaaaaaaaaaaataatataaacgaaaccaaaaccgaccccgccttccgcccgcgcgaaaattatttccgaaaaaaaaaaaacgaaacgaactataaaactacgaccgaaacgaactataaaactacgaccgacgcgaacgcgcgaaaatataaaaaacgaaatttcccgactatatcacttccctaataattataac

SEQ ID NO: 9151 - DNA, 750 bp, Artificial Sequence
  chemically treated genomic DNA (Homo sapiens) CpG-island No: 9151
tagagtaggcgtggggagttaggttgcgtattcggttttttagtttcgtagggaatttggtttggaattggtagcgtgtgttattgttgtagtttcgttgaatgaatattttttcggatatcggcgtttgttgcggttttatggcgaggataggatatttcgcgttgcggggtcgggggaatattaatcgcgagttagagtttcggtttggattcgggattttgattcgttagtttttcgtttttattcgtcgtcgaaaatagtttaaggttttttttgtttcgtttttttttatttatgttgttatcgcgggttttagttgtcgtttggtttaggtttcgcgttttttataattcggttcggttcgggaaatataaattcgttttttttgttttttagttgttgtcgtatcgttttcgtcgttatttacgttttgtcgtaaaaagtttttttttcgttttttagttcggttttttattttaggtttgggatttattttttttttcggtcgtaaagttattttgtcgaagttgcgcgttgtgggcgttgggtcgaggaagggaaatgatgtgggcggggttagggtcgatttcgtttttcgttcgcgcggggattgttttcggaaggagagaggcggggcgagttgtggggttgcggtcggggcgagttgtggggttgcggtcggcgcgagcgcgcgggggtgtgaggggcggagtttttcggttgtgttatttttttagtgattgtggt

SEQ ID NO: 9152 - DNA, 750 bp, Artificial Sequence
  chemically treated genomic DNA (Homo sapiens) CpG-island No: 9152
accacaatcactaaaaaaataacacaaccgaaaaactccgcccctcacacccccgcgcgctcgcgccgaccgcaaccccacaactcgccccgaccgcaaccccacaactcgccccgcctctctccttccgaaaacaatccccgcgcgaacgaaaaacgaaatcgaccctaaccccgcccacatcatttcccttcctcgacccaacgcccacaacgcgcaacttcgacaaaataactttacgaccgaaaaaaaaaataaatcccaaacctaaaataaaaaaccgaactaaaaaacgaaaaaaaaactttttacgacaaaacgtaaataacgacgaaaacgatacgacaacaactaaaaaacaaaaaaaacgaatttatatttcccgaaccgaaccgaattataaaaaacgcgaaacctaaaccaaacgacaactaaaacccgcgataacaacataaataaaaaaaaacgaaacaaaaaaaaccttaaactattttcgacgacgaataaaaacgaaaaactaacgaatcaaaatcccgaatccaaaccgaaactctaactcgcgattaatattcccccgaccccgcaacgcgaaatatcctatcctcgccataaaaccgcaacaaacgccgatatccgaaaaaatattcattcaacgaaactacaacaataacacacgctaccaattccaaaccaaattccctacgaaactaaaaaaccgaatacgcaacctaactccccacgcctactcta

SEQ ID NO: 9153 - DNA, 601 bp, Artificial Sequence
  chemically treated genomic DNA (Homo sapiens) CpG-island No: 9153
cgggttcggagagtaggcgagcggagaggcgggcggtcggggttcggggcgggcgcggatcgttttatttcggacggggggtattcgttttattcgtcggggattttcggggcgcggcgatggtgttttttgacgtcggcgtagcgtcgtcggggcgttttagatcgtaggtttcgcgcggtcgtttaagttcggtttttacgtttcgttttcggtttttcggaggtcggagattttgaggtaaggggttagtttttttttatttatcgatcgcgaggttaggtagttttaaatttcgcggcgatcgttttttttcgtttttgtcgtcgtcgcgggtttaagttgcgttaggacgtgcgcgcgttcgtttttgtttgcgtcgtttaacgtgattttgcgtttatcgtttcgtacgttttcgtcgggcgcgcgcgggtcggtagggcgggggtttagggagaggcgggtgtcgcgtggatcggtcgcgggttgggcgattcgcggagtcgttttttggcggattagggggtattgtcgggggcggggcggggtaggagtaggagaggtcgggttttggttgttttttcgttggcgcgttttt

SEQ ID NO: 9154 - DNA, 601 bp, Artificial Sequence
  chemically treated genomic DNA (Homo sapiens) CpG-island No: 9154
aaaaacgcgccaacgaaaaaacaaccaaaacccgacctctcctactcctaccccgccccgcccccgacaataccccctaatccgccaaaaaacgactccgcgaatcgcccaacccgcgaccgatccacgcgacacccgcctctccctaaacccccgccctaccgacccgcgcgcgcccgacgaaaacgtacgaaacgataaacgcaaaatcacgttaaacgacgcaaacaaaaacgaacgcgcgcacgtcctaacgcaacttaaacccgcgacgacgacaaaaacgaaaaaaaacgatcgccgcgaaatttaaaactacctaacctcgcgatcgataaataaaaaaaaactaaccccttacctcaaaatctccgacctccgaaaaaccgaaaacgaaacgtaaaaaccgaacttaaacgaccgcgcgaaacctacgatctaaaacgccccgacgacgctacgccgacgtcaaaaaacaccatcgccgcgccccgaaaatccccgacgaataaaacgaataccccccgtccgaaataaaacgatccgcgcccgccccgaaccccgaccgcccgcctctccgctcgcctactctccgaacccg

SEQ ID NO: 9155 - DNA, 601 bp, Artificial Sequence
  chemically treated genomic DNA (Homo sapiens) CpG-island No: 9155
agggacgcgttagcggagggatagttagggttcggttttttttgtttttgtttcgtttcgttttcggtagtgttttttagttcgttagagggcgatttcgcgggtcgtttaattcgcgatcggtttacgcggtattcgtttttttttaggttttcgttttgtcggttcgcgcgcgttcgacgggagcgtgcggggcggtgggcgtagggttacgttgggcggcgtagataaaggcgggcgcgcgtacgttttgacgtagtttgggttcgcggcggcggtaagggcgggagggagcggtcgtcgcgggatttggagttgtttagtttcgcggtcggtgagtaggagggagttggttttttattttaaagttttcgattttcggggagtcgagagcgggacgtgggagtcgggtttgggcggtcgcgcggggtttgcggtttgggacgtttcggcgacgttgcgtcggcgttaggaggtattatcgtcgcgtttcggggattttcggcgggtggagcgggtgtttttcgttcgggatggaacggttcgcgttcgtttcgaatttcggtcgttcgttttttcgttcgtttgtttttcgagttcg

SEQ ID NO: 9156 - DNA, 601 bp, Artificial Sequence
  chemically treated genomic DNA (Homo sapiens) CpG-island No: 9156
cgaactcgaaaaacaaacgaacgaaaaaacgaacgaccgaaattcgaaacgaacgcgaaccgttccatcccgaacgaaaaacacccgctccacccgccgaaaatccccgaaacgcgacgataatacctcctaacgccgacgcaacgtcgccgaaacgtcccaaaccgcaaaccccgcgcgaccgcccaaacccgactcccacgtcccgctctcgactccccgaaaatcgaaaactttaaaataaaaaaccaactccctcctactcaccgaccgcgaaactaaacaactccaaatcccgcgacgaccgctccctcccgcccttaccgccgccgcgaacccaaactacgtcaaaacgtacgcgcgcccgcctttatctacgccgcccaacgtaaccctacgcccaccgccccgcacgctcccgtcgaacgcgcgcgaaccgacaaaacgaaaacctaaaaaaaaacgaataccgcgtaaaccgatcgcgaattaaacgacccgcgaaatcgccctctaacgaactaaaaaacactaccgaaaacgaaacgaaacaaaaacaaaaaaaaccgaaccctaactatccctccgctaacgcgtccct

SEQ ID NO: 9157 - DNA, 756 bp, Artificial Sequence
  chemically treated genomic DNA (Homo sapiens) CpG-island No: 9157
  misc_feature (417)..(417): n is either a, c, g or t
  misc_feature (438)..(438): n is either a, c, g or t
  misc_feature (629)..(629): n is either a, c, g or t
  misc_feature (643)..(643): n is either a, c, g or t
  misc_feature (665)..(665): n is either a, c, g or t
  misc_feature (680)..(680): n is either a, c, g or t
  misc_feature (713)..(713): n is either a, c, g or t
ggcgaggggcggggaaaggggcggcgggttttattcgtagttttaggacgacgtagttatagttttttagagagcgatttcggtagaacggtaggaagtatgcggagaggaaggcggggaggcggtacgtgtttttcgtgttgggttcgtcgggtcggtcgggtgattttcgttagttgtgggggagcggagaggttcgcgttttcgggagttcgggtggacgtcgagattcgggagcgggaggcggtttatttggatttcggtgtaattttcgaagaagaagagtattatgttatggtagacgtagtagagtcggtcgtttagcgtttggtagaagcgggcgggtaggaaggcggagagtagtcgttagattttttaagttaatacgtaggtgggcgtcgtgtttaggagtacgancgttggatagtaggtagcgtnatcgagtacgtgtagagaaatagggatagtagtatttttttagttcggcggtatttagttacgtttgcgtttttcgttcgtttttcgggtcgtagtcgcggttagtaggcggttaattatcgttcgggttcgggtcggcgcgttcgttattcgtttttagtttacgtttttagtcgtatgggtcgcgtcgntcgttcggggtcgnggtaggcgagtaaaggggcgtnggtgcgtcgtttttnggcggaaaagtaagggaattcgcggtttttttnggatcgaaggtttagggatgtttatattttatgatttttattt

SEQ ID NO: 9158 - DNA, 756 bp, Artificial Sequence
  chemically treated genomic DNA (Homo sapiens) CpG-island No: 9158
  misc_feature (44)..(44): n is either a, c, g or t
  misc_feature (77)..(77): n is either a, c, g or t
  misc_feature (92)..(92): n is either a, c, g or t
  misc_feature (114)..(114): n is either a, c, g or t
  misc_feature (128)..(128): n is either a, c, g or t
  misc_feature (319)..(319): n is either a, c, g or t
  misc_feature (340)..(340): n is either a, c, g or t
aaataaaaatcataaaatataaacatccctaaaccttcgatccnaaaaaaaccgcgaattcccttacttttccgccnaaaaacgacgcaccnacgcccctttactcgcctaccncgaccccgaacgancgacgcgacccatacgactaaaaacgtaaactaaaaacgaataacgaacgcgccgacccgaacccgaacgataattaaccgcctactaaccgcgactacgacccgaaaaacgaacgaaaaacgcaaacgtaactaaataccgccgaactaaaaaaatactactatccctatttctctacacgtactcgatnacgctacctactatccaacgntcgtactcctaaacacgacgcccacctacgtattaacttaaaaaatctaacgactactctccgccttcctacccgcccgcttctaccaaacgctaaacgaccgactctactacgtctaccataacataatactcttcttcttcgaaaattacaccgaaatccaaataaaccgcctcccgctcccgaatctcgacgtccacccgaactcccgaaaacgcgaacctctccgctcccccacaactaacgaaaatcacccgaccgacccgacgaacccaacacgaaaaacacgtaccgcctccccgccttcctctccgcatacttcctaccgttctaccgaaatcgctctctaaaaaactataactacgtcgtcctaaaactacgaataaaacccgccgcccctttccccgcccctcgcc

SEQ ID NO: 9159 - DNA, 756 bp, Artificial Sequence
  chemically treated genomic DNA (Homo sapiens) CpG-island No: 9159
  misc_feature (44)..(44): n is either a, c, g or t
  misc_feature (77)..(77): n is either a, c, g or t
  misc_feature (92)..(92): n is either a, c, g or t
  misc_feature (114)..(114): n is either a, c, g or t
  misc_feature (128)..(128): n is either a, c, g or t
  misc_feature (319)..(319): n is either a, c, g or t
  misc_feature (340)..(340): n is either a, c, g or t
gggtgagggttatggggtgtgagtatttttgagttttcgatttngggagggtcgcgggtttttttgttttttcgttngggagcggcgtattnacgtttttttattcgtttattncggtttcgggcggncggcgcggtttatgcggttgggggcgtaggttgggagcgggtggcgggcgcgtcggttcgggttcgggcggtgattggtcgtttgttggtcgcgattgcggttcgggaggcgggcggggagcgtaggcgtagttgggtgtcgtcgggttggaaagatgttgttgtttttgtttttttatacgtattcgatngcgttatttgttgtttagcgntcgtgtttttgggtacggcgtttatttacgtgttggtttggggggtttggcggttgtttttcgtttttttgttcgttcgtttttattaagcgttggacgatcggttttattgcgtttattatagtatggtgtttttttttttcgagaattatatcggggtttaggtgagtcgtttttcgttttcgggtttcggcgtttattcgagttttcgggggcgcggattttttcgtttttttatagttggcgagggttattcggtcggttcggcggatttagtacggagagtacgtgtcgttttttcgttttttttttcgtatgttttttgtcgttttgtcgagatcgttttttaggaagttgtggttgcgtcgttttgaggttacgagtgggattcgtcgttttttttttcgtttttcgtt

SEQ ID NO: 9160 - DNA, 756 bp, Artificial Sequence
  chemically treated genomic DNA (Homo sapiens) CpG-island No: 9160
  misc_feature (417)..(417): n is either a, c, g or t
  misc_feature (438)..(438): n is either a, c, g or t
  misc_feature (629)..(629): n is either a, c, g or t
  misc_feature (643)..(643): n is either a, c, g or t
  misc_feature (665)..(665): n is either a, c, g or t
  misc_feature (680)..(680): n is either a, c, g or t
  misc_feature (713)..(713): n is either a, c, g or t
aacgaaaaacgaaaaaaaaaacgacgaatcccactcgtaacctcaaaacgacgcaaccacaacttcctaaaaaacgatctcgacaaaacgacaaaaaacatacgaaaaaaaaaacgaaaaaacgacacgtactctccgtactaaatccgccgaaccgaccgaataaccctcgccaactataaaaaaacgaaaaaatccgcgcccccgaaaactcgaataaacgccgaaacccgaaaacgaaaaacgactcacctaaaccccgatataattctcgaaaaaaaaaaacaccatactataataaacgcaataaaaccgatcgtccaacgcttaataaaaacgaacgaacaaaaaaacgaaaaacaaccgccaaaccccccaaaccaacacgtaaataaacgccgtacccaaaaacacgancgctaaacaacaaataacgcnatcgaatacgtataaaaaaacaaaaacaacaacatctttccaacccgacgacacccaactacgcctacgctccccgcccgcctcccgaaccgcaatcgcgaccaacaaacgaccaatcaccgcccgaacccgaaccgacgcgcccgccacccgctcccaacctacgcccccaaccgcataaaccgcgccgnccgcccgaaaccgnaataaacgaataaaaaaacgtnaatacgccgctcccnaacgaaaaaacaaaaaaacccgcgaccctcccnaaatcgaaaactcaaaaatactcacaccccataaccctcaccc

SEQ ID NO: 9161 - DNA, 1692 bp, Artificial Sequence
  chemically treated genomic DNA (Homo sapiens) CpG-island No: 9161
  misc_feature (667)..(667): n is either a, c, g or t
  misc_feature (741)..(741): n is either a, c, g or t
  misc_feature (755)..(755): n is either a, c, g or t
  misc_feature (1452)..(1452): n is either a, c, g or t
  misc_feature (1539)..(1539): n is either a, c, g or t
  misc_feature (1568)..(1568): n is either a, c, g or t
ttcgacgtttttgataggcgttcgtttttcgcgtatttttatcgttagcggtgttttgtattcgaaacggggttttcgggcgtttttcgtattttttttacgtttttttataggtttttttagttttcgggtcggagtcgggttcgtttttcgcgaacgcggtaataaaggcgaggagcggcggcgggttttggacgcggggtagttaggttcggttatttttagagcgtagcgtagttttagttgcgagtagtcgtacggattttagagtcgttcgtcgcgtttttagtttagtttcggtcggggttcgttcggaatagcgacgttttaggttcggtaagtttttttcggattttgggtcgagttttttcgtttcgttcgttttaggtttcggatgtgacggtatcgtcgttcgtagcgttcgttttacgggtcgcgcgtggagggtttcggtaggtggcggggggagggggttttttcgtcggttcgcggtttttacgtatttaagtgaggaggttttcgtatagtttcgttcgttttagcgattttacgttgaatatttttttcgtcgcggttaggtagcgtttatcgtttggttagatatcgtcgtcgttttgtcgggggattcgggggttcgcgtagttgattcggttttaggttcgtttgntttttcggattcggtcgtcgattttcgtttagcgttggtagcggtttcgtatcgttatttttagcgtttttttnttttttttttattncgggatcgcgcgttagtcgcgcgcgatttcggatacgttcgtcgtttcgcgttttcgttttcggtcgtttatatcgtttttttttagcgtcgtcgttttggttggagtcgaggtcgaggagttattgcgtacgttcgcgtttcggtcgattcgcgtcgtcgcgtcgtcgtcgtcgtcgtcgtcgtcgtcgttgtcgtcgggcgcgttttcgttattagttcgttgcgtgtcgaggcgagtacgcgtttcgttttggaggttgcggcgacgggttttttttcgtcgttcggtcgcgttttcgcggaagttcggtagtgcgcgtgcgttcgtattcgtattttaaattagaaaggggacgtttagtgggttgttcgggaggggtggcgggagcggttttggaaataatttgttttttgtcgtcgggaattggcgaggtagttttttcgcggtggagaggtacgttcggcgcgcggcggttacgtttattttatcggggttcgcggagtcgcggacggcggggtttggtttttttggggtagttttggtcgtcgaggttttgcggggcggcgggagtcgtcgttttttttttttcgggtttttttttcgtttggaagttttagaatcgtttcgcggttgttcggagtcgtcggcgacggtggaggggtcgacgcggagagcggttttaggtgggtttggncggcggcgaggatatcgtcgttttttttagggtcgttcggagcgtgattttgagaattttttttaatgtaggaggggtgtgcgtttngttcgttaattcgtaaggatatcggtcgnatttcgggtttgcgttttttagcgttcggagttgttttcgtttaatggcgaggcggatcgttttggagtttttatttttttagaggtacgaatttgtttgttgggttgtcgataaatttttaat

SEQ ID NO: 9162 - DNA, 1692 bp, Artificial Sequence
  chemically treated genomic DNA (Homo sapiens) CpG-island No: 9162
  misc_feature (125)..(125): n is either a, c, g or t
  misc_feature (154)..(154): n is either a, c, g or t
  misc_feature (241)..(241): n is either a, c, g or t
  misc_feature (938)..(938): n is either a, c, g or t
  misc_feature (952)..(952): n is either a, c, g or t
  misc_feature (1026)..(1026): n is either a, c, g or t
attaaaaatttatcgacaacccaacaaacaaattcgtacctctaaaaaaataaaaactccaaaacgatccgcctcgccattaaacgaaaacaactccgaacgctaaaaaacgcaaacccgaaatncgaccgatatccttacgaattaacgaacnaaacgcacacccctcctacattaaaaaaaattctcaaaatcacgctccgaacgaccctaaaaaaaacgacgatatcctcgccgccgnccaaacccacctaaaaccgctctccgcgtcgacccctccaccgtcgccgacgactccgaacaaccgcgaaacgattctaaaacttccaaacgaaaaaaaaacccgaaaaaaaaaaaacgacgactcccgccgccccgcaaaacctcgacgaccaaaactaccccaaaaaaaccaaaccccgccgtccgcgactccgcgaaccccgataaaataaacgtaaccgccgcgcgccgaacgtacctctccaccgcgaaaaaactacctcgccaattcccgacgacaaaaaacaaattatttccaaaaccgctcccgccacccctcccgaacaacccactaaacgtcccctttctaatttaaaatacgaatacgaacgcacgcgcactaccgaacttccgcgaaaacgcgaccgaacgacgaaaaaaaacccgtcgccgcaacctccaaaacgaaacgcgtactcgcctcgacacgcaacgaactaataacgaaaacgcgcccgacgacaacgacgacgacgacgacgacgacgacgacgcgacgacgcgaatcgaccgaaacgcgaacgtacgcaataactcctcgacctcgactccaaccaaaacgacgacgctaaaaaaaaacgatataaacgaccgaaaacgaaaacgcgaaacgacgaacgtatccgaaatcgcgcgcgactaacgcgcgatcccgnaataaaaaaaaaanaaaaaaacgctaaaaataacgatacgaaaccgctaccaacgctaaacgaaaatcgacgaccgaatccgaaaaancaaacgaacctaaaaccgaatcaactacgcgaacccccgaatcccccgacaaaacgacgacgatatctaaccaaacgataaacgctacctaaccgcgacgaaaaaaatattcaacgtaaaatcgctaaaacgaacgaaactatacgaaaacctcctcacttaaatacgtaaaaaccgcgaaccgacgaaaaaaccccctccccccgccacctaccgaaaccctccacgcgcgacccgtaaaacgaacgctacgaacgacgataccgtcacatccgaaacctaaaacgaacgaaacgaaaaaactcgacccaaaatccgaaaaaaacttaccgaacctaaaacgtcgctattccgaacgaaccccgaccgaaactaaactaaaaacgcgacgaacgactctaaaatccgtacgactactcgcaactaaaactacgctacgctctaaaaataaccgaacctaactaccccgcgtccaaaacccgccgccgctcctcgcctttattaccgcgttcgcgaaaaacgaacccgactccgacccgaaaactaaaaaaacctataaaaaaacgtaaaaaaaatacgaaaaacgcccgaaaaccccgtttcgaatacaaaacaccgctaacgataaaaatacgcgaaaaacgaacgcctatcaaaaacgtcgaa

SEQ ID NO: 9163 - DNA, 1692 bp, Artificial Sequence
  chemically treated genomic DNA (Homo sapiens) CpG-island No: 9163
  misc_feature (125)..(125): n is either a, c, g or t
  misc_feature (154)..(154): n is either a, c, g or t
  misc_feature (241)..(241): n is either a, c, g or t
  misc_feature (938)..(938): n is either a, c, g or t
  misc_feature (952)..(952): n is either a, c, g or t
  misc_feature (1026)..(1026): n is either a, c, g or t
gttaaaaatttatcggtagtttagtagatagattcgtgtttttaaagaggtggaagttttagaacgattcgtttcgttattaagcgaaggtaatttcgaacgttgagaaacgtaggttcggggtncggtcggtgtttttacggattggcgagtngggcgtatattttttttgtattaaggagagtttttagggttacgtttcgagcgattttagagggagcggcggtgttttcgtcgtcgnttaaatttatttagagtcgtttttcgcgtcggtttttttatcgtcgtcggcgatttcggatagtcgcggggcgattttggggtttttagacgagggaggggttcggggggaaggaggcggcgattttcgtcgtttcgtagagtttcggcggttagagttattttaagaaggttagatttcgtcgttcgcggtttcgcgggtttcgatagggtgggcgtggtcgtcgcgcgtcggacgtatttttttatcgcgaaggaattatttcgttagttttcggcgatagaggatagattatttttaggatcgttttcgttatttttttcgggtaatttattagacgttttttttttaatttggagtgcgggtgcgggcgtacgcgtattgtcgagttttcgcgagggcgcgatcggacggcggaggaggattcgtcgtcgtagtttttagggcggagcgcgtgttcgtttcgatacgtagcgaattggtggcgggggcgcgttcggcggtagcggcggcggcggcggcggcggcggcggcgcggcggcgcgggtcggtcggggcgcgagcgtgcgtagtggtttttcggtttcggttttagttagggcggcggcgttggggaggagcggtgtgggcggtcgggggcggggacgcggggcggcgggcgtgttcgaagtcgcgcgcggttggcgcgcggtttcgnagtgaaaggagaanggaggggcgttgggggtgacggtgcggagtcgttgttagcgttgggcgagagtcggcggtcggattcgaggagntaggcgggtttgaggtcgagttagttgcgcgggttttcggatttttcgatagagcggcggcggtgtttggttaggcggtaggcgttgtttggtcgcggcggggaagatgtttagcgtagagtcgttggagcgggcggagttgtgcgagagtttttttatttgggtacgtgggggtcgcgggtcggcgggaagatttttttttttcgttatttatcgggattttttacgcgcggttcgtggggcgagcgttgcgggcgacggtgtcgttatattcggggtttggggcgggcggggcgaggaggttcggtttagggttcgagagagatttgtcgggtttgaggcgtcgttgtttcgggcggatttcggtcggggttgggttgggaacgcggcgggcgattttgggattcgtgcggttgttcgtagttggggttgcgttgcgttttgggggtggtcgagtttgattgtttcgcgtttaggattcgtcgtcgtttttcgtttttgttgtcgcgttcgcggaggacgggttcggtttcggttcgggaattgaaaggatttgtgagggagcgtggggagaatgcgggaggcgttcggggatttcgtttcggatgtaaggtatcgttggcggtgggagtgcgcgaggggcggacgtttgttagaggcgtcggg

SEQ ID NO: 9164 - DNA, 1692 bp, Artificial Sequence
  chemically treated genomic DNA (Homo sapiens) CpG-island No: 9164
  misc_feature (667)..(667): n is either a, c, g or t
  misc_feature (741)..(741): n is either a, c, g or t
  misc_feature (755)..(755): n is either a, c, g or t
  misc_feature (1452)..(1452): n is either a, c, g or t
  misc_feature (1539)..(1539): n is either a, c, g or t
  misc_feature (1568)..(1568): n is either a, c, g or t
cccgacgcctctaacaaacgtccgcccctcgcgcactcccaccgccaacgataccttacatccgaaacgaaatccccgaacgcctcccgcattctccccacgctccctcacaaatcctttcaattcccgaaccgaaaccgaacccgtcctccgcgaacgcgacaacaaaaacgaaaaacgacgacgaatcctaaacgcgaaacaatcaaactcgaccacccccaaaacgcaacgcaaccccaactacgaacaaccgcacgaatcccaaaatcgcccgccgcgttcccaacccaaccccgaccgaaatccgcccgaaacaacgacgcctcaaacccgacaaatctctctcgaaccctaaaccgaacctcctcgccccgcccgccccaaaccccgaatataacgacaccgtcgcccgcaacgctcgccccacgaaccgcgcgtaaaaaatcccgataaataacgaaaaaaaaaaatcttcccgccgacccgcgacccccacgtacccaaataaaaaaactctcgcacaactccgcccgctccaacgactctacgctaaacatcttccccgccgcgaccaaacaacgcctaccgcctaaccaaacaccgccgccgctctatcgaaaaatccgaaaacccgcgcaactaactcgacctcaaacccgcctanctcctcgaatccgaccgccgactctcgcccaacgctaacaacgactccgcaccgtcacccccaacgcccctccnttctcctttcactncgaaaccgcgcgccaaccgcgcgcgacttcgaacacgcccgccgccccgcgtccccgcccccgaccgcccacaccgctcctccccaacgccgccgccctaactaaaaccgaaaccgaaaaaccactacgcacgctcgcgccccgaccgacccgcgccgccgcgccgccgccgccgccgccgccgccgccgctaccgccgaacgcgcccccgccaccaattcgctacgtatcgaaacgaacacgcgctccgccctaaaaactacgacgacgaatcctcctccgccgtccgatcgcgccctcgcgaaaactcgacaatacgcgtacgcccgcacccgcactccaaattaaaaaaaaaacgtctaataaattacccgaaaaaaataacgaaaacgatcctaaaaataatctatcctctatcgccgaaaactaacgaaataattccttcgcgataaaaaaatacgtccgacgcgcgacgaccacgcccaccctatcgaaacccgcgaaaccgcgaacgacgaaatctaaccttcttaaaataactctaaccgccgaaactctacgaaacgacgaaaatcgccgcctccttccccccgaacccctccctcgtctaaaaaccccaaaatcgccccgcgactatccgaaatcgccgacgacgataaaaaaaccgacgcgaaaaacgactctaaataaatttaancgacgacgaaaacaccgccgctccctctaaaatcgctcgaaacgtaaccctaaaaactctccttaatacaaaaaaaatatacgcccnactcgccaatccgtaaaaacaccgaccgnaccccgaacctacgtttctcaacgttcgaaattaccttcgcttaataacgaaacgaatcgttctaaaacttccacctctttaaaaacacgaatctatctactaaactaccgataaatttttaac

SEQ ID NO: 9165 - DNA, 861 bp, Artificial Sequence
  chemically treated genomic DNA (Homo sapiens) CpG-island No: 9165
  misc_feature (323)..(323): n is either a, c, g or t
  misc_feature (819)..(819): n is either a, c, g or t
gtcggttgcggaggtggggacgcggtcgcgcggacgagtgataggttggttcggcgtagtaaagggagcgggtgcggcggtagggttttttcgggggtagcgcgagggtttttttcggggtagcgcgggttaaggcggggtttttagagcgggggtagtagaggagggagcggaacgggagtcgggcggaggcggttgcggtagggggaggcgggaggcgggcgcgttagtttttatgttggtttcggtgttattcgcgcgtcggtcgcgtttcgggtttttttttttttttcgacgcgttacggttgtttagatatttcggnttgtcgggtttggagagtttttcgaattttttcgcggagaggagcgaggcggcgttagggtggttttcggggcgcgtttggtttcggagaagcggggacgaggtcggaggatgagcgattgagggcgacgcgggtattgacgcgagttggggtcgcgattatcggtagttgatagcgcgatgagcgattttttagagacgttttagttcggtgtgcgcgttaggcggagcgcgtaggtggggttgggttgttagtggttcgttttacgcgggtcgtcggtcggtttaggatgggcgttggtaattcgggttcgcgttcgtcgttgttatttttgcgttcgttgcgagttcggcgttcggttcgcgttttgcgtttatgtatgtaggtttggcgtcggtttttagggttgagggtgtatgttgggtgttttcgcgcggtcggacgcgttttagttgggtttagtcgtttagttgtttcggaggaatttttttttttngtttaagtttgtgaatatgggcgtttcgtttagtgttgaggt

SEQ ID NO: 9166 - DNA, 861 bp, Artificial Sequence
  chemically treated genomic DNA (Homo sapiens) CpG-island No: 9166
  misc_feature (43)..(43): n is either a, c, g or t
  misc_feature (539)..(539): n is either a, c, g or t
acctcaacactaaacgaaacgcccatattcacaaacttaaacnaaaaaaaaaaattcctccgaaacaactaaacgactaaacccaactaaaacgcgtccgaccgcgcgaaaacacccaacatacaccctcaaccctaaaaaccgacgccaaacctacatacataaacgcaaaacgcgaaccgaacgccgaactcgcaacgaacgcaaaaataacaacgacgaacgcgaacccgaattaccaacgcccatcctaaaccgaccgacgacccgcgtaaaacgaaccactaacaacccaaccccacctacgcgctccgcctaacgcgcacaccgaactaaaacgtctctaaaaaatcgctcatcgcgctatcaactaccgataatcgcgaccccaactcgcgtcaatacccgcgtcgccctcaatcgctcatcctccgacctcgtccccgcttctccgaaaccaaacgcgccccgaaaaccaccctaacgccgcctcgctcctctccgcgaaaaaattcgaaaaactctccaaacccgacaanccgaaatatctaaacaaccgtaacgcgtcgaaaaaaaaaaaaaaacccgaaacgcgaccgacgcgcgaataacaccgaaaccaacataaaaactaacgcgcccgcctcccgcctccccctaccgcaaccgcctccgcccgactcccgttccgctccctcctctactacccccgctctaaaaaccccgccttaacccgcgctaccccgaaaaaaaccctcgcgctacccccgaaaaaaccctaccgccgcacccgctccctttactacgccgaaccaacctatcactcgtccgcgcgaccgcgtccccacctccgcaaccgac

SEQ ID NO: 9167 - DNA, 861 bp, Artificial Sequence
  chemically treated genomic DNA (Homo sapiens) CpG-island No: 9167
  misc_feature (43)..(43): n is either a, c, g or t
  misc_feature (539)..(539): n is either a, c, g or t
attttaatattgggcgaagcgtttatatttataaatttgggtngggggagggggttttttcggagtagttgagcggttgaatttagttggagcgcgttcggtcgcgcggggatatttagtatgtatttttagttttgaagatcggcgttaaatttatatatatgagcgtagggcgcgggtcggacgtcgggttcgtagcgggcgtaggggtagtagcggcgggcgcgggttcgggttgttagcgtttattttgggtcggtcggcgattcgcgtggggcggattattaatagtttagttttatttgcgcgtttcgtttggcgcgtatatcgggttagggcgtttttggggagtcgtttatcgcgttgttagttgtcggtagtcgcggttttaattcgcgttagtgttcgcgtcgtttttagtcgtttatttttcggtttcgttttcgttttttcgagattaagcgcgtttcgggggttattttggcgtcgtttcgttttttttcgcggaggggttcggggagttttttagattcggtagntcggaatgtttgggtagtcgtggcgcgtcggagggaaaagagaagttcggagcgcggtcggcgcgcgagtggtatcgaggttagtatgggagttagcgcgttcgtttttcgtttttttttgtcgtagtcgttttcgttcggttttcgtttcgtttttttttttgttgttttcgttttggaggtttcgttttggttcgcgttgtttcgggggaggttttcgcgttgttttcggagaggttttatcgtcgtattcgttttttttgttgcgtcggattaatttgttattcgttcgcgcggtcgcgtttttattttcgtagtcggt

SEQ ID NO: 9168 - DNA, 861 bp, Artificial Sequence
  chemically treated genomic DNA (Homo sapiens) CpG-island No: 9168
  misc_feature (323)..(323): n is either a, c, g or t
  misc_feature (819)..(819): n is either a, c, g or t
accgactacgaaaataaaaacgcgaccgcgcgaacgaataacaaattaatccgacgcaacaaaaaaaacgaatacgacgataaaacctctccgaaaacaacgcgaaaacctcccccgaaacaacgcgaaccaaaacgaaacctccaaaacgaaaacaacaaaaaaaaaaacgaaacgaaaaccgaacgaaaacgactacgacaaaaaaaaacgaaaaacgaacgcgctaactcccatactaacctcgataccactcgcgcgccgaccgcgctccgaacttctcttttccctccgacgcgccacgactacccaaacattccganctaccgaatctaaaaaactccccgaacccctccgcgaaaaaaaacgaaacgacgccaaaataacccccgaaacgcgcttaatctcgaaaaaacgaaaacgaaaccgaaaaataaacgactaaaaacgacgcgaacactaacgcgaattaaaaccgcgactaccgacaactaacaacgcgataaacgactccccaaaaacgccctaacccgatatacgcgccaaacgaaacgcgcaaataaaactaaactattaataatccgccccacgcgaatcgccgaccgacccaaaataaacgctaacaacccgaacccgcgcccgccgctactacccctacgcccgctacgaacccgacgtccgacccgcgccctacgctcatatatataaatttaacgccgatcttcaaaactaaaaatacatactaaatatccccgcgcgaccgaacgcgctccaactaaattcaaccgctcaactactccgaaaaaaccccctcccccnacccaaatttataaatataaacgcttcgcccaatattaaaat

SEQ ID NO: 9169 - DNA, 540 bp, Artificial Sequence
  chemically treated genomic DNA (Homo sapiens) CpG-island No: 9169
aaaggtagcgagaagttcgttttttttgttttgttttcggcgatttgcggttcgggtgggagttcgtaggtttcgggtttttagcgtcgttggttagggcgcgggtaaagtttgttttttcgcgtttagtcggttttttcgttttcgtagcgtcgtaggtgtcgtttgttttcgtttttttgttgtaatcgttttattatggatttttcgatttagatttttcgcggggagtcgggttttatttgcgtttcgagcgtttgtttgttttttaatagtagcgtttggtttttcggttgggtcgagttcgatagtaacggtagcgtcggttcggaggacgcgtagttggagttcgcgtatattttttcggttatttcggttattattacggcggtttatttcgtagtgttcgtcgtgggtttggtgggtaattcgttggttatgttcgtgattattcggtgagcgcggggatagcgtagcgttgggggttgggcggggtagggagtgagggttaggtttcgttattggagtagtagtgggggt

SEQ ID NO: 9170 - DNA, 540 bp, Artificial Sequence
  chemically treated genomic DNA (Homo sapiens) CpG-island No: 9170
acccccactactactccaataacgaaacctaaccctcactccctaccccgcccaacccccaacgctacgctatccccgcgctcaccgaataatcacgaacataaccaacgaattacccaccaaacccacgacgaacactacgaaataaaccgccgtaataataaccgaaataaccgaaaaaatatacgcgaactccaactacgcgtcctccgaaccgacgctaccgttactatcgaactcgacccaaccgaaaaaccaaacgctactattaaaaaacaaacaaacgctcgaaacgcaaataaaacccgactccccgcgaaaaatctaaatcgaaaaatccataataaaacgattacaacaaaaaaacgaaaacaaacgacacctacgacgctacgaaaacgaaaaaaccgactaaacgcgaaaaaacaaactttacccgcgccctaaccaacgacgctaaaaacccgaaacctacgaactcccacccgaaccgcaaatcgccgaaaacaaaacaaaaaaaacgaacttctcgctaccttt

SEQ ID NO: 9171 - DNA, 540 bp, Artificial Sequence
  chemically treated genomic DNA (Homo sapiens) CpG-island No: 9171
gtttttattgttgttttagtggcggggtttgatttttattttttgtttcgtttagtttttagcgttgcgttgttttcgcgtttatcggatgattacgaatatgattagcgagttgtttattaagtttacgacgaatattacggagtagatcgtcgtgatgatgatcgggatggtcggggagatgtgcgcgggttttagttgcgcgtttttcgagtcggcgttgtcgttgttgtcgggttcggtttagtcgggaaattaggcgttgttgttggggggtaggtaggcgttcggggcgtaggtagggttcggtttttcgcggaagatttggatcggggagtttatggtggggcgattgtagtaggaaggcgaggataggcggtatttgcggcgttgcgggagcgaaagaatcggttggacgcggagaggtaaattttgttcgcgttttggttagcggcgttggggattcggagtttgcggatttttattcgggtcgtaagtcgtcgggggtaggatagggagaacggatttttcgttgttttt

SEQ ID NO: 9172 - DNA, 540 bp, Artificial Sequence
  chemically treated genomic DNA (Homo sapiens) CpG-island No: 9172
aaaaacaacgaaaaatccgttctccctatcctacccccgacgacttacgacccgaataaaaatccgcaaactccgaatccccaacgccgctaaccaaaacgcgaacaaaatttacctctccgcgtccaaccgattctttcgctcccgcaacgccgcaaataccgcctatcctcgccttcctactacaatcgccccaccataaactccccgatccaaatcttccgcgaaaaaccgaaccctacctacgccccgaacgcctacctaccccccaacaacaacgcctaatttcccgactaaaccgaacccgacaacaacgacaacgccgactcgaaaaacgcgcaactaaaacccgcgcacatctccccgaccatcccgatcatcatcacgacgatctactccgtaatattcgtcgtaaacttaataaacaactcgctaatcatattcgtaatcatccgataaacgcgaaaacaacgcaacgctaaaaactaaacgaaacaaaaaataaaaatcaaaccccgccactaaaacaacaataaaaac

SEQ ID NO: 9173 - DNA, 638 bp, Artificial Sequence
  chemically treated genomic DNA (Homo sapiens) CpG-island No: 9173
atgtacgtgtgtatacggcgcggtatgtttacgcgtttttacgggcggattggtatttaggcgtggtcgtgcgtatatatacgtatatgtatatagttattagcgtttattcgcgttttttcgtaggtatatataaatagaattcgtattcgcgttttcgtttatacgtttttcgtagggtgtcgggtggaattcgggtttttttaatttttttattcgagaatttcgcgcggagtcgagggtagttttggggcggcgttcgacggggtttggcgaggggatttcgcgttattttttcgggaggttgtgtttgagggtttttttgggttcgtagtcgtattggagttgggggcggtggttaacggcggtcgtacggtttaggttcggagcgggtattagggatcgatattgttatttagcggtgcgtatagtttcggcggcggcggttcgttttttagatgttaggcgtatttggattttagggaaggcgttagagggggtcggaatgtttgcgggtgatttcgaggtgtttaaaacgacgatagttggggcggggcggagtcggggagattttgagtttcgttttgttagtatttggtagtttttttacgcgggttaagagtaggatttaattatcg

SEQ ID NO: 9174 - DNA, 638 bp, Artificial Sequence
  chemically treated genomic DNA (Homo sapiens) CpG-island No: 9174
cgataattaaatcctactcttaacccgcgtaaaaaaactaccaaatactaacaaaacgaaactcaaaatctccccgactccgccccgccccaactatcgtcgttttaaacacctcgaaatcacccgcaaacattccgaccccctctaacgccttccctaaaatccaaatacgcctaacatctaaaaaacgaaccgccgccgccgaaactatacgcaccgctaaataacaatatcgatccctaatacccgctccgaacctaaaccgtacgaccgccgttaaccaccgcccccaactccaatacgactacgaacccaaaaaaaccctcaaacacaacctcccgaaaaaataacgcgaaatcccctcgccaaaccccgtcgaacgccgccccaaaactaccctcgactccgcgcgaaattctcgaataaaaaaattaaaaaaacccgaattccacccgacaccctacgaaaaacgtataaacgaaaacgcgaatacgaattctatttatatatacctacgaaaaaacgcgaataaacgctaataactatatacatatacgtatatatacgcacgaccacgcctaaataccaatccgcccgtaaaaacgcgtaaacataccgcgccgtatacacacgtacat

SEQ ID NO: 9175 - DNA, 638 bp, Artificial Sequence
  chemically treated genomic DNA (Homo sapiens) CpG-island No: 9175
cggtgattaagttttgtttttggttcgcgtgagggagttgttaggtgttgatagggcgaggtttagggttttttcgatttcgtttcgttttagttgtcgtcgttttggatatttcggggttattcgtagatatttcgattttttttggcgttttttttggaatttagatacgtttggtatttggggagcgagtcgtcgtcgtcggggttgtgcgtatcgttagatggtaatgtcggtttttggtgttcgtttcggatttagatcgtgcggtcgtcgttggttatcgtttttaattttaatgcgattgcgaatttagaggagtttttaggtatagtttttcggggaagtgacgcggggttttttcgttaggtttcgtcggacgtcgttttagagttgttttcggtttcgcgcggggttttcgggtgggaaagttgagggagttcggattttattcggtattttgcgaggaacgtgtgggcgggagcgcgagtgcgagttttgtttgtgtgtgtttacgggggagcgcgagtagacgttagtagttgtatgtatgtgcgtgtgtgtgcgtacggttacgtttggatattagttcgttcgtgagagcgcgtgagtatgtcgcgtcgtgtgtatacgtgtat

SEQ ID NO: 9176 - DNA, 638 bp, Artificial Sequence
  chemically treated genomic DNA (Homo sapiens) CpG-island No: 9176
atacacgtatacacacgacgcgacatactcacgcgctctcacgaacgaactaatatccaaacgtaaccgtacgcacacacacgcacatacatacaactactaacgtctactcgcgctcccccgtaaacacacacaaacaaaactcgcactcgcgctcccgcccacacgttcctcgcaaaataccgaataaaatccgaactccctcaactttcccacccgaaaaccccgcgcgaaaccgaaaacaactctaaaacgacgtccgacgaaacctaacgaaaaaaccccgcgtcacttccccgaaaaactatacctaaaaactcctctaaattcgcaatcgcattaaaattaaaaacgataaccaacgacgaccgcacgatctaaatccgaaacgaacaccaaaaaccgacattaccatctaacgatacgcacaaccccgacgacgacgactcgctccccaaataccaaacgtatctaaattccaaaaaaaacgccaaaaaaaatcgaaatatctacgaataaccccgaaatatccaaaacgacgacaactaaaacgaaacgaaatcgaaaaaaccctaaacctcgccctatcaacacctaacaactccctcacgcgaaccaaaaacaaaacttaatcaccg

SEQ ID NO: 9177 - DNA, 935 bp, Artificial Sequence
  chemically treated genomic DNA (Homo sapiens) CpG-island No: 9177
ttttcgcgagtgtatatttgtgagcgtgtagttgtttggtagcggagggatcgggggaggaaagatgcgcgtttggatgcgcgtagtgcgagtgtgttaggtcgggagatttagttttatttaggcgggtcgggtcgggttgggggtagggttttttgttgtttcgtttattcgtcgtttcgtttttcggatcgttttagcgggttgtagcgtagcgggcgttcggtagagggcgttgcgggttcggtgttatcgtgcggtcgagggggcgtgttcggcggcgggtaggtagcggttcggttagttatgcggggttttgcggtcgcggttggcggtattttttggagcggcggcggtagcggtttttcgggtatttgggcgtggggagcgggggcgcgcggcgcggggcgggcggagcgagcgcgcgttatggaggtggcgggcggcgcggagcgggcgtgttgaatttcggtcgtcggttcggtatgggcgtttttcgcgggtttttcgtcggtcggggttagggtcggatggagtcgcgggacggtagtttcgaggttcggagtagcgatttcgagtcggttttcgtttcgtttagcggtttcgagcgcgacgtcggtttcgagtcggataaggcgtcgcggcgatttaataagcggcgtttttcggggttgcggtttttcgggtataggtgagcggggcggcggcggggtaggtatcgaggtatcggtaggttatcgtttttttatcgggggatatttttcggttattgggggtgtcgggttatttcggtattgatattgagtcggggagaggttggtatcggcggtacgagtcgttttggcgtgggtatttattggggagttattttttagggtcgggatacgggcgggatcggtcggtttggtattgttatcgggtgggggttatttttt

SEQ ID NO: 9178 - DNA, 935 bp, Artificial Sequence
  chemically treated genomic DNA (Homo sapiens) CpG-island No: 9178
aaaaaataacccccacccgataacaataccaaaccgaccgatcccgcccgtatcccgaccctaaaaaataactccccaataaatacccacgccaaaacgactcgtaccgccgataccaacctctccccgactcaatatcaataccgaaataacccgacacccccaataaccgaaaaatatcccccgataaaaaaacgataacctaccgatacctcgatacctaccccgccgccgccccgctcacctatacccgaaaaaccgcaaccccgaaaaacgccgcttattaaatcgccgcgacgccttatccgactcgaaaccgacgtcgcgctcgaaaccgctaaacgaaacgaaaaccgactcgaaatcgctactccgaacctcgaaactaccgtcccgcgactccatccgaccctaaccccgaccgacgaaaaacccgcgaaaaacgcccataccgaaccgacgaccgaaattcaacacgcccgctccgcgccgcccgccacctccataacgcgcgctcgctccgcccgccccgcgccgcgcgcccccgctccccacgcccaaatacccgaaaaaccgctaccgccgccgctccaaaaaataccgccaaccgcgaccgcaaaaccccgcataactaaccgaaccgctacctacccgccgccgaacacgccccctcgaccgcacgataacaccgaacccgcaacgccctctaccgaacgcccgctacgctacaacccgctaaaacgatccgaaaaacgaaacgacgaataaacgaaacaacaaaaaaccctacccccaacccgacccgacccgcctaaataaaactaaatctcccgacctaacacactcgcactacgcgcatccaaacgcgcatctttcctcccccgatccctccgctaccaaacaactacacgctcacaaatatacactcgcgaaaa

SEQ ID NO: 9179 - DNA, 935 bp, Artificial Sequence
  chemically treated genomic DNA (Homo sapiens) CpG-island No: 9179
agggaatgatttttattcggtgatagtgttaagtcgatcgatttcgttcgtgtttcggttttgggggatgattttttagtgggtgtttacgttaagacggttcgtgtcgtcggtgttagttttttttcgatttagtgttagtatcgaagtggttcggtatttttagtggtcgaggaatgtttttcggtgagggagcggtaatttgtcggtgtttcggtgtttgtttcgtcgtcgtttcgtttatttgtgttcgaagagtcgtagtttcgggaagcgtcgtttgttgagtcgtcgcggcgttttgttcggttcgggatcggcgtcgcgttcggagtcgttggacgaggcggaagtcgattcggagtcgttgtttcgggtttcggggttatcgtttcgcggttttattcggttttagtttcggtcggcggagggttcgcgggagacgtttatgtcgggtcggcggtcggggtttagtacgttcgtttcgcgtcgttcgttatttttatggcgcgcgttcgtttcgttcgtttcgcgtcgcgcgttttcgttttttacgtttaggtgttcgggaagtcgttgtcgtcgtcgttttaggaagtgtcgttagtcgcggtcgtaggatttcgtatagttggtcgggtcgttgtttgttcgtcgtcgagtacgttttttcggtcgtacggtggtatcgggttcgtagcgttttttgtcggacgttcgttgcgttgtagttcgttggggcggttcgaggggcggggcgacgaatgggcggggtagtagaaagttttgtttttagttcggttcggttcgtttggatgggattgaatttttcggtttggtatattcgtattgcgcgtatttagacgcgtattttttttttttcgattttttcgttattaaataattgtacgtttataagtgtatattcgcgaggg

SEQ ID NO: 9180 - DNA, 935 bp, Artificial Sequence
  chemically treated genomic DNA (Homo sapiens) CpG-island No: 9180
ccctcgcgaatatacacttataaacgtacaattatttaataacgaaaaaatcgaaaaaaaaaaaatacgcgtctaaatacgcgcaatacgaatataccaaaccgaaaaattcaatcccatccaaacgaaccgaaccgaactaaaaacaaaactttctactaccccgcccattcgtcgccccgcccctcgaaccgccccaacgaactacaacgcaacgaacgtccgacaaaaaacgctacgaacccgataccaccgtacgaccgaaaaaacgtactcgacgacgaacaaacaacgacccgaccaactatacgaaatcctacgaccgcgactaacgacacttcctaaaacgacgacgacaacgacttcccgaacacctaaacgtaaaaaacgaaaacgcgcgacgcgaaacgaacgaaacgaacgcgcgccataaaaataacgaacgacgcgaaacgaacgtactaaaccccgaccgccgacccgacataaacgtctcccgcgaaccctccgccgaccgaaactaaaaccgaataaaaccgcgaaacgataaccccgaaacccgaaacaacgactccgaatcgacttccgcctcgtccaacgactccgaacgcgacgccgatcccgaaccgaacaaaacgccgcgacgactcaacaaacgacgcttcccgaaactacgactcttcgaacacaaataaacgaaacgacgacgaaacaaacaccgaaacaccgacaaattaccgctccctcaccgaaaaacattcctcgaccactaaaaataccgaaccacttcgatactaacactaaatcgaaaaaaaactaacaccgacgacacgaaccgtcttaacgtaaacacccactaaaaaatcatcccccaaaaccgaaacacgaacgaaatcgatcgacttaacactatcaccgaataaaaatcattccct

SEQ ID NO: 9181 - DNA, 824 bp, Artificial Sequence
  chemically treated genomic DNA (Homo sapiens) CpG-island No: 9181
gttttcgtaggtgtagttggcggaaacgtttttttatcgggggtttagcggtcgtgtttcgggaattttcgggttagggttgcgcgatttgggtttttttttcgcgtcggtatcgtcgtcgtattatttttttttcggttgttcggtcgtcgttagtttagttttagcgttgtttttcgtcgttttgtttttcggttatcgtgcggtcgtttttcgttcgcggtttttgcggtttttcgggtattcgtttaagttcgagtttttagttcgttcgggtcggggacgcgaggcggggagggaggggagcgtcgggtttcgttggtttttagcgacgtcgacgtttagacgataggagtagcgagatgttgggcgttgcgtttgggagaggcgggtcggggtttttttgcgtttcgggggggcgggggtttttggttggagtcggggtgttgcgttttgcgcgtcgcggcgtttttcggacggttggagcggagtcggagttcgggcggagagcgagtttttgtaatcgtcgttgttgtcgcgtattcgagtgttattttagagatattttttagtcggtggggttcggaggggagggcgtcgtttcgtttagttcgttcgtttagggtacgaagggagcgagttcggtttagtttattacgggtacgaatttagtttagggcgtaaggttcggggtgtggggcgttttttgcgattatttatgcgttttcgttcgggttttagtttaggtagttcggtagttgttaattattatttcgtcgtttgttatttagttattgcgatgtgttttttttatttttacggtt

SEQ ID NO: 9182 - DNA, 824 bp, Artificial Sequence
  chemically treated genomic DNA (Homo sapiens) CpG-island No: 9182
aaccgtaaaaataaaaaaaacacatcgcaataactaaataacaaacgacgaaataataattaacaactaccgaactacctaaactaaaacccgaacgaaaacgcataaataatcgcaaaaaacgccccacaccccgaaccttacgccctaaactaaattcgtacccgtaataaactaaaccgaactcgctcccttcgtaccctaaacgaacgaactaaacgaaacgacgccctcccctccgaaccccaccgactaaaaaatatctctaaaataacactcgaatacgcgacaacaacgacgattacaaaaactcgctctccgcccgaactccgactccgctccaaccgtccgaaaaacgccgcgacgcgcaaaacgcaacaccccgactccaaccaaaaacccccgcccccccgaaacgcaaaaaaaccccgacccgcctctcccaaacgcaacgcccaacatctcgctactcctatcgtctaaacgtcgacgtcgctaaaaaccaacgaaacccgacgctcccctccctccccgcctcgcgtccccgacccgaacgaactaaaaactcgaacttaaacgaatacccgaaaaaccgcaaaaaccgcgaacgaaaaacgaccgcacgataaccgaaaaacaaaacgacgaaaaacaacgctaaaactaaactaacgacgaccgaacaaccgaaaaaaaaataatacgacgacgataccgacgcgaaaaaaaaacccaaatcgcgcaaccctaacccgaaaattcccgaaacacgaccgctaaacccccgataaaaaaacgtttccgccaactacacctacgaaaac

SEQ ID NO: 9183 - DNA, 824 bp, Artificial Sequence
  chemically treated genomic DNA (Homo sapiens) CpG-island No: 9183
agtcgtgggggtggaggggatatatcgtagtagttgagtgataggcggcggggtgatgattggtagttgtcgagttgtttggattaggattcgggcgggggcgtataggtggtcgtaggaggcgttttatatttcgggttttgcgttttgagttaggttcgtgttcgtggtgggttgggtcgggttcgtttttttcgtgttttgagcgggcgggttgggcggagcggcgttttttttttcggattttatcggttggagagtgtttttaaggtgatattcgggtgcgcggtagtagcggcggttgtaggagttcgtttttcgttcgggtttcggtttcgttttagtcgttcggggggcgtcgcggcgcgtagagcgtagtatttcgattttagttaggagttttcgttttttcggagcgtaggaggatttcggttcgttttttttaggcgtagcgtttagtatttcgttgtttttgtcgtttaagcgtcggcgtcgttagggattagcggaattcggcgttttttttttttttcgtttcgcgttttcggttcgggcggattggagattcgaatttgagcgggtgttcgaaaggtcgtaggagtcgcgggcggaaggcggtcgtacgatggtcgaggggtagggcggcggagggtagcgttgggattgggttggcggcggtcgggtagtcgaggaggaggtggtgcggcggcgatgtcggcgcggggaggaggtttaggtcgcgtagttttggttcgagggttttcggggtacggtcgttgggttttcggtggaggagcgttttcgttagttgtatttacgaaagt

SEQ ID NO: 9184 - DNA, 824 bp, Artificial Sequence
  chemically treated genomic DNA (Homo sapiens) CpG-island No: 9184
actttcgtaaatacaactaacgaaaacgctcctccaccgaaaacccaacgaccgtaccccgaaaaccctcgaaccaaaactacgcgacctaaacctcctccccgcgccgacatcgccgccgcaccacctcctcctcgactacccgaccgccgccaacccaatcccaacgctaccctccgccgccctacccctcgaccatcgtacgaccgccttccgcccgcgactcctacgacctttcgaacacccgctcaaattcgaatctccaatccgcccgaaccgaaaacgcgaaacgaaaaaaaaaaaaaacgccgaattccgctaatccctaacgacgccgacgcttaaacgacaaaaacaacgaaatactaaacgctacgcctaaaaaaaacgaaccgaaatcctcctacgctccgaaaaaacgaaaactcctaactaaaatcgaaatactacgctctacgcgccgcgacgccccccgaacgactaaaacgaaaccgaaacccgaacgaaaaacgaactcctacaaccgccgctactaccgcgcacccgaatatcaccttaaaaacactctccaaccgataaaatccgaaaaaaaaaacgccgctccgcccaacccgcccgctcaaaacacgaaaaaaacgaacccgacccaacccaccacgaacacgaacctaactcaaaacgcaaaacccgaaatataaaacgcctcctacgaccacctatacgcccccgcccgaatcctaatccaaacaactcgacaactaccaatcatcaccccgccgcctatcactcaactactacgatatatcccctccacccccacgact

SEQ ID NO: 9185 - DNA, 704 bp, Artificial Sequence
  chemically treated genomic DNA (Homo sapiens) CpG-island No: 9185
aacgcggcgttttttcgcgggttgggaaagaagttggtagttgggtataggtcggcgttttcgttttcgttttgattatattggggggattttgagttattttcgcgttttttcgggattttagcgttttgcgtggtttcgttggcggtttggtcgcgaggcgcgggagtttgattttagcgggaggttgcgggtgggtggggcgggttgcgtcgttagggattcgtcggggtcgagggtcgggagttttagtcgcgtcgttgcgtgtcggtcgggtcgttcgcgaggaggggcgtcgtcggggtttggggaagcgtaggagcgggtggattggagaggttcggtcggggagagaagagtttatcgcggattattcgttcgtattcgttcggttgtttgtttagcgtttcgggtcggggaaggggcgcgtttttgtttttttagttttgggatgggacgcgtcgttagtttaggcgtagtttggatcgttagtttatcgtcgtttgtgagggatagtcggttgtttaaggtcgtcggggtcggagttcgggataagatttcggagagcgggtagttaattttagaggtcgttgggaatcgtacgggtcgtagttttaggatttcgggtttcgtttaggttgggcggattttggggcggttttagtatttcggagagtttttcgcgttttggtttagtagtttcg

SEQ ID NO: 9186 - DNA, 704 bp, Artificial Sequence
  chemically treated genomic DNA (Homo sapiens) CpG-island No: 9186
cgaaactactaaaccaaaacgcgaaaaactctccgaaatactaaaaccgccccaaaatccgcccaacctaaacgaaacccgaaatcctaaaactacgacccgtacgattcccaacgacctctaaaattaactacccgctctccgaaatcttatcccgaactccgaccccgacgaccttaaacaaccgactatccctcacaaacgacgataaactaacgatccaaactacgcctaaactaacgacgcgtcccatcccaaaactaaaaaaacaaaaacgcgccccttccccgacccgaaacgctaaacaaacaaccgaacgaatacgaacgaataatccgcgataaactcttctctccccgaccgaacctctccaatccacccgctcctacgcttccccaaaccccgacgacgcccctcctcgcgaacgacccgaccgacacgcaacgacgcgactaaaactcccgaccctcgaccccgacgaatccctaacgacgcaacccgccccacccacccgcaacctcccgctaaaatcaaactcccgcgcctcgcgaccaaaccgccaacgaaaccacgcaaaacgctaaaatcccgaaaaaacgcgaaaataactcaaaatccccccaatataatcaaaacgaaaacgaaaacgccgacctatacccaactaccaacttctttcccaacccgcgaaaaaacgccgcgtt

SEQ ID NO: 9187 - DNA, 704 bp, Artificial Sequence
  chemically treated genomic DNA (Homo sapiens) CpG-island No: 9187
cgaggttgttgggttagggcgcggggagtttttcgaggtgttgaagtcgttttaaggttcgtttagtttgggcgaggttcggagttttgaggttacggttcgtgcggtttttagcgatttttgagattggttgttcgtttttcgggattttgtttcgggtttcggtttcggcgattttgggtaatcgattgttttttataggcggcggtgaattggcggtttaggttgcgtttggattggcggcgcgttttattttagggttgggagagtaggggcgcgtttttttttcggttcggaacgttgagtaggtagtcgagcgggtgcgggcgagtggttcgcggtgggttttttttttttcggtcgaatttttttagtttattcgtttttgcgtttttttaggtttcgacggcgttttttttcgcgggcggttcggtcggtacgtagcggcgcggttggagttttcggttttcgatttcgacggatttttggcggcgtagttcgttttatttattcgtagtttttcgttggggttagattttcgcgtttcgcggttaaatcgttagcggggttacgtagggcgttgaggtttcggagaggcgcgaaaatagtttagggtttttttagtatggttagggcggaggcgggagcgtcggtttgtatttagttgttagttttttttttagttcgcgagggggcgtcgcgtt

SEQ ID NO: 9188 - DNA, 704 bp, Artificial Sequence
  chemically treated genomic DNA (Homo sapiens) CpG-island No: 9188
aacgcgacgccccctcgcgaactaaaaaaaaaactaacaactaaatacaaaccgacgctcccgcctccgccctaaccatactaaaaaaaccctaaactattttcgcgcctctccgaaacctcaacgccctacgtaaccccgctaacgatttaaccgcgaaacgcgaaaatctaaccccaacgaaaaactacgaataaataaaacgaactacgccgccaaaaatccgtcgaaatcgaaaaccgaaaactccaaccgcgccgctacgtaccgaccgaaccgcccgcgaaaaaaaacgccgtcgaaacctaaaaaaacgcaaaaacgaataaactaaaaaaattcgaccgaaaaaaaaaaaacccaccgcgaaccactcgcccgcacccgctcgactacctactcaacgttccgaaccgaaaaaaaaacgcgcccctactctcccaaccctaaaataaaacgcgccgccaatccaaacgcaacctaaaccgccaattcaccgccgcctataaaaaacaatcgattacccaaaatcgccgaaaccgaaacccgaaacaaaatcccgaaaaacgaacaaccaatctcaaaaatcgctaaaaaccgcacgaaccgtaacctcaaaactccgaacctcgcccaaactaaacgaaccttaaaacgacttcaacacctcgaaaaactccccgcgccctaacccaacaacctcg

SEQ ID NO: 9189 - DNA, 723 bp, Artificial Sequence
  chemically treated genomic DNA (Homo sapiens) CpG-island No: 9189
  misc_feature (93)..(93): n is either a, c, g or t
cggtcgggcgattttaaaagttgtagtagtaagcggtttcgcggcgtggttttagaattgggggtttagtcgtatagtgttcggatttcgttnatattttgtagttacgttgttgcgacgagcgggagtcgggttagatcgcgaggttattcgtggagtttcgggtattttttgtaaggtcgtttatcgagtttcgagtttcgtttatggggttatattttgagttcgtcgcgtatagacgcgttatatagtgttattaattttttatattttaaaattaacgtcgttttcggagtgatttttttaagagtagcggcgttgtcgttagttatatcgtatagtcgtacgttgtcgtaaaatggttttcgtaggtttattttattcgttttttaggttagaaatgcgcggtacgtacgttttttttttacggagcggggacgaggggtattacggggtaggagtgttttagaggggtttgtgcgggcgtaagtttgggagaaataatagacggaaaggggtggaaagtggtagggttttaggggaggtattcgaaagggtgagacggggtttaagagatgataagggtacgatcgagggggaggggtttaaaaaggcgtagagacgcgggttaattgcggtcgagtggtttgagagtttgggtcgaggggcgtggttaagttttttggaaaagttggaagtgagttcgggaattggttagggtag

SEQ ID NO: 9190 - DNA, 723 bp, Artificial Sequence
  chemically treated genomic DNA (Homo sapiens) CpG-island No: 9190
  misc_feature (631)..(631): n is either a, c, g or t
ctaccctaaccaattcccgaactcacttccaacttttccaaaaaacttaaccacgcccctcgacccaaactctcaaaccactcgaccgcaattaacccgcgtctctacgcctttttaaacccctccccctcgatcgtacccttatcatctcttaaaccccgtctcaccctttcgaatacctcccctaaaaccctaccactttccacccctttccgtctattatttctcccaaacttacgcccgcacaaacccctctaaaacactcctaccccgtaatacccctcgtccccgctccgtaaaaaaaaaacgtacgtaccgcgcatttctaacctaaaaaacgaataaaataaacctacgaaaaccattttacgacaacgtacgactatacgatataactaacgacaacgccgctactcttaaaaaaatcactccgaaaacgacgttaattttaaaatataaaaaattaataacactatataacgcgtctatacgcgacgaactcaaaatataaccccataaacgaaactcgaaactcgataaacgaccttacaaaaaatacccgaaactccacgaataacctcgcgatctaacccgactcccgctcgtcgcaacaacgtaactacaaaatatnaacgaaatccgaacactatacgactaaacccccaattctaaaaccacgccgcgaaaccgcttactactacaacttttaaaatcgcccgaccg

SEQ ID NO: 9191 - DNA, 723 bp, Artificial Sequence
  chemically treated genomic DNA (Homo sapiens) CpG-island No: 9191
  misc_feature (631)..(631): n is either a, c, g or t
ttgttttagttagttttcgggtttatttttagtttttttagaaagtttggttacgtttttcggtttagatttttaggttattcggtcgtaattaattcgcgtttttgcgtttttttaggtttttttttttcggtcgtgtttttgttattttttaggtttcgttttattttttcggatgttttttttagaattttattattttttattttttttcgtttgttattttttttaaatttgcgttcgtataggtttttttggaatatttttgtttcgtagtgtttttcgttttcgtttcgtagagaaagagcgtgcgtgtcgcgtatttttggtttggggagcgggtggagtaaatttgcgggaattattttacgataacgtgcggttgtgcggtgtggttgacggtaacgtcgttgtttttggagaggttatttcggagacggcgttggttttggggtgtggggggttggtggtattatgtggcgcgtttgtgcgcgacgggtttagaatgtagttttatgggcgggattcgaggttcggtggacggttttgtaggaggtattcggaattttacgagtgatttcgcgatttggttcggttttcgttcgtcgtaatagcgtgattatagggtatnggcggggttcgggtattgtgcggttggatttttagttttggggttacgtcgcggaatcgtttattgttgtagtttttggggtcgttcggtcg

SEQ ID NO: 9192 - DNA, 723 bp, Artificial Sequence
  chemically treated genomic DNA (Homo sapiens) CpG-island No: 9192
  misc_feature (93)..(93): n is either a, c, g or t
cgaccgaacgaccccaaaaactacaacaataaacgattccgcgacgtaaccccaaaactaaaaatccaaccgcacaatacccgaaccccgccnataccctataatcacgctattacgacgaacgaaaaccgaaccaaatcgcgaaatcactcgtaaaattccgaatacctcctacaaaaccgtccaccgaacctcgaatcccgcccataaaactacattctaaacccgtcgcgcacaaacgcgccacataataccaccaaccccccacaccccaaaaccaacgccgtctccgaaataacctctccaaaaacaacgacgttaccgtcaaccacaccgcacaaccgcacgttatcgtaaaataattcccgcaaatttactccacccgctccccaaaccaaaaatacgcgacacgcacgctctttctctacgaaacgaaaacgaaaaacactacgaaacaaaaatattccaaaaaaacctatacgaacgcaaatttaaaaaaaataacaaacgaaaaaaaataaaaaataataaaattctaaaaaaaacatccgaaaaaataaaacgaaacctaaaaaataacaaaaacacgaccgaaaaaaaaaaacctaaaaaaacgcaaaaacgcgaattaattacgaccgaataacctaaaaatctaaaccgaaaaacgtaaccaaactttctaaaaaaactaaaaataaacccgaaaactaactaaaacaa

SEQ ID NO: 9193 - DNA, 845 bp, Artificial Sequence
  chemically treated genomic DNA (Homo sapiens) CpG-island No: 9193
  misc_feature (85)..(85): n is either a, c, g or t
  misc_feature (316)..(316): n is either a, c, g or t
  misc_feature (712)..(712): n is either a, c, g or t
  misc_feature (718)..(718): n is either a, c, g or t
  misc_feature (828)..(828): n is either a, c, g or t
  misc_feature (835)..(835): n is either a, c, g or t
gcggttacggtcgggaggttcggattggcgttcgggggtcggggtcggggtaagcgggcgtgggggaggggagcggttttttttngttcgcggtatcggttcgcgtcgggagcgggttaattttaaatcgggggtttggttgtttttggacggttacgttttttttgttcgttagtcggttcgttagtttcggtttcggcgttttttttcggtatttatttcggcgttgcggaaagattgattgttaggtacgcgggttttcgggtttgagaggggtagcggtgttgacgagtttcggtttagttttcgtcggttnttcgtcgtgaggtggattgataggttagcgggacgtagaggggcgcggcgttcgggcgatacggtatcgggagagggttcgggagggtggcggcggcggcggcggcggtcgtttttcgtttttcgtttcgtcgggggtcgtgagggaggagttgagttttcgcgtagaggggcgggggcgaacgagggggaggggcggggttgtcgtggtttcgggcgcgggtttgttcgcgtttaggtttcgcgtagttaaggggaggcgtcggttacggttcgatttttcgcgttaaatttttaaatcgaaggcggaaggttcggtttcgtttttggcgtcgtcggttaatcgtaggttcgttttcggttttttgattggtcgggaattgttgttttggaaatntacgantgatgttgttcgggaattgtcgggattgcggcgggcggatagggtttgggggaggggtttttggtcgaaagttgggggaagtgtattgagcgagtggcggtcgggggatnagtattntgtttgtttt

SEQ ID NO: 9194 - DNA, 845 bp, Artificial Sequence
  chemically treated genomic DNA (Homo sapiens) CpG-island No: 9194
  misc_feature (11)..(11): n is either a, c, g or t
  misc_feature (18)..(18): n is either a, c, g or t
  misc_feature (128)..(128): n is either a, c, g or t
  misc_feature (134)..(134): n is either a, c, g or t
  misc_feature (530)..(530): n is either a, c, g or t
  misc_feature (761)..(761): n is either a, c, g or t
aaaacaaacanaatactnatcccccgaccgccactcgctcaatacacttcccccaactttcgaccaaaaacccctcccccaaaccctatccgcccgccgcaatcccgacaattcccgaacaacatcantcgtanatttccaaaacaacaattcccgaccaatcaaaaaaccgaaaacgaacctacgattaaccgacgacgccaaaaacgaaaccgaaccttccgccttcgatttaaaaatttaacgcgaaaaatcgaaccgtaaccgacgcctccccttaactacgcgaaacctaaacgcgaacaaacccgcgcccgaaaccacgacaaccccgcccctccccctcgttcgcccccgcccctctacgcgaaaactcaactcctccctcacgacccccgacgaaacgaaaaacgaaaaacgaccgccgccgccgccgccgccaccctcccgaaccctctcccgataccgtatcgcccgaacgccgcgcccctctacgtcccgctaacctatcaatccacctcacgacgaanaaccgacgaaaactaaaccgaaactcgtcaacaccgctacccctctcaaacccgaaaacccgcgtacctaacaatcaatctttccgcaacgccgaaataaataccgaaaaaaaacgccgaaaccgaaactaacgaaccgactaacgaacaaaaaaaacgtaaccgtccaaaaacaaccaaacccccgatttaaaattaacccgctcccgacgcgaaccgataccgcgaacnaaaaaaaaccgctcccctcccccacgcccgcttaccccgaccccgacccccgaacgccaatccgaacctcccgaccgtaaccgc

SEQ ID NO: 9195 - DNA, 845 bp, Artificial Sequence
  chemically treated genomic DNA (Homo sapiens) CpG-island No: 9195
  misc_feature (11)..(11): n is either a, c, g or t
  misc_feature (18)..(18): n is either a, c, g or t
  misc_feature (128)..(128): n is either a, c, g or t
  misc_feature (134)..(134): n is either a, c, g or t
  misc_feature (530)..(530): n is either a, c, g or t
  misc_feature (761)..(761): n is either a, c, g or t
aaggtaagtanggtattngtttttcggtcgttattcgtttagtgtattttttttaattttcggttaaaggttttttttttaggttttgttcgttcgtcgtagtttcgatagttttcggatagtattantcgtgngtttttaggataataattttcgattaattagagggtcggaagcgggtttgcgattggtcgacggcgttaggggcggggtcggatttttcgttttcgatttaaaaatttggcgcggaaagtcggatcgtggtcggcgtttttttttagttgcgcggggtttgagcgcgggtaaattcgcgttcggaattacggtaatttcgtttttttttttcgttcgttttcgtttttttgcgcgggagtttagttttttttttacggttttcggcgaagcgggaggcgggaaacggtcgtcgtcgtcgtcgtcgttattttttcgagttttttttcggtgtcgtgtcgttcgggcgtcgcgtttttttgcgtttcgttgatttgttagtttattttacggcgggnagtcggcgggggttgagtcgggattcgttagtatcgttgttttttttaggttcgggagttcgcgtatttggtagttagttttttcgtagcgtcgaggtgggtgtcggagagagacgtcgggatcgggattggcgggtcggttggcgggtagagggagcgtgatcgtttaggagtagttaagttttcgatttgaaattaattcgttttcggcgcgagtcgatatcgcgggtnggggagggtcgttttttttttttacgttcgtttgtttcggtttcggttttcgagcgttaattcgagtttttcgatcgtagtcgt

SEQ ID NO: 9196 - DNA, 845 bp, Artificial Sequence
  chemically treated genomic DNA (Homo sapiens) CpG-island No: 9196
  misc_feature (85)..(85): n is either a, c, g or t
  misc_feature (316)..(316): n is either a, c, g or t
  misc_feature (712)..(712): n is either a, c, g or t
  misc_feature (718)..(718): n is either a, c, g or t
  misc_feature (828)..(828): n is either a, c, g or t
  misc_feature (835)..(835): n is either a, c, g or t
acgactacgatcgaaaaactcgaattaacgctcgaaaaccgaaaccgaaacaaacgaacgtaaaaaaaaaaaacgaccctccccnacccgcgatatcgactcgcgccgaaaacgaattaatttcaaatcgaaaacttaactactcctaaacgatcacgctccctctacccgccaaccgacccgccaatcccgatcccgacgtctctctccgacacccacctcgacgctacgaaaaaactaactaccaaatacgcgaactcccgaacctaaaaaaaacaacgatactaacgaatcccgactcaacccccgccgactncccgccgtaaaataaactaacaaatcaacgaaacgcaaaaaaacgcgacgcccgaacgacacgacaccgaaaaaaaactcgaaaaaataacgacgacgacgacgacgaccgtttcccgcctcccgcttcgccgaaaaccgtaaaaaaaaaactaaactcccgcgcaaaaaaacgaaaacgaacgaaaaaaaaaaacgaaattaccgtaattccgaacgcgaatttacccgcgctcaaaccccgcgcaactaaaaaaaaacgccgaccacgatccgactttccgcgccaaatttttaaatcgaaaacgaaaaatccgaccccgcccctaacgccgtcgaccaatcgcaaacccgcttccgaccctctaattaatcgaaaattattatcctaaaaacncacgantaatactatccgaaaactatcgaaactacgacgaacgaacaaaacctaaaaaaaaaacctttaaccgaaaattaaaaaaaatacactaaacgaataacgaccgaaaaacnaataccntacttacctt

SEQ ID NO: 9197 - DNA, 1237 bp, Artificial Sequence
  chemically treated genomic DNA (Homo sapiens) CpG-island No: 9197
gtttagcggagacgcggagtttatagtagcgtttttcggagttttaatacgtcgttgttattattcgcgtcgggatttcgtagtcgagttcggtcgttcgtaggacgttttaggagcgtcgcggatcgggcggtacgggacgttgcggggttgagtttaagagtttaggttcgcgtcgagtttaatcggattcggacgttgcgcgcggagtgcgcgtcgagtgcgcgtcgagagagaagcggcgcgtagcggcgttttttcggatgcggacgcgtaatttgaagtaattttaaggtgagtagttttttgtttcgtttttgttttttattttggttttagtatcgatttatttttcggttattttcgcgtcgttcgtcggttttttttttcgcgtttattaagttcgtaaagttgttggcgaaagagttcgggcgttggttgatcgagcgtcgtaggttttattttcgattttcgaagtttgttattcggtttggttgatttcgtcggtgtttttgtgtatttatgttatttttttttattatttattttttttttagattcgagtagttcgtcggttcgcgcggatttagagtaagaagagggcgaggaagaagatgtttcggttcggtcgtaatacgtatagcgattagaagtcgttttattcgtatatttcgttgatcgttatggttatttagagttttttcgagaagatgttgtcgttgagcgagatttataagtttattatggatcgttttttttattatagggagaatacgtagcgttggtagaatagtttgcgttataattttttttttaacgattgttttattaagatttcgcggcggtcggattagttaggtaagggtagtttttgggcgttgtatttaagttgcggggatatgttcgagaacggtagttttttgcggcgtcgtaagcgttttaaggtgtttaagttcgattatttggcgtttagtaagttagtcgacgcggcgtagtatttgtagtagtaggttaagttgcggtttagcgcgttggcggtttcgggtacgtatttgttatagatgttcgtcgtcgtttataatttgggcggcgtggcgtagttttcgggttttaagtattttttcgttatcgagaatattatcgcgcgggaatataagatgtttggggggttggtttttttcgttatgtagtcggtgttcgttgtttattcgttttttaattagttgattattatggg

SEQ ID NO: 9198 - DNA, 1237 bp, Artificial Sequence
  chemically treated genomic DNA (Homo sapiens) CpG-island No: 9198
cccataataatcaactaattaaaaaacgaataaacaacgaacaccgactacataacgaaaaaaaccaaccccccaaacatcttatattcccgcgcgataatattctcgataacgaaaaaatacttaaaacccgaaaactacgccacgccgcccaaattataaacgacgacgaacatctataacaaatacgtacccgaaaccgccaacgcgctaaaccgcaacttaacctactactacaaatactacgccgcgtcgactaacttactaaacgccaaataatcgaacttaaacaccttaaaacgcttacgacgccgcaaaaaactaccgttctcgaacatatccccgcaacttaaatacaacgcccaaaaactacccttacctaactaatccgaccgccgcgaaatcttaataaaacaatcgttaaaaaaaaaattataacgcaaactattctaccaacgctacgtattctccctataataaaaaaaacgatccataataaacttataaatctcgctcaacgacaacatcttctcgaaaaaactctaaataaccataacgatcaacgaaatatacgaataaaacgacttctaatcgctatacgtattacgaccgaaccgaaacatcttcttcctcgccctcttcttactctaaatccgcgcgaaccgacgaactactcgaatctaaaaaaaaaataaataataaaaaaaaataacataaatacacaaaaacaccgacgaaatcaaccaaaccgaataacaaacttcgaaaatcgaaaataaaacctacgacgctcgatcaaccaacgcccgaactctttcgccaacaactttacgaacttaataaacgcgaaaaaaaaaaccgacgaacgacgcgaaaataaccgaaaaataaatcgatactaaaaccaaaataaaaaacaaaaacgaaacaaaaaactactcaccttaaaattacttcaaattacgcgtccgcatccgaaaaaacgccgctacgcgccgcttctctctcgacgcgcactcgacgcgcactccgcgcgcaacgtccgaatccgattaaactcgacgcgaacctaaactcttaaactcaaccccgcaacgtcccgtaccgcccgatccgcgacgctcctaaaacgtcctacgaacgaccgaactcgactacgaaatcccgacgcgaataataacaacgacgtattaaaactccgaaaaacgctactataaactccgcgtctccgctaaac

SEQ ID NO: 9199 - DNA, 1237 bp, Artificial Sequence
  chemically treated genomic DNA (Homo sapiens) CpG-island No: 9199
tttatggtagttaattggttggggagcgggtaggtagcgggtatcggttgtatggcggagaaggttagttttttaggtattttgtattttcgcgcgatgatgttttcgatggcgaaggggtgtttgaagttcgagggttgcgttacgtcgtttaagttgtaggcggcggcgggtatttgtggtaggtgcgtgttcgaggtcgttagcgcgttgagtcgtagtttggtttgttgttgtaggtattgcgtcgcgtcggttggtttgttgggcgttaggtggtcggatttaagtattttgaagcgtttgcggcgtcgtaggaagttgtcgttttcgaatatgttttcgtagtttgggtgtagcgtttagaagttgtttttgtttggttggttcggtcgtcgcgggattttgatgaagtagtcgttgaaggagaggttgtggcgtagattgttttgttagcgttgcgtgttttttttgtagtaggggaagcggtttatgatgaatttgtagatttcgtttagcggtagtattttttcgggagagttttggatggttatagcggttagcgagatgtacgagtagggcggtttttggtcgttgtacgtgttgcggtcgggtcgaggtattttttttttcgttttttttttgttttgggttcgcgcgggtcggcggattgttcggatttgggaagggggtgggtaatagggaaaggtagtatggatgtatagagatatcggcggggttagttagatcgagtaatagatttcgggggtcgggggtggggtttgcggcgttcgattagttagcgttcggattttttcgttagtaattttgcgggtttagtgggcgcgggaggggaagtcggcgaacggcgcgaggatagtcgggaagtaagtcggtattggggttagaatagggggtagggacggaatagagagttgtttattttaaagttgttttaagttgcgcgttcgtattcgggaggacgtcgttgcgcgtcgtttttttttcggcgcgtattcgacgcgtatttcgcgcgtagcgttcgggttcggttggattcggcgcgaatttgggtttttgagtttagtttcgtagcgtttcgtgtcgttcggttcgcgacgtttttggagcgttttgcgggcggtcgagttcggttgcggagtttcggcgcggatggtggtagcgacgtgttagggtttcggagggcgttgttgtgggtttcgcgttttcgttgagt

SEQ ID NO: 9200 - DNA, 1237 bp, Artificial Sequence
  chemically treated genomic DNA (Homo sapiens) CpG-island No: 9200
actcaacgaaaacgcgaaacccacaacaacgccctccgaaaccctaacacgtcgctaccaccatccgcgccgaaactccgcaaccgaactcgaccgcccgcaaaacgctccaaaaacgtcgcgaaccgaacgacacgaaacgctacgaaactaaactcaaaaacccaaattcgcgccgaatccaaccgaacccgaacgctacgcgcgaaatacgcgtcgaatacgcgccgaaaaaaaaacgacgcgcaacgacgtcctcccgaatacgaacgcgcaacttaaaacaactttaaaataaacaactctctattccgtccctaccccctattctaaccccaataccgacttacttcccgactatcctcgcgccgttcgccgacttcccctcccgcgcccactaaacccgcaaaattactaacgaaaaaatccgaacgctaactaatcgaacgccgcaaaccccacccccgacccccgaaatctattactcgatctaactaaccccgccgatatctctatacatccatactacctttccctattacccacccccttcccaaatccgaacaatccgccgacccgcgcgaacccaaaacaaaaaaaaaacgaaaaaaaaaatacctcgacccgaccgcaacacgtacaacgaccaaaaaccgccctactcgtacatctcgctaaccgctataaccatccaaaactctcccgaaaaaatactaccgctaaacgaaatctacaaattcatcataaaccgcttcccctactacaaaaaaaacacgcaacgctaacaaaacaatctacgccacaacctctccttcaacgactacttcatcaaaatcccgcgacgaccgaaccaaccaaacaaaaacaacttctaaacgctacacccaaactacgaaaacatattcgaaaacgacaacttcctacgacgccgcaaacgcttcaaaatacttaaatccgaccacctaacgcccaacaaaccaaccgacgcgacgcaatacctacaacaacaaaccaaactacgactcaacgcgctaacgacctcgaacacgcacctaccacaaatacccgccgccgcctacaacttaaacgacgtaacgcaaccctcgaacttcaaacaccccttcgccatcgaaaacatcatcgcgcgaaaatacaaaatacctaaaaaactaaccttctccgccatacaaccgatacccgctacctacccgctccccaaccaattaactaccataaa

SEQ ID NO: 9201 - DNA, 769 bp, Artificial Sequence
  chemically treated genomic DNA (Homo sapiens) CpG-island No: 9201
gggaacggtgttttcgattagcgggaagcgagaggataggggcggcgttttcgattcgtgggaagtaagcgggtaggggcggcgtttttgatttgtgaaaagcgaagggataggggaggcgttttcgattggtgggaagcgaggggatagggattgcgttttcgatttgtcgagagcgaaggggcggggggcggcgtttttgatcgttgggaagcgaggcggcggtcgttaggaggaggcgtttgaaggagatttatcgttttagtgcgcggggaggtcgaattaggagggtagggtttttttattaatcgtacgatttcgtttagttaaggcgttggtagaggacggatatagatattgcgcgtcgagacgaggttgtttggacggtaaattttggatttagtgggagttttcgttattttcgttggtcgttcgtaggttaagttttagttgcggacgttattgttttcgttttttttgttggttgcggggagcgaggggtagggagcgcgtcggggaggagatagagcggtcgagttcggagagagtgttttttggcggtgattttttaggcggattgtggcgcgggtcgggcggcgtttttagtttcgtagtttggttttttttttgttcgggtgttttatttgggaattcgttgtatcgtatagtcgaattcgagtgtgttaatgggtgtgtgttggaatgaggatggcgacgagaagatttttttcggaataatttaatttggtgagtagtggcgatagtagta

SEQ ID NO: 9202 - DNA, 769 bp, Artificial Sequence
  chemically treated genomic DNA (Homo sapiens) CpG-island No: 9202
tactactatcgccactactcaccaaattaaattattccgaaaaaaatcttctcgtcgccatcctcattccaacacacacccattaacacactcgaattcgactatacgatacaacgaattcccaaataaaacacccgaacaaaaaaaaaaccaaactacgaaactaaaaacgccgcccgacccgcgccacaatccgcctaaaaaatcaccgccaaaaaacactctctccgaactcgaccgctctatctcctccccgacgcgctccctacccctcgctccccgcaaccaacaaaaaaaacgaaaacaataacgtccgcaactaaaacttaacctacgaacgaccaacgaaaataacgaaaactcccactaaatccaaaatttaccgtccaaacaacctcgtctcgacgcgcaatatctatatccgtcctctaccaacgccttaactaaacgaaatcgtacgattaataaaaaaaccctaccctcctaattcgacctccccgcgcactaaaacgataaatctccttcaaacgcctcctcctaacgaccgccgcctcgcttcccaacgatcaaaaacgccgccccccgccccttcgctctcgacaaatcgaaaacgcaatccctatcccctcgcttcccaccaatcgaaaacgcctcccctatcccttcgcttttcacaaatcaaaaacgccgcccctacccgcttacttcccacgaatcgaaaacgccgcccctatcctctcgcttcccgctaatcgaaaacaccgttccc

SEQ ID NO: 9203 - DNA, 769 bp, Artificial Sequence
  chemically treated genomic DNA (Homo sapiens) CpG-island No: 9203
tattattgtcgttattgtttattaaattaagttatttcgggagggattttttcgtcgttatttttattttaatatatatttattgatatattcgggttcggttgtgcggtgtaacgaatttttaggtgggatattcgagtaggaagaaagttaggttgcggggttgggggcgtcgttcggttcgcgttatagttcgtttggaggattatcgttagggggtatttttttcgaattcggtcgttttgtttttttttcggcgcgttttttgtttttcgtttttcgtagttagtagagaaggcggaagtagtggcgttcgtagttggggtttggtttgcgggcggttagcgaaggtggcgaaggtttttattggatttagagtttgtcgtttaagtagtttcgtttcggcgcgtagtgtttgtgttcgttttttattagcgttttggttgagcggagtcgtgcggttggtgggggagttttgtttttttggttcggttttttcgcgtattagaacggtgagttttttttaggcgtttttttttggcggtcgtcgtttcgttttttagcggttagggacgtcgtttttcgttttttcgttttcggtaggtcggggacgtagtttttgttttttcgttttttattagtcggggacgttttttttgttttttcgttttttataggttagggacgtcgtttttattcgtttgttttttacgggtcggggacgtcgtttttgttttttcgtttttcgttggtcgaggatatcgttttt

SEQ ID NO: 9204 - DNA, 769 bp, Artificial Sequence
  chemically treated genomic DNA (Homo sapiens) CpG-island No: 9204
aaaaacgatatcctcgaccaacgaaaaacgaaaaaacaaaaacgacgtccccgacccgtaaaaaacaaacgaataaaaacgacgtccctaacctataaaaaacgaaaaaacaaaaaaaacgtccccgactaataaaaaacgaaaaaacaaaaactacgtccccgacctaccgaaaacgaaaaaacgaaaaacgacgtccctaaccgctaaaaaacgaaacgacgaccgccaaaaaaaaacgcctaaaaaaaactcaccgttctaatacgcgaaaaaaccgaaccaaaaaaacaaaactcccccaccaaccgcacgactccgctcaaccaaaacgctaataaaaaacgaacacaaacactacgcgccgaaacgaaactacttaaacgacaaactctaaatccaataaaaaccttcgccaccttcgctaaccgcccgcaaaccaaaccccaactacgaacgccactacttccgccttctctactaactacgaaaaacgaaaaacaaaaaacgcgccgaaaaaaaaacaaaacgaccgaattcgaaaaaaataccccctaacgataatcctccaaacgaactataacgcgaaccgaacgacgcccccaaccccgcaacctaactttcttcctactcgaatatcccacctaaaaattcgttacaccgcacaaccgaacccgaatatatcaataaatatatattaaaataaaaataacgacgaaaaaatccctcccgaaataacttaatttaataaacaataacgacaataata

SEQ ID NO: 9205 - DNA, 874 bp, Artificial Sequence
  chemically treated genomic DNA (Homo sapiens) CpG-island No: 9205
  misc_feature (6)..(6): n is either a, c, g or t
  misc_feature (37)..(37): n is either a, c, g or t
  misc_feature (68)..(68): n is either a, c, g or t
  misc_feature (132)..(132): n is either a, c, g or t
  misc_feature (259)..(259): n is either a, c, g or t
  misc_feature (803)..(803): n is either a, c, g or t
  misc_feature (829)..(829): n is either a, c, g or t
tcgcgntattcggacgagaaagttttgaaaatagggnttcgagtggagtagttgttttacgttttttngtgcgttttagcgttttggattcgtatttcgaatttgaggcgcgatttttatttgtattgggantttcggggtatcgggagcggggtttcggcgcggttttgtaggttgtgtagtatcggggtttcgaagggttcggcgggttaggtaggcgttagtggcgtttttacgtagggcgagtaggggttcggantggtggtggtggtggtggtggtggttggtggtacgtttcgtttagcggtcgcgcggtcgatagcgagttgtattggggttcgcggtcgtttatggtcgttaggttattgtcgtcgtcgtttacgtttttcgcgtttttattgttcgtcgtcgcgtagtttttcggttttcgcgcggcgtcgttggttatgggcgggttgggagagtaggggaagcgcgtcgagacgtgcgtcgcggttgagttagcgtcgttaggtttcgcggtttcgtcgttagtcgcgtcgttttcgttgtcgtatggagggttgtcggtcgaggtttgaggttagtcggggtgcgcgttcgcgtcgttcgcgtggttggttggtttattgttcgatttttgtaggtggtacggtaggtcgggtagtatggaatttacgcgggtggtgggtacgtagatcggggagttggtcgtcgtcgcggttgttgtcgtcgcggtcgtagagtgtacgaagtcgtcgggcgcgtcgtcgtaggcggtcggattttggttggagagagtnggcgagggtttggtatattttttttnggttgttcgggtgcgaaggggtttagtttggcgtcgcggttggat

SEQ ID NO: 9206 - DNA, 874 bp, Artificial Sequence
  chemically treated genomic DNA (Homo sapiens) CpG-island No: 9206
  misc_feature (46)..(46): n is either a, c, g or t
  misc_feature (72)..(72): n is either a, c, g or t
  misc_feature (616)..(616): n is either a, c, g or t
  misc_feature (743)..(743): n is either a, c, g or t
  misc_feature (807)..(807): n is either a, c, g or t
  misc_feature (838)..(838): n is either a, c, g or t
  misc_feature (869)..(869): n is either a, c, g or t
atccaaccgcgacgccaaactaaaccccttcgcacccgaacaaccnaaaaaaaatataccaaaccctcgccnactctctccaaccaaaatccgaccgcctacgacgacgcgcccgacgacttcgtacactctacgaccgcgacgacaacaaccgcgacgacgaccaactccccgatctacgtacccaccacccgcgtaaattccatactacccgacctaccgtaccacctacaaaaatcgaacaataaaccaaccaaccacgcgaacgacgcgaacgcgcaccccgactaacctcaaacctcgaccgacaaccctccatacgacaacgaaaacgacgcgactaacgacgaaaccgcgaaacctaacgacgctaactcaaccgcgacgcacgtctcgacgcgcttcccctactctcccaacccgcccataaccaacgacgccgcgcgaaaaccgaaaaactacgcgacgacgaacaataaaaacgcgaaaaacgtaaacgacgacgacaataacctaacgaccataaacgaccgcgaaccccaatacaactcgctatcgaccgcgcgaccgctaaacgaaacgtaccaccaaccaccaccaccaccaccaccaccantccgaacccctactcgccctacgtaaaaacgccactaacgcctacctaacccgccgaacccttcgaaaccccgatactacacaacctacaaaaccgcgccgaaaccccgctcccgataccccgaaantcccaatacaaataaaaatcgcgcctcaaattcgaaatacgaatccaaaacgctaaaacgcacnaaaaaacgtaaaacaactactccactcgaanccctattttcaaaactttctcgtccgaatancgcga

SEQ ID NO: 9207 - DNA, 874 bp, Artificial Sequence
  chemically treated genomic DNA (Homo sapiens) CpG-island No: 9207
  misc_feature (46)..(46): n is either a, c, g or t
  misc_feature (72)..(72): n is either a, c, g or t
  misc_feature (616)..(616): n is either a, c, g or t
  misc_feature (743)..(743): n is either a, c, g or t
  misc_feature (807)..(807): n is either a, c, g or t
  misc_feature (838)..(838): n is either a, c, g or t
  misc_feature (869)..(869): n is either a, c, g or t
gtttagtcgcggcgttaagttgagttttttcgtattcgagtagttnggaggagatgtattagattttcgttngttttttttagttagggttcggtcgtttacgacggcgcgttcggcggtttcgtgtattttgcggtcgcggcggtagtagtcgcggcggcggttagtttttcggtttacgtgtttattattcgcgtgggttttatgttgttcggtttatcgtattatttgtaggggtcgggtagtgggttagttaattacgcgggcggcgcgggcgcgtatttcggttggttttaggtttcggtcgatagttttttatacggtagcggaggcggcgcggttggcggcggggtcgcggggtttggcggcgttggtttagtcgcggcgtacgtttcggcgcgttttttttatttttttagttcgtttatggttaacggcgtcgcgcgggagtcgggaggttacgcggcggcgggtagtgggggcgcgggaggcgtgagcggcggcggtagtagtttggcggttatgggcggtcgcgagttttagtatagttcgttgtcggtcgcgcggtcgttgaacgggacgtattattaattattattattattattattattanttcgagtttttattcgttttacgtgggggcgttattgacgtttgtttggttcgtcggatttttcgagatttcggtgttgtatagtttgtagagtcgcgtcggagtttcgttttcggtgtttcggggnttttagtgtaggtaagggtcgcgttttaggttcggggtgcgggtttaaagcgttggggcgtatngggggacgtggagtagttgttttattcgggnttttgtttttaggattttttcgttcgggtgncgcgg

SEQ ID NO: 9208 - DNA, 874 bp, Artificial Sequence
  chemically treated genomic DNA (Homo sapiens) CpG-island No: 9208
  misc_feature (6)..(6): n is either a, c, g or t
  misc_feature (37)..(37): n is either a, c, g or t
  misc_feature (68)..(68): n is either a, c, g or t
  misc_feature (132)..(132): n is either a, c, g or t
  misc_feature (259)..(259): n is either a, c, g or t
  misc_feature (803)..(803): n is either a, c, g or t
  misc_feature (829)..(829): n is either a, c, g or t
ccgcgncacccgaacgaaaaaatcctaaaaacaaaancccgaataaaacaactactccacgtcccccnatacgccccaacgctttaaacccgcaccccgaacctaaaacgcgacccttacctacactaaaanccccgaaacaccgaaaacgaaactccgacgcgactctacaaactatacaacaccgaaatctcgaaaaatccgacgaaccaaacaaacgtcaataacgcccccacgtaaaacgaataaaaactcgaantaataataataataataataataattaataatacgtcccgttcaacgaccgcgcgaccgacaacgaactatactaaaactcgcgaccgcccataaccgccaaactactaccgccgccgctcacgcctcccgcgcccccactacccgccgccgcgtaacctcccgactcccgcgcgacgccgttaaccataaacgaactaaaaaaataaaaaaaacgcgccgaaacgtacgccgcgactaaaccaacgccgccaaaccccgcgaccccgccgccaaccgcgccgcctccgctaccgtataaaaaactatcgaccgaaacctaaaaccaaccgaaatacgcgcccgcgccgcccgcgtaattaactaacccactacccgacccctacaaataatacgataaaccgaacaacataaaacccacgcgaataataaacacgtaaaccgaaaaactaaccgccgccgcgactactaccgccgcgaccgcaaaatacacgaaaccgccgaacgcgccgtcgtaaacgaccgaaccctaactaaaaaaaacnaacgaaaatctaatacatctcctccnaactactcgaatacgaaaaaactcaacttaacgccgcgactaaac

SEQ ID NO: 9209 - DNA, 692 bp, Artificial Sequence
  chemically treated genomic DNA (Homo sapiens) CpG-island No: 9209
  misc_feature (226)..(226): n is either a, c, g or t
  misc_feature (251)..(251): n is either a, c, g or t
  misc_feature (267)..(267): n is either a, c, g or t
  misc_feature (275)..(275): n is either a, c, g or t
  misc_feature (307)..(307): n is either a, c, g or t
  misc_feature (326)..(326): n is either a, c, g or t
tatttcggtgtgatcgcgtttcggcgacgttgggtagggtgtagggagttagttcggtcgcggtttaacgggaggggagggggtcggtttcgaattcgggcgttcgggtcgcgggtgatttattgggaacgttaggttcgcgcgtttagatcggcgggcgacgtttagcgcgttttatttttttcgttcgggtcgttcgcgtagaagtagttttcgcgtatttttngtttttcgagacgggatttttcggngaaggagtttggagtncggtcggntcggggggtagtaatttttttttttttagttnattatggtcggtgcgattnttttattcgcgttcgtagacggattttttggaaagtatcgggttgggtttatttgattggcgttcgtaggggtcgtcgatttttttatagatttacggaaattgtcggtcgtaagtcgaggttcggtttttagtattcgtcggttcgttcgcgtcggttttttaaagagttgttagatttattcgttagtagtttttttattcgatcgttttgtaggtgcggtgggtttttttttcgttttcgacgcgcgtgcgtattttcgtgtcgcggggtattttgggagttgtagttttagtaagaagggcgaggtttaacgttgattttggtttttataatgggtagaacgtaggaaggggattgcgaata

SEQ ID NO: 9210 - DNA, 692 bp, Artificial Sequence
  chemically treated genomic DNA (Homo sapiens) CpG-island No: 9210
  misc_feature (367)..(367): n is either a, c, g or t
  misc_feature (386)..(386): n is either a, c, g or t
  misc_feature (418)..(418): n is either a, c, g or t
  misc_feature (426)..(426): n is either a, c, g or t
  misc_feature (442)..(442): n is either a, c, g or t
  misc_feature (467)..(467): n is either a, c, g or t
tattcgcaatccccttcctacgttctacccattataaaaaccaaaatcaacgttaaacctcgcccttcttactaaaactacaactcccaaaataccccgcgacacgaaaatacgcacgcgcgtcgaaaacgaaaaaaaaacccaccgcacctacaaaacgatcgaataaaaaaactactaacgaataaatctaacaactctttaaaaaaccgacgcgaacgaaccgacgaatactaaaaaccgaacctcgacttacgaccgacaatttccgtaaatctataaaaaaatcgacgacccctacgaacgccaatcaaataaacccaacccgatactttccaaaaaatccgtctacgaacgcgaataaaanaatcgcaccgaccataatnaactaaaaaaaaaaaaattactaccccccganccgaccgnactccaaactccttcnccgaaaaatcccgtctcgaaaaacnaaaaatacgcgaaaactacttctacgcgaacgacccgaacgaaaaaaataaaacgcgctaaacgtcgcccgccgatctaaacgcgcgaacctaacgttcccaataaatcacccgcgacccgaacgcccgaattcgaaaccgaccccctcccctcccgttaaaccgcgaccgaactaactccctacaccctacccaacgtcgccgaaacgcgatcacaccgaaata

SEQ ID NO: 9211 - DNA, 692 bp, Artificial Sequence
  chemically treated genomic DNA (Homo sapiens) CpG-island No: 9211
  misc_feature (367)..(367): n is either a, c, g or t
  misc_feature (386)..(386): n is either a, c, g or t
  misc_feature (418)..(418): n is either a, c, g or t
  misc_feature (426)..(426): n is either a, c, g or t
  misc_feature (442)..(442): n is either a, c, g or t
  misc_feature (467)..(467): n is either a, c, g or t
tattcgtagttttttttttacgttttgtttattgtaaagattagggttagcgttgagtttcgttttttttgttagaattataatttttaggatgtttcgcggtacgggagtgcgtacgcgcgtcggaggcgaaggaggaatttatcgtatttatagggcggtcgagtgagggagttgttggcgggtgggtttggtaattttttgggaggtcgacgcgggcggatcggcgggtgttgggaatcgagtttcggtttgcggtcggtagttttcgtgggtttgtgaagaggtcggcggtttttgcgggcgttagttaggtaagtttagttcggtgttttttaggaagttcgtttgcgggcgcgggtagggnagtcgtatcggttatggtnggttgaggagggagaggttgttgtttttcggntcggtcgnattttaggtttttttntcgaggggtttcgtttcggggagtnaggggtgcgcgggggttgtttttgcgcgaacggttcgggcgggggaggtggggcgcgttgggcgtcgttcgtcggtttaggcgcgcgaatttggcgtttttagtgaattattcgcggttcgggcgttcgggttcgggatcggtttttttttttttcgttgagtcgcggtcgagttggttttttgtattttatttagcgtcgtcgggacgcgattatatcgagatg

SEQ ID NO: 9212 - DNA, 692 bp, Artificial Sequence
  chemically treated genomic DNA (Homo sapiens) CpG-island No: 9212
  misc_feature (226)..(226): n is either a, c, g or t
  misc_feature (251)..(251): n is either a, c, g or t
  misc_feature (267)..(267): n is either a, c, g or t
  misc_feature (275)..(275): n is either a, c, g or t
  misc_feature (307)..(307): n is either a, c, g or t
  misc_feature (326)..(326): n is either a, c, g or t
catctcgatataatcgcgtcccgacgacgctaaataaaatacaaaaaaccaactcgaccgcgactcaacgaaaaaaaaaaaaaccgatcccgaacccgaacgcccgaaccgcgaataattcactaaaaacgccaaattcgcgcgcctaaaccgacgaacgacgcccaacgcgccccacctcccccgcccgaaccgttcgcgcaaaaacaacccccgcgcacccctnactccccgaaacgaaacccctcganaaaaaaacctaaaatncgaccganccgaaaaacaacaacctctccctcctcaaccnaccataaccgatacgactnccctacccgcgcccgcaaacgaacttcctaaaaaacaccgaactaaacttacctaactaacgcccgcaaaaaccgccgacctcttcacaaacccacgaaaactaccgaccgcaaaccgaaactcgattcccaacacccgccgatccgcccgcgtcgacctcccaaaaaattaccaaacccacccgccaacaactccctcactcgaccgccctataaatacgataaattcctccttcgcctccgacgcgcgtacgcactcccgtaccgcgaaacatcctaaaaattataattctaacaaaaaaaacgaaactcaacgctaaccctaatctttacaataaacaaaacgtaaaaaaaaaactacgaata

SEQ ID NO: 9213 - DNA, 895 bp, Artificial Sequence
  chemically treated genomic DNA (Homo sapiens) CpG-island No: 9213
  misc_feature (56)..(56): n is either a, c, g or t
  misc_feature (66)..(66): n is either a, c, g or t
  misc_feature (86)..(86): n is either a, c, g or t
  misc_feature (117)..(117): n is either a, c, g or t
  misc_feature (132)..(132): n is either a, c, g or t
  misc_feature (165)..(165): n is either a, c, g or t
  misc_feature (182)..(182): n is either a, c, g or t
  misc_feature (190)..(190): n is either a, c, g or t
ttttcgggcgttcgtattttcggttagcgatttttttagggtgatttggtggcggntcgatcgcgnaatattcggatttttacggnacgagtcgtcggagtcgtagtcggtttcggntttcggtttcgttangtttcgttattcgtcgtttcgtcgtcgttgttngtttttcgatttgggtnattcgagnagaatttttttatggtttcgtcggcgagttggagggcgtagggagcgtgtaagggtaagttttcggttcggcgcgtagtcgggcgttcgcgaggggtcgtcgtttttggttcgttcgagcgtgttgcggttcgttaagttttatatttcgcgttttttaagcgtatagtttgggtttcgtcgttcgtttcgcggtttcgttgtagttgttcggttttcgtaaagggcggtggggagggcggggacggggtcgggcgcgagggggcgggttcgaatttaggggcgacgtcgtcgttttcgttagtgtttcgggcgtttcgtcgttttattaagcgtttggagcgcgagtcggggtagaggaagagagcgaaagaggttgggcggtcggtttttttagggagtgggttagacgttttaggttataaattcgtaggatcgtagttcgtcgcgtcgtcgtcgtttcggtcgaattcgcgtcgttcgttattcgtggtcgttggcggggggggggggggggcgttgttgttaatcgtttattgaggtcgggcgattcgcgtaggcgcgttgttcgcgtcgtcggaagtgacggtttcggtttttgttacgtggagggggattaagggaggtgattgtgggggttggggattagggtaaagtcgggggtttcgggttcggggttgcgtcgggagggtattggttaggttcg

SEQ ID NO: 9214 - DNA, 895 bp, Artificial Sequence
  chemically treated genomic DNA (Homo sapiens) CpG-island No: 9214
  misc_feature (706)..(706): n is either a, c, g or t
  misc_feature (714)..(714): n is either a, c, g or t
  misc_feature (731)..(731): n is either a, c, g or t
  misc_feature (764)..(764): n is either a, c, g or t
  misc_feature (779)..(779): n is either a, c, g or t
  misc_feature (810)..(810): n is either a, c, g or t
  misc_feature (830)..(830): n is either a, c, g or t
  misc_feature (840)..(840): n is either a, c, g or t
cgaacctaaccaataccctcccgacgcaaccccgaacccgaaacccccgactttaccctaatccccaacccccacaatcacctcccttaatccccctccacgtaacaaaaaccgaaaccgtcacttccgacgacgcgaacaacgcgcctacgcgaatcgcccgacctcaataaacgattaacaacaacgccccccccccccccccgccaacgaccacgaataacgaacgacgcgaattcgaccgaaacgacgacgacgcgacgaactacgatcctacgaatttataacctaaaacgtctaacccactccctaaaaaaaccgaccgcccaacctctttcgctctcttcctctaccccgactcgcgctccaaacgcttaataaaacgacgaaacgcccgaaacactaacgaaaacgacgacgtcgcccctaaattcgaacccgccccctcgcgcccgaccccgtccccgccctccccaccgccctttacgaaaaccgaacaactacaacgaaaccgcgaaacgaacgacgaaacccaaactatacgcttaaaaaacgcgaaatataaaacttaacgaaccgcaacacgctcgaacgaaccaaaaacgacgacccctcgcgaacgcccgactacgcgccgaaccgaaaacttacccttacacgctccctacgccctccaactcgccgacgaaaccataaaaaaattctnctcgaatnacccaaatcgaaaaacnaacaacgacgacgaaacgacgaataacgaaacntaacgaaaccgaaanccgaaaccgactacgactccgacgactcgtnccgtaaaaatccgaatattncgcgatcganccgccaccaaatcaccctaaaaaaatcgctaaccgaaaatacgaacgcccgaaaa

SEQ ID NO: 9215 - DNA, 895 bp, Artificial Sequence
  chemically treated genomic DNA (Homo sapiens) CpG-island No: 9215
  misc_feature (706)..(706): n is either a, c, g or t
  misc_feature (714)..(714): n is either a, c, g or t
  misc_feature (731)..(731): n is either a, c, g or t
  misc_feature (764)..(764): n is either a, c, g or t
  misc_feature (779)..(779): n is either a, c, g or t
  misc_feature (810)..(810): n is either a, c, g or t
  misc_feature (830)..(830): n is either a, c, g or t
  misc_feature (840)..(840): n is either a, c, g or t
cgggtttggttagtattttttcggcgtaatttcggattcgggattttcgattttgttttagtttttaatttttataattattttttttggtttttttttacgtgataagagtcggaatcgttattttcggcggcgcgggtagcgcgtttgcgcgggtcgttcggttttagtgaacggttggtagtagcgtttttttttttttttcgttaacggttacgagtggcgggcggcgcgggttcggtcggggcggcggcggcgcgacgggttgcggttttgcgggtttgtggtttgagacgtttagtttattttttggaggggtcggtcgtttagtttttttcgttttttttttttatttcggttcgcgttttaggcgtttagtgaggcggcgggacgttcggggtattggcggaggcggcggcgtcgtttttggattcggattcgttttttcgcgttcggtttcgttttcgttttttttatcgttttttgcgggagtcgggtagttgtagcggagtcgcggagcgggcggcggggtttaggttgtgcgtttggggagcgcggaatgtgaggtttggcgggtcgtagtacgttcggacgggttaggggcggcgatttttcgcggacgttcggttgcgcgtcgggtcggggatttgtttttgtacgttttttgcgttttttagttcgtcggcgggattatgaagaagttttnttcggatngtttaagtcggagggtnggtagcggcggcggagcggcgggtggcggggtntggcggggtcggggntcggggtcggttgcggtttcggcggttcgtntcgtgggggttcgggtgttncgcggtcggntcgttattaggttattttggaagagtcgttggtcgaaggtacgggcgttcgggga

SEQ ID NO: 9216 - DNA, 895 bp, Artificial Sequence
  chemically treated genomic DNA (Homo sapiens) CpG-island No: 9216
  misc_feature (56)..(56): n is either a, c, g or t
  misc_feature (66)..(66): n is either a, c, g or t
  misc_feature (86)..(86): n is either a, c, g or t
  misc_feature (117)..(117): n is either a, c, g or t
  misc_feature (132)..(132): n is either a, c, g or t
  misc_feature (165)..(165): n is either a, c, g or t
  misc_feature (182)..(182): n is either a, c, g or t
  misc_feature (190)..(190): n is either a, c, g or t
tccccgaacgcccgtaccttcgaccaacgactcttccaaaataacctaataacganccgaccgcgnaacacccgaacccccacganacgaaccgccgaaaccgcaaccgaccccganccccgaccccgccanaccccgccacccgccgctccgccgccgctaccnaccctccgacttaaacnatccgaanaaaacttcttcataatcccgccgacgaactaaaaaacgcaaaaaacgtacaaaaacaaatccccgacccgacgcgcaaccgaacgtccgcgaaaaatcgccgcccctaacccgtccgaacgtactacgacccgccaaacctcacattccgcgctccccaaacgcacaacctaaaccccgccgcccgctccgcgactccgctacaactacccgactcccgcaaaaaacgataaaaaaaacgaaaacgaaaccgaacgcgaaaaaacgaatccgaatccaaaaacgacgccgccgcctccgccaataccccgaacgtcccgccgcctcactaaacgcctaaaacgcgaaccgaaataaaaaaaaaaaacgaaaaaaactaaacgaccgacccctccaaaaaataaactaaacgtctcaaaccacaaacccgcaaaaccgcaacccgtcgcgccgccgccgccccgaccgaacccgcgccgcccgccactcgtaaccgttaacgaaaaaaaaaaaaaaacgctactaccaaccgttcactaaaaccgaacgacccgcgcaaacgcgctacccgcgccgccgaaaataacgattccgactcttatcacgtaaaaaaaaaccaaaaaaaataattataaaaattaaaaactaaaacaaaatcgaaaatcccgaatccgaaattacgccgaaaaaatactaaccaaacccg

SEQ ID NO: 9217 - DNA, 588 bp, Artificial Sequence
  chemically treated genomic DNA (Homo sapiens) CpG-island No: 9217
gcgtcggtttaggaggttcggtatttgttcgagtcgtcgggtcgcgtttagtttcgcgtcgagttaaagttcgagtttaagttcgagtttaagttcgagtttaagttcgttgggttcgcgtttttattttgttcgtcgcggtttatgtttttagttcgtcgtttcgtgttttttgtagtattttcgtttgtagttcgtttcggttcggatcgttcgtcgcgtcgcgtagagttttttttcgttttcgtcggcgattttcgcgaagtttttatttttagaggcgtcgggcgcggcggcgtcgttcgttttcggtttggagcgtttttttggggcgttatttaattatttgattcggtcgatttgtgcgtttcgttacgtcggcgcgggcggcgtagcgttaggagggtcgggcgtatttcgattttcgtatcggttggaagtcggtcgggaggagggaagaggacggcgaggagatggattcggttatggaggttgcgtggagtttgtttgggaatcgggatggcgtttgttttttattattaagttatttataaaattaaaagtttttttcgaggttttggagatgtt

SEQ ID NO: 9218 - DNA, 588 bp, Artificial Sequence
  chemically treated genomic DNA (Homo sapiens) CpG-island No: 9218
aacatctccaaaacctcgaaaaaaacttttaattttataaataacttaataataaaaaacaaacgccatcccgattcccaaacaaactccacgcaacctccataaccgaatccatctcctcgccgtcctcttccctcctcccgaccgacttccaaccgatacgaaaatcgaaatacgcccgaccctcctaacgctacgccgcccgcgccgacgtaacgaaacgcacaaatcgaccgaatcaaataattaaataacgccccaaaaaaacgctccaaaccgaaaacgaacgacgccgccgcgcccgacgcctctaaaaataaaaacttcgcgaaaatcgccgacgaaaacgaaaaaaaactctacgcgacgcgacgaacgatccgaaccgaaacgaactacaaacgaaaatactacaaaaaacacgaaacgacgaactaaaaacataaaccgcgacgaacaaaataaaaacgcgaacccaacgaacttaaactcgaacttaaactcgaacttaaactcgaactttaactcgacgcgaaactaaacgcgacccgacgactcgaacaaataccgaacctcctaaaccgacgc

SEQ ID NO: 9219 - DNA, 588 bp, Artificial Sequence
  chemically treated genomic DNA (Homo sapiens) CpG-island No: 9219
ggtatttttaaggtttcggaggaaatttttgattttataaataatttgatggtggaaggtaaacgttatttcggtttttaagtaggttttacgtagtttttatggtcgagtttattttttcgtcgttttttttttttttttcggtcgatttttagtcggtgcgggagtcggggtgcgttcggtttttttagcgttgcgtcgttcgcgtcgacgtggcggagcgtataggtcgatcgggttaggtggttgggtgacgttttaggaaagcgttttaggtcgagggcgggcggcgtcgtcgcgttcgacgtttttgggggtggggatttcgcgggagtcgtcggcggaggcgaggaggagttttgcgcggcgcggcgggcgattcgagtcgggacgggttgtaggcgggggtgttgtagaggatacgaggcggcgggttggagatatggatcgcggcgagtaaggtgagggcgcggatttagcgggtttgggttcgggtttggattcgggtttggattcgggttttggttcggcgcggggttgagcgcggttcggcggttcgagtaggtgtcgagttttttgggtcggcgt

SEQ ID NO: 9220 - DNA, 588 bp, Artificial Sequence
  chemically treated genomic DNA (Homo sapiens) CpG-island No: 9220
acgccgacccaaaaaactcgacacctactcgaaccgccgaaccgcgctcaaccccgcgccgaaccaaaacccgaatccaaacccgaatccaaacccgaacccaaacccgctaaatccgcgccctcaccttactcgccgcgatccatatctccaacccgccgcctcgtatcctctacaacacccccgcctacaacccgtcccgactcgaatcgcccgccgcgccgcgcaaaactcctcctcgcctccgccgacgactcccgcgaaatccccacccccaaaaacgtcgaacgcgacgacgccgcccgccctcgacctaaaacgctttcctaaaacgtcacccaaccacctaacccgatcgacctatacgctccgccacgtcgacgcgaacgacgcaacgctaaaaaaaccgaacgcaccccgactcccgcaccgactaaaaatcgaccgaaaaaaaaaaaaaaaacgacgaaaaaataaactcgaccataaaaactacgtaaaacctacttaaaaaccgaaataacgtttaccttccaccatcaaattatttataaaatcaaaaatttcctccgaaaccttaaaaatacc

SEQ ID NO: 9221 - DNA, 727 bp, Artificial Sequence
  chemically treated genomic DNA (Homo sapiens) CpG-island No: 9221
gacggtatttttgtttcggtttcggttgaggcggggcggttaggttggtttgcggcgtagcggtcgtttttttttagtgcgtttgtcggcggcggcggtggcggcgtcggtaatttcggtttttggtataacgtttggcggtcggtttagggcgaggagtggtttttaggaagcgggcggaggagcgttttagtcgagtttcgtcgtcgtcgcggtttcgcgcgtttcgagcggttcgggtttggttttatacggcgttttttcgcgttttcggcgtttttagtttaagtcgagggcgcggtgtcggcgcgtaggttgacgggcgtttgggcgcgtcgtgtatttgtcgggcggtgtaggtggcggcgcgcgtttttcgtttttgggtcggggttagcgtagcgttttgcgcgttcggagggggcgggagaggcggggtagttttcgttttagttttatttaatttcgcggcggcggcggcgattgcggcgtcgcgggttggaggtcggcgtcggggaaggttttggtgtcggatttcgtacgaggtgttgacgggcggtttttgttaatttttttttagcgcgcgtcgagttcgcgcggtttcggggttgtacgttttagatatttttgcggcgtaaggtgggtgtatcgagttcggcgtagggcggttttttaggggtcgggggaaggcgttttttagagggagtaagatttggagtagtggttt

SEQ ID NO: 9222 - DNA, 727 bp, Artificial Sequence
  chemically treated genomic DNA (Homo sapiens) CpG-island No: 9222
aaaccactactccaaatcttactccctctaaaaaacgccttcccccgacccctaaaaaaccgccctacgccgaactcgatacacccaccttacgccgcaaaaatatctaaaacgtacaaccccgaaaccgcgcgaactcgacgcgcgctaaaaaaaaattaacaaaaaccgcccgtcaacacctcgtacgaaatccgacaccaaaaccttccccgacgccgacctccaacccgcgacgccgcaatcgccgccgccgccgcgaaattaaataaaactaaaacgaaaactaccccgcctctcccgccccctccgaacgcgcaaaacgctacgctaaccccgacccaaaaacgaaaaacgcgcgccgccacctacaccgcccgacaaatacacgacgcgcccaaacgcccgtcaacctacgcgccgacaccgcgccctcgacttaaactaaaaacgccgaaaacgcgaaaaaacgccgtataaaaccaaacccgaaccgctcgaaacgcgcgaaaccgcgacgacgacgaaactcgactaaaacgctcctccgcccgcttcctaaaaaccactcctcgccctaaaccgaccgccaaacgttataccaaaaaccgaaattaccgacgccgccaccgccgccgccgacaaacgcactaaaaaaaaacgaccgctacgccgcaaaccaacctaaccgccccgcctcaaccgaaaccgaaacaaaaataccgtc

SEQ ID NO: 9223 - DNA, 727 bp, Artificial Sequence
  chemically treated genomic DNA (Homo sapiens) CpG-island No: 9223
aggttattgttttaagttttattttttttggggagcgttttttttcgatttttgaggggtcgttttgcgtcgagttcggtgtatttattttgcgtcgtagaagtatttgggacgtgtagtttcggggtcgcgcgggttcggcgcgcgttggggagaagttggtagaagtcgttcgttaatatttcgtgcggaattcggtattaggatttttttcgacgtcggtttttagttcgcggcgtcgtagtcgtcgtcgtcgtcgcgaagttaaatggggttgggacgggggttgtttcgtttttttcgtttttttcgggcgcgtagagcgttgcgttggtttcggtttagaggcggagggcgcgcgtcgttatttgtatcgttcggtaagtgtacggcgcgtttaggcgttcgttagtttgcgcgtcggtatcgcgttttcggtttgagttggaggcgtcgggggcgcgaagagacgtcgtgtggggttaggttcgggtcgttcggagcgcgcggggtcgcggcgacggcgggattcggttggaacgttttttcgttcgttttttggaagttatttttcgttttgggtcggtcgttaggcgttgtgttaagagtcgggattgtcgacgtcgttatcgtcgtcgtcggtaggcgtattggggaaaggcggtcgttgcgtcgtaagttagtttggtcgtttcgttttagtcggagtcggagtagggatgtcgtt

SEQ ID NO: 9224 - DNA, 727 bp, Artificial Sequence
  chemically treated genomic DNA (Homo sapiens) CpG-island No: 9224
aacgacatccctactccgactccgactaaaacgaaacgaccaaactaacttacgacgcaacgaccgcctttccccaatacgcctaccgacgacgacgataacgacgtcgacaatcccgactcttaacacaacgcctaacgaccgacccaaaacgaaaaataacttccaaaaaacgaacgaaaaaacgttccaaccgaatcccgccgtcgccgcgaccccgcgcgctccgaacgacccgaacctaaccccacacgacgtctcttcgcgcccccgacgcctccaactcaaaccgaaaacgcgataccgacgcgcaaactaacgaacgcctaaacgcgccgtacacttaccgaacgatacaaataacgacgcgcgccctccgcctctaaaccgaaaccaacgcaacgctctacgcgcccgaaaaaaacgaaaaaaacgaaacaacccccgtcccaaccccatttaacttcgcgacgacgacgacgactacgacgccgcgaactaaaaaccgacgtcgaaaaaaatcctaataccgaattccgcacgaaatattaacgaacgacttctaccaacttctccccaacgcgcgccgaacccgcgcgaccccgaaactacacgtcccaaatacttctacgacgcaaaataaatacaccgaactcgacgcaaaacgacccctcaaaaatcgaaaaaaaacgctccccaaaaaaaataaaacttaaaacaataacct

SEQ ID NO: 9225 - DNA, 544 bp, Artificial Sequence
  chemically treated genomic DNA (Homo sapiens) CpG-island No: 9225
  misc_feature (34)..(34): n is either a, c, g or t
  misc_feature (107)..(107): n is either a, c, g or t
  misc_feature (382)..(382): n is either a, c, g or t
cgggggcgggtttcgttgtttcgtcgcgtttttnattggttattaggttttttaaaatgtgattttgaatttgtgttttttcgtcgtagaatttagttttatcgaanagggtaatttgttcgcgcgtttcgtcgtcgtcgtcgcgtttttttttgaaggtgattgcgttcgcggggacgtagggggcggggttcgggtcgttcggagtcgggattgggtagagggcggggcggcggagggattgcggcggttcgtagcgggataattttgaggttgaggtagtggttttttgtatagtagttgtacgcgtcgtggtttcggattttttcgtttttgtagcgtagttcgagtcggttagcgtcggaggtgagcggtgtagganggttacgttattagtttttattaagggttagtcgttcggttagtgcggaatttcggcgcgtcggtcggtttcgggtacgtaggtagggcggcgtaggatttagggcgtttgggatgtagtggagtttagagagaggagaacggttttttacgtttggggttt

SEQ ID NO: 9226 - DNA, 544 bp, Artificial Sequence
  chemically treated genomic DNA (Homo sapiens) CpG-island No: 9226
  misc_feature (163)..(163): n is either a, c, g or t
  misc_feature (438)..(438): n is either a, c, g or t
  misc_feature (511)..(511): n is either a, c, g or t
aaaccccaaacgtaaaaaaccgttctcctctctctaaactccactacatcccaaacgccctaaatcctacgccgccctacctacgtacccgaaaccgaccgacgcgccgaaattccgcactaaccgaacgactaacccttaataaaaactaataacgtaaccntcctacaccgctcacctccgacgctaaccgactcgaactacgctacaaaaacgaaaaaatccgaaaccacgacgcgtacaactactatacaaaaaaccactacctcaacctcaaaattatcccgctacgaaccgccgcaatccctccgccgccccgccctctacccaatcccgactccgaacgacccgaaccccgccccctacgtccccgcgaacgcaatcaccttcaaaaaaaaacgcgacgacgacgacgaaacgcgcgaacaaattaccctnttcgataaaactaaattctacgacgaaaaaacacaaattcaaaatcacattttaaaaaacctaataaccaatnaaaaacgcgacgaaacaacgaaacccgcccccg

SEQ ID NO: 9227 - DNA, 544 bp, Artificial Sequence
  chemically treated genomic DNA (Homo sapiens) CpG-island No: 9227
  misc_feature (163)..(163): n is either a, c, g or t
  misc_feature (438)..(438): n is either a, c, g or t
  misc_feature (511)..(511): n is either a, c, g or t
aggttttaggcgtgaggagtcgtttttttttttttgagttttattgtattttagacgttttggattttgcgtcgttttgtttgcgtgttcggggtcggtcggcgcgtcgggatttcgtattagtcgggcgattggtttttggtggggattgatggcgtagttnttttgtatcgtttattttcggcgttgatcgattcgggttacgttgtaaagacgaagagattcggagttacggcgcgtgtagttgttgtgtaaggagttattgttttagttttaaggttatttcgttgcgggtcgtcgtaattttttcgtcgtttcgttttttgtttaatttcggtttcgggcgattcgggtttcgttttttgcgttttcgcgggcgtagttatttttaggaggaagcgcggcggcggcggcggaacgcgcgggtaggttgttttnttcggtgggattaaattttgcggcggaaggatatagatttagagttatattttaagaaatttgatgattaatnggggacgcggcggggtaacggggttcgttttcg

SEQ ID NO: 9228 - DNA, 544 bp, Artificial Sequence
  chemically treated genomic DNA (Homo sapiens) CpG-island No: 9228
  misc_feature (34)..(34): n is either a, c, g or t
  misc_feature (107)..(107): n is either a, c, g or t
  misc_feature (382)..(382): n is either a, c, g or t
cgaaaacgaaccccgttaccccgccgcgtccccnattaatcatcaaatttcttaaaatataactctaaatctatatccttccgccgcaaaatttaatcccaccgaanaaaacaacctacccgcgcgttccgccgccgccgccgcgcttcctcctaaaaataactacgcccgcgaaaacgcaaaaaacgaaacccgaatcgcccgaaaccgaaattaaacaaaaaacgaaacgacgaaaaaattacgacgacccgcaacgaaataaccttaaaactaaaacaataactccttacacaacaactacacgcgccgtaactccgaatctcttcgtctttacaacgtaacccgaatcgatcaacgccgaaaataaacgatacaaaanaactacgccatcaatccccaccaaaaaccaatcgcccgactaatacgaaatcccgacgcgccgaccgaccccgaacacgcaaacaaaacgacgcaaaatccaaaacgtctaaaatacaataaaactcaaaaaaaaaaaaacgactcctcacgcctaaaacct

SEQ ID NO: 9229 - DNA, 555 bp, Artificial Sequence
  chemically treated genomic DNA (Homo sapiens) CpG-island No: 9229
gaggggttcggagattcgtttattagtaggcggcgtcgggggtttcggggtttcgattcgaataaggcggtgtgggggagagtcgtggcgcgggggcggcgtgggttcgggggcgataggggtggcgagggcggcggagtcggacgatttttcggagtaggggttttcgaagtcgcgttttcgttgtagtttgtatgcggttaggatgttcgggggcggcgcggggggcgcggtcggagagggcgtaggggggcggtagtcgggttcggggggcgtcggtttgttgtttttttcgtcgtcgtttttttcgcggaagtttaggtgttttcggagttatttggttatttcgtcgttgtcgtttttttttgggtcggttttcgtattttcggcgtttcggcgggattttttcgggtcgtttttagcgtttttttgcgttcgcggtttcgggcgggagttagtcggaggagtttcgtttagtaatatggggttagttagattgagcgaggggagcgtagcggcgtgtggggggcgggggtcggggtgggaagggggttt

SEQ ID NO: 9230 - DNA, 555 bp, Artificial Sequence
  chemically treated genomic DNA (Homo sapiens) CpG-island No: 9230
aaacccccttcccaccccgacccccgccccccacacgccgctacgctcccctcgctcaatctaactaaccccatattactaaacgaaactcctccgactaactcccgcccgaaaccgcgaacgcaaaaaaacgctaaaaacgacccgaaaaaatcccgccgaaacgccgaaaatacgaaaaccgacccaaaaaaaaacgacaacgacgaaataaccaaataactccgaaaacacctaaacttccgcgaaaaaaacgacgacgaaaaaaacaacaaaccgacgccccccgaacccgactaccgcccccctacgccctctccgaccgcgccccccgcgccgcccccgaacatcctaaccgcatacaaactacaacgaaaacgcgacttcgaaaacccctactccgaaaaatcgtccgactccgccgccctcgccacccctatcgcccccgaacccacgccgcccccgcgccacgactctcccccacaccgccttattcgaatcgaaaccccgaaacccccgacgccgcctactaataaacgaatctccgaacccctc

SEQ ID NO: 9231 - DNA, 555 bp, Artificial Sequence
  chemically treated genomic DNA (Homo sapiens) CpG-island No: 9231
aggttttttttttatttcggttttcgttttttatacgtcgttgcgtttttttcgtttagtttggttggttttatgttattgagcggagttttttcggttggttttcgttcggggtcgcgaacgtaggggagcgttgggggcggttcgggggggtttcgtcggggcgtcgggggtgcgggagtcggtttaggagggggcggtagcggcggagtagttaagtggtttcgggagtatttgggttttcgcggggggggcggcggcggagggggtagtaagtcggcgtttttcgagttcgattatcgtttttttgcgtttttttcggtcgcgtttttcgcgtcgttttcggatattttggtcgtatataggttgtagcgggagcgcgatttcgaagatttttatttcggggggtcgttcggtttcgtcgttttcgttatttttgtcgttttcggatttacgtcgttttcgcgttacggtttttttttatatcgttttattcgggtcgagatttcggggttttcggcgtcgtttgttgatgagcggattttcggatttttt

SEQ ID NO: 9232 - DNA, 555 bp, Artificial Sequence
  chemically treated genomic DNA (Homo sapiens) CpG-island No: 9232
aaaaaatccgaaaatccgctcatcaacaaacgacgccgaaaaccccgaaatctcgacccgaataaaacgatataaaaaaaaaccgtaacgcgaaaacgacgtaaatccgaaaacgacaaaaataacgaaaacgacgaaaccgaacgaccccccgaaataaaaatcttcgaaatcgcgctcccgctacaacctatatacgaccaaaatatccgaaaacgacgcgaaaaacgcgaccgaaaaaaacgcaaaaaaacgataatcgaactcgaaaaacgccgacttactaccccctccgccgccgccccccccgcgaaaacccaaatactcccgaaaccacttaactactccgccgctaccgccccctcctaaaccgactcccgcacccccgacgccccgacgaaacccccccgaaccgcccccaacgctcccctacgttcgcgaccccgaacgaaaaccaaccgaaaaaactccgctcaataacataaaaccaaccaaactaaacgaaaaaaacgcaacgacgtataaaaaacgaaaaccgaaataaaaaaaaaacct

SEQ ID NO: 9233 - DNA, 534 bp, Artificial Sequence
  chemically treated genomic DNA (Homo sapiens) CpG-island No: 9233
  misc_feature (285)..(285): n is either a, c, g or t
  misc_feature (304)..(304): n is either a, c, g or t
  misc_feature (320)..(321): n is either a, c, g or t
  misc_feature (331)..(331): n is either a, c, g or t
  misc_feature (337)..(337): n is either a, c, g or t
  misc_feature (345)..(345): n is either a, c, g or t
  misc_feature (364)..(364): n is either a, c, g or t
  misc_feature (374)..(374): n is either a, c, g or t
  misc_feature (388)..(388): n is either a, c, g or t
  misc_feature (406)..(406): n is either a, c, g or t
  misc_feature (411)..(412): n is either a, c, g or t
  misc_feature (428)..(429): n is either a, c, g or t
  misc_feature (510)..(510): n is either a, c, g or t
  misc_feature (518)..(518): n is either a, c, g or t
gggcgcgcggggtgttgttgttgttggacgtttttttcgtattttcgttttaggcgcggggtttgttttaattttcgcgcggtttttttttcgttttttttttttatcgagcgggtttgagtcgcggagtagttacgcgagtgcggaattcggggcgcgggcggcggtggggttcgggcgcgggtagggttggttatggcgcgggcggcgggcgcgcggggttttgtcgggtggtgtacgaggcgcgggcgttgcgggcggggtacgtttttttttttcgtcgtngtggatcgcgggttgggtngttggcggtcgcgttnngttgtttcgncgcgtnattcgggntgttttttttaagcgttgntatcgacgangaagagtcggcgtnattttggtttcgttggtnaggtnnttcgtcgtcgttttgnntttcgcgtcgcgcgttcggggaggggggattatattcgttttcggtttttagttttttcggggatttgggtggcggtggtnattcgttnggggatatgggttttt

SEQ ID NO: 9234 - DNA, 534 bp, Artificial Sequence
  chemically treated genomic DNA (Homo sapiens) CpG-island No: 9234
  misc_feature (17)..(17): n is either a, c, g or t
  misc_feature (25)..(25): n is either a, c, g or t
  misc_feature (106)..(107): n is either a, c, g or t
  misc_feature (123)..(124): n is either a, c, g or t
  misc_feature (129)..(129): n is either a, c, g or t
  misc_feature (147)..(147): n is either a, c, g or t
  misc_feature (161)..(161): n is either a, c, g or t
  misc_feature (171)..(171): n is either a, c, g or t
  misc_feature (190)..(190): n is either a, c, g or t
  misc_feature (198)..(198): n is either a, c, g or t
  misc_feature (204)..(204): n is either a, c, g or t
  misc_feature (214)..(215): n is either a, c, g or t
  misc_feature (231)..(231): n is either a, c, g or t
  misc_feature (250)..(250): n is either a, c, g or t
aaaaacccatatccccnaacgaatnaccaccgccacccaaatccccgaaaaaactaaaaaccgaaaacgaatataatcccccctccccgaacgcgcgacgcgaaanncaaaacgacgacgaannacctnaccaacgaaaccaaaatnacgccgactcttcntcgtcgatancaacgcttaaaaaaaacancccgaatnacgcgncgaaacaacnnaacgcgaccgccaacnacccaacccgcgatccacnacgacgaaaaaaaaaaacgtaccccgcccgcaacgcccgcgcctcgtacaccacccgacaaaaccccgcgcgcccgccgcccgcgccataaccaaccctacccgcgcccgaaccccaccgccgcccgcgccccgaattccgcactcgcgtaactactccgcgactcaaacccgctcgataaaaaaaaaaaacgaaaaaaaaaccgcgcgaaaattaaaacaaaccccgcgcctaaaacgaaaatacgaaaaaaacgtccaacaacaacaacaccccgcgcgccc

SEQ ID NO: 9235 - DNA, 534 bp, Artificial Sequence
  chemically treated genomic DNA (Homo sapiens) CpG-island No: 9235
  misc_feature (17)..(17): n is either a, c, g or t
  misc_feature (25)..(25): n is either a, c, g or t
  misc_feature (106)..(107): n is either a, c, g or t
  misc_feature (123)..(124): n is either a, c, g or t
  misc_feature (129)..(129): n is either a, c, g or t
  misc_feature (147)..(147): n is either a, c, g or t
  misc_feature (161)..(161): n is either a, c, g or t
  misc_feature (171)..(171): n is either a, c, g or t
  misc_feature (190)..(190): n is either a, c, g or t
  misc_feature (198)..(198): n is either a, c, g or t
  misc_feature (204)..(204): n is either a, c, g or t
  misc_feature (214)..(215): n is either a, c, g or t
  misc_feature (231)..(231): n is either a, c, g or t
  misc_feature (250)..(250): n is either a, c, g or t
gggaatttatgtttttnggcgggtngttatcgttatttaagttttcgggaaggttggggatcgggagcgggtgtgatttttttttttcggacgcgcggcgcggggnntagaacggcggcgggnnatttnattagcggggttaggatngcgtcggttttttntcgtcggtgntagcgtttggagaggatanttcgggtngcgcgncggagtagtnnagcgcggtcgttagtnatttagttcgcggtttatngcggcgaaggggaggagcgtgtttcgttcgtagcgttcgcgtttcgtgtattattcggtagggtttcgcgcgttcgtcgttcgcgttatggttagttttgttcgcgttcgggttttatcgtcgttcgcgtttcgagtttcgtattcgcgtagttgtttcgcggtttaggttcgttcggtggggagggggaacgggggaggggtcgcgcgagggttggggtaggtttcgcgtttggggcggaggtgcggggagggcgtttagtagtagtaatatttcgcgcgttt

SEQ ID NO: 9236 - DNA, 534 bp, Artificial Sequence
  chemically treated genomic DNA (Homo sapiens) CpG-island No: 9236
  misc_feature (285)..(285): n is either a, c, g or t
  misc_feature (304)..(304): n is either a, c, g or t
  misc_feature (320)..(321): n is either a, c, g or t
  misc_feature (331)..(331): n is either a, c, g or t
  misc_feature (337)..(337): n is either a, c, g or t
  misc_feature (345)..(345): n is either a, c, g or t
  misc_feature (364)..(364): n is either a, c, g or t
  misc_feature (374)..(374): n is either a, c, g or t
  misc_feature (388)..(388): n is either a, c, g or t
  misc_feature (406)..(406): n is either a, c, g or t
  misc_feature (411)..(412): n is either a, c, g or t
  misc_feature (428)..(429): n is either a, c, g or t
  misc_feature (510)..(510): n is either a, c, g or t
  misc_feature (518)..(518): n is either a, c, g or t
aaacgcgcgaaatattactactactaaacgccctccccgcacctccgccccaaacgcgaaacctaccccaaccctcgcgcgacccctcccccgttccccctccccaccgaacgaacctaaaccgcgaaacaactacgcgaatacgaaactcgaaacgcgaacgacgataaaacccgaacgcgaacaaaactaaccataacgcgaacgacgaacgcgcgaaaccctaccgaataatacacgaaacgcgaacgctacgaacgaaacacgctcctccccttcgccgcnataaaccgcgaactaaatnactaacgaccgcgctnnactactccgncgcgcnacccgaantatcctctccaaacgctancaccgacganaaaaaaccgacgcnatcctaaccccgctaatnaaatnncccgccgccgttctannccccgcgccgcgcgtccgaaaaaaaaaaatcacacccgctcccgatccccaaccttcccgaaaacttaaataacgataacnacccgccnaaaaacataaattccc

SEQ ID NO: 9237 - DNA, 804 bp, Artificial Sequence
  chemically treated genomic DNA (Homo sapiens) CpG-island No: 9237
  misc_feature (323)..(323): n is either a, c, g or t
  misc_feature (412)..(412): n is either a, c, g or t
gcgttcggattggtataatcgtcgttgttttatttttttcggggcggtaatatcgtagtgttaggtttgggattgaggcgtggggttttttttcgtttcgttttggcgtcgttcgtcgtttcgttttttggggggtttcgtggcgtatttttgtgacgtagcgtttgtgtcgatatcggcgcgcgtcgagttcggaagaggcgcgggttaggaaaggagttggttcgcgtaggtgcggcgtttgggtttttatggcgttgtggcgcggtttcgcgtacgcgggttttttggcgttggtcgtgggttgcgtttttttgttggangttagagttgttaggttcggcgttgcgttttttttggagttcgttgtgtttggggttcgcgtttgcgttttcgggattcgttttttttngagggtcggttggcggtagtttgggacgcgtttatcgtgcggttagttcggcgttggcgtcgcgtggtagtggggtgagtgttaacggggtttgggtttttgagttttcgaggtcggttttggaggtcgggcggagtcgcgtagaaatagggttttttagaggttttcgggaggcgttgttgttcgcgttggttttttggcgagaagtgtcggacgtttgagtggaattcggttcgttatcgttgttttttttattcggttggtttttgcgttttttttttatttcggtaggattagttttaatagttttttgttaatttcgttttgtttgatattttttttcgagttttttttttcgttttaatttttagtttttttttttttggcgattg

SEQ ID NO: 9238 - DNA, 804 bp, Artificial Sequence
  chemically treated genomic DNA (Homo sapiens) CpG-island No: 9238
  misc_feature (393)..(393): n is either a, c, g or t
  misc_feature (482)..(482): n is either a, c, g or t
caatcgccaaaaaaaaaaaaactaaaaattaaaacgaaaaaaaaaactcgaaaaaaaatatcaaacaaaacgaaattaacaaaaaactattaaaactaatcctaccgaaataaaaaaaaaacgcaaaaaccaaccgaataaaaaaaacaacgataacgaaccgaattccactcaaacgtccgacacttctcgccaaaaaaccaacgcgaacaacaacgcctcccgaaaacctctaaaaaaccctatttctacgcgactccgcccgacctccaaaaccgacctcgaaaactcaaaaacccaaaccccgttaacactcaccccactaccacgcgacgccaacgccgaactaaccgcacgataaacgcgtcccaaactaccgccaaccgaccctcnaaaaaaaacgaatcccgaaaacgcaaacgcgaaccccaaacacaacgaactccaaaaaaaacgcaacgccgaacctaacaactctaacntccaacaaaaaaacgcaacccacgaccaacgccaaaaaacccgcgtacgcgaaaccgcgccacaacgccataaaaacccaaacgccgcacctacgcgaaccaactcctttcctaacccgcgcctcttccgaactcgacgcgcgccgatatcgacacaaacgctacgtcacaaaaatacgccacgaaaccccccaaaaaacgaaacgacgaacgacgccaaaacgaaacgaaaaaaaaccccacgcctcaatcccaaacctaacactacgatattaccgccccgaaaaaaataaaacaacgacgattataccaatccgaacgc

SEQ ID NO: 9239 - DNA, 804 bp, Artificial Sequence
  chemically treated genomic DNA (Homo sapiens) CpG-island No: 9239
  misc_feature (393)..(393): n is either a, c, g or t
  misc_feature (482)..(482): n is either a, c, g or t
tagtcgttagaagagaaggggttaaaagttggaacgaggaagaaggttcggagaaaggtgttagataaagcgggattagtaagaagttgttagggttggttttatcgggatgagagaaaggcgtagaggttagtcgagtggaaagagtagcggtgacgaatcgggttttatttagacgttcgatatttttcgttaaggggttagcgcggatagtagcgtttttcggggatttttgagaagttttgtttttgcgcggtttcgttcgatttttaaggtcgatttcggaggtttagagatttaggtttcgttggtatttattttattgttacgcggcgttagcgtcggattggtcgtacgataagcgcgttttaggttgtcgttaatcggtttttngggggagacgggtttcgggggcgtaggcgcgggttttagatatagcgagttttagagagagcgtagcgtcgagtttggtagttttggtntttagtaggaagacgtagtttacggttagcgttaggaagttcgcgtacgcggagtcgcgttatagcgttatggggatttaggcgtcgtatttgcgcgaattaattttttttttagttcgcgtttttttcgggttcggcgcgcgtcgatgtcgatataagcgttacgttataagggtgcgttacggggttttttaaggggcggggcgacgggcggcgttaggacggagcgaggggggattttacgttttagttttaggtttggtattgcggtgttgtcgtttcggaggaggtgggataacggcggttgtgttagttcgggcgt

SEQ ID NO: 9240 - DNA, 804 bp, Artificial Sequence
  chemically treated genomic DNA (Homo sapiens) CpG-island No: 9240
  misc_feature (323)..(323): n is either a, c, g or t
  misc_feature (412)..(412): n is either a, c, g or t
acgcccgaactaacacaaccgccgttatcccacctcctccgaaacgacaacaccgcaataccaaacctaaaactaaaacgtaaaatcccccctcgctccgtcctaacgccgcccgtcgccccgccccttaaaaaaccccgtaacgcacccttataacgtaacgcttatatcgacatcgacgcgcgccgaacccgaaaaaaacgcgaactaaaaaaaaaattaattcgcgcaaatacgacgcctaaatccccataacgctataacgcgactccgcgtacgcgaacttcctaacgctaaccgtaaactacgtcttcctactaaanaccaaaactaccaaactcgacgctacgctctctctaaaactcgctatatctaaaacccgcgcctacgcccccgaaacccgtctcccccnaaaaaccgattaacgacaacctaaaacgcgcttatcgtacgaccaatccgacgctaacgccgcgtaacaataaaataaataccaacgaaacctaaatctctaaacctccgaaatcgaccttaaaaatcgaacgaaaccgcgcaaaaacaaaacttctcaaaaatccccgaaaaacgctactatccgcgctaaccccttaacgaaaaatatcgaacgtctaaataaaacccgattcgtcaccgctactctttccactcgactaacctctacgcctttctctcatcccgataaaaccaaccctaacaacttcttactaatcccgctttatctaacacctttctccgaaccttcttcctcgttccaacttttaaccccttctcttctaacgacta

SEQ ID NO: 9241 - DNA, 1013 bp, Artificial Sequence
  chemically treated genomic DNA (Homo sapiens) CpG-island No: 9241
  misc_feature (472)..(472): n is either a, c, g or t
  misc_feature (564)..(564): n is either a, c, g or t
  misc_feature (703)..(703): n is either a, c, g or t
  misc_feature (922)..(922): n is either a, c, g or t
tttcgtcgttatttagttgtcgggttaattagtagtcgaggtgtgcggttaggcgcgagttttgcgggagtttagttttcgggagagattcggtagcggcgcggcgaggacggcggcgcggcgaggacggcggcgcggcgaggacggcggcgcggcgaggacggcggcgcggcgaggacgcgcggcgcggcgaggacggcggcgcggcgaggacggcggcgcggcgaggacggcggaacggcgaggacggcggcgcggcgaggattacggcgcgtcgagaacggcggttcggcgaagaacgcggcgcggcgaggacggcggttcggcgaggacggcggttcggtaaggacggcgggttcggtaaggacgtcggtacggttaggacggcggcgcggatagaacgttcggttcggtaagtacggcggttttgtaaaaacgtcggttcggtaagaacggcggcgaatcggggtangtttcgcgttttggttaggtaagttcggggaatttcggttgtttgattcgttggcggcggtagttttggtttcgttcgcggcgtcgcggggnattcggacgcgtggggggcggcgcgtaagttgcgggttaagagttttcgagcgttgtttttcggattcggcggggttgcggggaggtcgtcgttgggatttaggggtgtagttcggcggttttacgtttttcggatcgngattattttttttttacgatgggcgggcgggtgcggcggggattaggcgatggttttcgtatttcgggaggggtttatcgcggcgaggggttattttcggcgtcggtaagtggcgttgtttggcgggttcgttcgttcgcgtttcgtcgggttggtcgggtcgttggtgcgtttcgttgttcggtttggcgtcggtattaagttttcgtgttgggcggntaattattgagtttgggatcgtttttgggtttatttttttgggagaattcgagttcggattttcggtttttttttttttttgtataataag

SEQ ID NO: 9242 - DNA, 1013 bp, Artificial Sequence
  chemically treated genomic DNA (Homo sapiens) CpG-island No: 9242
  misc_feature (92)..(92): n is either a, c, g or t
  misc_feature (311)..(311): n is either a, c, g or t
  misc_feature (450)..(450): n is either a, c, g or t
  misc_feature (542)..(542): n is either a, c, g or t
cttattatacaaaaaaaaaaaaaaaccgaaaatccgaactcgaattctcccaaaaaaataaacccaaaaacgatcccaaactcaataattanccgcccaacacgaaaacttaataccgacgccaaaccgaacaacgaaacgcaccaacgacccgaccaacccgacgaaacgcgaacgaacgaacccgccaaacaacgccacttaccgacgccgaaaataacccctcgccgcgataaacccctcccgaaatacgaaaaccatcgcctaatccccgccgcacccgcccgcccatcgtaaaaaaaaaataatcncgatccgaaaaacgtaaaaccgccgaactacacccctaaatcccaacgacgacctccccgcaaccccgccgaatccgaaaaacaacgctcgaaaactcttaacccgcaacttacgcgccgccccccacgcgtccgaatnccccgcgacgccgcgaacgaaaccaaaactaccgccgccaacgaatcaaacaaccgaaattccccgaacttacctaaccaaaacgcgaaacntaccccgattcgccgccgttcttaccgaaccgacgtttttacaaaaccgccgtacttaccgaaccgaacgttctatccgcgccgccgtcctaaccgtaccgacgtccttaccgaacccgccgtccttaccgaaccgccgtcctcgccgaaccgccgtcctcgccgcgccgcgttcttcgccgaaccgccgttctcgacgcgccgtaatcctcgccgcgccgccgtcctcgccgttccgccgtcctcgccgcgccgccgtcctcgccgcgccgccgtcctcgccgcgccgcgcgtcctcgccgcgccgccgtcctcgccgcgccgccgtcctcgccgcgccgccgtcctcgccgcgccgccgtcctcgccgcgccgctaccgaatctctcccgaaaactaaactcccgcaaaactcgcgcctaaccgcacacctcgactactaattaacccgacaactaaataacgacgaaa

SEQ ID NO: 9243 - DNA, 1013 bp, Artificial Sequence
  chemically treated genomic DNA (Homo sapiens) CpG-island No: 9243
  misc_feature (92)..(92): n is either a, c, g or t
  misc_feature (311)..(311): n is either a, c, g or t
  misc_feature (450)..(450): n is either a, c, g or t
  misc_feature (542)..(542): n is either a, c, g or t
tttattatatagggaaagggaagggtcgaagattcgggttcgagtttttttagggaagtgaatttagaggcgattttaaatttagtagttgntcgtttagtacggggatttgatgtcggcgttaagtcgggtagcggaacgtattagcggttcgattagttcggcgagacgcgagcgggcgggttcgttagatagcgttatttgtcggcgtcgagagtggtttttcgtcgcggtgagtttttttcgggatgcgaaagttatcgtttagttttcgtcgtattcgttcgtttatcgtgggaggaggatggttncggttcgagaggcgtaaggtcgtcgggttgtatttttagattttagcggcggttttttcgtagtttcgtcgagttcggggggtagcgttcgggagtttttggttcgtagtttacgcgtcgttttttacgcgttcgggtntttcgcggcgtcgcgggcggggttaaggttgtcgtcgttagcgagttaggtagtcgaggtttttcgagtttatttggttagggcgcggggtntgtttcggttcgtcgtcgtttttgtcgggtcggcgtttttgtagggtcgtcgtgtttgtcgggtcgggcgttttattcgcgtcgtcgttttagtcgtgtcggcgtttttgtcgggttcgtcgtttttgtcgggtcgtcgttttcgtcgggtcgtcgttttcgtcgcgtcgcgtttttcgtcgagtcgtcgttttcggcgcgtcgtagttttcgtcgcgtcgtcgttttcgtcgtttcgtcgttttcgtcgcgtcgtcgttttcgtcgcgtcgtcgttttcgtcgcgtcgcgcgttttcgtcgcgtcgtcgttttcgtcgcgtcgtcgttttcgtcgcgtcgtcgttttcgtcgcgtcgtcgttttcgtcgcgtcgttgtcgggtttttttcgggggttgagttttcgtagagttcgcgtttagtcgtatatttcgattgttgattagttcgatagttgaatagcggcggga

SEQ ID NO: 9244 - DNA, 1013 bp, Artificial Sequence
  chemically treated genomic DNA (Homo sapiens) CpG-island No: 9244
  misc_feature (472)..(472): n is either a, c, g or t
  misc_feature (564)..(564): n is either a, c, g or t
  misc_feature (703)..(703): n is either a, c, g or t
  misc_feature (922)..(922): n is either a, c, g or t
tcccgccgctattcaactatcgaactaatcaacaatcgaaatatacgactaaacgcgaactctacgaaaactcaacccccgaaaaaaacccgacaacgacgcgacgaaaacgacgacgcgacgaaaacgacgacgcgacgaaaacgacgacgcgacgaaaacgacgacgcgacgaaaacgcgcgacgcgacgaaaacgacgacgcgacgaaaacgacgacgcgacgaaaacgacgaaacgacgaaaacgacgacgcgacgaaaactacgacgcgccgaaaacgacgactcgacgaaaaacgcgacgcgacgaaaacgacgacccgacgaaaacgacgacccgacaaaaacgacgaacccgacaaaaacgccgacacgactaaaacgacgacgcgaataaaacgcccgacccgacaaacacgacgaccctacaaaaacgccgacccgacaaaaacgacgacgaaccgaaacanaccccgcgccctaaccaaataaactcgaaaaacctcgactacctaactcgctaacgacgacaaccttaaccccgcccgcgacgccgcgaaanacccgaacgcgtaaaaaacgacgcgtaaactacgaaccaaaaactcccgaacgctaccccccgaactcgacgaaactacgaaaaaaccgccgctaaaatctaaaaatacaacccgacgaccttacgcctctcgaaccgnaaccatcctcctcccacgataaacgaacgaatacgacgaaaactaaacgataactttcgcatcccgaaaaaaactcaccgcgacgaaaaaccactctcgacgccgacaaataacgctatctaacgaacccgcccgctcgcgtctcgccgaactaatcgaaccgctaatacgttccgctacccgacttaacgccgacatcaaatccccgtactaaacgancaactactaaatttaaaatcgcctctaaattcacttccctaaaaaaactcgaacccgaatcttcgacccttccctttccctatataataaa

SEQ ID NO: 9245 - DNA, 1198 bp, Artificial Sequence
  chemically treated genomic DNA (Homo sapiens) CpG-island No: 9245
  misc_feature (734)..(734): n is either a, c, g or t
  misc_feature (941)..(941): n is either a, c, g or t
  misc_feature (1164)..(1164): n is either a, c, g or t
tagagcgagtagggcgtagcgtcgcggtcggggtaggatgcggagtttcgcgtttatcggttttattcgcgagattagatttttgtaattttttagttagtaaggtcgggacgtgtttcgggtatttgtgtgttttttagggttcgggacgttcggggcgttgagtcgtttaacgtttgggttttagtttcggtttcgtagattttttcggttggattcgggttttgggtgtattcgttcgttttgtcgatgttttagtgtcggggttaggggtcgtagggtttcgtgaacgttcggtacggacgtattttttttttttttttttttttcgcgcgcggtgtcgtcgggaagcgtttttcggttttagtgatttaagagcgggtgaggtaaagcggtagggatcggggtacgggttcggtagtcgtagtttagtgcgcgtgcgttaggtagcggtagttttgcgtgtttttcgtatttcgtttgcggtatgtattcgtcgttatttagttttcgggttaattagtagtcgcggtgtgtcgttaagtgcgggtttttaaggagtttagtttttcggacggagtcggcggttgcggggcgaggacggcggcggatcggggtagtttcgcgttttggttaggtaagttggggaattttggttgtttgattttttggcggcggtaatttggggtcgttcgcggcgtcgcggggatttcgacgcgtggggggcggcgcgngaagttgtaggttaagagttttcgagcgttgtttttcggattcggcggggttgcggggaggtcgtcgttgggatttaggggtgtagttcggttggtttacgtttttcggatcggtttattttttttttataaaaggcggtcgggtgcggcggggattaattaaaattttcgtatttcgggaggggtttatcgcggtaaggggttatntttcggcgcgggtaagtggcgttgtttgtttttttcgttagataagaaatcgttgggttggtcgggtcgttggtgcgtttcgttgtttcgtttgacgtcggtattaagttttcgagttgggcggtaattattgagtttggggtcgtttttgggttcgttttttcgggagaattcgagttcggattttcgttttttttttttttttgtataataaggtttagangagaaaaattttttaattaaaaattttatatttt

SEQ ID NO: 9246 - DNA, 1198 bp, Artificial Sequence
  chemically treated genomic DNA (Homo sapiens) CpG-island No: 9246
  misc_feature (35)..(35): n is either a, c, g or t
  misc_feature (258)..(258): n is either a, c, g or t
  misc_feature (465)..(465): n is either a, c, g or t
aaaatataaaatttttaattaaaaaatttttctcntctaaaccttattatacaaaaaaaaaaaaaaaacgaaaatccgaactcgaattctcccgaaaaaacgaacccaaaaacgaccccaaactcaataattaccgcccaactcgaaaacttaataccgacgtcaaacgaaacaacgaaacgcaccaacgacccgaccaacccaacgatttcttatctaacgaaaaaaacaaacaacgccacttacccgcgccgaaanataaccccttaccgcgataaacccctcccgaaatacgaaaattttaattaatccccgccgcacccgaccgccttttataaaaaaaaaataaaccgatccgaaaaacgtaaaccaaccgaactacacccctaaatcccaacgacgacctccccgcaaccccgccgaatccgaaaaacaacgctcgaaaactcttaacctacaacttcncgcgccgccccccacgcgtcgaaatccccgcgacgccgcgaacgaccccaaattaccgccgccaaaaaatcaaacaaccaaaattccccaacttacctaaccaaaacgcgaaactaccccgatccgccgccgtcctcgccccgcaaccgccgactccgtccgaaaaactaaactccttaaaaacccgcacttaacgacacaccgcgactactaattaacccgaaaactaaataacgacgaatacataccgcaaacgaaatacgaaaaacacgcaaaactaccgctacctaacgcacgcgcactaaactacgactaccgaacccgtaccccgatccctaccgctttacctcacccgctcttaaatcactaaaaccgaaaaacgcttcccgacgacaccgcgcgcgaaaaaaaaaaaaaaaaaaaaaatacgtccgtaccgaacgttcacgaaaccctacgacccctaaccccgacactaaaacatcgacaaaacgaacgaatacacccaaaacccgaatccaaccgaaaaaatctacgaaaccgaaactaaaacccaaacgttaaacgactcaacgccccgaacgtcccgaaccctaaaaaacacacaaatacccgaaacacgtcccgaccttactaactaaaaaattacaaaaatctaatctcgcgaataaaaccgataaacgcgaaactccgcatcctaccccgaccgcgacgctacgccctactcgctcta

SEQ ID NO: 9247 - DNA, 1198 bp, Artificial Sequence
  chemically treated genomic DNA (Homo sapiens) CpG-island No: 9247
  misc_feature (35)..(35): n is either a, c, g or t
  misc_feature (258)..(258): n is either a, c, g or t
  misc_feature (465)..(465): n is either a, c, g or t
aaggtgtggggtttttaattgagaagttttttttntttgggttttattatataggaaaagggaaggggcgaagattcgggttcgggttttttcggggaagcgaatttagaggcgattttaaatttagtagttgtcgtttagttcggggatttgatgtcggcgttaagcggggtagcggaacgtattagcggttcggttagtttagcgattttttatttggcggggggggtagatagcgttatttgttcgcgtcgagangtggttttttatcgcggtgagtttttttcgggatgcgagagttttggttggttttcgtcgtattcggtcgttttttgtgggaggaggatgggtcggttcgagaggcgtaggttagtcgggttgtatttttagattttagcggcggttttttcgtagtttcgtcgagttcggggggtagcgttcgggagtttttggtttgtagttttncgcgtcgttttttacgcgtcggggttttcgcggcgtcgcgggcggttttaggttgtcgtcgttagggagttaggtagttaaggttttttagtttatttggttagggcgcggggttgtttcggttcgtcgtcgttttcgtttcgtagtcgtcggtttcgttcgggaggttgagttttttgagagttcgtatttagcggtatatcgcgattgttaattagttcggaagttgaatagcggcgggtatatatcgtaagcggagtacggaaagtacgtagggttgtcgttatttggcgtacgcgtattgagttgcggttgtcgagttcgtgtttcggtttttgtcgttttattttattcgtttttggattattggggtcgggaaacgtttttcggcgatatcgcgcgcggggaagagagggaagaaaaagatgcgttcgtgtcgggcgtttacgaggttttgcggtttttggtttcggtattgggatatcggtagggcgggcgggtgtatttaggattcgggtttagtcgggaggatttacgggatcggggttggaatttagacgttggacggtttagcgtttcgaacgtttcgggttttggggagtatatagatgttcgaagtacgtttcggttttgttggttggggagttgtaggggtttggtttcgcgggtaaagtcggtgaacgcgaggtttcgtattttgtttcggtcgcggcgttgcgttttgttcgttttg

SEQ ID NO: 9248 - DNA, 1198 bp, Artificial Sequence
  chemically treated genomic DNA (Homo sapiens) CpG-island No: 9248
  misc_feature (734)..(734): n is either a, c, g or t
  misc_feature (941)..(941): n is either a, c, g or t
  misc_feature (1164)..(1164): n is either a, c, g or t
caaaacgaacaaaacgcaacgccgcgaccgaaacaaaatacgaaacctcgcgttcaccgactttacccgcgaaaccaaacccctacaactccccaaccaacaaaaccgaaacgtacttcgaacatctatatactccccaaaacccgaaacgttcgaaacgctaaaccgtccaacgtctaaattccaaccccgatcccgtaaatcctcccgactaaacccgaatcctaaatacacccgcccgccctaccgatatcccaataccgaaaccaaaaaccgcaaaacctcgtaaacgcccgacacgaacgcatctttttcttccctctcttccccgcgcgcgatatcgccgaaaaacgtttcccgaccccaataatccaaaaacgaataaaataaaacgacaaaaaccgaaacacgaactcgacaaccgcaactcaatacgcgtacgccaaataacgacaaccctacgtactttccgtactccgcttacgatatatacccgccgctattcaacttccgaactaattaacaatcgcgatataccgctaaatacgaactctcaaaaaactcaacctcccgaacgaaaccgacgactacgaaacgaaaacgacgacgaaccgaaacaaccccgcgccctaaccaaataaactaaaaaaccttaactacctaactccctaacgacgacaacctaaaaccgcccgcgacgccgcgaaaaccccgacgcgtaaaaaacgacgcgnaaaactacaaaccaaaaactcccgaacgctaccccccgaactcgacgaaactacgaaaaaaccgccgctaaaatctaaaaatacaacccgactaacctacgcctctcgaaccgacccatcctcctcccacaaaaaacgaccgaatacgacgaaaaccaaccaaaactctcgcatcccgaaaaaaactcaccgcgataaaaaaccacntctcgacgcgaacaaataacgctatctaccccccccgccaaataaaaaatcgctaaactaaccgaaccgctaatacgttccgctaccccgcttaacgccgacatcaaatccccgaactaaacgacaactactaaatttaaaatcgcctctaaattcgcttccccgaaaaaacccgaacccgaatcttcgccccttcccttttcctatataataaaacccaaanaaaaaaaacttctcaattaaaaaccccacacctt

SEQ ID NO: 9249 - DNA, 590 bp, Artificial Sequence
  chemically treated genomic DNA (Homo sapiens) CpG-island No: 9249
  misc_feature (117)..(117): n is either a, c, g or t
ttcgacggcgttaggtaacggttttcgtagtcgcggaaggttatattgtcggagcggaattgtagcgtgtagttagtggtcggttcggggcgcgttattaggcgtttgttatggcgntaggaagcggtggttcgcggtttgtacgttgtagcgttgtttttggaaggcgagggtgacgagcgagtcgacgttttagggtacgtcgcggtttattgcgatttcgtcggtcggcggcgcgtttaggtgcgtttagcgtttaggggtgacgcggtagatgttgatttgagggtgtatggcgatgtgtacgttttatttttcggcgggggatatcgtttgcgcgaagtacgataggcggtttttcgtgtcgtcgaaggagcgtcggtgcgtttcggattgtagcgattagcggtcgtcgtcgtgcgttacggtgaggaagcggtagtcgggatcgggtatttcgcgttcgtaggttatattgtcgtttttgttcgtcgttaggtagcggtttaggtggttgcgtaggtatacggtcgcgttgttcgtttagttagggggttgttttagcgtttagatttgttgtttttttaggt

SEQ ID NO: 9250 - DNA, 590 bp, Artificial Sequence
  chemically treated genomic DNA (Homo sapiens) CpG-island No: 9250
  misc_feature (474)..(474): n is either a, c, g or t
acctaaaaaaacaacaaatctaaacgctaaaacaaccccctaactaaacgaacaacgcgaccgtatacctacgcaaccacctaaaccgctacctaacgacgaacaaaaacgacaatataacctacgaacgcgaaatacccgatcccgactaccgcttcctcaccgtaacgcacgacgacgaccgctaatcgctacaatccgaaacgcaccgacgctccttcgacgacacgaaaaaccgcctatcgtacttcgcgcaaacgatatcccccgccgaaaaataaaacgtacacatcgccatacaccctcaaatcaacatctaccgcgtcacccctaaacgctaaacgcacctaaacgcgccgccgaccgacgaaatcgcaataaaccgcgacgtaccctaaaacgtcgactcgctcgtcaccctcgccttccaaaaacaacgctacaacgtacaaaccgcgaaccaccgcttcctancgccataacaaacgcctaataacgcgccccgaaccgaccactaactacacgctacaattccgctccgacaatataaccttccgcgactacgaaaaccgttacctaacgccgtcgaa

SEQ ID NO: 9251 - DNA, 590 bp, Artificial Sequence
  chemically treated genomic DNA (Homo sapiens) CpG-island No: 9251
  misc_feature (474)..(474): n is either a, c, g or t
gtttgaagaagtagtagatttggacgttggagtagttttttgattaggcgggtagcgcggtcgtgtgtttgcgtagttatttgggtcgttatttggcggcggataaggacggtaatgtgatttgcgagcgcgaggtgttcggtttcgattgtcgtttttttatcgtggcgtacgacgacggtcgttggtcgttgtagttcgaggcgtatcggcgttttttcggcggtacggaggatcgtttgtcgtgtttcgcgtagacggtgtttttcgtcgagaagtggagcgtgtatatcgttatgtatttttaggttaatatttatcgcgttatttttaagcgttaggcgtatttgagcgcgtcgtcggtcgacgagatcgtagtggatcgcgacgtgttttggggcgtcgattcgttcgttattttcgttttttaggagtagcgttatagcgtgtagatcgcggattatcgttttttgncgttatgataggcgtttggtggcgcgtttcgagtcggttattggttatacgttgtagtttcgtttcggtaatgtggtttttcgcgattgcgagggtcgttatttggcgtcgtcggg

SEQ ID NO: 9252 - DNA, 590 bp, Artificial Sequence
  chemically treated genomic DNA (Homo sapiens) CpG-island No: 9252
  misc_feature (117)..(117): n is either a, c, g or t
cccgacgacgccaaataacgaccctcgcaatcgcgaaaaaccacattaccgaaacgaaactacaacgtataaccaataaccgactcgaaacgcgccaccaaacgcctatcataacgncaaaaaacgataatccgcgatctacacgctataacgctactcctaaaaaacgaaaataacgaacgaatcgacgccccaaaacacgtcgcgatccactacgatctcgtcgaccgacgacgcgctcaaatacgcctaacgcttaaaaataacgcgataaatattaacctaaaaatacataacgatatacacgctccacttctcgacgaaaaacaccgtctacgcgaaacacgacaaacgatcctccgtaccgccgaaaaaacgccgatacgcctcgaactacaacgaccaacgaccgtcgtcgtacgccacgataaaaaaacgacaatcgaaaccgaacacctcgcgctcgcaaatcacattaccgtccttatccgccgccaaataacgacccaaataactacgcaaacacacgaccgcgctacccgcctaatcaaaaaactactccaacgtccaaatctactacttcttcaaac

SEQ ID NO: 9253 - DNA, 775 bp, Artificial Sequence
  chemically treated genomic DNA (Homo sapiens) CpG-island No: 9253
  misc_feature (306)..(306): n is either a, c, g or t
  misc_feature (534)..(534): n is either a, c, g or t
  misc_feature (555)..(555): n is either a, c, g or t
  misc_feature (569)..(569): n is either a, c, g or t
  misc_feature (571)..(571): n is either a, c, g or t
gatcgtcgtcggtttgagtttttacgaggtttgcgttaagtgcgggaatttgtttataaatttggatagtttgaacgtttataatgttatttatcgtagagtcgaggttagtcgtacgcgcgtttcggtcgaggagggggcggaggggttttcggatattaagtagttttttttttagtgtttgaatttgaggtcgtcggcggtcggcgattcgtgttttggtacgtaggtcggacggcgggtggttgagttggattcggttaatagttattaggtttggtagttggttacgcggggtaaggtggntcgagtcggtcgagtattttaagtacggggtttgggacgaggcgttggtcggggacgtggttttcgataaggataggcgcgagtacgttttggtgagttaggagaagcgtaagcgtgagtaggatgtattagtcgcgtaggggttttcgcggaagcgcgcgagcgggtttggggatttcgcgttcgtcggttatttcgattttcgttcggtcgcgcgttttaatcgtnagggtcgtagttattatcggnttagggtaagtttntntcgagtgtttcgagtgcggtaagatttttcgtatttattattagatggtgttgtatttacgcgtgtatcgtcgcgcgcgtcgcgagagggatagtgacggggatagggcggcgcgggttcgttgcggattatttagtgagggtgattcggttttttagtttagtagttttggtttcgtttgtgtcgttgttgatttttcgggtt

SEQ ID NO: 9254 - DNA, 775 bp, Artificial Sequence
  chemically treated genomic DNA (Homo sapiens) CpG-island No: 9254
  misc_feature (205)..(205): n is either a, c, g or t
  misc_feature (207)..(207): n is either a, c, g or t
  misc_feature (221)..(221): n is either a, c, g or t
  misc_feature (242)..(242): n is either a, c, g or t
  misc_feature (470)..(470): n is either a, c, g or t
aacccgaaaaatcaacaacgacacaaacgaaaccaaaactactaaactaaaaaaccgaatcaccctcactaaataatccgcaacgaacccgcgccgccctatccccgtcactatccctctcgcgacgcgcgcgacgatacacgcgtaaatacaacaccatctaataataaatacgaaaaatcttaccgcactcgaaacactcgananaaacttaccctaanccgataataactacgaccctnacgattaaaacgcgcgaccgaacgaaaatcgaaataaccgacgaacgcgaaatccccaaacccgctcgcgcgcttccgcgaaaacccctacgcgactaatacatcctactcacgcttacgcttctcctaactcaccaaaacgtactcgcgcctatccttatcgaaaaccacgtccccgaccaacgcctcgtcccaaaccccgtacttaaaatactcgaccgactcganccaccttaccccgcgtaaccaactaccaaacctaataactattaaccgaatccaactcaaccacccgccgtccgacctacgtaccaaaacacgaatcgccgaccgccgacgacctcaaattcaaacactaaaaaaaaaactacttaatatccgaaaacccctccgccccctcctcgaccgaaacgcgcgtacgactaacctcgactctacgataaataacattataaacgttcaaactatccaaatttataaacaaattcccgcacttaacgcaaacctcgtaaaaactcaaaccgacgacgatc

SEQ ID NO: 9255 - DNA, 775 bp, Artificial Sequence
  chemically treated genomic DNA (Homo sapiens) CpG-island No: 9255
  misc_feature (205)..(205): n is either a, c, g or t
  misc_feature (207)..(207): n is either a, c, g or t
  misc_feature (221)..(221): n is either a, c, g or t
  misc_feature (242)..(242): n is either a, c, g or t
  misc_feature (470)..(470): n is either a, c, g or t
agttcggggagttagtagcggtataggcggagttagggttgttgggttgggaggtcgagttatttttattgagtgattcgtagcgggttcgcgtcgttttgttttcgttattgtttttttcgcggcgcgcgcggcgatgtacgcgtgagtgtagtattatttgatgataggtgcggaagattttgtcgtattcgaagtattcggnanggatttgttttggntcggtggtggttgcggttttngcggttggggcgcgcggtcgagcggggatcgaggtggtcggcgggcgcggggtttttaggttcgttcgcgcgttttcgcgggggtttttgcgcggttggtgtattttgtttacgtttgcgttttttttggtttattaggacgtattcgcgtttgtttttgtcgaaggttacgttttcggttagcgtttcgttttaggtttcgtatttgaggtattcggtcggttcggnttattttatttcgcgtggttagttgttaggtttggtagttgttgatcgggtttagtttagttattcgtcgttcggtttgcgtgttagggtacgagtcgtcggtcgtcgacggttttaggtttaggtattggaggaagaattgtttggtgttcgagggttttttcgtttttttttcggtcggggcgcgcgtgcggttggtttcgattttgcggtggatggtattgtgggcgtttaagttgtttaggtttgtaaataggttttcgtatttggcgtagatttcgtagaggtttaggtcggcgacgatt

SEQ ID NO: 9256 - DNA, 775 bp, Artificial Sequence
  chemically treated genomic DNA (Homo sapiens) CpG-island No: 9256
  misc_feature (306)..(306): n is either a, c, g or t
  misc_feature (534)..(534): n is either a, c, g or t
  misc_feature (555)..(555): n is either a, c, g or t
  misc_feature (569)..(569): n is either a, c, g or t
  misc_feature (571)..(571): n is either a, c, g or t
aatcgtcgccgacctaaacctctacgaaatctacgccaaatacgaaaacctatttacaaacctaaacaacttaaacgcccacaataccatccaccgcaaaatcgaaaccaaccgcacgcgcgccccgaccgaaaaaaaaacgaaaaaaccctcgaacaccaaacaattcttcctccaatacctaaacctaaaaccgtcgacgaccgacgactcgtaccctaacacgcaaaccgaacgacgaataactaaactaaacccgatcaacaactaccaaacctaacaactaaccacgcgaaataaaataanccgaaccgaccgaatacctcaaatacgaaacctaaaacgaaacgctaaccgaaaacgtaaccttcgacaaaaacaaacgcgaatacgtcctaataaaccaaaaaaaacgcaaacgtaaacaaaatacaccaaccgcgcaaaaacccccgcgaaaacgcgcgaacgaacctaaaaaccccgcgcccgccgaccacctcgatccccgctcgaccgcgcgccccaaccgcnaaaaccgcaaccaccaccganccaaaacaaatccntnccgaatacttcgaatacgacaaaatcttccgcacctatcatcaaataatactacactcacgcgtacatcgccgcgcgcgccgcgaaaaaaacaataacgaaaacaaaacgacgcgaacccgctacgaatcactcaataaaaataactcgacctcccaacccaacaaccctaactccgcctataccgctactaactccccgaact

SEQ ID NO: 9257 - DNA, 885 bp, Artificial Sequence
  chemically treated genomic DNA (Homo sapiens) CpG-island No: 9257
  misc_feature (30)..(30): n is either a, c, g or t
  misc_feature (68)..(68): n is either a, c, g or t
  misc_feature (114)..(114): n is either a, c, g or t
  misc_feature (355)..(355): n is either a, c, g or t
  misc_feature (483)..(483): n is either a, c, g or t
  misc_feature (502)..(502): n is either a, c, g or t
  misc_feature (697)..(697): n is either a, c, g or t
ggcggcgtcgttttagacgggcgacgtttntagtttcgcggatttggttcgggcgaggaatcgcggtncggtttttttttcgttttcgaatagcgttttttggggataatgggnttttttttttcgttttcgggaggagagatataaaggaagagaggagtcgtcgggcgcgaagttaggcgtcgggaaaagtgaaggtggaggagggagaaggaataagaggggattacggcgtacgtaggagttcgcgggttgttttttcggtcgtttcgggcgtcgttcgagttgtattacggcggtaaaggcgggagtacggattagcggttttttagattttcggtcgagaagggaaganggagtttgtatataaagacgagcgggatttttatttttcgttagcgtcggatcgaggacggcggagcgcgtttttatcgtcgagggttcgcggcgttcgtttaattcgcgttttttaggggtcggggnttcgtgcgggggcgttttnttttttcgatttatttatagtttcgtgttttagtttatggcgggaattttttggtcgtttggcggtgtcgttgttttttagtttgtcggttttatagtttgttcgattttttattcgttggtcggcgggttagtagtttagcgggtttatttcgaaaggtgtcgttatcgtcgggttttttagtgagtgagaaangacgcgattggagaagttttcgtcgtcgacgcgttttcgttttttcgcgttgggcgggagggggtcggggtcgaggggaggcggaacgcggcgcggggagggggcggggcgtagtgtattttgggatcggggaggatttgggttagtttggttatcgtcggcggggtttttaagcgggtatttggtta

SEQ ID NO: 9258 - DNA, 885 bp, Artificial Sequence
  chemically treated genomic DNA (Homo sapiens) CpG-island No: 9258
  misc_feature (189)..(189): n is either a, c, g or t
  misc_feature (384)..(384): n is either a, c, g or t
  misc_feature (403)..(403): n is either a, c, g or t
  misc_feature (531)..(531): n is either a, c, g or t
  misc_feature (772)..(772): n is either a, c, g or t
  misc_feature (818)..(818): n is either a, c, g or t
  misc_feature (856)..(856): n is either a, c, g or t
taaccaaatacccgcttaaaaaccccgccgacgataaccaaactaacccaaatcctccccgatcccaaaatacactacgccccgccccctccccgcgccgcgttccgcctcccctcgaccccgaccccctcccgcccaacgcgaaaaaacgaaaacgcgtcgacgacgaaaacttctccaatcgcgtcntttctcactcactaaaaaacccgacgataacgacacctttcgaaataaacccgctaaactactaacccgccgaccaacgaataaaaaatcgaacaaactataaaaccgacaaactaaaaaacaacgacaccgccaaacgaccaaaaaattcccgccataaactaaaacacgaaactataaataaatcgaaaaaanaaaacgcccccgcacgaanccccgacccctaaaaaacgcgaattaaacgaacgccgcgaaccctcgacgataaaaacgcgctccgccgtcctcgatccgacgctaacgaaaaataaaaatcccgctcgtctttatatacaaactccntcttcccttctcgaccgaaaatctaaaaaaccgctaatccgtactcccgcctttaccgccgtaatacaactcgaacgacgcccgaaacgaccgaaaaaacaacccgcgaactcctacgtacgccgtaatcccctcttattccttctccctcctccaccttcacttttcccgacgcctaacttcgcgcccgacgactcctctcttcctttatatctctcctcccgaaaacgaaaaaaaaaancccattatccccaaaaaacgctattcgaaaacgaaaaaaaaaccgnaccgcgattcctcgcccgaaccaaatccgcgaaactanaaacgtcgcccgtctaaaacgacgccgcc

SEQ ID NO: 9259 - DNA, 885 bp, Artificial Sequence
  chemically treated genomic DNA (Homo sapiens) CpG-island No: 9259
  misc_feature (189)..(189): n is either a, c, g or t
  misc_feature (384)..(384): n is either a, c, g or t
  misc_feature (403)..(403): n is either a, c, g or t
  misc_feature (531)..(531): n is either a, c, g or t
  misc_feature (772)..(772): n is either a, c, g or t
  misc_feature (818)..(818): n is either a, c, g or t
  misc_feature (856)..(856): n is either a, c, g or t
tgattaggtgttcgtttggggatttcgtcggcggtggttaggttagtttaggtttttttcgattttaggatgtattgcgtttcgtttttttttcgcgtcgcgtttcgttttttttcggtttcggttttttttcgtttagcgcggggaggcggggacgcgtcggcggcggaggtttttttagtcgcgttnttttttatttattggggagttcggcggtggcggtatttttcgaggtagattcgttgagttgttagttcgtcggttagcgagtgagaggtcggatagattgtggagtcgatagattgaaggatagcggtatcgttagacggttagaaagttttcgttatgagttggggtacggagttgtgggtgagtcggggaganggggcgttttcgtacggantttcggtttttgagaagcgcgggttgggcgggcgtcgcggattttcggcggtgaaagcgcgtttcgtcgttttcggttcggcgttggcggagggtgagggtttcgttcgtttttgtgtgtagattttntttttttttttcggtcgggggtttagggggtcgttagttcgtgttttcgtttttgtcgtcgtggtgtagttcgggcggcgttcgggacggtcgggggagtagttcgcgggtttttgcgtgcgtcgtgatttttttttgtttttttttttttttttatttttatttttttcgacgtttggtttcgcgttcggcggtttttttttttttttgtattttttttttcggaggcgggggagggggntttattgtttttaaggggcgttgttcgagggcggggaggggatcgngtcgcgatttttcgttcgggttaggttcgcggggttangggcgtcgttcgtttggggcggcgtcgtt

SEQ ID NO: 9260 - DNA, 885 bp, Artificial Sequence
  chemically treated genomic DNA (Homo sapiens) CpG-island No: 9260
  misc_feature (30)..(30): n is either a, c, g or t
  misc_feature (68)..(68): n is either a, c, g or t
  misc_feature (114)..(114): n is either a, c, g or t
  misc_feature (355)..(355): n is either a, c, g or t
  misc_feature (483)..(483): n is either a, c, g or t
  misc_feature (502)..(502): n is either a, c, g or t
  misc_feature (697)..(697): n is either a, c, g or t
aacgacgccgccccaaacgaacgacgcccntaaccccgcgaacctaacccgaacgaaaaatcgcgacncgatcccctccccgccctcgaacaacgccccttaaaaacaataaanccccctcccccgcctccgaaaaaaaaaatacaaaaaaaaaaaaaaaccgccgaacgcgaaaccaaacgtcgaaaaaaataaaaataaaaaaaaaaaaaaaaacaaaaaaaaatcacgacgcacgcaaaaacccgcgaactactcccccgaccgtcccgaacgccgcccgaactacaccacgacgacaaaaacgaaaacacgaactaacgaccccctaaacccccgaccgaaaaaaaaaaanaaaatctacacacaaaaacgaacgaaaccctcaccctccgccaacgccgaaccgaaaacgacgaaacgcgctttcaccgccgaaaatccgcgacgcccgcccaacccgcgcttctcaaaaaccgaaantccgtacgaaaacgccccntctccccgactcacccacaactccgtaccccaactcataacgaaaactttctaaccgtctaacgataccgctatccttcaatctatcgactccacaatctatccgacctctcactcgctaaccgacgaactaacaactcaacgaatctacctcgaaaaataccgccaccgccgaactccccaataaataaaaaanaacgcgactaaaaaaacctccgccgccgacgcgtccccgcctccccgcgctaaacgaaaaaaaaccgaaaccgaaaaaaaacgaaacgcgacgcgaaaaaaaaacgaaacgcaatacatcctaaaatcgaaaaaaacctaaactaacctaaccaccgccgacgaaatccccaaacgaacacctaatca

SEQ ID NO: 9261 - DNA, 673 bp, Artificial Sequence
  chemically treated genomic DNA (Homo sapiens) CpG-island No: 9261
  misc_feature (218)..(218): n is either a, c, g or t
  misc_feature (268)..(268): n is either a, c, g or t
  misc_feature (317)..(317): n is either a, c, g or t
  misc_feature (335)..(335): n is either a, c, g or t
  misc_feature (346)..(346): n is either a, c, g or t
  misc_feature (461)..(461): n is either a, c, g or t
  misc_feature (475)..(475): n is either a, c, g or t
  misc_feature (508)..(508): n is either a, c, g or t
atggtttcgatttcgttagcgttagagtcgttttgtatgaggtaggatgtggtgggcgtatagtagggacgaggcggggggtacggggtagaaaggagagggcgacgggaagaaggtagagaaaatttaaaaggttcggaaggttgggagggaggtagggtataggttggaaatcgcggttatttgtagcgtcgttttcgggttgcggttaggttggncgttggtagttttggcggtcgagttcgtcgtttttttcggtgttttcggnttattcgggtacggttttggtcggtgcgtttagtttcgttcggtttttngcggtttcggcggcgggntgggttgcggncgttgtcgttagaggagggattcggtcgattcggggtgggttggggtagggtcgtgcgtaagtcggggtgcgattttcggcggggtatgtcgcggcggtggcgttttcgcgggangtcgggtcgggggncgggtcgcggtcgcggcgaggtttttagggcgntcgggtgggcgtaggattgttaaacgttgcggtttggttaagattgcggagtcgagaagagaaagggcgtaggagggagggatttaaaataaaattaaaaggaggggggaagtagagggaaacgtgagatgagggcggatgagggtaggaagttgatattttttg

SEQ ID NO: 9262 - DNA, 673 bp, Artificial Sequence
  chemically treated genomic DNA (Homo sapiens) CpG-island No: 9262
  misc_feature (166)..(166): n is either a, c, g or t
  misc_feature (199)..(199): n is either a, c, g or t
  misc_feature (213)..(213): n is either a, c, g or t
  misc_feature (328)..(328): n is either a, c, g or t
  misc_feature (339)..(339): n is either a, c, g or t
  misc_feature (357)..(357): n is either a, c, g or t
  misc_feature (406)..(406): n is either a, c, g or t
  misc_feature (456)..(456): n is either a, c, g or t
caaaaaatatcaacttcctaccctcatccgccctcatctcacgtttccctctacttcccccctccttttaattttattttaaatccctccctcctacgccctttctcttctcgactccgcaatcttaaccaaaccgcaacgtttaacaatcctacgcccacccgancgccctaaaaacctcgccgcgaccgcgacccgncccccgacccgacntcccgcgaaaacgccaccgccgcgacataccccgccgaaaatcgcaccccgacttacgcacgaccctaccccaacccaccccgaatcgaccgaatccctcctctaacgacaacgnccgcaacccancccgccgccgaaaccgcnaaaaaccgaacgaaactaaacgcaccgaccaaaaccgtacccgaataanccgaaaacaccgaaaaaaacgacgaactcgaccgccaaaactaccaacgnccaacctaaccgcaacccgaaaacgacgctacaaataaccgcgatttccaacctataccctacctccctcccaaccttccgaaccttttaaattttctctaccttcttcccgtcgccctctcctttctaccccgtaccccccgcctcgtccctactatacgcccaccacatcctacctcatacaaaacgactctaacgctaacgaaatcgaaaccat

SEQ ID NO: 9263 - DNA, 673 bp, Artificial Sequence
  chemically treated genomic DNA (Homo sapiens) CpG-island No: 9263
  misc_feature (166)..(166): n is either a, c, g or t
  misc_feature (199)..(199): n is either a, c, g or t
  misc_feature (213)..(213): n is either a, c, g or t
  misc_feature (328)..(328): n is either a, c, g or t
  misc_feature (339)..(339): n is either a, c, g or t
  misc_feature (357)..(357): n is either a, c, g or t
  misc_feature (406)..(406): n is either a, c, g or t
  misc_feature (456)..(456): n is either a, c, g or t
taggaaatgttagttttttgtttttattcgtttttattttacgtttttttttgttttttttttttttttagttttgttttaaattttttttttttgcgtttttttttttttcggtttcgtaattttagttaaatcgtagcgtttagtaattttgcgtttattcggncgttttgggagtttcgtcgcggtcgcgattcgnttttcggttcggtntttcgcgggggcgttatcgtcgcgatatatttcgtcgggggtcgtatttcgatttgcgtacggttttgttttagtttatttcggatcggtcgggttttttttttggcggtagcgntcgtagtttanttcgtcgtcggggtcgtnggggatcgggcggagttggacgtatcggttagggtcgtgttcgggtggntcgagggtatcgggaggggcggcgggttcggtcgttaggattgttagcgnttagtttgatcgtagttcgagggcgacgttgtaaatagtcgcggtttttagtttgtgttttgttttttttttagtttttcggattttttgggttttttttgtttttttttcgtcgtttttttttttttgtttcgtgtttttcgtttcgtttttgttgtgcgtttattatattttgttttatgtaggacggttttggcgttgacgaggtcgggattat

SEQ ID NO: 9264 - DNA, 673 bp, Artificial Sequence
  chemically treated genomic DNA (Homo sapiens) CpG-island No: 9264
  misc_feature (218)..(218): n is either a, c, g or t
  misc_feature (268)..(268): n is either a, c, g or t
  misc_feature (317)..(317): n is either a, c, g or t
  misc_feature (335)..(335): n is either a, c, g or t
  misc_feature (346)..(346): n is either a, c, g or t
  misc_feature (461)..(461): n is either a, c, g or t
  misc_feature (475)..(475): n is either a, c, g or t
  misc_feature (508)..(508): n is either a, c, g or t
ataatcccgacctcgtcaacgccaaaaccgtcctacataaaacaaaatataataaacgcacaacaaaaacgaaacgaaaaacacgaaacaaaaaaaaaaaaacgacgaaaaaaaaacaaaaaaaacccaaaaaatccgaaaaactaaaaaaaaaacaaaacacaaactaaaaaccgcgactatttacaacgtcgccctcgaactacgatcaaactaancgctaacaatcctaacgaccgaacccgccgcccctcccgataccctcganccacccgaacacgaccctaaccgatacgtccaactccgcccgatccccnacgaccccgacgacgaantaaactacgancgctaccgccaaaaaaaaaacccgaccgatccgaaataaactaaaacaaaaccgtacgcaaatcgaaatacgacccccgacgaaatatatcgcgacgataacgcccccgcgaaanaccgaaccgaaaancgaatcgcgaccgcgacgaaactcccaaaacgnccgaataaacgcaaaattactaaacgctacgatttaactaaaattacgaaaccgaaaaaaaaaaaaacgcaaaaaaaaaaaatttaaaacaaaactaaaaaaaaaaaaaaaacaaaaaaaaacgtaaaataaaaacgaataaaaacaaaaaactaacatttccta

SEQ ID NO: 9265 - DNA, 587 bp, Artificial Sequence
  chemically treated genomic DNA (Homo sapiens) CpG-island No: 9265
  misc_feature (21)..(21): n is either a, c, g or t
  misc_feature (391)..(391): n is either a, c, g or t
ttgtgtgcgttagtgtacgtnattgttttcgatgttgtcgttagaggaattttttaatttttattatttttattttcggtttttattttgtattcggcgatgaagacgtcggcgaaacgtttattttttatgtttaggtttgggaaggtttgaagatttcggcggagttgttttcgttcggggtcgggtaaattcgttgtagtcgggttggttttagggtttttcgtcggttcgttatgttttttcggggcgttttggtaggttagtcggcggtttgttagtttagtttttggtgcgggcgtttcgttttggtttatcgggttcggggttgggatatcgagggaaaattttagagtttcgggttatcgagtttggaagttacgcgtttttntagtttacgcgtttttaatttcggggtattttttgtttttttatttagcgaagtttagcgtcgcgtgtttttttagcggcgtagtttgtttttaagatatttttaaaatcgttttattttttgttaatcgttttttttttttttttttttttgttttttttttttttttttcgtttttttatttcgtgttttaaga

SEQ ID NO: 9266 - DNA, 587 bp, Artificial Sequence
  chemically treated genomic DNA (Homo sapiens) CpG-island No: 9266
  misc_feature (197)..(197): n is either a, c, g or t
  misc_feature (567)..(567): n is either a, c, g or t
tcttaaaacacgaaataaaaaaacgaaaaaaaaaaaaaaaaaacaaaaaaaaaaaaaaaaaaaaaacgattaacaaaaaataaaacgattttaaaaatatcttaaaaacaaactacgccgctaaaaaaacacgcgacgctaaacttcgctaaataaaaaaacaaaaaataccccgaaattaaaaacgcgtaaactanaaaaacgcgtaacttccaaactcgataacccgaaactctaaaattttccctcgatatcccaaccccgaacccgataaaccaaaacgaaacgcccgcaccaaaaactaaactaacaaaccgccgactaacctaccaaaacgccccgaaaaaacataacgaaccgacgaaaaaccctaaaaccaacccgactacaacgaatttacccgaccccgaacgaaaacaactccgccgaaatcttcaaaccttcccaaacctaaacataaaaaataaacgtttcgccgacgtcttcatcgccgaatacaaaataaaaaccgaaaataaaaataataaaaattaaaaaattcctctaacgacaacatcgaaaacaatnacgtacactaacgcacacaa

SEQ ID NO: 9267 - DNA, 587 bp, Artificial Sequence
  chemically treated genomic DNA (Homo sapiens) CpG-island No: 9267
  misc_feature (197)..(197): n is either a, c, g or t
  misc_feature (567)..(567): n is either a, c, g or t
ttttgggatacggggtggggggacggaggaagagagagagagatagagagagagagagagagaaaacggttaataaaaaatgaggcggttttgagggtgttttggaggtaggttgcgtcgttggggagatacgcgacgttgaatttcgttggatgagggagtaggaaatatttcgggattggggacgcgtgggttgnggggacgcgtaatttttaggttcggtggttcggagttttgaagttttttttcggtgttttagtttcggattcggtggattaaaacgaggcgttcgtattaggagttggattgatagatcgtcggttggtttgttagggcgtttcggggaaatatagcgagtcggcgagaggttttgaggttaattcggttgtaacgaatttgttcggtttcgaacgaaggtagtttcgtcgggatttttagatttttttagatttaggtatggaaagtaggcgtttcgtcgacgtttttatcgtcgggtgtagggtgaaagtcggaggtgggagtagtgggagttggaaggtttttttagcggtaatatcgaagataatngcgtgtattagcgtatataa

SEQ ID NO: 9268 - DNA, 587 bp, Artificial Sequence
  chemically treated genomic DNA (Homo sapiens) CpG-island No: 9268
  misc_feature (21)..(21): n is either a, c, g or t
  misc_feature (391)..(391): n is either a, c, g or t
ttatatacgctaatacacgcnattatcttcgatattaccgctaaaaaaaccttccaactcccactactcccacctccgactttcaccctacacccgacgataaaaacgtcgacgaaacgcctactttccatacctaaatctaaaaaaatctaaaaatcccgacgaaactaccttcgttcgaaaccgaacaaattcgttacaaccgaattaacctcaaaacctctcgccgactcgctatatttccccgaaacgccctaacaaaccaaccgacgatctatcaatccaactcctaatacgaacgcctcgttttaatccaccgaatccgaaactaaaacaccgaaaaaaaacttcaaaactccgaaccaccgaacctaaaaattacgcgtccccncaacccacgcgtccccaatcccgaaatatttcctactccctcatccaacgaaattcaacgtcgcgtatctccccaacgacgcaacctacctccaaaacaccctcaaaaccgcctcattttttattaaccgttttctctctctctctctctctatctctctctctcttcctccgtccccccaccccgtatcccaaaa

SEQ ID NO: 9269 - DNA, 766 bp, Artificial Sequence
  chemically treated genomic DNA (Homo sapiens) CpG-island No: 9269
  misc_feature (146)..(146): n is either a, c, g or t
  misc_feature (195)..(195): n is either a, c, g or t
  misc_feature (320)..(320): n is either a, c, g or t
  misc_feature (540)..(540): n is either a, c, g or t
cggttagtagtcgggcggcgaggagtttcgaggttgggaggcgagtcgggaaggcgtcgtgagcgaagtcgaggcggttttggcgtaggcggcggttggcgtcggggatagtgttgcggcggtcgggcgcggagttgggagcgttngcgttgtgggtcgcggttagttttggttttggggtcgcggttttttttntgggtcgcgggtagcggagcgcgcggtcgggaatttcgcggcgagtcggtgggcggaagcgaggggcgttcggcggggttttggagggtcgtaggagtcgtaggtcgaggttgaatcgttttttnttttcgttcggtgcgtttttcgtagtgtcggtgaaggaggagtcggaagtagaggtgcgtatggtgaatgggaagtttaagaaggttcgaaagtcgcgtacgatttattttagttattagttggtcgttttgtagcgtcgtttttagaaggtttagtatttggcgttgttcgagcgcgtcgagttggtcgcgtagttgggttttacgtagatataggttnggtgtttggttgtttagggtcgcgggggcgcgcgggatttcgtagtttttcgcgcgttgtcgagtttggttggttattgaagggttttgcgggtttttggaattttcgtcgttacgatgggggtttgcgaaggggaatttcggtgggaagaatttgcgttagtacgtgtataagtgagtatagtggtttattcgtgtaattgtgtatgtttttttattttagaatt

SEQ ID NO: 9270 - DNA, 766 bp, Artificial Sequence
  chemically treated genomic DNA (Homo sapiens) CpG-island No: 9270
  misc_feature (227)..(227): n is either a, c, g or t
  misc_feature (447)..(447): n is either a, c, g or t
  misc_feature (572)..(572): n is either a, c, g or t
  misc_feature (621)..(621): n is either a, c, g or t
aattctaaaataaaaaaacatacacaattacacgaataaaccactatactcacttatacacgtactaacgcaaattcttcccaccgaaattccccttcgcaaacccccatcgtaacgacgaaaattccaaaaacccgcaaaacccttcaataaccaaccaaactcgacaacgcgcgaaaaactacgaaatcccgcgcgcccccgcgaccctaaacaaccaaacaccnaacctatatctacgtaaaacccaactacgcgaccaactcgacgcgctcgaacaacgccaaatactaaaccttctaaaaacgacgctacaaaacgaccaactaataactaaaataaatcgtacgcgactttcgaaccttcttaaacttcccattcaccatacgcacctctacttccgactcctccttcaccgacactacgaaaaacgcaccgaacgaaaanaaaaaacgattcaacctcgacctacgactcctacgaccctccaaaaccccgccgaacgcccctcgcttccgcccaccgactcgccgcgaaattcccgaccgcgcgctccgctacccgcgacccanaaaaaaaaccgcgaccccaaaaccaaaactaaccgcgacccacaacgcnaacgctcccaactccgcgcccgaccgccgcaacactatccccgacgccaaccgccgcctacgccaaaaccgcctcgacttcgctcacgacgccttcccgactcgcctcccaacctcgaaactcctcgccgcccgactactaaccg

SEQ ID NO: 9271 - DNA, 766 bp, Artificial Sequence
  chemically treated genomic DNA (Homo sapiens) CpG-island No: 9271
  misc_feature (227)..(227): n is either a, c, g or t
  misc_feature (447)..(447): n is either a, c, g or t
  misc_feature (572)..(572): n is either a, c, g or t
  misc_feature (621)..(621): n is either a, c, g or t
aattttggagtaggggaatatatatagttgtacgggtggattattatgtttatttgtatacgtgttaacgtagattttttttatcgaggttttttttcgtaggtttttatcgtaacggcgagagttttaggagttcgtagggttttttagtggttagttaggttcggtagcgcgcggggaattacggggtttcgcgcgttttcgcggttttggatagttaaatattnaatttgtgtttgcgtgaggtttagttgcgcggttagttcggcgcgttcgggtagcgttaggtattgggttttttggaagcggcgttgtagggcggttagttggtagttggagtagatcgtacgcggttttcggatttttttgggttttttatttattatgcgtatttttgttttcggttttttttttatcgatattgcggggaacgtatcgggcggaagnagggggcggtttagtttcggtttgcgatttttgcgattttttagggtttcgtcggacgtttttcgttttcgtttatcgattcgtcgcgggattttcggtcgcgcgtttcgttgttcgcggtttanggggggagtcgcggttttagagttagaattggtcgcggtttataacgtnggcgtttttagtttcgcgttcggtcgtcgtagtattgttttcggcgttagtcgtcgtttgcgttaggatcgtttcggtttcgtttacgacgttttttcggttcgttttttagtttcggggtttttcgtcgttcggttgttagtcg

SEQ ID NO: 9272 - DNA, 766 bp, Artificial Sequence
  chemically treated genomic DNA (Homo sapiens) CpG-island No: 9272
  misc_feature (146)..(146): n is either a, c, g or t
  misc_feature (195)..(195): n is either a, c, g or t
  misc_feature (320)..(320): n is either a, c, g or t
  misc_feature (540)..(540): n is either a, c, g or t
cgactaacaaccgaacgacgaaaaaccccgaaactaaaaaacgaaccgaaaaaacgtcgtaaacgaaaccgaaacgatcctaacgcaaacgacgactaacgccgaaaacaatactacgacgaccgaacgcgaaactaaaaacgccnacgttataaaccgcgaccaattctaactctaaaaccgcgactccccccntaaaccgcgaacaacgaaacgcgcgaccgaaaatcccgcgacgaatcgataaacgaaaacgaaaaacgtccgacgaaaccctaaaaaatcgcaaaaatcgcaaaccgaaactaaaccgccccctncttccgcccgatacgttccccgcaatatcgataaaaaaaaaaccgaaaacaaaaatacgcataataaataaaaaacccaaaaaaatccgaaaaccgcgtacgatctactccaactaccaactaaccgccctacaacgccgcttccaaaaaacccaatacctaacgctacccgaacgcgccgaactaaccgcgcaactaaacctcacgcaaacacaaattnaatatttaactatccaaaaccgcgaaaacgcgcgaaaccccgtaattccccgcgcgctaccgaacctaactaaccactaaaaaaccctacgaactcctaaaactctcgccgttacgataaaaacctacgaaaaaaaacctcgataaaaaaaatctacgttaacacgtatacaaataaacataataatccacccgtacaactatatatattcccctactccaaaatt

SEQ ID NO: 9273 - DNA, 1195 bp, Artificial Sequence
  chemically treated genomic DNA (Homo sapiens) CpG-island No: 9273
gtcgcggcggtagtaggtagttcgggagtttcggcggcggtcgagttagcggcggtttcgttttttgttttttgtaaattttgcgagtagttcgttcggggggtcgggggcgcgttcgggaggttcggttcggttcgcggtcgagtttttcgtcgtcgtagcgttagtcgtcgtagttattatcgtcgtagtttcgcgttttttcggggagtagtcggcggttttcgcggttttttagtttcggttttagggtattgttcggcgagtgtttcggtaagggtgggggttgtcgcggcgcggtcggtcgcgggttgtcggggggcggtcgtcgttatttagagaggcgcgtagaggcgtcgagagcgtttttcggcgggtttttcgcgtattcgtcgcgttcgggtagcggttcgatcgggcgagtatgggcggcgcggagtgacgtcgttgtgttcgtttggtattaaggatatttagttcgcgggggtggggacgaaggggggtagttcggcgtcgttatcgtagttttcgagagtcgtcgtcgttgttcgggtttcggggttgggtggaggaaaggggtgttcggaatcgatttttatttttcgatttttttgttggatattacgtttattttggacgtcgtaagagaagttgttaagtttcgtaggttttgattcggcgtttttcgcgtttttcggttgttttcggtttttttgtgtttcggtggagtatttgcgttcggggttggggttggaggaggtagttatacgcgcgtatacgtatacgtttagaggagggcgagaggtagcggtataggttttatttgtagtgttaatgcggcgttttcgttgaaggagggaaacgcggcgcgtttaggtaaggagtcggttcgtcggggagtggggtcgggcgggcggcgagggtagtaaggtcggatagatttgggttcgattcgggagtttttagtgtttcggagttagttcgcggtatacgtatacgtatatacgtaggtatatatatagatttatatcggtatatacggcgttcgcgtatttgtttacgttttatttggacgttcgcggaggtgtagcggtcggagtagggatttttcgggtgtgttttttttttacgtttttggatttagatttttttttttcgggattttcggggtgggattttgtgtattttcggtttt

SEQ ID NO: 9274 - DNA, 1195 bp, Artificial Sequence
  chemically treated genomic DNA (Homo sapiens) CpG-island No: 9274
aaaaccgaaaatacacaaaatcccaccccgaaaatcccgaaaaaaaaaaatctaaatccaaaaacgtaaaaaaaaaacacacccgaaaaatccctactccgaccgctacacctccgcgaacgtccaaataaaacgtaaacaaatacgcgaacgccgtatataccgatataaatctatatatatacctacgtatatacgtatacgtataccgcgaactaactccgaaacactaaaaactcccgaatcgaacccaaatctatccgaccttactaccctcgccgcccgcccgaccccactccccgacgaaccgactccttacctaaacgcgccgcgtttccctccttcaacgaaaacgccgcattaacactacaaataaaacctataccgctacctctcgccctcctctaaacgtatacgtatacgcgcgtataactacctcctccaaccccaaccccgaacgcaaatactccaccgaaacacaaaaaaaccgaaaacaaccgaaaaacgcgaaaaacgccgaatcaaaacctacgaaacttaacaacttctcttacgacgtccaaaataaacgtaatatccaacaaaaaaatcgaaaaataaaaatcgattccgaacacccctttcctccacccaaccccgaaacccgaacaacgacgacgactctcgaaaactacgataacgacgccgaactaccccccttcgtccccacccccgcgaactaaatatccttaataccaaacgaacacaacgacgtcactccgcgccgcccatactcgcccgatcgaaccgctacccgaacgcgacgaatacgcgaaaaacccgccgaaaaacgctctcgacgcctctacgcgcctctctaaataacgacgaccgccccccgacaacccgcgaccgaccgcgccgcgacaacccccacccttaccgaaacactcgccgaacaataccctaaaaccgaaactaaaaaaccgcgaaaaccgccgactactccccgaaaaaacgcgaaactacgacgataataactacgacgactaacgctacgacgacgaaaaactcgaccgcgaaccgaaccgaacctcccgaacgcgcccccgaccccccgaacgaactactcgcaaaatttacaaaaaacaaaaaacgaaaccgccgctaactcgaccgccgccgaaactcccgaactacctactaccgccgcgac

SEQ ID NO: 9275 - DNA, 1195 bp, Artificial Sequence
  chemically treated genomic DNA (Homo sapiens) CpG-island No: 9275
agagtcgggaatatatagaattttatttcgaaagtttcgggaaagagaagtttgagtttaggagcgtgagaggagaatatattcgggaaatttttgtttcggtcgttgtattttcgcgggcgtttaggtgggacgtgggtaggtgcgcgagcgtcgtgtgtgtcggtgtggatttgtgtgtgtgtttgcgtgtgtgcgtgtgcgtgtgtcgcgggttggtttcgggatattgaggattttcgggtcgggtttaggtttgttcgattttgttgttttcgtcgttcgttcggttttatttttcggcgggtcggttttttatttggacgcgtcgcgttttttttttttagcgggagcgtcgtattgatattgtagatggagtttatgtcgttgtttttcgtttttttttgaacgtgtgcgtgtgcgcgcgtgtggttgttttttttagttttagtttcgaacgtaaatattttatcgaggtatagggaagtcgggagtagtcgaggaacgcggagggcgtcgaattagagtttgcggggtttgatagttttttttgcggcgtttaaggtgggcgtaatgtttaataaaaaggtcggaaaatggggatcgatttcgaatattttttttttttatttagtttcggagttcgagtagcggcggcggttttcgggggttgcggtggcgacgtcgggttgttttttttcgtttttattttcgcgggttgaatgtttttgatgttaagcgggtatagcggcgttatttcgcgtcgtttatgttcgttcggtcgggtcgttgttcgggcgcggcgagtgcgcgggggattcgtcggggagcgttttcggcgtttttgcgcgtttttttgggtagcggcggtcgtttttcggtagttcgcggtcggtcgcgtcgcggtagtttttatttttgtcgagatattcgtcgggtagtgttttggggtcggggttggggggtcgcgggagtcgtcggttgtttttcggggaggcgcggggttgcggcggtggtggttgcggcggttggcgttgcggcggcggagagttcggtcgcgggtcgagtcgggtttttcgggcgcgttttcggtttttcgggcgggttgttcgtaaagtttgtagggggtagggagcggggtcgtcgttggttcggtcgtcgtcggagttttcgggttgtttgttgtcgtcgcggt

SEQ ID NO: 9276 - DNA, 1195 bp, Artificial Sequence
  chemically treated genomic DNA (Homo sapiens) CpG-island No: 9276
accgcgacgacaacaaacaacccgaaaactccgacgacgaccgaaccaacgacgaccccgctccctaccccctacaaactttacgaacaacccgcccgaaaaaccgaaaacgcgcccgaaaaacccgactcgacccgcgaccgaactctccgccgccgcaacgccaaccgccgcaaccaccaccgccgcaaccccgcgcctccccgaaaaacaaccgacgactcccgcgaccccccaaccccgaccccaaaacactacccgacgaatatctcgacaaaaataaaaactaccgcgacgcgaccgaccgcgaactaccgaaaaacgaccgccgctacccaaaaaaacgcgcaaaaacgccgaaaacgctccccgacgaatcccccgcgcactcgccgcgcccgaacaacgacccgaccgaacgaacataaacgacgcgaaataacgccgctatacccgcttaacatcaaaaacattcaacccgcgaaaataaaaacgaaaaaaaacaacccgacgtcgccaccgcaacccccgaaaaccgccgccgctactcgaactccgaaactaaataaaaaaaaaaaatattcgaaatcgatccccattttccgacctttttattaaacattacgcccaccttaaacgccgcaaaaaaaactatcaaaccccgcaaactctaattcgacgccctccgcgttcctcgactactcccgacttccctatacctcgataaaatatttacgttcgaaactaaaactaaaaaaaacaaccacacgcgcgcacacgcacacgttcaaaaaaaaacgaaaaacaacgacataaactccatctacaatatcaatacgacgctcccgctaaaaaaaaaaaacgcgacgcgtccaaataaaaaaccgacccgccgaaaaataaaaccgaacgaacgacgaaaacaacaaaatcgaacaaacctaaacccgacccgaaaatcctcaatatcccgaaaccaacccgcgacacacgcacacgcacacacgcaaacacacacacaaatccacaccgacacacacgacgctcgcgcacctacccacgtcccacctaaacgcccgcgaaaatacaacgaccgaaacaaaaatttcccgaatatattctcctctcacgctcctaaactcaaacttctctttcccgaaactttcgaaataaaattctatatattcccgactct

SEQ ID NO: 9277 - DNA, 657 bp, Artificial Sequence
  chemically treated genomic DNA (Homo sapiens) CpG-island No: 9277
  misc_feature (334)..(334): n is either a, c, g or t
  misc_feature (451)..(451): n is either a, c, g or t
  misc_feature (454)..(454): n is either a, c, g or t
  misc_feature (460)..(461): n is either a, c, g or t
  misc_feature (472)..(472): n is either a, c, g or t
  misc_feature (493)..(493): n is either a, c, g or t
  misc_feature (535)..(535): n is either a, c, g or t
cggttgatcgaggcgtcgggttttgcggcggtcgcgttcgtttaaagtaggcgataagtgaggtagcgtttttcgcggggagttcggcgcgcgtttcggcggcgaaagagaaagagaaagagtttgggtcgggatcggggttatttttaatcgttatcgtttttatcggttcggttttcgtcgcgggagtcgtgtaggtttttttatttgttcggggatggggttatttcgcgcggcggcggtcgtgggtatttacgcgggttcgcgattattttacgcgggcggcggcgttttttttatttttagcggagcggcgtttgttcgtaacgtcgantcgagttataggcggggggcgagtcggagcgcgaggtttcgttagtttaggttgcggcgtcgttgtttcgcggtgttcggcgggaggggcgcgagggtgtacgcgcggggtgggggncgncggganngtcgttttttngttcgtttcgcgcgtatgttnttcgtcgtatttgtttcgtttagtgttttatatttcggggangtcgggtggcgttgggttcgtcgaggtcggggtttttttatgggagggaggtggttgcggcggaatttttagatgcgtttttttttgtattcgttttttgggaaggatttttttaaattttg

SEQ ID NO: 9278 - DNA, 657 bp, Artificial Sequence
  chemically treated genomic DNA (Homo sapiens) CpG-island No: 9278
  misc_feature (123)..(123): n is either a, c, g or t
  misc_feature (165)..(165): n is either a, c, g or t
  misc_feature (186)..(186): n is either a, c, g or t
  misc_feature (197)..(198): n is either a, c, g or t
  misc_feature (204)..(204): n is either a, c, g or t
  misc_feature (207)..(207): n is either a, c, g or t
  misc_feature (324)..(324): n is either a, c, g or t
caaaatttaaaaaaatccttcccaaaaaacgaatacaaaaaaaaacgcatctaaaaattccgccgcaaccacctccctcccataaaaaaaccccgacctcgacgaacccaacgccacccgacntccccgaaatataaaacactaaacgaaacaaatacgacgaanaacatacgcgcgaaacgaacnaaaaaacgacnntcccgncgncccccaccccgcgcgtacaccctcgcgcccctcccgccgaacaccgcgaaacaacgacgccgcaacctaaactaacgaaacctcgcgctccgactcgccccccgcctataactcgantcgacgttacgaacaaacgccgctccgctaaaaataaaaaaaacgccgccgcccgcgtaaaataatcgcgaacccgcgtaaatacccacgaccgccgccgcgcgaaataaccccatccccgaacaaataaaaaaacctacacgactcccgcgacgaaaaccgaaccgataaaaacgataacgattaaaaataaccccgatcccgacccaaactctttctctttctctttcgccgccgaaacgcgcgccgaactccccgcgaaaaacgctacctcacttatcgcctactttaaacgaacgcgaccgccgcaaaacccgacgcctcgatcaaccg

SEQ ID NO: 9279 - DNA, 657 bp, Artificial Sequence
  chemically treated genomic DNA (Homo sapiens) CpG-island No: 9279
  misc_feature (123)..(123): n is either a, c, g or t
  misc_feature (165)..(165): n is either a, c, g or t
  misc_feature (186)..(186): n is either a, c, g or t
  misc_feature (197)..(198): n is either a, c, g or t
  misc_feature (204)..(204): n is either a, c, g or t
  misc_feature (207)..(207): n is either a, c, g or t
  misc_feature (324)..(324): n is either a, c, g or t
taagatttgggggaattttttttagggaacgaatatagagaaggacgtatttgaaaatttcgtcgtagttattttttttttatgggaaagtttcgatttcggcgggtttagcgttattcggtnttttcggggtgtggaatattgagcgaggtaggtgcggcgggnagtatgcgcgcggggcgggtnagggggcggtnntttcgncgntttttatttcgcgcgtgtattttcgcgtttttttcgtcgggtatcgcggggtagcggcgtcgtagtttgggttggcggaatttcgcgtttcgattcgtttttcgtttgtagttcggntcggcgttgcgggtaggcgtcgtttcgttgggggtaagaaggacgtcgtcgttcgcgtgggatggtcgcgagttcgcgtgggtgtttacggtcgtcgtcgcgcggggtggttttattttcgggtaggtagaggggtttgtacgattttcgcggcgagggtcgggtcggtgggggcggtggcggttggggatagtttcggtttcggtttaggttttttttttttttttttcgtcgtcggggcgcgcgtcgggtttttcgcgagaggcgttgttttatttgtcgtttattttggacgggcgcggtcgtcgtagagttcggcgtttcggttagtcg

SEQ ID NO: 9280 - DNA, 657 bp, Artificial Sequence
  chemically treated genomic DNA (Homo sapiens) CpG-island No: 9280
  misc_feature (334)..(334): n is either a, c, g or t
  misc_feature (451)..(451): n is either a, c, g or t
  misc_feature (454)..(454): n is either a, c, g or t
  misc_feature (460)..(461): n is either a, c, g or t
  misc_feature (472)..(472): n is either a, c, g or t
  misc_feature (493)..(493): n is either a, c, g or t
  misc_feature (535)..(535): n is either a, c, g or t
cgactaaccgaaacgccgaactctacgacgaccgcgcccgtccaaaataaacgacaaataaaacaacgcctctcgcgaaaaacccgacgcgcgccccgacgacgaaaaaaaaaaaaaaaaaacctaaaccgaaaccgaaactatccccaaccgccaccgcccccaccgacccgaccctcgccgcgaaaatcgtacaaacccctctacctacccgaaaataaaaccaccccgcgcgacgacgaccgtaaacacccacgcgaactcgcgaccatcccacgcgaacgacgacgtccttcttacccccaacgaaacgacgcctacccgcaacgccganccgaactacaaacgaaaaacgaatcgaaacgcgaaattccgccaacccaaactacgacgccgctaccccgcgatacccgacgaaaaaaacgcgaaaatacacgcgcgaaataaaaancgncgaaannaccgccccctnacccgccccgcgcgcatactncccgccgcacctacctcgctcaatattccacaccccgaaaanaccgaataacgctaaacccgccgaaatcgaaactttcccataaaaaaaaaataactacgacgaaattttcaaatacgtccttctctatattcgttccctaaaaaaaattcccccaaatctta

SEQ ID NO: 9281 - DNA, 720 bp, Artificial Sequence
  chemically treated genomic DNA (Homo sapiens) CpG-island No: 9281
  misc_feature (386)..(386): n is either a, c, g or t
  misc_feature (470)..(470): n is either a, c, g or t
  misc_feature (473)..(473): n is either a, c, g or t
  misc_feature (545)..(545): n is either a, c, g or t
atttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggagtcgggttcgggttttgtcgtggatgtttcggtggtgtcgtggatggtgtcggntaaaatattcgaagcgttattcgcgtaggtaacggcgttgatgatttatttggacgagcgatttgatgttttttcgttggatgntgngtattcgttggcgttgatacggtcgtcgttggatgagcgagcgggggtgttggggtcggattcgtgaaacgntgttggcggtgtgaaagttttttttgtcggtatgaggtttttgggtggtgtcggatttgggcgtttgcgttcgatcgtttgtgttttcgttatggcgttattgtttggattggtcgatttttatcgtttttcgcggtattgttttttttataattgatcgtttgattttattgtt

SEQ ID NO: 9282 - DNA, 720 bp, Artificial Sequence
  chemically treated genomic DNA (Homo sapiens) CpG-island No: 9282
  misc_feature (176)..(176): n is either a, c, g or t
  misc_feature (248)..(248): n is either a, c, g or t
  misc_feature (251)..(251): n is either a, c, g or t
  misc_feature (335)..(335): n is either a, c, g or t
aacaataaaatcaaacgatcaattataaaaaaaacaataccgcgaaaaacgataaaaatcgaccaatccaaacaataacgccataacgaaaacacaaacgatcgaacgcaaacgcccaaatccgacaccacccaaaaacctcataccgacaaaaaaaactttcacaccgccaacancgtttcacgaatccgaccccaacacccccgctcgctcatccaacgacgaccgtatcaacgccaacgaatacncancatccaacgaaaaaacatcaaatcgctcgtccaaataaatcatcaacgccgttacctacgcgaataacgcttcgaatattttanccgacaccatccacgacaccaccgaaacatccacgacaaaacccgaacccgactccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaat

SEQ ID NO: 9283 - DNA, 720 bp, Artificial Sequence
  chemically treated genomic DNA (Homo sapiens) CpG-island No: 9283
  misc_feature (176)..(176): n is either a, c, g or t
  misc_feature (248)..(248): n is either a, c, g or t
  misc_feature (251)..(251): n is either a, c, g or t
  misc_feature (335)..(335): n is either a, c, g or t
ggtagtggaattaggcggttagttgtgaaaagagtagtatcgcgaaaagcggtaaagatcggttaatttaagtagtggcgttatggcgaaaatataagcgatcgggcgtaggcgtttagattcggtattatttagaagttttatgtcggtagaaagggtttttatatcgttaatancgttttacgggttcgattttagtattttcgttcgtttatttagcggcgatcgtgttaacgttagcgagtatntantatttagcgaggagatattaggtcgttcgtttagataggttattaacgtcgttgtttgcgcggatagcgtttcgggtgttttgntcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggt

SEQ ID NO: 9284 - DNA, 720 bp, Artificial Sequence
  chemically treated genomic DNA (Homo sapiens) CpG-island No: 9284
  misc_feature (386)..(386): n is either a, c, g or t
  misc_feature (470)..(470): n is either a, c, g or t
  misc_feature (473)..(473): n is either a, c, g or t
  misc_feature (545)..(545): n is either a, c, g or t
acctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgancaaaacacccgaaacgctatccgcgcaaacaacgacgttaataacctatctaaacgaacgacctaatatctcctcgctaaatantanatactcgctaacgttaacacgatcgccgctaaataaacgaacgaaaatactaaaatcgaacccgtaaaacgntattaacgatataaaaaccctttctaccgacataaaacttctaaataataccgaatctaaacgcctacgcccgatcgcttatattttcgccataacgccactacttaaattaaccgatctttaccgcttttcgcgatactactcttttcacaactaaccgcctaattccactacc

SEQ ID NO: 9285 - DNA, 625 bp, Artificial Sequence
  chemically treated genomic DNA (Homo sapiens) CpG-island No: 9285
  misc_feature (523)..(523): n is either a, c, g or t
tttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggcgtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggaggtgggtattcgttggcgttgatacggtcggcgttggatgagcgagcgtggtgttgngtcgatacggatacgtgtgtgcggggaaagcgtgttgcggtatgagttttggtgtgacgtttggggttgtttttatttttggttgtatattagttaatagcg

SEQ ID NO: 9286 - DNA, 625 bp, Artificial Sequence
  chemically treated genomic DNA (Homo sapiens) CpG-island No: 9286
  misc_feature (103)..(103): n is either a, c, g or t
cgctattaactaatatacaaccaaaaataaaaacaaccccaaacgtcacaccaaaactcataccgcaacacgctttccccgcacacacgtatccgtatcgacncaacaccacgctcgctcatccaacgccgaccgtatcaacgccaacgaatacccacctccaacgaaaaaacatcaaatcgctcgtccaaataaatcatcaacgccgttacctacgcgaataacgcttcgaatattttacccgacaccatccacgacaccaccgaaacatccacgacaaaacccgaacccgacgccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaa

SEQ ID NO: 9287 - DNA, 625 bp, Artificial Sequence
  chemically treated genomic DNA (Homo sapiens) CpG-island No: 9287
  misc_feature (103)..(103): n is either a, c, g or t
cgttattaattaatgtgtaattaaaaataggagtagttttaaacgttatattaaagtttatgtcgtaatacgtttttttcgtatatacgtattcgtgtcgatntagtattacgttcgtttatttagcgtcgatcgtgttaacgttagcgagtatttatttttagcgaggagatattaggtcgttcgtttagataggttattaacgtcgttgtttgcgcggatagcgtttcgggtgttttgttcgatattatttacggtattatcggaatatttacgatagaattcgaattcggcgtcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtagg

SEQ ID NO: 9288 - DNA, 625 bp, Artificial Sequence
  chemically treated genomic DNA (Homo sapiens) CpG-island No: 9288
  misc_feature (523)..(523): n is either a, c, g or t
cctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgacgccgaattcgaattctatcgtaaatattccgataataccgtaaataatatcgaacaaaacacccgaaacgctatccgcgcaaacaacgacgttaataacctatctaaacgaacgacctaatatctcctcgctaaaaataaatactcgctaacgttaacacgatcgacgctaaataaacgaacgtaatactanatcgacacgaatacgtatatacgaaaaaaacgtattacgacataaactttaatataacgtttaaaactactcctatttttaattacacattaattaataacg

SEQ ID NO: 9289 - DNA, 557 bp, Artificial Sequence
  chemically treated genomic DNA (Homo sapiens) CpG-island No: 9289
ggaggtggattgttcggcggggacggtttaattttttacggagaatacgttttggtttaggagtggtcgtgttcgtcgggtgggggtgtcgtcgttcgggattagtggtattaacgcgtacgttattttcgaataggcggcgggagtgtcgagttagtttgtcgcgtttcggttcgggtttttgttcgcgaatgttttcgggggtgtttcggggattggtgttcgggtaataaataattcgaaagtcgtttaatttcgcgggagggtatatcgggacgtttgtatgaatttatagttttgggatcgaagtcggaaacgtggatcgtttttttttatcgttggtgatggagtggggttaatttcggtttggtcgtttggattacggtttttattcgtttgatattgaagtcgaagtcgggtgggtgtttcgggagttcgttattcggtgaataacgtttgtttgtggtaggtgtagaaaattttttggttggtcgtatatgaagtttttttggttgggcgatcggattcgagggggtttggagttagaatcgtttttt

SEQ ID NO: 9290 - DNA, 557 bp, Artificial Sequence
  chemically treated genomic DNA (Homo sapiens) CpG-island No: 9290
aaaaaacgattctaactccaaaccccctcgaatccgatcgcccaaccaaaaaaacttcatatacgaccaaccaaaaaattttctacacctaccacaaacaaacgttattcaccgaataacgaactcccgaaacacccacccgacttcgacttcaatatcaaacgaataaaaaccgtaatccaaacgaccaaaccgaaattaaccccactccatcaccaacgataaaaaaaaacgatccacgtttccgacttcgatcccaaaactataaattcatacaaacgtcccgatataccctcccgcgaaattaaacgactttcgaattatttattacccgaacaccaatccccgaaacacccccgaaaacattcgcgaacaaaaacccgaaccgaaacgcgacaaactaactcgacactcccgccgcctattcgaaaataacgtacgcgttaataccactaatcccgaacgacgacacccccacccgacgaacacgaccactcctaaaccaaaacgtattctccgtaaaaaattaaaccgtccccgccgaacaatccacctcc

SEQ ID NO: 9291 - DNA, 557 bp, Artificial Sequence
  chemically treated genomic DNA (Homo sapiens) CpG-island No: 9291
aaagggcgattttggttttaggttttttcggattcggtcgtttaattaagaaagttttatgtacggttagttaaggggttttttatatttgttataaataaacgttatttatcgggtgacggattttcgaggtatttattcggtttcggttttaatattaagcggatggaaatcgtggtttaaacggttaagtcgaagttagttttattttattattagcggtaggaaggagcgatttacgttttcggtttcggttttaggattatgggtttatgtaaacgtttcggtatgttttttcgcggaattaggcggttttcgggttgtttattgttcgaatattaattttcggggtattttcgggaatattcgcgaataagagttcgaatcggagcgcggtaggttgattcggtattttcgtcgtttgttcgaggatgacgtgcgcgttagtattattgatttcgaacgacgatatttttattcgacgaatacgattatttttgggttagggcgtgtttttcgtaaggagttgaatcgttttcgtcgagtaatttattttt

SEQ ID NO: 9292 - DNA, 557 bp, Artificial Sequence
  chemically treated genomic DNA (Homo sapiens) CpG-island No: 9292
aaaaataaattactcgacgaaaacgattcaactccttacgaaaaacacgccctaacccaaaaataatcgtattcgtcgaataaaaatatcgtcgttcgaaatcaataatactaacgcgcacgtcatcctcgaacaaacgacgaaaataccgaatcaacctaccgcgctccgattcgaactcttattcgcgaatattcccgaaaataccccgaaaattaatattcgaacaataaacaacccgaaaaccgcctaattccgcgaaaaaacataccgaaacgtttacataaacccataatcctaaaaccgaaaccgaaaacgtaaatcgctccttcctaccgctaataataaaataaaactaacttcgacttaaccgtttaaaccacgatttccatccgcttaatattaaaaccgaaaccgaataaatacctcgaaaatccgtcacccgataaataacgtttatttataacaaatataaaaaaccccttaactaaccgtacataaaactttcttaattaaacgaccgaatccgaaaaaacctaaaaccaaaatcgcccttt

SEQ ID NO: 9293 - DNA, 727 bp, Artificial Sequence
  chemically treated genomic DNA (Homo sapiens) CpG-island No: 9293
  misc_feature (104)..(104): n is either a, c, g or t
attacgtttattttttagcgcgtatatttttaatatcgtcgacgtttttattatttttaaaatgtatatttgttttaatgcgtttattttcgttattattatancgtgattttttcgattttatttttgatttttcgttagttattttttattcggtacgttgtacgttttttcgttatcgcgttttttttttttatttttatcgcgtttttttttgttttttttttttattgttttttatttttaattatattcgtttgttttttcgattattttttttttttatttttattttatcgtattttttttttcgttttatattttattttaagttttttttatcgtcgttatttttttatttcgtttcgttttatttgttattttattcgtttttatcgtttttgttttaattttttttttaatatttcgtattttttcgcgtcgattttatttgttttagattaattttttattttttcgcgttttatttttattttttttattttgattataattgtttttcgtatttcgatcgcgtattatacggatttgttattttatttttttcgttattgtttttttacgtatatttattttttttttcgatttttttttttatattattttttattttgatttttatttattttttcgatatttaataattcggtttttatttttaattttattatcgtttcgtcgtatcgttcgttttttgcgttcgttt

SEQ ID NO: 9294 - DNA, 727 bp, Artificial Sequence
  chemically treated genomic DNA (Homo sapiens) CpG-island No: 9294
  misc_feature (624)..(624): n is either a, c, g or t
aaacgaacgcaaaaaacgaacgatacgacgaaacgataataaaattaaaaataaaaaccgaattattaaatatcgaaaaaataaataaaaatcaaaataaaaaataatataaaaaaaaaaatcgaaaaaaaaaataaatatacgtaaaaaaacaataacgaaaaaaataaaataacaaatccgtataatacgcgatcgaaatacgaaaaacaattataatcaaaataaaaaaaataaaaataaaacgcgaaaaaataaaaaattaatctaaaacaaataaaatcgacgcgaaaaaatacgaaatattaaaaaaaaaattaaaacaaaaacgataaaaacgaataaaataacaaataaaacgaaacgaaataaaaaaataacgacgataaaaaaaacttaaaataaaatataaaacgaaaaaaaaaatacgataaaataaaaataaaaaaaaaaaataatcgaaaaaacaaacgaatataattaaaaataaaaaacaataaaaaaaaaaaacaaaaaaaaacgcgataaaaataaaaaaaaaaaacgcgataacgaaaaaacgtacaacgtaccgaataaaaaataactaacgaaaaatcaaaaataaaatcgaaaaaatcacgntataataataacgaaaataaacgcattaaaacaaatatacattttaaaaataataaaaacgtcgacgatattaaaaatatacgcgctaaaaaataaacgtaat

SEQ ID NO: 9295 - DNA, 727 bp, Artificial Sequence
  chemically treated genomic DNA (Homo sapiens) CpG-island No: 9295
  misc_feature (624)..(624): n is either a, c, g or t
gggcgggcgtaggaggcgggcggtacggcgaggcggtggtggagttagagatgggaatcggattgttggatatcgaggaggtgggtggagattagaatgagaggtgatatgagggggaaggtcgagggaaaggatgagtgtgcgtgggaagatagtgacgggaagagtaagatggtagattcgtgtgatgcgcgatcggagtgcgaggagtagttgtggttagggtgggagaggtgggagtgaggcgcgaggaagtgggagattagtttgggataggtggagtcggcgcgaggggatacgagatgttagaagggagattgaagtagagacgatgagaacggatggaataatagatggagcgaagcgggatgagggggtggcggcggtgggggaggtttagggtggggtgtggagcgaagaaagaggtacggtaggataggagtgggagagggaagtagtcgaaggagtaggcgggtatgattaggaatggagagtaatgagaagaaggagtagagagaagcgcgatgagaataggagggagagacgcggtgacgggaggacgtataacgtgtcgagtagggggtggttagcgagagattagaagtgggatcgaggaggttacgntgtgatgatagcgaggatgagcgtattaaggtagatgtgtattttgagggtggtgagaacgtcgacgatgttgggggtgtacgcgttgagaaatgggcgtggt

SEQ ID NO: 9296 - DNA, 727 bp, Artificial Sequence
  chemically treated genomic DNA (Homo sapiens) CpG-island No: 9296
  misc_feature (104)..(104): n is either a, c, g or t
accacgcccatttctcaacgcgtacacccccaacatcgtcgacgttctcaccaccctcaaaatacacatctaccttaatacgctcatcctcgctatcatcacancgtaacctcctcgatcccacttctaatctctcgctaaccaccccctactcgacacgttatacgtcctcccgtcaccgcgtctctccctcctattctcatcgcgcttctctctactccttcttctcattactctccattcctaatcatacccgcctactccttcgactacttccctctcccactcctatcctaccgtacctctttcttcgctccacaccccaccctaaacctcccccaccgccgccaccccctcatcccgcttcgctccatctattattccatccgttctcatcgtctctacttcaatctcccttctaacatctcgtatcccctcgcgccgactccacctatcccaaactaatctcccacttcctcgcgcctcactcccacctctcccaccctaaccacaactactcctcgcactccgatcgcgcatcacacgaatctaccatcttactcttcccgtcactatcttcccacgcacactcatcctttccctcgaccttccccctcatatcacctctcattctaatctccacccacctcctcgatatccaacaatccgattcccatctctaactccaccaccgcctcgccgtaccgcccgcctcctacgcccgccc

SEQ ID NO: 9297 - DNA, 788 bp, Artificial Sequence
  chemically treated genomic DNA (Homo sapiens) CpG-island No: 9297
  misc_feature (247)..(247): n is either a, c, g or t
cgtttacgtagtacggattgttttttttatattttttatatttttttttgtacgatttatttttatttttttttcgatttttcgtgtttttattcgacgttcgattttttttttttttttaatttttcgtttcgtttcgttttttttttatcggtattcgtatttattttattatttattttatatatttttttattttcgtcgtcgattattatttttaaatcgatttttcgtatcgtttcgtatntcgttattttattttcgcgtcgtcgattttcgtatttttttatttatttatttatttcgattattttacggcgtcgcgttttgcgttttttattttattttttttcgttttttttattttttttttatttatttttacggtattgattttatttcggattattttcgtttgtcgttatcgtatcgtttttttttttatcgtatttcgttttaatcgatcgattttttcgtatttttttttttatttttttttttttatttttttgttcgttcgtaatttttcgttttatttttttttttcgtcgttttatcgtttttatcgtttttttttttttttcgttttttttttttttttttagtattttattttttattcgtcgtttcgttttattttttgttcgtattcgtttttttttcgggttcggaggatcgtttcgtttttttttttttattttatttatttttattttttttattttatttcgtttttcgtttgttatttttatcgtttttacgtaatacgtttgtatttattcgttacg

SEQ ID NO: 9298 - DNA, 788 bp, Artificial Sequence
  chemically treated genomic DNA (Homo sapiens) CpG-island No: 9298
  misc_feature (542)..(542): n is either a, c, g or t
cgtaacgaataaatacaaacgtattacgtaaaaacgataaaaataacaaacgaaaaacgaaataaaataaaaaaaataaaaataaataaaataaaaaaaaaaaaacgaaacgatcctccgaacccgaaaaaaaaacgaatacgaacaaaaaataaaacgaaacgacgaataaaaaataaaatactaaaaaaaaaaaaaaaaaacgaaaaaaaaaaaaaaacgataaaaacgataaaacgacgaaaaaaaaaaataaaacgaaaaattacgaacgaacaaaaaaataaaaaaaaaaaaataaaaaaaaaaatacgaaaaaatcgatcgattaaaacgaaatacgataaaaaaaaaaacgatacgataacgacaaacgaaaataatccgaaataaaatcaataccgtaaaaataaataaaaaaaaaataaaaaaaacgaaaaaaaataaaataaaaaacgcaaaacgcgacgccgtaaaataatcgaaataaataaataaataaaaaaatacgaaaatcgacgacgcgaaaataaaataacganatacgaaacgatacgaaaaatcgatttaaaaataataatcgacgacgaaaataaaaaaatatataaaataaataataaaataaatacgaataccgataaaaaaaaaacgaaacgaaacgaaaaattaaaaaaaaaaaaaaaatcgaacgtcgaataaaaacacgaaaaatcgaaaaaaaaataaaaataaatcgtacaaaaaaaaatataaaaaatataaaaaaaacaatccgtactacgtaaacg

SEQ ID NO: 9299 - DNA, 788 bp, Artificial Sequence
  chemically treated genomic DNA (Homo sapiens) CpG-island No: 9299
  misc_feature (542)..(542): n is either a, c, g or t
cgtggcgagtgagtataagcgtattgcgtgagagcggtggggatagtaggcgaggagcgaggtgaggtgagaagggtagaagtgggtggggtggagggaagggaacggaacgatttttcgagttcgggaggaagacgggtgcggataggggatggggcggggcggcgggtgggaggtggggtgttggggagagggaggaggagcggggggagagggagggcgatggaggcggtgggacgacggggggagaaggtgggacggagggttgcgagcgggtaggggaatggggaggaaggggtagagggggaagtacgggagggtcggtcggttggggcggagtgcgatggagagggaggcggtgcggtggcggtaggcgggggtggttcggagtagagttaatatcgtgggaatagatagaggaagggtggggagggcgaaaagaggtaaggtgaggagcgtagagcgcggcgtcgtgggatgatcggagtagatgagtgggtggagggatgcggagatcgacgacgcggaagtggaatggcggnatgcgagacggtgcggaagatcggtttgaggatggtggtcggcgacgaaggtgggaaagtgtataaggtgggtggtgagataggtgcgaatgtcgataggaggggaacggagcggagcgaagggttggggggggggagggagtcgagcgtcgggtggaggtacggaggatcgggggggaggtaggggtgggtcgtgtagagaggagtgtggagggtgtgaggaaagtagttcgtgttgcgtaggcg

SEQ ID NO: 9300 - DNA, 788 bp, Artificial Sequence
  chemically treated genomic DNA (Homo sapiens) CpG-island No: 9300
  misc_feature (247)..(247): n is either a, c, g or t
cgcctacgcaacacgaactactttcctcacaccctccacactcctctctacacgacccacccctacctcccccccgatcctccgtacctccacccgacgctcgactccctccccccccccaacccttcgctccgctccgttcccctcctatcgacattcgcacctatctcaccacccaccttatacactttcccaccttcgtcgccgaccaccatcctcaaaccgatcttccgcaccgtctcgcatnccgccattccacttccgcgtcgtcgatctccgcatccctccacccactcatctactccgatcatcccacgacgccgcgctctacgctcctcaccttacctcttttcgccctccccacccttcctctatctattcccacgatattaactctactccgaaccacccccgcctaccgccaccgcaccgcctccctctccatcgcactccgccccaaccgaccgaccctcccgtacttccccctctaccccttcctccccattcccctacccgctcgcaaccctccgtcccaccttctccccccgtcgtcccaccgcctccatcgccctccctctccccccgctcctcctccctctccccaacaccccacctcccacccgccgccccgccccatcccctatccgcacccgtcttcctcccgaactcgaaaaatcgttccgttcccttccctccaccccacccacttctacccttctcacctcacctcgctcctcgcctactatccccaccgctctcacgcaatacgcttatactcactcgccacg

SEQ ID NO: 9301 - DNA, 528 bp, Artificial Sequence
  chemically treated genomic DNA (Homo sapiens) CpG-island No: 9301
  misc_feature (389)..(389): n is either a, c, g or t
tatcgattattttttttttttttaatagatttaattttttatttattacgtcggttatataaagcggaattttatatttttatttataattaattatgcgaatatcggttagtattttattttattttcgattttaatataatatttgtataaattttttttttattcgtttatttttttataattttttacggttttatttatttattttttaaattcgtttcgaagtattttcgtattttttttttatattaatcgtataagttagtcggttttataatcgatattcgtatatttttttaattacgtaattattttacgttttttatttacgcgattcgatatttttaattatatatatttattttttttttatttttatttcgttntttttttttttaattttattattttattcgatatcgatatcgttttttcgaaacgtttatatttattatataacgtaaattcgtaatttattatcgtaaatcgcgttagtatttgtatacgcgatacgttattgcgttt

SEQ ID NO: 9302 - DNA, 528 bp, Artificial Sequence
  chemically treated genomic DNA (Homo sapiens) CpG-island No: 9302
  misc_feature (140)..(140): n is either a, c, g or t
aaacgcaataacgtatcgcgtatacaaatactaacgcgatttacgataataaattacgaatttacgttatataataaatataaacgtttcgaaaaaacgatatcgatatcgaataaaataataaaattaaaaaaaaaaanaacgaaataaaaataaaaaaaaaataaatatatataattaaaaatatcgaatcgcgtaaataaaaaacgtaaaataattacgtaattaaaaaaatatacgaatatcgattataaaaccgactaacttatacgattaatataaaaaaaaaatacgaaaatacttcgaaacgaatttaaaaaataaataaataaaaccgtaaaaaattataaaaaaataaacgaataaaaaaaaaatttatacaaatattatattaaaatcgaaaataaaataaaatactaaccgatattcgcataattaattataaataaaaatataaaattccgctttatataaccgacgtaataaataaaaaattaaatctattaaaaaaaaaaaaaataatcgata

SEQ ID NO: 9303 - DNA, 528 bp, Artificial Sequence
  chemically treated genomic DNA (Homo sapiens) CpG-island No: 9303
  misc_feature (140)..(140): n is either a, c, g or t
gggcgtagtggcgtgtcgcgtgtgtaggtgttggcgcggtttgcggtggtgggttgcggatttgcgttgtgtgatgggtgtgagcgtttcgagagggcggtgtcggtgtcgagtggggtgatggagttggaggaaggaanggcggggtggaaatggaggggaggtgggtgtgtgtggttgagggtgtcgagtcgcgtgggtgggagacgtggagtagttgcgtagttaagagggtgtgcgagtgtcggttgtggggtcgattggtttgtgcggttggtgtggagaaggggtgcggaggtgtttcggagcggatttggggggtgagtgagtggggtcgtagaaagttgtggaggggtaggcgggtggggaaggggtttgtgtaggtgttgtgttggagtcgagaatagggtgaggtgttggtcggtgttcgtatggttggttatgggtgggggtataaggtttcgttttgtgtggtcggcgtggtgggtagagggttgggtttgttggaagggggagaggtggtcggta

SEQ ID NO: 9304 - DNA, 528 bp, Artificial Sequence
  chemically treated genomic DNA (Homo sapiens) CpG-island No: 9304
  misc_feature (389)..(389): n is either a, c, g or t
taccgaccacctctcccccttccaacaaacccaaccctctacccaccacgccgaccacacaaaacgaaaccttatacccccacccataaccaaccatacgaacaccgaccaacacctcaccctattctcgactccaacacaacacctacacaaaccccttccccacccgcctacccctccacaactttctacgaccccactcactcaccccccaaatccgctccgaaacacctccgcaccccttctccacaccaaccgcacaaaccaatcgaccccacaaccgacactcgcacaccctcttaactacgcaactactccacgtctcccacccacgcgactcgacaccctcaaccacacacacccacctcccctccatttccaccccgccnttccttcctccaactccatcaccccactcgacaccgacaccgccctctcgaaacgctcacacccatcacacaacgcaaatccgcaacccaccaccgcaaaccgcgccaacacctacacacgcgacacgccactacgccc

SEQ ID NO: 9305 - DNA, 711 bp, Artificial Sequence
  chemically treated genomic DNA (Homo sapiens) CpG-island No: 9305
gagcgtagcggttttcgcggttgttttaggtgatcgtggggattcgagacgattagttcgaagcggtttttcggcgtttttgtggttatttattcgcgttttagttatcgtttcgtttcgttttttgcgtttagttttttcgttttgtttgattggtattcgagtttcgcgattttcgggtttttttcgttcgtagtttcggtcggtttttttgtttagcgtttttgttagttttttgttcgttcgttgtttttagttttggcgtttcggtttttcgtttttttcgttcggttagttttttttttgttgtttgttttgttaaaatattgtttaggttacgtgttttaataatagttaatttatttcggtcgttatttttttttcggcggttttcgcggttttggcgttcggttattatggtaatgtcgtcgttcgtttcggggcgttagtttggggtcgggttttcggtgtaggtgttcggcgggtgcgagggcgttggagatggcggttgggagatattagtagagtttcggaagttcgagacgttttaggtatttcggttgcgtttttagtcggtagaggcgcgtttggattttgagattaggaatcggagttgcgttattagagcgtagggtaattggggagatgttatttaaaggtttgttttagacgtggaggataattatagtcgtcgttttttttttttttttt

SEQ ID NO: 9306 - DNA, 711 bp, Artificial Sequence
  chemically treated genomic DNA (Homo sapiens) CpG-island No: 9306
aaaaaaaaaaaaaaaaacgacgactataattatcctccacgtctaaaacaaacctttaaataacatctccccaattaccctacgctctaataacgcaactccgattcctaatctcaaaatccaaacgcgcctctaccgactaaaaacgcaaccgaaatacctaaaacgtctcgaacttccgaaactctactaatatctcccaaccgccatctccaacgccctcgcacccgccgaacacctacaccgaaaacccgaccccaaactaacgccccgaaacgaacgacgacattaccataataaccgaacgccaaaaccgcgaaaaccgccgaaaaaaaaataacgaccgaaataaattaactattattaaaacacgtaacctaaacaatattttaacaaaacaaacaacaaaaaaaaaactaaccgaacgaaaaaaacgaaaaaccgaaacgccaaaactaaaaacaacgaacgaacaaaaaactaacaaaaacgctaaacaaaaaaaccgaccgaaactacgaacgaaaaaaacccgaaaatcgcgaaactcgaataccaatcaaacaaaacgaaaaaactaaacgcaaaaaacgaaacgaaacgataactaaaacgcgaataaataaccacaaaaacgccgaaaaaccgcttcgaactaatcgtctcgaatccccacgatcacctaaaacaaccgcgaaaaccgctacgctc

SEQ ID NO: 9307 - DNA, 711 bp, Artificial Sequence
  chemically treated genomic DNA (Homo sapiens) CpG-island No: 9307
ggaggaggaggaggagacgacgattataattattttttacgtttggggtaggtttttggatgatatttttttagttattttgcgttttaatagcgtagtttcgatttttggttttagaatttaggcgcgtttttgtcggttgggagcgtaatcgaagtgtttgggacgtttcgggttttcgggattttgttggtgttttttagtcgttatttttagcgttttcgtattcgtcgggtatttgtatcgaaaattcggttttaaattagcgtttcggggcgagcggcggtattgttatagtaatcgggcgttagggtcgcggaggtcgtcggggaggaagtgacgatcggggtgggttggttgttgttgggatacgtgatttaggtagtgttttgatagggtaaatagtagagaaagaattggtcgagcgagggggacggggagtcggggcgttagagttagagatagcgggcgggtaaggagttggtagaggcgttgggtaagagggtcggtcggggttacgggcggggaaagttcgggggtcgcggggttcgggtgttagttaggtagggcggaggggttgagcgtagggagcggagcgaggcggtggttgaggcgcgggtggatggttataggggcgtcggggagtcgtttcgggttggtcgtttcgggtttttacggttatttgaggtagtcgcgggggtcgttgcgttt

SEQ ID NO: 9308 - DNA, 711 bp, Artificial Sequence
  chemically treated genomic DNA (Homo sapiens) CpG-island No: 9308
aaacgcaacgacccccgcgactacctcaaataaccgtaaaaacccgaaacgaccaacccgaaacgactccccgacgcccctataaccatccacccgcgcctcaaccaccgcctcgctccgctccctacgctcaacccctccgccctacctaactaacacccgaaccccgcgacccccgaactttccccgcccgtaaccccgaccgaccctcttacccaacgcctctaccaactccttacccgcccgctatctctaactctaacgccccgactccccgtccccctcgctcgaccaattctttctctactatttaccctatcaaaacactacctaaatcacgtatcccaacaacaaccaacccaccccgatcgtcacttcctccccgacgacctccgcgaccctaacgcccgattactataacaataccgccgctcgccccgaaacgctaatttaaaaccgaattttcgatacaaatacccgacgaatacgaaaacgctaaaaataacgactaaaaaacaccaacaaaatcccgaaaacccgaaacgtcccaaacacttcgattacgctcccaaccgacaaaaacgcgcctaaattctaaaaccaaaaatcgaaactacgctattaaaacgcaaaataactaaaaaaatatcatccaaaaacctaccccaaacgtaaaaaataattataatcgtcgtctcctcctcctcctcc

SEQ ID NO: 9309 - DNA, 660 bp, Artificial Sequence
  chemically treated genomic DNA (Homo sapiens) CpG-island No: 9309
cgatttacggaggtgttataaaaggtacgattcggagtaaacgcggggtacgttggaatttttaattcgtcggcgtattagttagcgacggcgggaagttaaaggtggggcgtaggagtttcggttttatgcgtttcggtttcgtatttcgggcgcggtttttcgtttggcgggagtaggtcgttcgttagattcggttttgggtagggtttagggtttacgtttcgcgcgtttattttttgttttttcgcggaggttgtttcggggattttcgtagatatagtgttttttttgtagacgagacgtcgggaaaagatgtaattagcgggtggtcgaggttattcggtcgtcgttcgttttagtttttttagggttcgtcgggtcgttttcgttcgcgaaaatggtcgtcgttttatgacgatacggagtcgcgaaacgtttcgttggttaaggttttcgtacgtcggagttcgtttgtttttttcgtatcgtatttttatttatttgatttcgtttttttcgttcgttgtcgtttaaatattttttttttttttttaaaggtcgtcgtttttgttttattttatattcgtttgtggttgtcgagtgttttttgggaattgtagtttttaagtggaatcgttttttttcgtttttttttgt

SEQ ID NO: 9310 - DNA, 660 bp, Artificial Sequence
  chemically treated genomic DNA (Homo sapiens) CpG-island No: 9310
acaaaaaaaaacgaaaaaaaacgattccacttaaaaactacaattcccaaaaaacactcgacaaccacaaacgaatataaaataaaacaaaaacgacgacctttaaaaaaaaaaaaaaaatatttaaacgacaacgaacgaaaaaaacgaaatcaaataaataaaaatacgatacgaaaaaaacaaacgaactccgacgtacgaaaaccttaaccaacgaaacgtttcgcgactccgtatcgtcataaaacgacgaccattttcgcgaacgaaaacgacccgacgaaccctaaaaaaactaaaacgaacgacgaccgaataacctcgaccacccgctaattacatcttttcccgacgtctcgtctacaaaaaaaacactatatctacgaaaatccccgaaacaacctccgcgaaaaaacaaaaaataaacgcgcgaaacgtaaaccctaaaccctacccaaaaccgaatctaacgaacgacctactcccgccaaacgaaaaaccgcgcccgaaatacgaaaccgaaacgcataaaaccgaaactcctacgccccacctttaacttcccgccgtcgctaactaatacgccgacgaattaaaaattccaacgtaccccgcgtttactccgaatcgtaccttttataacacctccgtaaatcg

SEQ ID NO: 9311 - DNA, 660 bp, Artificial Sequence
  chemically treated genomic DNA (Homo sapiens) CpG-island No: 9311
ataggaaagggcggggaggggcggttttatttagaaattataatttttaggaagtattcggtagttataaacggatgtgaggtgaggtaggagcggcgatttttgaaggaaaaaaggaagtgtttggacgatagcgagcgggagaagcggggttaagtaggtaggggtgcggtgcgggaggggtaggcgggtttcggcgtgcgagggttttggttagcggagcgtttcgcggtttcgtgtcgttataaggcggcggttattttcgcgggcggaggcggttcggcgggttttgggagagttgggacgggcggcggtcgggtggtttcggttattcgttaattgtattttttttcggcgtttcgtttgtagagggagtattatgtttgcggaagttttcgaggtagttttcgcggaggagtagaaggtgagcgcgcggggcgtgagttttgggttttgtttaaggtcgggtttggcgggcggtttgttttcgttaggcggagggtcgcgttcgagatgcggggtcgaggcgtatgaggtcgaggtttttgcgttttatttttggtttttcgtcgtcgttggttggtgcgtcgacgaattgggagttttaacgtgtttcgcgtttatttcgaatcgtgttttttgtaatattttcgtgggtcg

SEQ ID NO: 9312 - DNA, 660 bp, Artificial Sequence
  chemically treated genomic DNA (Homo sapiens) CpG-island No: 9312
cgacccacgaaaatattacaaaaaacacgattcgaaataaacgcgaaacacgttaaaactcccaattcgtcgacgcaccaaccaacgacgacgaaaaaccaaaaataaaacgcaaaaacctcgacctcatacgcctcgaccccgcatctcgaacgcgaccctccgcctaacgaaaacaaaccgcccgccaaacccgaccttaaacaaaacccaaaactcacgccccgcgcgctcaccttctactcctccgcgaaaactacctcgaaaacttccgcaaacataatactccctctacaaacgaaacgccgaaaaaaaatacaattaacgaataaccgaaaccacccgaccgccgcccgtcccaactctcccaaaacccgccgaaccgcctccgcccgcgaaaataaccgccgccttataacgacacgaaaccgcgaaacgctccgctaaccaaaaccctcgcacgccgaaacccgcctacccctcccgcaccgcacccctacctacttaaccccgcttctcccgctcgctatcgtccaaacacttccttttttccttcaaaaatcgccgctcctacctcacctcacatccgtttataactaccgaatacttcctaaaaattataatttctaaataaaaccgcccctccccgccctttcctat

SEQ ID NO: 9313 - DNA, 952 bp, Artificial Sequence
  chemically treated genomic DNA (Homo sapiens) CpG-island No: 9313
gtttcgtttggtagtagtttcgtcgtttagaggcgttcgagatttttcgattcgtgggtacgtataggtttcgttagcgagttttgtttaggtaacgagtcgttagttcgttttttcgtcgcgggttaggttttatttcgttattagtacgttttggataagtagtgttaggtttgatgtcgggtgtggtgagtgtcgtcgggatttaggtgcgtcgtttcgatgaggtttcggcgtcgtttcggttgtagtattatttttagtttcgcgaaggttttgcggtgtcgttgtcgtcgttggtaatatagagtttcgtcgcgtattacgtagtaggcggtagtttttcggattttacgtttgatattgttttcggtgttcggcgtatacggttcgcgttcgttcgttaggtaacgtaggatggttcggtagtttttttcgtttgatatcgcggatcgcggttttttgagggcgtttgttagggataggtgaggaaaacggttcgttatttacgggcggttgtaggaggagcggcggtatcgtagggagaaacggttgcgtttttggcgagcgtttttcgacggtttttttagttcgaaggaaaagcgggcgagttggtaattagggggaattgtatttttttagcgcgcgggattcgttggcgattgataaaatggttgttgtattatcggaagtgacgtaaggtaagggcggggattgagttttgattggagcgtattttcgttttttggtttgatggagtcgatttagtgacgttaggaatgcgggtggatattttggaagcgggtaggattttttattgtagttcgagggatttttaagtagatttttggggcgtttcggtcggttcgtttgggggggttttttttttttttttaagggtcgtgttttgttcggggtttgtggtggttcgttttgttttttttttttttgg

SEQ ID NO: 9314 - DNA, 952 bp, Artificial Sequence
  chemically treated genomic DNA (Homo sapiens) CpG-island No: 9314
ccaaaaaaaaaaaaaacaaaacgaaccaccacaaaccccgaacaaaacacgacccttaaaaaaaaaaaaaaaacccccccaaacgaaccgaccgaaacgccccaaaaatctacttaaaaatccctcgaactacaataaaaaatcctacccgcttccaaaatatccacccgcattcctaacgtcactaaatcgactccatcaaaccaaaaaacgaaaatacgctccaatcaaaactcaatccccgcccttaccttacgtcacttccgataatacaacaaccattttatcaatcgccaacgaatcccgcgcgctaaaaaaatacaattccccctaattaccaactcgcccgcttttccttcgaactaaaaaaaccgtcgaaaaacgctcgccaaaaacgcaaccgtttctccctacgataccgccgctcctcctacaaccgcccgtaaataacgaaccgttttcctcacctatccctaacaaacgccctcaaaaaaccgcgatccgcgatatcaaacgaaaaaaactaccgaaccatcctacgttacctaacgaacgaacgcgaaccgtatacgccgaacaccgaaaacaatatcaaacgtaaaatccgaaaaactaccgcctactacgtaatacgcgacgaaactctatattaccaacgacgacaacgacaccgcaaaaccttcgcgaaactaaaaataatactacaaccgaaacgacgccgaaacctcatcgaaacgacgcacctaaatcccgacgacactcaccacacccgacatcaaacctaacactacttatccaaaacgtactaataacgaaataaaacctaacccgcgacgaaaaaacgaactaacgactcgttacctaaacaaaactcgctaacgaaacctatacgtacccacgaatcgaaaaatctcgaacgcctctaaacgacgaaactactaccaaacgaaac

SEQ ID NO: 9315 - DNA, 952 bp, Artificial Sequence
  chemically treated genomic DNA (Homo sapiens) CpG-island No: 9315
ttaaaagagggggaaatagggcgggttattataaatttcgggtaaaatacgatttttaaaaaaaagaagggagtttttttagacgggtcggtcgggacgttttaagagtttgtttaaagatttttcgaattgtagtgaagggttttattcgtttttaaaatgtttattcgtatttttgacgttattggatcggttttattaagttagaaaacgagagtgcgttttaattagggtttagttttcgtttttgttttgcgttattttcggtggtgtagtagttattttgttagtcgttagcggatttcgcgcgttggagaagtgtagttttttttggttattaattcgttcgtttttttttcggattaagggagtcgtcgaagagcgttcgttaaaggcgtagtcgtttttttttacggtgtcgtcgttttttttgtagtcgttcgtaggtagcgggtcgttttttttatttgtttttgataggcgtttttagggagtcgcggttcgcgatgttaagcgaggaaagttatcgggttattttgcgttatttgacgaacgagcgcgagtcgtatgcgtcgggtatcgagggtaatgttaagcgtaaaattcgaaaagttgtcgtttgttacgtggtgcgcggcgggattttgtattattagcggcggtagcggtatcgtaagattttcgcggagttggaggtggtgttgtagtcggagcgacgtcgggattttatcgaggcggcgtatttgggtttcggcggtatttattatattcggtattagatttggtattatttgtttaagacgtattggtggcgaggtgagatttagttcgcggcgagggggcgggttggcgattcgttgtttgggtaaggttcgttggcgaggtttatgcgtatttacgagtcggagggtttcggacgtttttgggcggcggagttgttgttaggcggagt

SEQ ID NO: 9316 - DNA, 952 bp, Artificial Sequence
  chemically treated genomic DNA (Homo sapiens) CpG-island No: 9316
actccgcctaacaacaactccgccgcccaaaaacgtccgaaaccctccgactcgtaaatacgcataaacctcgccaacgaaccttacccaaacaacgaatcgccaacccgccccctcgccgcgaactaaatctcacctcgccaccaatacgtcttaaacaaataataccaaatctaataccgaatataataaataccgccgaaacccaaatacgccgcctcgataaaatcccgacgtcgctccgactacaacaccacctccaactccgcgaaaatcttacgataccgctaccgccgctaataatacaaaatcccgccgcgcaccacgtaacaaacgacaacttttcgaattttacgcttaacattaccctcgatacccgacgcatacgactcgcgctcgttcgtcaaataacgcaaaataacccgataactttcctcgcttaacatcgcgaaccgcgactccctaaaaacgcctatcaaaaacaaataaaaaaaacgacccgctacctacgaacgactacaaaaaaaacgacgacaccgtaaaaaaaaacgactacgcctttaacgaacgctcttcgacgactcccttaatccgaaaaaaaaacgaacgaattaataaccaaaaaaaactacacttctccaacgcgcgaaatccgctaacgactaacaaaataactactacaccaccgaaaataacgcaaaacaaaaacgaaaactaaaccctaattaaaacgcactctcgttttctaacttaataaaaccgatccaataacgtcaaaaatacgaataaacattttaaaaacgaataaaacccttcactacaattcgaaaaatctttaaacaaactcttaaaacgtcccgaccgacccgtctaaaaaaactcccttcttttttttaaaaatcgtattttacccgaaatttataataacccgccctatttccccctcttttaa

SEQ ID NO: 9317 - DNA, 527 bp, Artificial Sequence
  chemically treated genomic DNA (Homo sapiens) CpG-island No: 9317
aataattcggtattcgcggtcgttttagcgttgggcgggggaagttcggggatttcgcgtacgcgtatatttttgtttcggtagtcgcgtaagcgtaatcgttcggaatatggttgtcgtcggtcgttaatcgtaagtgtcgacgtatttttgagttttgcgttgttttcgttttttgcggagggaagttttggcgggtggaggttcgtcgggtttttgtggggcggcgaggggcgcgttcgcgggtgggttttatttgggtggtgggtatgtcgggttcgttagggcgagggtttggttaggggcgtagtttttttggtgggtggggacgtttcgtggcgattggggttatttttttgaggacgaggtcgtttcggggttggtttggacgttttcgttttttttttagcgttattcgtgagtttcgcgttcgtatttttagttcgtttttttatagagattgttttgttacgtttgttgggtgttttggttcgttttcgggggtaattttcgagtttgtagttttt

SEQ ID NO: 9318 - DNA, 527 bp, Artificial Sequence
  chemically treated genomic DNA (Homo sapiens) CpG-island No: 9318
aaaaactacaaactcgaaaattacccccgaaaacgaaccaaaacacccaacaaacgtaacaaaacaatctctataaaaaaacgaactaaaaatacgaacgcgaaactcacgaataacgctaaaaaaaaaacgaaaacgtccaaaccaaccccgaaacgacctcgtcctcaaaaaaataaccccaatcgccacgaaacgtccccacccaccaaaaaaactacgcccctaaccaaaccctcgccctaacgaacccgacatacccaccacccaaataaaacccacccgcgaacgcgcccctcgccgccccacaaaaacccgacgaacctccacccgccaaaacttccctccgcaaaaaacgaaaacaacgcaaaactcaaaaatacgtcgacacttacgattaacgaccgacgacaaccatattccgaacgattacgcttacgcgactaccgaaacaaaaatatacgcgtacgcgaaatccccgaacttcccccgcccaacgctaaaacgaccgcgaataccgaattatt

SEQ ID NO: 9319 - DNA, 527 bp, Artificial Sequence
  chemically treated genomic DNA (Homo sapiens) CpG-island No: 9319
aaaagttgtagattcgggggttattttcggagacggattaggatatttagtaggcgtggtaaaatagtttttatgggagggcgggttagagatgcgagcgcggaatttacgggtgacgttaaggaaagagcgggggcgtttagattagtttcggagcgatttcgtttttagaggagtgattttaatcgttacggagcgtttttatttattaggagaattacgtttttggttagattttcgttttagcgggttcgatatgtttattatttaggtgaaatttattcgcggacgcgtttttcgtcgttttataaggattcggcggatttttattcgttaagattttttttcgtaggaaacggaggtagcgtagggtttagggatgcgtcggtatttacggttggcggtcggcggtagttatgtttcgggcgattgcgtttgcgcggttgtcgggataaggatgtgcgcgtgcgcggagttttcgagtttttttcgtttaacgttggggcggtcgcgggtatcgggttatt

SEQ ID NO: 9320 - DNA, 527 bp, Artificial Sequence
  chemically treated genomic DNA (Homo sapiens) CpG-island No: 9320
aataacccgatacccgcgaccgccccaacgttaaacgaaaaaaactcgaaaactccgcgcacgcgcacatccttatcccgacaaccgcgcaaacgcaatcgcccgaaacataactaccgccgaccgccaaccgtaaataccgacgcatccctaaaccctacgctacctccgtttcctacgaaaaaaaatcttaacgaataaaaatccgccgaatccttataaaacgacgaaaaacgcgtccgcgaataaatttcacctaaataataaacatatcgaacccgctaaaacgaaaatctaaccaaaaacgtaattctcctaataaataaaaacgctccgtaacgattaaaatcactcctctaaaaacgaaatcgctccgaaactaatctaaacgcccccgctctttccttaacgtcacccgtaaattccgcgctcgcatctctaacccgccctcccataaaaactattttaccacgcctactaaatatcctaatccgtctccgaaaataacccccgaatctacaactttt

SEQ ID NO: 9321 - DNA, 554 bp, Artificial Sequence
  chemically treated genomic DNA (Homo sapiens) CpG-island No: 9321
tgatatcgtagttcgcgagaggcgaggaggatttttggattgtgggtaggatcgtaggtagcggaggttttgttcggaaggcgggatttggggacgatttttattttttttagtcgtagacgcggagtttataggagttttcgtagttttagttcgtgtatttacggcggagtcgaggtcgcgatttcgggtttgttggttggaattcgtagtcgtgtttcgggtcgtttcggtagcggttatttttgagagtattcggtttcgttttatttcgtagtggtttggggagtgtaggttattatttttattcgttaaggcggacgtcggattttttattgcgtatgagcgtttattgcggcgtcgttgttgcgtatgagtgtgtttttatcgtttatattttttagaaaatttcgcggcgcggcgttttatcgttttcgttttcgggttgcgttagtcgcgacgatggcgttttttagtggtagtagggaggttgtgggggtgttgggcgttgcggtgtgtaggttttttgggaggatatttggcgtcgattttga

SEQ ID NO: 9322 - DNA, 554 bp, Artificial Sequence
  chemically treated genomic DNA (Homo sapiens) CpG-island No: 9322
tcaaaatcgacgccaaatatcctcccaaaaaacctacacaccgcaacgcccaacacccccacaacctccctactaccactaaaaaacgccatcgtcgcgactaacgcaacccgaaaacgaaaacgataaaacgccgcgccgcgaaattttctaaaaaatataaacgataaaaacacactcatacgcaacaacgacgccgcaataaacgctcatacgcaataaaaaatccgacgtccgccttaacgaataaaaataataacctacactccccaaaccactacgaaataaaacgaaaccgaatactctcaaaaataaccgctaccgaaacgacccgaaacacgactacgaattccaaccaacaaacccgaaatcgcgacctcgactccgccgtaaatacacgaactaaaactacgaaaactcctataaactccgcgtctacgactaaaaaaaataaaaatcgtccccaaatcccgccttccgaacaaaacctccgctacctacgatcctacccacaatccaaaaatcctcctcgcctctcgcgaactacgatatca

SEQ ID NO: 9323 - DNA, 554 bp, Artificial Sequence
  chemically treated genomic DNA (Homo sapiens) CpG-island No: 9323
ttaaggtcggcgttaggtatttttttagaaaatttgtatatcgtaacgtttagtatttttatagtttttttgttgttattggggggcgttatcgtcgcggttaacgtaattcgagggcggaagcggtggagcgtcgcgtcgcggggttttttgggagatgtaggcggtggaagtatatttatgcgtagtaacggcgtcgtagtgggcgtttatgcgtaatggagggttcggcgttcgttttggcgggtgggagtgatgatttgtattttttaaattattgcgggatagaacggggtcgagtgtttttaggggtggtcgttatcggggcggttcgagatacggttgcgggttttagttaataggttcggagtcgcggtttcggtttcgtcgtgggtgtacgggttagggttgcggggatttttgtgggtttcgcgtttgcggttgggaggaatggggatcgtttttagatttcgtttttcgggtagggttttcgttgtttgcgattttgtttatagtttaaggatttttttcgtttttcgcggattgcggtgtta

SEQ ID NO: 9324 - DNA, 554 bp, Artificial Sequence
  chemically treated genomic DNA (Homo sapiens) CpG-island No: 9324
taacaccgcaatccgcgaaaaacgaaaaaaatccttaaactataaacaaaatcgcaaacaacgaaaaccctacccgaaaaacgaaatctaaaaacgatccccattcctcccaaccgcaaacgcgaaacccacaaaaatccccgcaaccctaacccgtacacccacgacgaaaccgaaaccgcgactccgaacctattaactaaaacccgcaaccgtatctcgaaccgccccgataacgaccacccctaaaaacactcgaccccgttctatcccgcaataatttaaaaaatacaaatcatcactcccacccgccaaaacgaacgccgaaccctccattacgcataaacgcccactacgacgccgttactacgcataaatatacttccaccgcctacatctcccaaaaaaccccgcgacgcgacgctccaccgcttccgccctcgaattacgttaaccgcgacgataacgccccccaataacaacaaaaaaactataaaaatactaaacgttacgatatacaaattttctaaaaaaatacctaacgccgaccttaa

SEQ ID NO: 9325 - DNA, 625 bp, Artificial Sequence
  chemically treated genomic DNA (Homo sapiens) CpG-island No: 9325
attttcgtagtcgttatcgtttttatttttcgtagtagcgtttttgacgttgcgcgattcgttgttaaggcgattggaatcgcggttcgaggtaattggagggtacggcgggggcggggcgtttattttaggcggtttttgattggtttcggtcgtttcgtgcgttatagtttcgtttttgttcgggagtttcgtagcggtgatttgttatcgacgttcggcgtgatttagcggattaatggcggtcgttcgcggcgcgtagcgtgcggggatggggtttcgttcgcggcgttgggcgcgttcgttagtttaggggtcgttatgatcgagcggtttaggttcgagcgaagttcgcgcgcggtgagttcgtcgcggtttattcgttttttcgttcgttagagcgtttatcgggacgtttattcgggagggtttcggcgtcgcgtcggcgggagttggttcgggatcgcggtttaggggcgcgcgtcgggggaggcgggttcgggttcgggagggggcgggtcgggtcggggttttagagtttatcgggagttttgaggtcgtcgtaggggagggaaggggaaggttagaggttacgcggggcggggattgggggggttggggtcgt

SEQ ID NO: 9326 - DNA, 625 bp, Artificial Sequence
  chemically treated genomic DNA (Homo sapiens) CpG-island No: 9326
acgaccccaacccccccaatccccgccccgcgtaacctctaaccttccccttccctcccctacgacgacctcaaaactcccgataaactctaaaaccccgacccgacccgccccctcccgaacccgaacccgcctcccccgacgcgcgcccctaaaccgcgatcccgaaccaactcccgccgacgcgacgccgaaaccctcccgaataaacgtcccgataaacgctctaacgaacgaaaaaacgaataaaccgcgacgaactcaccgcgcgcgaacttcgctcgaacctaaaccgctcgatcataacgacccctaaactaacgaacgcgcccaacgccgcgaacgaaaccccatccccgcacgctacgcgccgcgaacgaccgccattaatccgctaaatcacgccgaacgtcgataacaaatcaccgctacgaaactcccgaacaaaaacgaaactataacgcacgaaacgaccgaaaccaatcaaaaaccgcctaaaataaacgccccgcccccgccgtaccctccaattacctcgaaccgcgattccaatcgccttaacaacgaatcgcgcaacgtcaaaaacgctactacgaaaaataaaaacgataacgactacgaaaat

SEQ ID NO: 9327 - DNA, 625 bp, Artificial Sequence
  chemically treated genomic DNA (Homo sapiens) CpG-island No: 9327
gcggttttagtttttttagttttcgtttcgcgtggtttttagtttttttttttttttttttacggcgattttaggattttcgatgggttttggaatttcggttcggttcgttttttttcgggttcgggttcgtttttttcgacgcgcgtttttggatcgcgatttcgggttagttttcgtcgacgcggcgtcgagattttttcgggtgggcgtttcgatggacgttttggcgggcggagggacggatgggtcgcggcggatttatcgcgcgcgggtttcgttcgggtttgggtcgttcggttatggcgatttttgggttggcgagcgcgtttaacgtcgcgggcgggattttattttcgtacgttgcgcgtcgcgggcggtcgttattggttcgttggattacgtcgggcgtcggtgataagttatcgttgcgggattttcgggtaggggcggggttgtgacgtacgaggcggtcgaggttaattagaagtcgtttgggatgagcgtttcgttttcgtcgtgttttttagttatttcgggtcgcggttttagtcgttttggtaacgggtcgcgtagcgttagggacgttgttgcggaaagtggagacggtggcggttgcggggat

SEQ ID NO: 9328 - DNA, 625 bp, Artificial Sequence
  chemically treated genomic DNA (Homo sapiens) CpG-island No: 9328
atccccgcaaccgccaccgtctccactttccgcaacaacgtccctaacgctacgcgacccgttaccaaaacgactaaaaccgcgacccgaaataactaaaaaacacgacgaaaacgaaacgctcatcccaaacgacttctaattaacctcgaccgcctcgtacgtcacaaccccgcccctacccgaaaatcccgcaacgataacttatcaccgacgcccgacgtaatccaacgaaccaataacgaccgcccgcgacgcgcaacgtacgaaaataaaatcccgcccgcgacgttaaacgcgctcgccaacccaaaaatcgccataaccgaacgacccaaacccgaacgaaacccgcgcgcgataaatccgccgcgacccatccgtccctccgcccgccaaaacgtccatcgaaacgcccacccgaaaaaatctcgacgccgcgtcgacgaaaactaacccgaaatcgcgatccaaaaacgcgcgtcgaaaaaaacgaacccgaacccgaaaaaaaacgaaccgaaccgaaattccaaaacccatcgaaaatcctaaaatcgccgtaaaaaaaaaaaaaaaaaaactaaaaaccacgcgaaacgaaaactaaaaaaactaaaaccgc

SEQ ID NO: 9329 - DNA, 637 bp, Artificial Sequence
  chemically treated genomic DNA (Homo sapiens) CpG-island No: 9329
ttggtttcgcgatcggtgggcgggaacggaggaaatagattcgagaggtcgcgagaggacggaatttatttttcgtcgtcgtagcgttttcgttagttcgtttttcgatttttcgtatgggcgcgtagagttttcggatgcgatatttcggtgatatcggacgttgggggcggggtttagtgcgacgagggcggggtcggggtcggttcggggcggggtcgtggtcgtagttgtttggtagttagaatttgggagcgttcgtagtgttgtttttcggggttttttgtttttcgtttttgttggtaggtgaggtttaatagacggaaagacgtcgggagcgtacgtgggttgttttgagtcgttgcggacgagtattttgttttttaggttgattagtcgtatattcgtttgcgagtttgtattattttgggcgcgcgtggtttcggtagaatttcgtttatacgggttttattcgtaggttgttgtgtttttttttttttacggcgtcggggattggggtttggagttatttttttataggggtgtggaacgcgttaatggacgttgatatttttatgcggtcgtttaacgtttcgtgtataataattattttatttagttgtgtgatgttttatcg

SEQ ID NO: 9330 - DNA, 637 bp, Artificial Sequence
  chemically treated genomic DNA (Homo sapiens) CpG-island No: 9330
cgataaaacatcacacaactaaataaaataattattatacacgaaacgttaaacgaccgcataaaaatatcaacgtccattaacgcgttccacacccctataaaaaaataactccaaaccccaatccccgacgccgtaaaaaaaaaaaaacacaacaacctacgaataaaacccgtataaacgaaattctaccgaaaccacgcgcgcccaaaataatacaaactcgcaaacgaatatacgactaatcaacctaaaaaacaaaatactcgtccgcaacgactcaaaacaacccacgtacgctcccgacgtctttccgtctattaaacctcacctaccaacaaaaacgaaaaacaaaaaaccccgaaaaacaacactacgaacgctcccaaattctaactaccaaacaactacgaccacgaccccgccccgaaccgaccccgaccccgccctcgtcgcactaaaccccgcccccaacgtccgatatcaccgaaatatcgcatccgaaaactctacgcgcccatacgaaaaatcgaaaaacgaactaacgaaaacgctacgacgacgaaaaataaattccgtcctctcgcgacctctcgaatctatttcctccgttcccgcccaccgatcgcgaaaccaa

SEQ ID NO: 9331 - DNA, 637 bp, Artificial Sequence
  chemically treated genomic DNA (Homo sapiens) CpG-island No: 9331
cgatggagtattatataattgagtaaaatggttattgtgtacggagcgttaaacgatcgtatgaaggtgttagcgtttattggcgcgttttatatttttgtagaggagtgattttaggttttagttttcgacgtcgtgagaggaaggagatatagtagtttacgagtgggattcgtgtgaacgagattttgtcgagattacgcgcgtttagggtggtgtaggttcgtaagcggatatacggttggttaatttgagagataaggtgttcgttcgtagcggtttaaggtagtttacgtgcgttttcggcgttttttcgtttgttaaattttatttattagtagaagcgaaggataaagaatttcgaaaggtagtattgcgagcgtttttaggttttggttgttaggtagttgcggttacggtttcgtttcgggtcggtttcggtttcgttttcgtcgtattaggtttcgtttttagcgttcggtgttatcggaatatcgtattcgggaattttgcgcgtttatgcggagagtcggagggcgagttgacgaggacgttacggcggcgggaagtgagtttcgttttttcgcggtttttcgggtttgtttttttcgttttcgtttatcggtcgcggagttaa

SEQ ID NO: 9332 - DNA, 637 bp, Artificial Sequence
  chemically treated genomic DNA (Homo sapiens) CpG-island No: 9332
ttaactccgcgaccgataaacgaaaacgaaaaaaacaaacccgaaaaaccgcgaaaaaacgaaactcacttcccgccgccgtaacgtcctcgtcaactcgccctccgactctccgcataaacgcgcaaaattcccgaatacgatattccgataacaccgaacgctaaaaacgaaacctaatacgacgaaaacgaaaccgaaaccgacccgaaacgaaaccgtaaccgcaactacctaacaaccaaaacctaaaaacgctcgcaatactacctttcgaaattctttatccttcgcttctactaataaataaaatttaacaaacgaaaaaacgccgaaaacgcacgtaaactaccttaaaccgctacgaacgaacaccttatctctcaaattaaccaaccgtatatccgcttacgaacctacaccaccctaaacgcgcgtaatctcgacaaaatctcgttcacacgaatcccactcgtaaactactatatctccttcctctcacgacgtcgaaaactaaaacctaaaatcactcctctacaaaaatataaaacgcgccaataaacgctaacaccttcatacgatcgtttaacgctccgtacacaataaccattttactcaattatataatactccatcg

SEQ ID NO: 9333 - DNA, 528 bp, Artificial Sequence
  chemically treated genomic DNA (Homo sapiens) CpG-island No: 9333
gttttgggagttttggtggtggattttttttattatcgaattttgcgcggaagtcgggggcgcgaaggttagcgtatatcgttcggaattttttggggggtagtttggttaacgtttttttggattttacgtcgcgttttttttaagcgatttttgtcgggtttttattcgcgtttacgattatgcgcgggtcggggcgttttttatcgttcgttcggttatttcgcgttcgggtatttcgtgtagtttttcgtttattttcgtattcgcgtttcgcggcgttttgcgttaggtattttgttcgttaggggagggggggcgggtgttgtttttttttcgtttcgggggtattttattttcgcggcgttttgcgtagagagcgcgggtcggttcgcggtttattgattttcgttattttcgtcgttcgtcgttttagttttagtttcgttcgatggtattttatcgcgtgtcgcgggcgaacggcgtcgcgtacggttgtggtatgcgcgtacgcgttattcgttcgcg

SEQ ID NO: 9334 - DNA, 528 bp, Artificial Sequence
  chemically treated genomic DNA (Homo sapiens) CpG-island No: 9334
cgcgaacgaataacgcgtacgcgcataccacaaccgtacgcgacgccgttcgcccgcgacacgcgataaaataccatcgaacgaaactaaaactaaaacgacgaacgacgaaaataacgaaaatcaataaaccgcgaaccgacccgcgctctctacgcaaaacgccgcgaaaataaaatacccccgaaacgaaaaaaaaacaacacccgccccccctcccctaacgaacaaaatacctaacgcaaaacgccgcgaaacgcgaatacgaaaataaacgaaaaactacacgaaatacccgaacgcgaaataaccgaacgaacgataaaaaacgccccgacccgcgcataatcgtaaacgcgaataaaaacccgacaaaaatcgcttaaaaaaaacgcgacgtaaaatccaaaaaaacgttaaccaaactaccccccaaaaaattccgaacgatatacgctaaccttcgcgcccccgacttccgcgcaaaattcgataataaaaaaaatccaccaccaaaactcccaaaac

SEQ ID NO: 9335 - DNA, 528 bp, Artificial Sequence
  chemically treated genomic DNA (Homo sapiens) CpG-island No: 9335
cgcgggcgggtggcgcgtacgcgtatgttatagtcgtgcgcggcgtcgttcgttcgcgatacgcgatgaagtattatcgagcgaggttgaagttggggcggcgagcgacggaggtggcgagagttaatggatcgcgggtcggttcgcgttttttgcgtagggcgtcgcgggggtggggtattttcgagacgaggagagaataatattcgtttttttttttttgacgaatagggtatttggcgtagagcgtcgcgagacgcggatgcgggggtgggcggagggttatacgaggtattcgaacgcgggatggtcgggcgggcggtagagaacgtttcggttcgcgtatggtcgtgagcgcggatgggggttcggtaaaggtcgtttgaggagaacgcggcgtgggatttaaaagggcgttagttaagttgttttttaaaaggtttcgagcggtatgcgttgattttcgcgttttcggttttcgcgtagggttcggtggtaaaggggatttattattagaatttttaaggt

SEQ ID NO: 9336 - DNA, 528 bp, Artificial Sequence
  chemically treated genomic DNA (Homo sapiens) CpG-island No: 9336
accttaaaaattctaataataaatcccctttaccaccgaaccctacgcgaaaaccgaaaacgcgaaaatcaacgcataccgctcgaaaccttttaaaaaacaacttaactaacgcccttttaaatcccacgccgcgttctcctcaaacgacctttaccgaacccccatccgcgctcacgaccatacgcgaaccgaaacgttctctaccgcccgcccgaccatcccgcgttcgaatacctcgtataaccctccgcccacccccgcatccgcgtctcgcgacgctctacgccaaataccctattcgtcaaaaaaaaaaaaacgaatattattctctcctcgtctcgaaaataccccacccccgcgacgccctacgcaaaaaacgcgaaccgacccgcgatccattaactctcgccacctccgtcgctcgccgccccaacttcaacctcgctcgataatacttcatcgcgtatcgcgaacgaacgacgccgcgcacgactataacatacgcgtacgcgccacccgcccgcg

SEQ ID NO: 9337 - DNA, 670 bp, Artificial Sequence
  chemically treated genomic DNA (Homo sapiens) CpG-island No: 9337
ttttcgtcggttttttttcgagggaaatacggttcgttattttcgggtagttgacgcgtcggcggttacgttaatagttatagaacggtttatatttatggtagttcgatcgttatatcgcggcggttttcgtttagtaaagttcgcggttttttaacggaggcgattggcgtatatttacgcggttatcgtcgcgcgttttttttcgcgcgacgaggtcgttgcggtttcgtcgtacgttcgttacgcgtcgttagggcgttcggagcggatggattttattcgcgcgatttgttcgtgttttgtgtttattttcgggtcgcgttgcggtcgcgcggtttgagatttttttagtttttgtcgagaagtacgaattatacgacgttatattaatacgcgcgagagggggagtttgttttatagtcgtatgcgatagggttagagcgcgttagttacgagaattatcgatagatacgaggagacgcgcgtattatcgtgatcgacgtagatagagagtgaatcgtttcgcgtcgttcgtagtcggcgttacgttagattatacgtcgtattgcgagttcgtttttttcgggttagtttgcgaaggtattcgatcgagattatattgcgtatcggacggagttattcgtcgttagtcgggtcgcgggatgta

SEQ ID NO: 9338 - DNA, 670 bp, Artificial Sequence
  chemically treated genomic DNA (Homo sapiens) CpG-island No: 9338
tacatcccgcgacccgactaacgacgaataactccgtccgatacgcaatataatctcgatcgaataccttcgcaaactaacccgaaaaaaacgaactcgcaatacgacgtataatctaacgtaacgccgactacgaacgacgcgaaacgattcactctctatctacgtcgatcacgataatacgcgcgtctcctcgtatctatcgataattctcgtaactaacgcgctctaaccctatcgcatacgactataaaacaaactccccctctcgcgcgtattaatataacgtcgtataattcgtacttctcgacaaaaactaaaaaaatctcaaaccgcgcgaccgcaacgcgacccgaaaataaacacaaaacacgaacaaatcgcgcgaataaaatccatccgctccgaacgccctaacgacgcgtaacgaacgtacgacgaaaccgcaacgacctcgtcgcgcgaaaaaaaacgcgcgacgataaccgcgtaaatatacgccaatcgcctccgttaaaaaaccgcgaactttactaaacgaaaaccgccgcgatataacgatcgaactaccataaatataaaccgttctataactattaacgtaaccgccgacgcgtcaactacccgaaaataacgaaccgtatttccctcgaaaaaaaaccgacgaaaa

SEQ ID NO: 9339 - DNA, 670 bp, Artificial Sequence
  chemically treated genomic DNA (Homo sapiens) CpG-island No: 9339
tgtatttcgcggttcggttggcggcgggtagtttcgttcggtgcgtagtgtggtttcggtcggatgttttcgtaggttgattcgaggggagcgagttcgtagtgcggcgtgtggtttggcgtggcgtcggttgcggacggcgcggggcggtttattttttgtttgcgtcggttacggtagtgcgcgcgttttttcgtgtttgtcggtggttttcgtagttggcgcgttttggttttgtcgtatgcgattgtgaggtaggttttttttttcgcgcgtgttagtgtgacgtcgtgtggttcgtgtttttcggtaggagttgaaagggttttagatcgcgcgatcgtaacgcgattcggaggtgagtataaggtacgagtagatcgcgcgaatggagtttattcgtttcgagcgttttgacggcgcgtgacgaacgtacggcggagtcgtagcgatttcgtcgcgcgagaggaagcgcgcggcgatgatcgcgtgggtatacgttagtcgttttcgttgggggatcgcgagttttgttgggcgggggtcgtcgcgatatggcggtcggattgttatgggtgtaggtcgttttgtggttattaacgtggtcgtcggcgcgttagttgttcgaagatggcggatcgtgtttttttcgaggaaagatcggcgaggg

SEQ ID NO: 9340 - DNA, 670 bp, Artificial Sequence
  chemically treated genomic DNA (Homo sapiens) CpG-island No: 9340
ccctcgccgatctttcctcgaaaaaaacacgatccgccatcttcgaacaactaacgcgccgacgaccacgttaataaccacaaaacgacctacacccataacaatccgaccgccatatcgcgacgacccccgcccaacaaaactcgcgatcccccaacgaaaacgactaacgtatacccacgcgatcatcgccgcgcgcttcctctcgcgcgacgaaatcgctacgactccgccgtacgttcgtcacgcgccgtcaaaacgctcgaaacgaataaactccattcgcgcgatctactcgtaccttatactcacctccgaatcgcgttacgatcgcgcgatctaaaaccctttcaactcctaccgaaaaacacgaaccacacgacgtcacactaacacgcgcgaaaaaaaaaacctacctcacaatcgcatacgacaaaaccaaaacgcgccaactacgaaaaccaccgacaaacacgaaaaaacgcgcgcactaccgtaaccgacgcaaacaaaaaataaaccgccccgcgccgtccgcaaccgacgccacgccaaaccacacgccgcactacgaactcgctcccctcgaatcaacctacgaaaacatccgaccgaaaccacactacgcaccgaacgaaactacccgccgccaaccgaaccgcgaaataca

SEQ ID NO: 9341 - DNA, 759 bp, Artificial Sequence
  chemically treated genomic DNA (Homo sapiens) CpG-island No: 9341
  misc_feature (357)..(357): n is either a, c, g or t
  misc_feature (395)..(395): n is either a, c, g or t
  misc_feature (546)..(546): n is either a, c, g or t
  misc_feature (603)..(603): n is either a, c, g or t
gcgcgggtacgttatcggttttatagtcgcggtgcggtgtacgttgagtttcgttttattatttagtacgcgtatcgaggtacgatttcgttggagagcgagttttgagtgcgtgtgacgattgagattcgtagttagtcgtacgcgcgtttcgtgttatagcgcgattacgtcggcgttatttagcgcgcgattaacgtgcgtacgttcgcgcggcgagtttttgcggagcgatcgattgaatgttagcgagtacgttacgtagcgtttgtcggcgttcgagttcgcgcgtcgcgtcggtatcgcggagtgcgcgcgcgtttatcggcgtggtggtcgcgttgtattgatcgtcgntatttttagttcgttacgaatatcgagcgtataatagnacgcgcgcgtagcgaggggtgcgttcgcgagtgcggcggcgttttcggtgattattcgatgacgcgacgcgtatcgcgcgatgtggatacggagagttttatttatagcgacgtcgcgtatcgtgagtcgcgcggcgttcgagttttcggngttcgtcgcgtttacgcgcgaggcgagttgttcggtcggttagttcgtcgagcggangcgtatttagttcggtagcgtttatcgaacggcgttcgtacgtcgcggttatcgttcggattgattgtagagatgtatagcgtacggatttcgtcgagcggagtacgcgcgaatagttagcgcgtcgcgcgttgtcggggattacgagttttattt

SEQ ID NO: 9342 - DNA, 759 bp, Artificial Sequence
  chemically treated genomic DNA (Homo sapiens) CpG-island No: 9342
  misc_feature (157)..(157): n is either a, c, g or t
  misc_feature (214)..(214): n is either a, c, g or t
  misc_feature (365)..(365): n is either a, c, g or t
  misc_feature (403)..(403): n is either a, c, g or t
aaataaaactcgtaatccccgacaacgcgcgacgcgctaactattcgcgcgtactccgctcgacgaaatccgtacgctatacatctctacaatcaatccgaacgataaccgcgacgtacgaacgccgttcgataaacgctaccgaactaaatacgcntccgctcgacgaactaaccgaccgaacaactcgcctcgcgcgtaaacgcgacgaacnccgaaaactcgaacgccgcgcgactcacgatacgcgacgtcgctataaataaaactctccgtatccacatcgcgcgatacgcgtcgcgtcatcgaataatcaccgaaaacgccgccgcactcgcgaacgcacccctcgctacgcgcgcgtnctattatacgctcgatattcgtaacgaactaaaaatancgacgatcaatacaacgcgaccaccacgccgataaacgcgcgcgcactccgcgataccgacgcgacgcgcgaactcgaacgccgacaaacgctacgtaacgtactcgctaacattcaatcgatcgctccgcaaaaactcgccgcgcgaacgtacgcacgttaatcgcgcgctaaataacgccgacgtaatcgcgctataacacgaaacgcgcgtacgactaactacgaatctcaatcgtcacacgcactcaaaactcgctctccaacgaaatcgtacctcgatacgcgtactaaataataaaacgaaactcaacgtacaccgcaccgcgactataaaaccgataacgtacccgcgc

SEQ ID NO: 9343 - DNA, 759 bp, Artificial Sequence
  chemically treated genomic DNA (Homo sapiens) CpG-island No: 9343
  misc_feature (157)..(157): n is either a, c, g or t
  misc_feature (214)..(214): n is either a, c, g or t
  misc_feature (365)..(365): n is either a, c, g or t
  misc_feature (403)..(403): n is either a, c, g or t
aggtgagattcgtagttttcggtagcgcgcggcgcgttgattgttcgcgcgtgtttcgttcgacgaagttcgtgcgttgtgtatttttgtagttagttcgggcggtggtcgcggcgtgcggacgtcgttcggtgagcgttatcgggttggatgcgtnttcgttcggcgaattgatcgatcgagtagttcgtttcgcgcgtgagcgcggcgagtntcggaagttcggacgtcgcgcggtttacggtacgcggcgtcgttgtgagtgaagtttttcgtgtttatatcgcgcggtgcgcgtcgcgttatcgagtggttatcgaggacgtcgtcgtattcgcggacgtatttttcgttacgcgcgcgtnttgttgtgcgttcggtgttcgtggcgagttgagggtgncgacgattagtatagcgcggttattacgtcggtaggcgcgcgcgtatttcgcggtgtcgacgcggcgcgcggattcgggcgtcggtaagcgttgcgtgacgtattcgttgatatttagtcgatcgtttcgtaggggttcgtcgcgcgggcgtacgtacgttgatcgcgcgttaagtgacgtcgacgtggtcgcgttgtagtacggaacgcgcgtgcggttgattgcgggttttagtcgttatacgtatttagagttcgttttttaacgaggtcgtatttcggtgcgcgtgttaggtggtggggcggagtttagcgtgtatcgtatcgcggttgtggggtcggtagcgtgttcgcgt

SEQ ID NO: 9344 - DNA, 759 bp, Artificial Sequence
  chemically treated genomic DNA (Homo sapiens) CpG-island No: 9344
  misc_feature (357)..(357): n is either a, c, g or t
  misc_feature (395)..(395): n is either a, c, g or t
  misc_feature (546)..(546): n is either a, c, g or t
  misc_feature (603)..(603): n is either a, c, g or t
acgcgaacacgctaccgaccccacaaccgcgatacgatacacgctaaactccgccccaccacctaacacgcgcaccgaaatacgacctcgttaaaaaacgaactctaaatacgtataacgactaaaacccgcaatcaaccgcacgcgcgttccgtactacaacgcgaccacgtcgacgtcacttaacgcgcgatcaacgtacgtacgcccgcgcgacgaacccctacgaaacgatcgactaaatatcaacgaatacgtcacgcaacgcttaccgacgcccgaatccgcgcgccgcgtcgacaccgcgaaatacgcgcgcgcctaccgacgtaataaccgcgctatactaatcgtcgncaccctcaactcgccacgaacaccgaacgcacaacaanacgcgcgcgtaacgaaaaatacgtccgcgaatacgacgacgtcctcgataaccactcgataacgcgacgcgcaccgcgcgatataaacacgaaaaacttcactcacaacgacgccgcgtaccgtaaaccgcgcgacgtccgaacttccganactcgccgcgctcacgcgcgaaacgaactactcgatcgatcaattcgccgaacgaanacgcatccaacccgataacgctcaccgaacgacgtccgcacgccgcgaccaccgcccgaactaactacaaaaatacacaacgcacgaacttcgtcgaacgaaacacgcgcgaacaatcaacgcgccgcgcgctaccgaaaactacgaatctcacct

SEQ ID NO: 9345 - DNA, 549 bp, Artificial Sequence
  chemically treated genomic DNA (Homo sapiens) CpG-island No: 9345
cggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgtttggcgttaaaatgtatgcgtttgatgaacgaacggtggtgttggggtcgatttttaaacgtttttttgtcgt

SEQ ID NO: 9346 - DNA, 549 bp, Artificial Sequence
  chemically treated genomic DNA (Homo sapiens) CpG-island No: 9346
acgacaaaaaaacgtttaaaaatcgaccccaacaccaccgttcgttcatcaaacgcatacattttaacgccaaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccg

SEQ ID NO: 9347 - DNA, 549 bp, Artificial Sequence
  chemically treated genomic DNA (Homo sapiens) CpG-island No: 9347
acggtaaaaaaacgtttaggggtcgattttaatattatcgttcgtttattaagcgtatatattttaacgttaagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcg

SEQ ID NO: 9348 - DNA, 549 bp, Artificial Sequence
  chemically treated genomic DNA (Homo sapiens) CpG-island No: 9348
cgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgcttaacgttaaaatatatacgcttaataaacgaacgataatattaaaatcgacccctaaacgtttttttaccgt

SEQ ID NO: 9349 - DNA, 819 bp, Artificial Sequence
  chemically treated genomic DNA (Homo sapiens) CpG-island No: 9349
  misc_feature (91)..(91): n is either a, c, g or t
  misc_feature (97)..(97): n is either a, c, g or t
  misc_feature (99)..(99): n is either a, c, g or t
  misc_feature (105)..(106): n is either a, c, g or t
  misc_feature (124)..(124): n is either a, c, g or t
  misc_feature (145)..(145): n is either a, c, g or t
  misc_feature (211)..(211): n is either a, c, g or t
  misc_feature (235)..(235): n is either a, c, g or t
  misc_feature (243)..(243): n is either a, c, g or t
  misc_feature (255)..(255): n is either a, c, g or t
  misc_feature (274)..(274): n is either a, c, g or t
  misc_feature (295)..(295): n is either a, c, g or t
  misc_feature (297)..(297): n is either a, c, g or t
  misc_feature (305)..(305): n is either a, c, g or t
  misc_feature (344)..(344): n is either a, c, g or t
  misc_feature (364)..(364): n is either a, c, g or t
  misc_feature (373)..(373): n is either a, c, g or t
  misc_feature (509)..(509): n is either a, c, g or t
  misc_feature (518)..(518): n is either a, c, g or t
  misc_feature (531)..(531): n is either a, c, g or t
  misc_feature (561)..(561): n is either a, c, g or t
  misc_feature (600)..(600): n is either a, c, g or t
  misc_feature (607)..(607): n is either a, c, g or t
  misc_feature (662)..(662): n is either a, c, g or t
  misc_feature (667)..(667): n is either a, c, g or t
  misc_feature (688)..(688): n is either a, c, g or t
  misc_feature (690)..(690): n is either a, c, g or t
  misc_feature (755)..(757): n is either a, c, g or t
  misc_feature (760)..(760): n is either a, c, g or t
  misc_feature (784)..(784): n is either a, c, g or t
gtacgcgtaaaatcggggaaacgtatagaaaaagaatcgcggggttatcgtcgttttttttttcgtaattagaaatatataacgataaaantttcgntncgtagnnaatcgttcgagattagangagaataaaataaacgattanattagatcgttttacggtttttttagattttttttaagcgaaaatatttatttttatttatcgtantttcggtttttttacgtttttatngattttantttaaaataaanatatataaatatcgttttncgtttcggtcgcgttatttantnatataatngagatagaaatttatattcgcgttttcgaagcgcgcganttttttttttcgcggttttngttaattanattattttagattagacgaaaagacgtcgtaaatattattatacgcgcgtttttcgagtaatatatacgcgaatagttaaatcgatatatagtaaaataaattaggatttcgacggcgcgagcgtaagttttttanggattcgtnttacggttttttnaacgtttttaagttaaaatatattcggganacgaagtaagcgtagtagaagtttaggtagggttacgantaaattntcgcggttatatatacgtagatacgcggtagacgtataaagtcggttatttcggngtagngtaacgtacgcgtaattacgnangataatatagtatagcgtataaacgtaggcgtaaataatcgaatagatattttcgtagtatattnnnttnttatatatataaaaatagataatntattacgcgtcgtattttcgtaatttttatcgtta

SEQ ID NO: 9350 - DNA, 819 bp, Artificial Sequence
  chemically treated genomic DNA (Homo sapiens) CpG-island No: 9350
  misc_feature (36)..(36): n is either a, c, g or t
  misc_feature (60)..(60): n is either a, c, g or t
  misc_feature (63)..(65): n is either a, c, g or t
  misc_feature (130)..(130): n is either a, c, g or t
  misc_feature (132)..(132): n is either a, c, g or t
  misc_feature (153)..(153): n is either a, c, g or t
  misc_feature (158)..(158): n is either a, c, g or t
  misc_feature (213)..(213): n is either a, c, g or t
  misc_feature (220)..(220): n is either a, c, g or t
  misc_feature (259)..(259): n is either a, c, g or t
  misc_feature (289)..(289): n is either a, c, g or t
  misc_feature (302)..(302): n is either a, c, g or t
  misc_feature (311)..(311): n is either a, c, g or t
  misc_feature (447)..(447): n is either a, c, g or t
  misc_feature (456)..(456): n is either a, c, g or t
  misc_feature (476)..(476): n is either a, c, g or t
  misc_feature (515)..(515): n is either a, c, g or t
  misc_feature (523)..(523): n is either a, c, g or t
  misc_feature (525)..(525): n is either a, c, g or t
  misc_feature (546)..(546): n is either a, c, g or t
  misc_feature (565)..(565): n is either a, c, g or t
  misc_feature (577)..(577): n is either a, c, g or t
  misc_feature (585)..(585): n is either a, c, g or t
  misc_feature (609)..(609): n is either a, c, g or t
  misc_feature (675)..(675): n is either a, c, g or t
  misc_feature (696)..(696): n is either a, c, g or t
  misc_feature (714)..(715): n is either a, c, g or t
  misc_feature (721)..(721): n is either a, c, g or t
  misc_feature (723)..(723): n is either a, c, g or t
  misc_feature (729)..(729): n is either a, c, g or t
taacgataaaaattacgaaaatacgacgcgtaatanattatctatttttatatatataanaannnaatatactacgaaaatatctattcgattatttacgcctacgtttatacgctatactatattatcntncgtaattacgcgtacgttacnctacnccgaaataaccgactttatacgtctaccgcgtatctacgtatatataaccgcganaatttantcgtaaccctacctaaacttctactacgcttacttcgtntcccgaatatattttaacttaaaaacgttnaaaaaaccgtaanacgaatccntaaaaaacttacgctcgcgccgtcgaaatcctaatttattttactatatatcgatttaactattcgcgtatatattactcgaaaaacgcgcgtataataatatttacgacgtcttttcgtctaatctaaaataatntaattaacnaaaaccgcgaaaaaaaaaantcgcgcgcttcgaaaacgcgaatataaatttctatctcnattatatnantaaataacgcgaccgaaacgnaaaacgatatttatatatntttattttaaantaaaatcnataaaaacgtaaaaaaaccgaaantacgataaataaaaataaatattttcgcttaaaaaaaatctaaaaaaaccgtaaaacgatctaatntaatcgtttattttattctcntctaatctcgaacgattnnctacgnancgaaanttttatcgttatatatttctaattacgaaaaaaaaaacgacgataaccccgcgattctttttctatacgtttccccgattttacgcgtac

SEQ ID NO: 9351 - DNA, 819 bp, Artificial Sequence
  chemically treated genomic DNA (Homo sapiens) CpG-island No: 9351
  misc_feature (36)..(36): n is either a, c, g or t
  misc_feature (60)..(60): n is either a, c, g or t
  misc_feature (63)..(65): n is either a, c, g or t
  misc_feature (130)..(130): n is either a, c, g or t
  misc_feature (132)..(132): n is either a, c, g or t
  misc_feature (153)..(153): n is either a, c, g or t
  misc_feature (158)..(158): n is either a, c, g or t
  misc_feature (213)..(213): n is either a, c, g or t
  misc_feature (220)..(220): n is either a, c, g or t
  misc_feature (259)..(259): n is either a, c, g or t
  misc_feature (289)..(289): n is either a, c, g or t
  misc_feature (302)..(302): n is either a, c, g or t
  misc_feature (311)..(311): n is either a, c, g or t
  misc_feature (447)..(447): n is either a, c, g or t
  misc_feature (456)..(456): n is either a, c, g or t
  misc_feature (476)..(476): n is either a, c, g or t
  misc_feature (515)..(515): n is either a, c, g or t
  misc_feature (523)..(523): n is either a, c, g or t
  misc_feature (525)..(525): n is either a, c, g or t
  misc_feature (546)..(546): n is either a, c, g or t
  misc_feature (565)..(565): n is either a, c, g or t
  misc_feature (577)..(577): n is either a, c, g or t
  misc_feature (585)..(585): n is either a, c, g or t
  misc_feature (609)..(609): n is either a, c, g or t
  misc_feature (675)..(675): n is either a, c, g or t
  misc_feature (696)..(696): n is either a, c, g or t
  misc_feature (714)..(715): n is either a, c, g or t
  misc_feature (721)..(721): n is either a, c, g or t
  misc_feature (723)..(723): n is either a, c, g or t
  misc_feature (729)..(729): n is either a, c, g or t
tggcggtgggggttgcgggggtgcggcgcgtggtgngttgtttgtttttgtgtgtgtggnggnnnggtgtgttgcgggggtgtttgttcggttgtttgcgtttgcgtttgtgcgttgtgttgtgttgttntncgtggttgcgcgtgcgttgtnttgtntcggggtggtcggttttgtgcgtttgtcgcgtgtttgcgtgtgtgtggtcgcggnggtttgntcgtggttttgtttgggtttttgttgcgtttgtttcgtntttcgggtgtgttttggtttgggggcgttnggggggtcgtggngcgggtttntggggggtttgcgttcgcgtcgtcggggttttggtttgttttgttgtgtgtcggtttggttgttcgcgtgtgtgttgttcggggggcgcgcgtgtggtggtgtttgcggcgttttttcgtttggtttggggtggtntggttggtnggggtcgcgggggggggggntcgcgcgtttcgggggcgcgggtgtgggtttttgttttngttgtgtngntgggtggcgcggtcggggcgnggggcggtgtttgtgtgtntttgttttgggntggggttngtgagggcgtgggggggtcggggntgcggtgggtgggggtgggtgttttcgtttggggggggtttgggggggtcgtggggcggtttggtntggtcgtttgttttgtttttntttggtttcgggcggttnnttgcgngncggggnttttgtcgttgtgtgtttttggttgcgggggggggggcggcggtggtttcgcggttttttttttgtgcgttttttcggttttgcgcgtgt

SEQ ID NO: 9352 - DNA, 819 bp, Artificial Sequence
  chemically treated genomic DNA (Homo sapiens) CpG-island No: 9352
  misc_feature (91)..(91): n is either a, c, g or t
  misc_feature (97)..(97): n is either a, c, g or t
  misc_feature (99)..(99): n is either a, c, g or t
  misc_feature (105)..(106): n is either a, c, g or t
  misc_feature (124)..(124): n is either a, c, g or t
  misc_feature (145)..(145): n is either a, c, g or t
  misc_feature (211)..(211): n is either a, c, g or t
  misc_feature (235)..(235): n is either a, c, g or t
  misc_feature (243)..(243): n is either a, c, g or t
  misc_feature (255)..(255): n is either a, c, g or t
  misc_feature (274)..(274): n is either a, c, g or t
  misc_feature (295)..(295): n is either a, c, g or t
  misc_feature (297)..(297): n is either a, c, g or t
  misc_feature (305)..(305): n is either a, c, g or t
  misc_feature (344)..(344): n is either a, c, g or t
  misc_feature (364)..(364): n is either a, c, g or t
  misc_feature (373)..(373): n is either a, c, g or t
  misc_feature (509)..(509): n is either a, c, g or t
  misc_feature (518)..(518): n is either a, c, g or t
  misc_feature (531)..(531): n is either a, c, g or t
  misc_feature (561)..(561): n is either a, c, g or t
  misc_feature (600)..(600): n is either a, c, g or t
  misc_feature (607)..(607): n is either a, c, g or t
  misc_feature (662)..(662): n is either a, c, g or t
  misc_feature (667)..(667): n is either a, c, g or t
  misc_feature (688)..(688): n is either a, c, g or t
  misc_feature (690)..(690): n is either a, c, g or t
  misc_feature (755)..(757): n is either a, c, g or t
  misc_feature (760)..(760): n is either a, c, g or t
  misc_feature (784)..(784): n is either a, c, g or t
acacgcgcaaaaccgaaaaaacgcacaaaaaaaaaaccgcgaaaccaccgccgcccccccccccgcaaccaaaaacacacaacgacaaaanccccgncncgcaannaaccgcccgaaaccaaanaaaaacaaaacaaacgaccanaccaaaccgccccacgacccccccaaaccccccccaaacgaaaacacccacccccacccaccgcanccccgacccccccacgccctcacnaaccccancccaaaacaaanacacacaaacaccgccccncgccccgaccgcgccacccancnacacaacnaaaacaaaaacccacacccgcgcccccgaaacgcgcgancccccccccccgcgaccccnaccaaccanaccaccccaaaccaaacgaaaaaacgccgcaaacaccaccacacgcgcgccccccgaacaacacacacgcgaacaaccaaaccgacacacaacaaaacaaaccaaaaccccgacgacgcgaacgcaaaccccccanaaacccgcnccacgaccccccnaacgcccccaaaccaaaacacacccgaaanacgaaacaaacgcaacaaaaacccaaacaaaaccacgancaaaccnccgcgaccacacacacgcaaacacgcgacaaacgcacaaaaccgaccaccccganacaanacaacgcacgcgcaaccacgnanaacaacacaacacaacgcacaaacgcaaacgcaaacaaccgaacaaacacccccgcaacacaccnnnccnccacacacacaaaaacaaacaacncaccacgcgccgcacccccgcaacccccaccgcca

SEQ ID NO: 9353 - DNA, 525 bp, Artificial Sequence
  chemically treated genomic DNA (Homo sapiens) CpG-island No: 9353
acgatcgaaggatatagtcgagcgcgttcgttcgagttatcgtggcgtcgcgttagagaacgttatcggtattagttacgtttttatggcggggttttcgtcgggtcgcgatatcgtttcgtttatttatttttttggtttgttttgttgcggtcgtcgtattatttagggatattcgtgtagaggtgtttacgtggaggcgaagaagcgttcgttttttcgcggtaggttgcggtcgtagtttagttttacgttcgtttttcgtggtttttcgtatttttttttttagtttacgtttatgtttcgtttggttcggttttttgtttgttcggtttcgtcgaattttcgtttttgtcgttgtggtttatttagtcgacgattggttcggtgtggggttttcgtcggtgtttttgcgcggcgtttgggtcgtttttcgtatttcgttttttttacggtgggtcgattatttttttgtacggcgtatttgtcgcgtgttttattatttatgttttgtttttatttttt

SEQ ID NO: 9354 - DNA, 525 bp, Artificial Sequence
  chemically treated genomic DNA (Homo sapiens) CpG-island No: 9354
aaaaaataaaaacaaaacataaataataaaacacgcgacaaatacgccgtacaaaaaaataatcgacccaccgtaaaaaaaacgaaatacgaaaaacgacccaaacgccgcgcaaaaacaccgacgaaaaccccacaccgaaccaatcgtcgactaaataaaccacaacgacaaaaacgaaaattcgacgaaaccgaacaaacaaaaaaccgaaccaaacgaaacataaacgtaaactaaaaaaaaaaatacgaaaaaccacgaaaaacgaacgtaaaactaaactacgaccgcaacctaccgcgaaaaaacgaacgcttcttcgcctccacgtaaacacctctacacgaatatccctaaataatacgacgaccgcaacaaaacaaaccaaaaaaataaataaacgaaacgatatcgcgacccgacgaaaaccccgccataaaaacgtaactaataccgataacgttctctaacgcgacgccacgataactcgaacgaacgcgctcgactatatccttcgatcgt

SEQ ID NO: 9355 - DNA, 525 bp, Artificial Sequence
  chemically treated genomic DNA (Homo sapiens) CpG-island No: 9355
gggagatagaggtagaatatagatgatgaggtacgcgataagtgcgtcgtataaggaggtgatcgatttatcgtgagggaggcggagtacgaaggacgatttaggcgtcgcgtaaaagtatcggcgaaggttttatatcgagttaatcgtcgattgggtgaattatagcgataggggcgagagttcggcgagatcggatagataaaagatcgggttaagcgaggtatggacgtgagttgagaagaaaggtgcgaggagttacgagaagcgaacgtgaggttaggttacggtcgtaatttgtcgcgaagaggcgggcgttttttcgtttttacgtgggtatttttatacgggtgtttttagatgatacgacggtcgtagtaggataagttaggggagtggatagacggggcgatgtcgcggttcggcgggggtttcgttatgagggcgtagttggtgtcgatagcgttttttggcgcggcgttacggtagttcgggcggacgcgttcggttatgtttttcgatcgt

SEQ ID NO: 9356 - DNA, 525 bp, Artificial Sequence
  chemically treated genomic DNA (Homo sapiens) CpG-island No: 9356
acgatcgaaaaacataaccgaacgcgtccgcccgaactaccgtaacgccgcgccaaaaaacgctatcgacaccaactacgccctcataacgaaacccccgccgaaccgcgacatcgccccgtctatccactcccctaacttatcctactacgaccgtcgtatcatctaaaaacacccgtataaaaatacccacgtaaaaacgaaaaaacgcccgcctcttcgcgacaaattacgaccgtaacctaacctcacgttcgcttctcgtaactcctcgcacctttcttctcaactcacgtccatacctcgcttaacccgatcttttatctatccgatctcgccgaactctcgcccctatcgctataattcacccaatcgacgattaactcgatataaaaccttcgccgatacttttacgcgacgcctaaatcgtccttcgtactccgcctccctcacgataaatcgatcacctccttatacgacgcacttatcgcgtacctcatcatctatattctacctctatctccc

SEQ ID NO: 9357 - DNA, 748 bp, Artificial Sequence
  chemically treated genomic DNA (Homo sapiens) CpG-island No: 9357
gatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaagcgttgtttgtcggttatgaggtttttaggttggtgaacggatttgtaggggttgggggttcgtatcgggtttgtgtttttcggttagggtggttagtggttggggatgggtcggggttttatcgggtttttacggtgttcgttgttgttttttgacgaattttgtgtcgagttggatgtatatttgggttaggaaattg

SEQ ID NO: 9358 - DNA, 748 bp, Artificial Sequence
  chemically treated genomic DNA (Homo sapiens) CpG-island No: 9358
caatttcctaacccaaatatacatccaactcgacacaaaattcgtcaaaaaacaacaacgaacaccgtaaaaacccgataaaaccccgacccatccccaaccactaaccaccctaaccgaaaaacacaaacccgatacgaacccccaacccctacaaatccgttcaccaacctaaaaacctcataaccgacaaacaacgcttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatc

SEQ ID NO: 9359 - DNA, 748 bp, Artificial Sequence
  chemically treated genomic DNA (Homo sapiens) CpG-island No: 9359
taattttttggtttagatgtgtatttagttcggtataaggttcgttaaagggtagtagcgaatatcgtaaaagttcggtaaagtttcggtttatttttagttattgattattttgatcggaaaatataaattcgatgcgggtttttagtttttatagattcgtttattaatttagaagttttatgatcggtagatagcgttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgatt

SEQ ID NO: 9360 - DNA, 748 bp, Artificial Sequence
  chemically treated genomic DNA (Homo sapiens) CpG-island No: 9360
aatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaacgctatctaccgatcataaaacttctaaattaataaacgaatctataaaaactaaaaacccgcatcgaatttatattttccgatcaaaataatcaataactaaaaataaaccgaaactttaccgaacttttacgatattcgctactaccctttaacgaaccttataccgaactaaatacacatctaaaccaaaaaatta

SEQ ID NO: 9361 - DNA, 664 bp, Artificial Sequence
  chemically treated genomic DNA (Homo sapiens) CpG-island No: 9361
tcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttgggatgttggtattcgttggcgttgatacggtcggcgttggattagttatcggtggtgttggggtcggatcgtgaaagattgttgtgcggtgtgaaagttttgttttgtcggttatgaggtttttaggtttgtgatcggatttttgggggtttggtggtcgtatcggggtttgtagttttcggtttaaggtgttagttgtttgggaatggtcgggggttttaacgggttt

SEQ ID NO: 9362 - DNA, 664 bp, Artificial Sequence
  chemically treated genomic DNA (Homo sapiens) CpG-island No: 9362
aaacccgttaaaacccccgaccattcccaaacaactaacaccttaaaccgaaaactacaaaccccgatacgaccaccaaacccccaaaaatccgatcacaaacctaaaaacctcataaccgacaaaacaaaactttcacaccgcacaacaatctttcacgatccgaccccaacaccaccgataactaatccaacgccgaccgtatcaacgccaacgaataccaacatcccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacga

SEQ ID NO: 9363 - DNA, 664 bp, Artificial Sequence
  chemically treated genomic DNA (Homo sapiens) CpG-island No: 9363
aggttcgttaaagttttcggttatttttaagtaattgatattttggatcggaaattataaatttcgatgcggttattaagtttttaaagattcggttataaatttagaagttttatgatcggtaagatagggtttttatatcgtataataattttttacggttcgattttagtattatcgatggttaatttagcgtcgatcgtgttaacgttagcgagtattaatattttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacgg

SEQ ID NO: 9364 - DNA, 664 bp, Artificial Sequence
  chemically treated genomic DNA (Homo sapiens) CpG-island No: 9364
ccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaaatattaatactcgctaacgttaacacgatcgacgctaaattaaccatcgataatactaaaatcgaaccgtaaaaaattattatacgatataaaaaccctatcttaccgatcataaaacttctaaatttataaccgaatctttaaaaacttaataaccgcatcgaaatttataatttccgatccaaaatatcaattacttaaaaataaccgaaaactttaacgaacct

SEQ ID NO: 9365 - DNA, 873 bp, Artificial Sequence
  chemically treated genomic DNA (Homo sapiens) CpG-island No: 9365
gggtaggcgattgtcggattcgcgcgaagtcgcggggcgagcgcggtttttatttttttttttttttttttttcgtggttcggttttcgttcgttttttagcgtcgtcggttgaggtagtttagttcggggacgcgatttaatatggtgttgttgtcgggggcgcgcgagcgggcgacgggtaaggcgagtcgatggtgaggggtttgggcggttagaggtttaagagtttcggcggcggcggcggcggggttagggtaggcggggttgggggtggggagggggaggtttgtgtggtggtttgtggaaagcgcggtgatagcgtgtatttcggtttcggtttcgcggggttttcgtatatatttacgcgcggtttcggtcgttgaggtcgggcgttttcgggtagaagtatcggcggtagttgagtcgttgcgcgtcgttcgtttgttttttttttcgttagtttttttttttgtcgtcgttacggtttggtagttagtgttatatagcgattttcgagggttggtcgcggtattgcgtttggttttatatcgtttcggtagattttcgcggggaataatagattcgattcgtcgggtttagggttcgtttgtaatgtgtcgtatattttatacgtatataaagtcggcggaaaggggggcggtgcggggaaacggttattatcggttgttttagggttaggggtggaggcgatgtcgcgttttcggttcggttgttggaagggtcgtttcggagttttcgttcgttcgatagaatcggtgtggcgttttgaagggaaaggaagtttatcggggtagttttttatcgtacgtaatatttatagatcggaataaagttaatttgttattttttg

SEQ ID NO: 9366 - DNA, 873 bp, Artificial Sequence
  chemically treated genomic DNA (Homo sapiens) CpG-island No: 9366
caaaaaataacaaattaactttattccgatctataaatattacgtacgataaaaaactaccccgataaacttcctttcccttcaaaacgccacaccgattctatcgaacgaacgaaaactccgaaacgacccttccaacaaccgaaccgaaaacgcgacatcgcctccacccctaaccctaaaacaaccgataataaccgtttccccgcaccgcccccctttccgccgactttatatacgtataaaatatacgacacattacaaacgaaccctaaacccgacgaatcgaatctattattccccgcgaaaatctaccgaaacgatataaaaccaaacgcaataccgcgaccaaccctcgaaaatcgctatataacactaactaccaaaccgtaacgacgacaaaaaaaaaaactaacgaaaaaaaaaacaaacgaacgacgcgcaacgactcaactaccgccgatacttctacccgaaaacgcccgacctcaacgaccgaaaccgcgcgtaaatatatacgaaaaccccgcgaaaccgaaaccgaaatacacgctatcaccgcgctttccacaaaccaccacacaaacctccccctccccacccccaaccccgcctaccctaaccccgccgccgccgccgccgaaactcttaaacctctaaccgcccaaacccctcaccatcgactcgccttacccgtcgcccgctcgcgcgcccccgacaacaacaccatattaaatcgcgtccccgaactaaactacctcaaccgacgacgctaaaaaacgaacgaaaaccgaaccacgaaaaaaaaaaaaaaaaaaaaataaaaaccgcgctcgccccgcgacttcgcgcgaatccgacaatcgcctaccc

SEQ ID NO: 9367 - DNA, 873 bp, Artificial Sequence
  chemically treated genomic DNA (Homo sapiens) CpG-island No: 9367
tagaaggtaataaattgattttatttcgatttgtgaatgttgcgtacggtgaggggttatttcggtgagttttttttttttttagagcgttatatcggttttgtcgggcgggcggggatttcgaggcggtttttttaatagtcgggtcggggacgcgatatcgtttttatttttaattttggaataatcggtagtggtcgttttttcgtatcgttttttttttcgtcggttttgtgtgcgtgtgaaatgtgcggtatattgtagacgaattttaagttcggcgagtcgagtttattgtttttcgcgaggatttgtcggggcggtgtggagttaggcgtagtgtcgcggttagttttcgggggtcgttgtgtggtattggttgttaggtcgtggcggcggtagagagggaggttggcggggagggaagtaggcgggcggcgcgtagcggtttagttgtcgtcggtgtttttgttcggggacgttcggttttagcggtcgaggtcgcgcgtgaatgtgtgcgagggtttcgcggagtcggggtcgaaatatacgttgttatcgcgttttttataaattattatatagatttttttttttttatttttagtttcgtttgttttagtttcgtcgtcgtcgtcgtcgaaatttttgggtttttggtcgtttagattttttattatcggttcgttttgttcgtcgttcgttcgcgcgttttcggtagtagtattatgttgaatcgcgttttcgggttgagttgttttagtcggcggcgttgagaggcgggcgagagtcgggttacggggagggagggaaggaaggggtgggggtcgcgttcgtttcgcggtttcgcgcggattcggtagtcgtttgttt

SEQ ID NO: 9368 - DNA, 873 bp, Artificial Sequence
  chemically treated genomic DNA (Homo sapiens) CpG-island No: 9368
aaacaaacgactaccgaatccgcgcgaaaccgcgaaacgaacgcgacccccaccccttccttccctccctccccgtaacccgactctcgcccgcctctcaacgccgccgactaaaacaactcaacccgaaaacgcgattcaacataatactactaccgaaaacgcgcgaacgaacgacgaacaaaacgaaccgataataaaaaatctaaacgaccaaaaacccaaaaatttcgacgacgacgacgacgaaactaaaacaaacgaaactaaaaataaaaaaaaaaaaatctatataataatttataaaaaacgcgataacaacgtatatttcgaccccgactccgcgaaaccctcgcacacattcacgcgcgacctcgaccgctaaaaccgaacgtccccgaacaaaaacaccgacgacaactaaaccgctacgcgccgcccgcctacttccctccccgccaacctccctctctaccgccgccacgacctaacaaccaataccacacaacgacccccgaaaactaaccgcgacactacgcctaactccacaccgccccgacaaatcctcgcgaaaaacaataaactcgactcgccgaacttaaaattcgtctacaatataccgcacatttcacacgcacacaaaaccgacgaaaaaaaaaacgatacgaaaaaacgaccactaccgattattccaaaattaaaaataaaaacgatatcgcgtccccgacccgactattaaaaaaaccgcctcgaaatccccgcccgcccgacaaaaccgatataacgctctaaaaaaaaaaaaaactcaccgaaataacccctcaccgtacgcaacattcacaaatcgaaataaaatcaatttattaccttcta

SEQ ID NO: 9369 - DNA, 667 bp, Artificial Sequence
  chemically treated genomic DNA (Homo sapiens) CpG-island No: 9369
tacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgatcgagcggtggtgttggggtcggatcgttaaagattttttgtgcggtgtgaaagcgttgtttgtcggttatgaggtttttcggtttggtgatcggatttgttcggggttgggggtcgtatcgggtttgtgttttttaggtaaggtggttagtggttgggga

SEQ ID NO: 9370 - DNA, 667 bp, Artificial Sequence
  chemically treated genomic DNA (Homo sapiens) CpG-island No: 9370
tccccaaccactaaccaccttacctaaaaaacacaaacccgatacgacccccaaccccgaacaaatccgatcaccaaaccgaaaaacctcataaccgacaaacaacgctttcacaccgcacaaaaaatctttaacgatccgaccccaacaccaccgctcgatcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgta

SEQ ID NO: 9371 - DNA, 667 bp, Artificial Sequence
  chemically treated genomic DNA (Homo sapiens) CpG-island No: 9371
tttttagttattgattattttatttggaaagtataaattcgatgcggtttttagtttcgagtagattcggttattaagtcgagaagttttatgatcggtagatagcgtttttatatcgtataaaaaatttttaacggttcgattttagtattatcgttcggttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgta

SEQ ID NO: 9372 - DNA, 667 bp, Artificial Sequence
  chemically treated genomic DNA (Homo sapiens) CpG-island No: 9372
tacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaccgaacgataatactaaaatcgaaccgttaaaaattttttatacgatataaaaacgctatctaccgatcataaaacttctcgacttaataaccgaatctactcgaaactaaaaaccgcatcgaatttatactttccaaataaaataatcaataactaaaaa

SEQ ID NO: 9373 - DNA, 569 bp, Artificial Sequence
  chemically treated genomic DNA (Homo sapiens) CpG-island No: 9373
  misc_feature (151)..(151): n is either a, c, g or t
  misc_feature (248)..(248): n is either a, c, g or t
  misc_feature (308)..(308): n is either a, c, g or t
ttttgtttgcgtcgttttattttttcggttttttcgagtttttgtcgttttatttcgtttttcgcggtcgtcgttttttgtattcgttttttttcggtttttttcgtttttttttttttttgtttttttttattatttcgttttttttttnttttcgttcgttcgcgtttatatttttttttcgtttttttttcgtttttttttcgcgtttgattttttagtttttttacgttttttcgtatatttanacgttttttttttcgcgtttttttatttttttttttcgagttttcgttgatttcgcgttntcgtacgttcggggttttttcgttatttcgtagtgtttttttcgcgtttatatttttattcgtcgggatttttatatattcgtttttttgcgtttgtcgatggttttcgacgttagttggcgtagtcgggttatttttcgggcgcggttcgttttttcgttgtcggcgttttttttatatattcgttgatgacgggtttttttttaatcgcgttttttatttttatttttttatttttattaatagagcgtaagaacgtat

SEQ ID NO: 9374 - DNA, 569 bp, Artificial Sequence
  chemically treated genomic DNA (Homo sapiens) CpG-island No: 9374
  misc_feature (262)..(262): n is either a, c, g or t
  misc_feature (322)..(322): n is either a, c, g or t
  misc_feature (419)..(419): n is either a, c, g or t
atacgttcttacgctctattaataaaaataaaaaaataaaaataaaaaacgcgattaaaaaaaaacccgtcatcaacgaatatataaaaaaaacgccgacaacgaaaaaacgaaccgcgcccgaaaaataacccgactacgccaactaacgtcgaaaaccatcgacaaacgcaaaaaaacgaatatataaaaatcccgacgaataaaaatataaacgcgaaaaaaacactacgaaataacgaaaaaaccccgaacgtacganaacgcgaaatcaacgaaaactcgaaaaaaaaaaataaaaaaacgcgaaaaaaaaaacgtntaaatatacgaaaaaacgtaaaaaaactaaaaaatcaaacgcgaaaaaaaaacgaaaaaaaaacgaaaaaaaaatataaacgcgaacgaacgaaaanaaaaaaaaaacgaaataataaaaaaaaacaaaaaaaaaaaaaaacgaaaaaaaccgaaaaaaaacgaatacaaaaaacgacgaccgcgaaaaacgaaataaaacgacaaaaactcgaaaaaaccgaaaaaataaaacgacgcaaacaaaa

SEQ ID NO: 9375 - DNA, 569 bp, Artificial Sequence
  chemically treated genomic DNA (Homo sapiens) CpG-island No: 9375
  misc_feature (262)..(262): n is either a, c, g or t
  misc_feature (322)..(322): n is either a, c, g or t
  misc_feature (419)..(419): n is either a, c, g or t
gtgcgtttttacgttttgttgatgagagtaggggggtgggagtgagaaacgcggttgggggggagttcgttattagcggatgtgtaggaaaggcgtcgataacggaggggcgggtcgcgttcgaagggtggttcgattgcgttagttggcgtcgagggttatcggtaggcgtaagggggcgggtatgtgaggatttcggcgggtgggggtgtgggcgcgggggagatattacgggatggcgggggaatttcgggcgtgcggnagcgcggggttagcggaggttcggggggggaaggtaggggggcgcggggggggggacgtntgggtatgcgggaggacgtgggggagttagaagattaggcgcgggggagggacggggggggggcggggggggggtgtgggcgcgggcgagcgagggnggggagggggcggagtgatggaagggggtaggaaggggggaaagcggggggagtcggggaaggacggatgtaaagagcggcggtcgcggggggcgggataaagcggtaggggttcgagagggtcggggagatagggcgacgtagatagga

SEQ ID NO: 9376 - DNA, 569 bp, Artificial Sequence
  chemically treated genomic DNA (Homo sapiens) CpG-island No: 9376
  misc_feature (151)..(151): n is either a, c, g or t
  misc_feature (248)..(248): n is either a, c, g or t
  misc_feature (308)..(308): n is either a, c, g or t
tcctatctacgtcgccctatctccccgaccctctcgaacccctaccgctttatcccgccccccgcgaccgccgctctttacatccgtccttccccgactccccccgctttccccccttcctacccccttccatcactccgccccctccccnccctcgctcgcccgcgcccacaccccccccccgccccccccccgtccctcccccgcgcctaatcttctaactcccccacgtcctcccgcatacccanacgtccccccccccgcgcccccctaccttccccccccgaacctccgctaaccccgcgctnccgcacgcccgaaattcccccgccatcccgtaatatctcccccgcgcccacacccccacccgccgaaatcctcacatacccgcccccttacgcctaccgataaccctcgacgccaactaacgcaatcgaaccacccttcgaacgcgacccgcccctccgttatcgacgcctttcctacacatccgctaataacgaactcccccccaaccgcgtttctcactcccacccccctactctcatcaacaaaacgtaaaaacgcac

SEQ ID NO: 9377 - DNA, 563 bp, Artificial Sequence
  chemically treated genomic DNA (Homo sapiens) CpG-island No: 9377
gtcgcgtcgtttaaagttttttaggttcgcgcgttatagttcgaagtttttagtttttaaatttttggttttgtggggttttcgcgatgtgtgtaggaatgcgagttgaacgtttggtttcgaaacgatttagtttttatttacgtttcgtagttgttgttgttgttgttgttgtttttttattacgttatcggcgtatgtcgtacgttattttcgttttagtttttcggtgtcgtttcggaagtaatttttcgttgatttcgagagttagttcgagtatcgttttgttttggttgcgacgttagtttcgtttttataatttgcgacgtggtcggttttttttgttcggagaggacgttattttcgtcgagtttttgatttgttgttaggatcgcgacgggaattggagttcgaggttttcgcgcggttcgggtttggcgttttgaggggaagagcggttcggttcgaggtgagaggaatatgtttgggcgacgggaagttgaacgtataaatttgtttagagggtaagatgtttcgagtttcggggaaggatgaggatatat

SEQ ID NO: 9378 - DNA, 563 bp, Artificial Sequence
  chemically treated genomic DNA (Homo sapiens) CpG-island No: 9378
atatatcctcatccttccccgaaactcgaaacatcttaccctctaaacaaatttatacgttcaacttcccgtcgcccaaacatattcctctcacctcgaaccgaaccgctcttcccctcaaaacgccaaacccgaaccgcgcgaaaacctcgaactccaattcccgtcgcgatcctaacaacaaatcaaaaactcgacgaaaataacgtcctctccgaacaaaaaaaaccgaccacgtcgcaaattataaaaacgaaactaacgtcgcaaccaaaacaaaacgatactcgaactaactctcgaaatcaacgaaaaattacttccgaaacgacaccgaaaaactaaaacgaaaataacgtacgacatacgccgataacgtaataaaaaaacaacaacaacaacaacaacaactacgaaacgtaaataaaaactaaatcgtttcgaaaccaaacgttcaactcgcattcctacacacatcgcgaaaaccccacaaaaccaaaaatttaaaaactaaaaacttcgaactataacgcgcgaacctaaaaaactttaaacgacgcgac

SEQ ID NO: 9379 - DNA, 563 bp, Artificial Sequence
  chemically treated genomic DNA (Homo sapiens) CpG-island No: 9379
gtgtgtttttattttttttcggggttcggggtattttgttttttggataggtttgtgcgtttaatttttcgtcgtttaagtatgttttttttatttcgggtcgggtcgtttttttttttagggcgttaggttcgggtcgcgcggggatttcgggttttagttttcgtcgcgattttagtagtaggttagggattcggcggaaatgacgtttttttcgggtagaagaagtcggttacgtcgtagattataagggcggagttgacgtcgtagttagggtagggcgatattcgagttagttttcgagattagcgagaggttattttcggggcggtatcgagaagttgaaacggaagtggcgtacggtatgcgtcggtggcgtgatggagaggtagtagtagtagtaatagtaattgcgaaacgtaagtgagaattaagtcgtttcgaggttagacgtttagttcgtatttttgtatatatcgcgggaattttatagggttagggatttgagggttggaaatttcgggttatggcgcgcgggtttgggaaattttgggcggcgcgat

SEQ ID NO: 9380 - DNA, 563 bp, Artificial Sequence
  chemically treated genomic DNA (Homo sapiens) CpG-island No: 9380
atcgcgccgcccaaaatttcccaaacccgcgcgccataacccgaaatttccaaccctcaaatccctaaccctataaaattcccgcgatatatacaaaaatacgaactaaacgtctaacctcgaaacgacttaattctcacttacgtttcgcaattactattactactactactacctctccatcacgccaccgacgcataccgtacgccacttccgtttcaacttctcgataccgccccgaaaataacctctcgctaatctcgaaaactaactcgaatatcgccctaccctaactacgacgtcaactccgcccttataatctacgacgtaaccgacttcttctacccgaaaaaaacgtcatttccgccgaatccctaacctactactaaaatcgcgacgaaaactaaaacccgaaatccccgcgcgacccgaacctaacgccctaaaaaaaaaaacgacccgacccgaaataaaaaaaacatacttaaacgacgaaaaattaaacgcacaaacctatccaaaaaacaaaataccccgaaccccgaaaaaaaataaaaacacac

SEQ ID NO: 9381 - DNA, 525 bp, Artificial Sequence
  chemically treated genomic DNA (Homo sapiens) CpG-island No: 9381
tttcggagtcggaggtagttggcggagattcgggattcgagattcgggattcggttcgtcggttcgtcggttttttagtagtattaaggaggtagcgttcgtaggaggtggaggcgttggcgggggggcgtgcgggtgcggtaggggtgggtaggcggggtgggcggggttttcgcggcggcgggcggggcgtgggtgggttttttttattggagttattttttttttcggtcggttcgtagtttcgtttcggttttttttttcggtttgtgcggttagttcggcggcggcgtcggcgcggggataggcggaggcgcgggtagggtcgggcggacgggcgttggtagtagtagtagcgtcgcgggttttttagagtggtcgtagttcgagttttgttttcgtattttgttttaacgcggtgagtgcgacgggcgggttttaagggtgcgtttgtatttttgttagttcgggtttgggtcggagcgtttgtgggtgggggtatagatgatttttaaaagttgtgtt

SEQ ID NO: 9382 - DNA, 525 bp, Artificial Sequence
  chemically treated genomic DNA (Homo sapiens) CpG-island No: 9382
aacacaacttttaaaaatcatctatacccccacccacaaacgctccgacccaaacccgaactaacaaaaatacaaacgcacccttaaaacccgcccgtcgcactcaccgcgttaaaacaaaatacgaaaacaaaactcgaactacgaccactctaaaaaacccgcgacgctactactactaccaacgcccgtccgcccgaccctacccgcgcctccgcctatccccgcgccgacgccgccgccgaactaaccgcacaaaccgaaaaaaaaaaccgaaacgaaactacgaaccgaccgaaaaaaaaaataactccaataaaaaaaacccacccacgccccgcccgccgccgcgaaaaccccgcccaccccgcctacccacccctaccgcacccgcacgcccccccgccaacgcctccacctcctacgaacgctacctccttaatactactaaaaaaccgacgaaccgacgaaccgaatcccgaatctcgaatcccgaatctccgccaactacctccgactccgaaa

SEQ ID NO: 9383 - DNA, 525 bp, Artificial Sequence
  chemically treated genomic DNA (Homo sapiens) CpG-island No: 9383
ggtatagtttttgaaaattatttgtgtttttatttatagacgtttcgatttagattcgggttgataggaatataaacgtatttttggggttcgttcgtcgtatttatcgcgttggaataggatgcgagggtaaagttcggattgcggttattttgaagggttcgcggcgttgttattgttgttagcgttcgttcgttcggttttgttcgcgttttcgtttgttttcgcgtcggcgtcgtcgtcggattagtcgtataggtcggagggaggggtcggggcggggttgcggatcggtcgggggagggggtgattttagtagggaagatttatttacgtttcgttcgtcgtcgcggaggtttcgtttatttcgtttgtttatttttatcgtattcgtacgttttttcgttaacgtttttattttttgcggacgttgtttttttggtgttgttagggagtcggcgagtcggcgagtcggatttcggatttcggatttcggattttcgttagttgttttcggtttcggga

SEQ ID NO: 9384 - DNA, 525 bp, Artificial Sequence
  chemically treated genomic DNA (Homo sapiens) CpG-island No: 9384
tcccgaaaccgaaaacaactaacgaaaatccgaaatccgaaatccgaaatccgactcgccgactcgccgactccctaacaacaccaaaaaaacaacgtccgcaaaaaataaaaacgttaacgaaaaaacgtacgaatacgataaaaataaacaaacgaaataaacgaaacctccgcgacgacgaacgaaacgtaaataaatcttccctactaaaatcaccccctcccccgaccgatccgcaaccccgccccgacccctccctccgacctatacgactaatccgacgacgacgccgacgcgaaaacaaacgaaaacgcgaacaaaaccgaacgaacgaacgctaacaacaataacaacgccgcgaacccttcaaaataaccgcaatccgaactttaccctcgcatcctattccaacgcgataaatacgacgaacgaaccccaaaaatacgtttatattcctatcaacccgaatctaaatcgaaacgtctataaataaaaacacaaataattttcaaaaactatacc

SEQ ID NO: 9385 - DNA, 515 bp, Artificial Sequence
  chemically treated genomic DNA (Homo sapiens) CpG-island No: 9385
gcgcggcgggagtcgagattcgggggcgcgggggttcggggtcggaggcggcggaggtcggcgtcgtttcggggttcgcgtcggagtcgttgtagtttatcgggtcggtgggagaggcggcgaatagagtcgttttcgttttcgttcgcgtcgcgtatatttcggggtgacgttacgcgtttacgattcgtttcgtttgtttttgttagtgttttttagttcgtttttcgtttttttttatagtggatttgcgggttagaggaaataggttgtagggcggagatcgatttttggcgaattgcgttgtcgtagttatttcgttttagtttttgtcgtgtttcgcggcgatttcgtttagatcggaattagcgtgcgtttggttttttttcgtcgttttgggatattttattttgtttgacgtttaagatttggtttcgatatttatggttttatgtttttcgattacgggttgtttgtttgtttgtatcgttttaagtttttttatttagtttttt

SEQ ID NO: 9386 - DNA, 515 bp, Artificial Sequence
  chemically treated genomic DNA (Homo sapiens) CpG-island No: 9386
aaaaaactaaataaaaaaacttaaaacgatacaaacaaacaaacaacccgtaatcgaaaaacataaaaccataaatatcgaaaccaaatcttaaacgtcaaacaaaataaaatatcccaaaacgacgaaaaaaaaccaaacgcacgctaattccgatctaaacgaaatcgccgcgaaacacgacaaaaactaaaacgaaataactacgacaacgcaattcgccaaaaatcgatctccgccctacaacctatttcctctaacccgcaaatccactataaaaaaaaacgaaaaacgaactaaaaaacactaacaaaaacaaacgaaacgaatcgtaaacgcgtaacgtcaccccgaaatatacgcgacgcgaacgaaaacgaaaacgactctattcgccgcctctcccaccgacccgataaactacaacgactccgacgcgaaccccgaaacgacgccgacctccgccgcctccgaccccgaacccccgcgcccccgaatctcgactcccgccgcgc

SEQ ID NO: 9387 - DNA, 515 bp, Artificial Sequence
  chemically treated genomic DNA (Homo sapiens) CpG-island No: 9387
aaaaggttgaataagggaatttgaaacgatgtagataggtaggtaattcgtagtcgagggatatagggttataaatgtcgaagttaggttttgagcgttagatagaatgaggtgttttagagcggcggaggagagttagacgtacgttggtttcggtttggacggaatcgtcgcggagtacggtagaggttagggcggaatggttacggtagcgtagttcgttaaggatcggttttcgttttgtagtttattttttttaattcgtagatttattatgggaggaggcggggagcgggttggagagtattaatagagataggcggggcgagtcgtgggcgcgtgacgttatttcggggtgtgcgcggcgcgagcggaagcggaagcggttttgttcgtcgttttttttatcggttcgatgagttgtagcggtttcggcgcggatttcgaggcggcgtcggttttcgtcgttttcggtttcgggttttcgcgttttcgggtttcggttttcgtcgcgt

SEQ ID NO: 9388 - DNA, 515 bp, Artificial Sequence
  chemically treated genomic DNA (Homo sapiens) CpG-island No: 9388
acgcgacgaaaaccgaaacccgaaaacgcgaaaacccgaaaccgaaaacgacgaaaaccgacgccgcctcgaaatccgcgccgaaaccgctacaactcatcgaaccgataaaaaaaacgacgaacaaaaccgcttccgcttccgctcgcgccgcgcacaccccgaaataacgtcacgcgcccacgactcgccccgcctatctctattaatactctccaacccgctccccgcctcctcccataataaatctacgaattaaaaaaaataaactacaaaacgaaaaccgatccttaacgaactacgctaccgtaaccattccgccctaacctctaccgtactccgcgacgattccgtccaaaccgaaaccaacgtacgtctaactctcctccgccgctctaaaacacctcattctatctaacgctcaaaacctaacttcgacatttataaccctatatccctcgactacgaattacctacctatctacatcgtttcaaattcccttattcaacctttt

SEQ ID NO: 9389 - DNA, 534 bp, Artificial Sequence
  chemically treated genomic DNA (Homo sapiens) CpG-island No: 9389
ttcgcggtttgaaatagtttttattgttttcgcgagttatttattttgttttgcgaggaggtcgtaggcgaaggtcgtgagattacgggtttaaggttcgcggttattggggtcgtttcggtttatttaggtttttcgaatatgagggtcgggagggtagggtcgtcgagttttcgtttttttttacgtgtatagcgtttttttggaagtcggagcgtttagatttgttagaatcgattcggaaattaaagcgtgatagttaggggttgttagagcggtcggcgcggcgtagcgaattatcgagtttaattaggcgcggttagaagggtagggaggcggtgggaggggagggacggaggttcgcgttgtttaagagcgttacgggcggggcggggtcggcggcgggttgcgggcgcggtcggacgggagtttttcggagaaggattttgtagttcgagtttcggtgagtgcgagaggattcgcgttttttgttattttttattttttttgagttttaagtaaggaacggagtta

SEQ ID NO: 9390 - DNA, 534 bp, Artificial Sequence
  chemically treated genomic DNA (Homo sapiens) CpG-island No: 9390
taactccgttccttacttaaaactcaaaaaaaataaaaaataacaaaaaacgcgaatcctctcgcactcaccgaaactcgaactacaaaatccttctccgaaaaactcccgtccgaccgcgcccgcaacccgccgccgaccccgccccgcccgtaacgctcttaaacaacgcgaacctccgtccctcccctcccaccgcctccctacccttctaaccgcgcctaattaaactcgataattcgctacgccgcgccgaccgctctaacaacccctaactatcacgctttaatttccgaatcgattctaacaaatctaaacgctccgacttccaaaaaaacgctatacacgtaaaaaaaaacgaaaactcgacgaccctaccctcccgaccctcatattcgaaaaacctaaataaaccgaaacgaccccaataaccgcgaaccttaaacccgtaatctcacgaccttcgcctacgacctcctcgcaaaacaaaataaataactcgcgaaaacaataaaaactatttcaaaccgcgaa

SEQ ID NO: 9391 - DNA, 534 bp, Artificial Sequence
  chemically treated genomic DNA (Homo sapiens) CpG-island No: 9391
tggtttcgttttttatttgggatttaggagaagtgaggggtgatagggggcgcgggttttttcgtatttatcgggattcgggttgtaggattttttttcggggaattttcgttcggtcgcgttcgtagttcgtcgtcggtttcgtttcgttcgtggcgtttttgggtagcgcgggttttcgtttttttttttttatcgtttttttgtttttttagtcgcgtttggttaaattcgatggttcgttgcgtcgcgtcggtcgttttagtaatttttggttgttacgttttggttttcgggtcggttttggtaggtttgagcgtttcgatttttagaggagcgttgtgtacgtggagaagagcggggattcggcgattttgttttttcgatttttatgttcgaagagtttgagtgggtcgaggcggttttagtagtcgcgggttttgggttcgtaattttacgattttcgtttgcggttttttcgtaaaataaggtgagtgattcgcgggagtaatgggagttgttttaggtcgcgaa

SEQ ID NO: 9392 - DNA, 534 bp, Artificial Sequence
  chemically treated genomic DNA (Homo sapiens) CpG-island No: 9392
ttcgcgacctaaaacaactcccattactcccgcgaatcactcaccttattttacgaaaaaaccgcaaacgaaaatcgtaaaattacgaacccaaaacccgcgactactaaaaccgcctcgacccactcaaactcttcgaacataaaaatcgaaaaaacaaaatcgccgaatccccgctcttctccacgtacacaacgctcctctaaaaatcgaaacgctcaaacctaccaaaaccgacccgaaaaccaaaacgtaacaaccaaaaattactaaaacgaccgacgcgacgcaacgaaccatcgaatttaaccaaacgcgactaaaaaaacaaaaaaacgataaaaaaaaaaaaacgaaaacccgcgctacccaaaaacgccacgaacgaaacgaaaccgacgacgaactacgaacgcgaccgaacgaaaattccccgaaaaaaaatcctacaacccgaatcccgataaatacgaaaaaacccgcgccccctatcacccctcacttctcctaaatcccaaataaaaaacgaaacca

SEQ ID NO: 9393 - DNA, 819 bp, Artificial Sequence
  chemically treated genomic DNA (Homo sapiens) CpG-island No: 9393
gatagtagttgagggattgcggttcggttttttgttgggttcggtggtagcgttagatttcgcgggtgtgggtgtatttatttatatattggtgggcggtgtcgatttcgagggtattttcgcgttggatgcggttttagggcgtttgtatttggcgcggtttttggatttcgaagttggttcgtcgtggcgcgcgtttacggtacgcgttgaggggtcgggaggcgcgggcgcgcggttgttgcgagtgtaggtgtaagtgtaggacgagaatgagtatgcgttcgtttttgcgcgcgattcgttggcgttggcgttgttagagaattcggagttcggcgtagcgttgtatatttttcgcgcgtcggacgtcgacggtttcggttttaatagcgacgtgcgttatcgtttgttgcgttaggagtcgttcgtgtcggcgtttcgtttggacgcgcgtatcggggcgtttagcgtttcgcgcggtttggatcgagagattattttcgcgttgttgttgttggtggaagttatcgatcggttcgttaacgttagtcgtcgtcgtgtagcgcgcgttttagcgcgcgttttcgttacggatgagaatgataacgcgtttgttttcgtttcgtcgttacgcgtgcgttttttagaggattagtcgtttgggttcgcggttttgtacgtggtagttcgggattcggatttgggcgaggttgtacgcgtgttttatcggttggtatttggcggggacggttattttcggttgtatttaagtattggtgagagttaggtttgggagtgagggcgaggaaggtgttg

SEQ ID NO: 9394 - DNA, 819 bp, Artificial Sequence
  chemically treated genomic DNA (Homo sapiens) CpG-island No: 9394
caacaccttcctcgccctcactcccaaacctaactctcaccaatacttaaatacaaccgaaaataaccgtccccgccaaataccaaccgataaaacacgcgtacaacctcgcccaaatccgaatcccgaactaccacgtacaaaaccgcgaacccaaacgactaatcctctaaaaaacgcacgcgtaacgacgaaacgaaaacaaacgcgttatcattctcatccgtaacgaaaacgcgcgctaaaacgcgcgctacacgacgacgactaacgttaacgaaccgatcgataacttccaccaacaacaacaacgcgaaaataatctctcgatccaaaccgcgcgaaacgctaaacgccccgatacgcgcgtccaaacgaaacgccgacacgaacgactcctaacgcaacaaacgataacgcacgtcgctattaaaaccgaaaccgtcgacgtccgacgcgcgaaaaatatacaacgctacgccgaactccgaattctctaacaacgccaacgccaacgaatcgcgcgcaaaaacgaacgcatactcattctcgtcctacacttacacctacactcgcaacaaccgcgcgcccgcgcctcccgacccctcaacgcgtaccgtaaacgcgcgccacgacgaaccaacttcgaaatccaaaaaccgcgccaaatacaaacgccctaaaaccgcatccaacgcgaaaataccctcgaaatcgacaccgcccaccaatatataaataaatacacccacacccgcgaaatctaacgctaccaccgaacccaacaaaaaaccgaaccgcaatccctcaactactatc

SEQ ID NO: 9395 - DNA, 819 bp, Artificial Sequence
  chemically treated genomic DNA (Homo sapiens) CpG-island No: 9395
tagtatttttttcgtttttatttttagatttaatttttattagtgtttgagtgtagtcggaagtggtcgttttcgttagatgttagtcgataggatacgcgtgtagtttcgtttagattcgggtttcgggttattacgtgtagggtcgcgggtttaggcggttggttttttgggaggcgtacgcgtgacggcgaggcgaagataggcgcgttgttatttttattcgtgacgaagacgcgcgttgaaacgcgcgttgtacgacggcggttggcgttggcgggtcggtcggtggtttttattagtagtagtagcgcgggagtggtttttcggtttaggtcgcgcggagcgttgagcgtttcggtgcgcgcgtttaggcgaagcgtcggtacgggcggtttttggcgtagtaggcggtagcgtacgtcgttattggggtcggggtcgtcggcgttcgacgcgcggaaagtgtatagcgttgcgtcgggtttcgggttttttggtagcgttagcgttagcgggtcgcgcgtaaaggcgggcgtatgtttattttcgttttgtatttgtatttgtattcgtagtagtcgcgcgttcgcgtttttcggttttttagcgcgtatcgtgagcgcgcgttacggcgggttagtttcgaagtttaggggtcgcgttaggtataagcgttttgaggtcgtatttagcgcgaaggtgttttcgggatcggtatcgtttattagtgtgtaggtgagtgtatttatattcgcgggatttggcgttgttatcgagtttaatagagagtcgggtcgtagttttttagttgttgtt

SEQ ID NO: 9396 - DNA, 819 bp, Artificial Sequence
  chemically treated genomic DNA (Homo sapiens) CpG-island No: 9396
aacaacaactaaaaaactacgacccgactctctattaaactcgataacaacgccaaatcccgcgaatataaatacactcacctacacactaataaacgataccgatcccgaaaacaccttcgcgctaaatacgacctcaaaacgcttatacctaacgcgacccctaaacttcgaaactaacccgccgtaacgcgcgctcacgatacgcgctaaaaaaccgaaaaacgcgaacgcgcgactactacgaatacaaatacaaatacaaaacgaaaataaacatacgcccgcctttacgcgcgacccgctaacgctaacgctaccaaaaaacccgaaacccgacgcaacgctatacactttccgcgcgtcgaacgccgacgaccccgaccccaataacgacgtacgctaccgcctactacgccaaaaaccgcccgtaccgacgcttcgcctaaacgcgcgcaccgaaacgctcaacgctccgcgcgacctaaaccgaaaaaccactcccgcgctactactactaataaaaaccaccgaccgacccgccaacgccaaccgccgtcgtacaacgcgcgtttcaacgcgcgtcttcgtcacgaataaaaataacaacgcgcctatcttcgcctcgccgtcacgcgtacgcctcccaaaaaaccaaccgcctaaacccgcgaccctacacgtaataacccgaaacccgaatctaaacgaaactacacgcgtatcctatcgactaacatctaacgaaaacgaccacttccgactacactcaaacactaataaaaattaaatctaaaaataaaaacgaaaaaaatacta

SEQ ID NO: 9397 - DNA, 651 bp, Artificial Sequence
  chemically treated genomic DNA (Homo sapiens) CpG-island No: 9397
gcgagagcggttggttgtattggcggtataggttttttcggagcggttatatgagaatgtatagttggaattggtttttgaggtggacggtttgcggcgatcggtgtttaatttgggcgtattgtttattacgagcgttattgtatacgaaacggtggttacgggagagggtttgcgttaggcgttagtgggttagtttgtttcgtttattgttattattaaagataaggacgggcggttggtgcgtataggtagcgttgagttgcgtgtagagattatcggttcggacggtacgcgtttttcggtgttagtggtggattataagaatggtatatatgagttagtgtatatagcgcgtacggaaggcgagttgtttttttcggtgttgttttacggatagatagtgcgcggtagtttttttcgcgtgcgtgttttgcgttcggggggatttgttatttttttcggacgatgtgaagcgtcgtgttaagttttttggcggtttcgatagttatgtgcgttagaaggtagtgcgtaggtttagttttatgtatagtataggcggtaaacgaaaggataatttaattgaggatgagttcgtttttcgtgttggtatagatagtcgagggtagagttagatgggttaggtttagg

SEQ ID NO: 9398 - DNA, 651 bp, Artificial Sequence
  chemically treated genomic DNA (Homo sapiens) CpG-island No: 9398
cctaaacctaacccatctaactctaccctcgactatctataccaacacgaaaaacgaactcatcctcaattaaattatcctttcgtttaccgcctatactatacataaaactaaacctacgcactaccttctaacgcacataactatcgaaaccgccaaaaaacttaacacgacgcttcacatcgtccgaaaaaaataacaaatccccccgaacgcaaaacacgcacgcgaaaaaaactaccgcgcactatctatccgtaaaacaacaccgaaaaaaacaactcgccttccgtacgcgctatatacactaactcatatataccattcttataatccaccactaacaccgaaaaacgcgtaccgtccgaaccgataatctctacacgcaactcaacgctacctatacgcaccaaccgcccgtccttatctttaataataacaataaacgaaacaaactaacccactaacgcctaacgcaaaccctctcccgtaaccaccgtttcgtatacaataacgctcgtaataaacaatacgcccaaattaaacaccgatcgccgcaaaccgtccacctcaaaaaccaattccaactatacattctcatataaccgctccgaaaaaacctataccgccaatacaaccaaccgctctcgc

SEQ ID NO: 9399 - DNA, 651 bp, Artificial Sequence
  chemically treated genomic DNA (Homo sapiens) CpG-island No: 9399
tttgagtttggtttatttggttttgttttcggttgtttgtattaatacggaagacgagtttatttttaattgggttgttttttcgtttgtcgtttgtgttgtatatggagttgggtttacgtattgttttttggcgtatatggttgtcggggtcgttaggggatttgatacggcgttttatatcgttcggggaaggtggtaggttttttcggacgtagggtacgtacgcggaaggggttgtcgcgtattgtttgttcgtagagtagtatcgagaggagtagttcgtttttcgtgcgcgttgtgtatattagtttatatgtgttatttttgtggtttattattggtatcggaaggcgcgtgtcgttcgggtcggtgatttttgtacgtagtttagcgttgtttgtgcgtattaatcgttcgtttttgtttttggtagtgatagtgagcgaggtaggttggtttattagcgtttggcgtaggttttttttcgtggttatcgtttcgtgtgtagtggcgttcgtggtgagtagtgcgtttagattgagtatcgatcgtcgtagatcgtttattttaaggattagttttagttgtgtatttttatgtggtcgtttcgggaaggtttgtgtcgttaatgtagttagtcgttttcgt

SEQ ID NO: 9400 - DNA, 651 bp, Artificial Sequence
  chemically treated genomic DNA (Homo sapiens) CpG-island No: 9400
acgaaaacgactaactacattaacgacacaaaccttcccgaaacgaccacataaaaatacacaactaaaactaatccttaaaataaacgatctacgacgatcgatactcaatctaaacgcactactcaccacgaacgccactacacacgaaacgataaccacgaaaaaaaacctacgccaaacgctaataaaccaacctacctcgctcactatcactaccaaaaacaaaaacgaacgattaatacgcacaaacaacgctaaactacgtacaaaaatcaccgacccgaacgacacgcgccttccgataccaataataaaccacaaaaataacacatataaactaatatacacaacgcgcacgaaaaacgaactactcctctcgatactactctacgaacaaacaatacgcgacaaccccttccgcgtacgtaccctacgtccgaaaaaacctaccaccttccccgaacgatataaaacgccgtatcaaatcccctaacgaccccgacaaccatatacgccaaaaaacaatacgtaaacccaactccatatacaacacaaacgacaaacgaaaaaacaacccaattaaaaataaactcgtcttccgtattaatacaaacaaccgaaaacaaaaccaaataaaccaaactcaaa

SEQ ID NO: 9401 - DNA, 529 bp, Artificial Sequence
  chemically treated genomic DNA (Homo sapiens) CpG-island No: 9401
  misc_feature (294)..(294): n is either a, c, g or t
atattttttttatacgttttcgtacgcgtttttagagatgacgttagtcggaatattttttcgtcgtttttatatgtttaaattacgatagtagtttagattttatatattatcgagtcgatcgacgttcgttatttttcggcgtaatcggtttttttttatgacgggtagtcgtattttttttattttgatttttatttcgtcgtcggtaacgatagttatagtttttcgtttttataaaacgattttaaaatgaattattttaacgattttttttcgttcgtattacgattntttttttttttattatatatatttatttttattattattttttttcgtttcggaattatgttttagatattttttcgattatatttagttagagattttattattatcgaaaaagtatttaatttttaattattattaattattgatttatatcggtttttttcgcgtcgttcgttattttattattattttttatattatcgatattacgggtagttagaaaatattatagttt

SEQ ID NO: 9402 - DNA, 529 bp, Artificial Sequence
  chemically treated genomic DNA (Homo sapiens) CpG-island No: 9402
  misc_feature (236)..(236): n is either a, c, g or t
aaactataatattttctaactacccgtaatatcgataatataaaaaataataataaaataacgaacgacgcgaaaaaaaccgatataaatcaataattaataataattaaaaattaaatactttttcgataataataaaatctctaactaaatataatcgaaaaaatatctaaaacataattccgaaacgaaaaaaaataataataaaaataaatatatataataaaaaaaaaaanaatcgtaatacgaacgaaaaaaaatcgttaaaataattcattttaaaatcgttttataaaaacgaaaaactataactatcgttaccgacgacgaaataaaaatcaaaataaaaaaaatacgactacccgtcataaaaaaaaaccgattacgccgaaaaataacgaacgtcgatcgactcgataatatataaaatctaaactactatcgtaatttaaacatataaaaacgacgaaaaaatattccgactaacgtcatctctaaaaacgcgtacgaaaacgtataaaaaaaatat

SEQ ID NO: 9403 - DNA, 529 bp, Artificial Sequence
  chemically treated genomic DNA (Homo sapiens) CpG-island No: 9403
  misc_feature (236)..(236): n is either a, c, g or t
gggttgtagtgttttttggttattcgtagtgtcggtggtgtgagaggtggtaatggagtagcgagcggcgcgagggggatcggtatgggttagtggttagtagtggttgaaggttggatattttttcggtggtaatggagtttttgattgggtgtagtcggggggatgtttgaggtatagtttcggggcggaggggggtagtgatggaggtggatgtgtgtggtggggaggggggngatcgtagtgcgggcgagggggaatcgttagagtgatttattttgaagtcgttttgtggaagcggggggttgtgattatcgttgtcggcggcggggtgggagttaagatgggggggatgcggttgttcgttatgggaggagatcggttgcgtcgaggagtggcggacgtcggtcgattcggtggtgtgtgaggtttaggttgttgtcgtggtttgggtatgtgggggcggcgagggggtgtttcgattaacgttatttttgggggcgcgtacgggggcgtatagggggaatgt

SEQ ID NO: 9404 - DNA, 529 bp, Artificial Sequence
  chemically treated genomic DNA (Homo sapiens) CpG-island No: 9404
  misc_feature (294)..(294): n is either a, c, g or t
acattccccctatacgcccccgtacgcgcccccaaaaataacgttaatcgaaacaccccctcgccgcccccacatacccaaaccacgacaacaacctaaacctcacacaccaccgaatcgaccgacgtccgccactcctcgacgcaaccgatctcctcccataacgaacaaccgcatcccccccatcttaactcccaccccgccgccgacaacgataatcacaaccccccgcttccacaaaacgacttcaaaataaatcactctaacgattccccctcgcccgcactacgatcncccccctccccaccacacacatccacctccatcactacccccctccgccccgaaactatacctcaaacatccccccgactacacccaatcaaaaactccattaccaccgaaaaaatatccaaccttcaaccactactaaccactaacccataccgatccccctcgcgccgctcgctactccattaccacctctcacaccaccgacactacgaataaccaaaaaacactacaaccc

SEQ ID NO: 9405 - DNA, 749 bp, Artificial Sequence
  chemically treated genomic DNA (Homo sapiens) CpG-island No: 9405
  misc_feature (663)..(664): n is either a, c, g or t
acggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgtttgggtcggatcgtgaaacgttgttgtgcggtgtgaaagcgttgtttgtcggttatgaggtttttgggtttggtgatcggatttgtgtggggtttgggggcgtatcggggtttgtgtttttcggttagggttgttagtggtttnnggattggtcggggtttttaacgggtttttttggtgttcgtttttttatttgacgagtttttgtcgagtttgatttatattttggg

SEQ ID NO: 9406 - DNA, 749 bp, Artificial Sequence
  chemically treated genomic DNA (Homo sapiens) CpG-island No: 9406
  misc_feature (86)..(87): n is either a, c, g or t
cccaaaatataaatcaaactcgacaaaaactcgtcaaataaaaaaacgaacaccaaaaaaacccgttaaaaaccccgaccaatccnnaaaccactaacaaccctaaccgaaaaacacaaaccccgatacgcccccaaaccccacacaaatccgatcaccaaacccaaaaacctcataaccgacaaacaacgctttcacaccgcacaacaacgtttcacgatccgacccaaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgt

SEQ ID NO: 9407 - DNA, 749 bp, Artificial Sequence
  chemically treated genomic DNA (Homo sapiens) CpG-island No: 9407
  misc_feature (86)..(87): n is either a, c, g or t
tttaagatgtgaattaagttcggtaaaagttcgttaaatggagaagcgaatattagaaaagttcgttaaagatttcggttaatttnnaagttattgataattttgatcggaaaatataaatttcgatgcgtttttaagttttatatagattcggttattaaatttagaagttttatgatcggtagatagcgtttttatatcgtataataacgttttacggttcgatttaagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgt

SEQ ID NO: 9408 - DNA, 749 bp, Artificial Sequence
  chemically treated genomic DNA (Homo sapiens) CpG-island No: 9408
  misc_feature (663)..(664): n is either a, c, g or t
acgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatacttaaatcgaaccgtaaaacgttattatacgatataaaaacgctatctaccgatcataaaacttctaaatttaataaccgaatctatataaaacttaaaaacgcatcgaaatttatattttccgatcaaaattatcaataacttnnaaattaaccgaaatctttaacgaacttttctaatattcgcttctccatttaacgaacttttaccgaacttaattcacatcttaaa

SEQ ID NO: 9409 - DNA, 932 bp, Artificial Sequence
  chemically treated genomic DNA (Homo sapiens) CpG-island No: 9409
  misc_feature (425)..(425): n is either a, c, g or t
  misc_feature (510)..(510): n is either a, c, g or t
  misc_feature (729)..(729): n is either a, c, g or t
cgtgcgcggcggggagggggtagttcggggcgtttcggcgggttttaagggttgattttcgtttcggaagtgcgcgtaaggtttacggttcgtagggggcgttgtcgcgtcgtttagtcgtcgtcgttcgggtcgtttatttcgcgggcgcgtttttacgtagattaacgtcgttcggatcgggattcgttcgcgtagatttttcgggcggattgaggacgtcgtcgttcggggtcgtttttgtgttcgtttttagcgttcgtttagttcgtcgttcgcgtttcggtggcgggttcgacgttcgtatttcgttcgtgtttaggcgtagagttttcgtttcggggagttttttggtcgtcggcgggtttcgcggttcgcgcgttcggcgttttgttcgtcgggtagaggggaaggcggcggtcggnttggggatgggcggttcggttgcgtcgaggggcgtcgggaggtttcgcgcgttgttgttggcgttggtggtcgcggggatttttngcgggcgtttataatttcgattcgtagcgtttcgtgtatttttagggtttcgttgattcgtttttcggttacgtagttttggagtatttttacgataatacgcgttggtgagtgttcgttcgatttcgcgattttggttcgcgcggttatcgtttcggtttttaggttagcgtcgtcgtcgttttttcggttttttttacgtcgtcgtttcgagggggncgatttaaatgttttcgttgcgcgcggttcggtcgtcgggggacggcgggagaagggaggacgtcgttcggggttcgttaaggtcggggtcggcgtttggaggcgggcgggggcgttcgggtgtttttttggggttttagtttagagcgtggggggagagtcgttagagttgtttttttcgtcgtttagttagattcggtttt

SEQ ID NO: 9410 - DNA, 932 bp, Artificial Sequence
  chemically treated genomic DNA (Homo sapiens) CpG-island No: 9410
  misc_feature (204)..(204): n is either a, c, g or t
  misc_feature (423)..(423): n is either a, c, g or t
  misc_feature (508)..(508): n is either a, c, g or t
aaaaccgaatctaactaaacgacgaaaaaaacaactctaacgactctccccccacgctctaaactaaaaccccaaaaaaacacccgaacgcccccgcccgcctccaaacgccgaccccgaccttaacgaaccccgaacgacgtcctcccttctcccgccgtcccccgacgaccgaaccgcgcgcaacgaaaacatttaaatcgnccccctcgaaacgacgacgtaaaaaaaaccgaaaaaacgacgacgacgctaacctaaaaaccgaaacgataaccgcgcgaaccaaaatcgcgaaatcgaacgaacactcaccaacgcgtattatcgtaaaaatactccaaaactacgtaaccgaaaaacgaatcaacgaaaccctaaaaatacacgaaacgctacgaatcgaaattataaacgcccgcnaaaaatccccgcgaccaccaacgccaacaacaacgcgcgaaacctcccgacgcccctcgacgcaaccgaaccgcccatccccaanccgaccgccgccttcccctctacccgacgaacaaaacgccgaacgcgcgaaccgcgaaacccgccgacgaccaaaaaactccccgaaacgaaaactctacgcctaaacacgaacgaaatacgaacgtcgaacccgccaccgaaacgcgaacgacgaactaaacgaacgctaaaaacgaacacaaaaacgaccccgaacgacgacgtcctcaatccgcccgaaaaatctacgcgaacgaatcccgatccgaacgacgttaatctacgtaaaaacgcgcccgcgaaataaacgacccgaacgacgacgactaaacgacgcgacaacgccccctacgaaccgtaaaccttacgcgcacttccgaaacgaaaatcaacccttaaaacccgccgaaacgccccgaactaccccctccccgccgcgcacg

SEQ ID NO: 9411 - DNA, 932 bp, Artificial Sequence
  chemically treated genomic DNA (Homo sapiens) CpG-island No: 9411
  misc_feature (204)..(204): n is either a, c, g or t
  misc_feature (423)..(423): n is either a, c, g or t
  misc_feature (508)..(508): n is either a, c, g or t
gaagtcgagtttagttgggcggcggaggagataattttagcggttttttttttacgttttgggttgggattttagggaggtattcggacgttttcgttcgtttttaggcgtcgatttcgattttagcgggtttcggacggcgtttttttttttttcgtcgtttttcggcggtcgagtcgcgcgtaacggagatatttaaatcgnttttttcgggacggcggcgtggaagagatcggaaaggcggcggcggcgttggtttgggggtcggggcggtggtcgcgcgggttagggtcgcggagtcgggcgggtatttattagcgcgtgttgtcgtggaaatgttttagaattgcgtagtcgaagaacgagttagcggggttttggaagtgtacggggcgttgcgggtcgaggttgtaggcgttcgtnggggattttcgcgattattagcgttagtagtagcgcgcggagtttttcggcgtttttcggcgtagtcgggtcgtttatttttagntcggtcgtcgtttttttttttgttcggcgagtagggcgtcgagcgcgcgggtcgcggggttcgtcgacggttaggaagtttttcggggcgggagttttgcgtttggatacgggcggaatgcgggcgtcgggttcgttatcggggcgcggacggcgggttgagcgggcgttgaaggcgagtataggggcggtttcgagcggcggcgtttttagttcgttcgagaagtttgcgcgagcgggtttcggttcgggcggcgttggtttgcgtaggggcgcgttcgcgaggtgggcggttcgggcggcggcggttggacggcgcggtagcgttttttgcgggtcgtgagttttgcgcgtattttcggggcgggagttagtttttgggattcgtcggggcgtttcgaattgtttttttttcgtcgcgtacg

SEQ ID NO: 9412 - DNA, 932 bp, Artificial Sequence
  chemically treated genomic DNA (Homo sapiens) CpG-island No: 9412
  misc_feature (425)..(425): n is either a, c, g or t
  misc_feature (510)..(510): n is either a, c, g or t
  misc_feature (729)..(729): n is either a, c, g or t
cgtacgcgacgaaaaaaaaacaattcgaaacgccccgacgaatcccaaaaactaactcccgccccgaaaatacgcgcaaaactcacgacccgcaaaaaacgctaccgcgccgtccaaccgccgccgcccgaaccgcccacctcgcgaacgcgcccctacgcaaaccaacgccgcccgaaccgaaacccgctcgcgcaaacttctcgaacgaactaaaaacgccgccgctcgaaaccgcccctatactcgccttcaacgcccgctcaacccgccgtccgcgccccgataacgaacccgacgcccgcattccgcccgtatccaaacgcaaaactcccgccccgaaaaacttcctaaccgtcgacgaaccccgcgacccgcgcgctcgacgccctactcgccgaacaaaaaaaaaaacgacgaccganctaaaaataaacgacccgactacgccgaaaaacgccgaaaaactccgcgcgctactactaacgctaataatcgcgaaaatccccnacgaacgcctacaacctcgacccgcaacgccccgtacacttccaaaaccccgctaactcgttcttcgactacgcaattctaaaacatttccacgacaacacgcgctaataaatacccgcccgactccgcgaccctaacccgcgcgaccaccgccccgacccccaaaccaacgccgccgccgcctttccgatctcttccacgccgccgtcccgaaaaaancgatttaaatatctccgttacgcgcgactcgaccgccgaaaaacgacgaaaaaaaaaaaaacgccgtccgaaacccgctaaaatcgaaatcgacgcctaaaaacgaacgaaaacgtccgaatacctccctaaaatcccaacccaaaacgtaaaaaaaaaaccgctaaaattatctcctccgccgcccaactaaactcgacttc

SEQ ID NO: 9413 - DNA, 1013 bp, Artificial Sequence
  chemically treated genomic DNA (Homo sapiens) CpG-island No: 9413
  misc_feature (566)..(566): n is either a, c, g or t
cgtacgttcgtttcgcgtttagttttcgttttatttttttatacgcggagataaaaggtttttatagttaagtagcggttacggtcgtcgggttcgggttagacgtttttttgcgtcgtttttttttaagattttcgtagttatcgtttcgattttcgttcgtcgcgtttattaagttcgtcgcgtagatttcggggtttatcgtaggggtatatacgttcggcggggtagggacgacgttcgggtcggcgttttttttcgcgggattgcgcggcggcgatagtggtttcgcgttcgtttattttcgggcggtcgtggcggtagttttagcggttttttcgtgttttttcgtttttagtagtttcgtatcgtcgtcgtcgtcgttttttttcgcgtttcggtcgagttttcgtttttttttatcgtcgtcgtcgcgggttcggttgcgcgttacgtgatcgcgttacgtgattcggcgcggcgagcggcgtttttttcggcggcgttatcgtttcggtttttatcgtcggtcgttggcgtttttcggtcgtttttttttttcggtntagggttcgcgtttttaacgttatttcgcgggtcgtcgcgtcgttcgttatcggagtcgtcgtttggttcgggttatttgttcgtattttcggcgtcgttatttcgggagattttcgttttcggttcgtatcgcgttacggtgtttaagatgtttatagtgtcgggtttaggtttttagttttttggttcgggacggttttagtattcgggtatcgcgcggtttgcgcgtcgtttgaatttcgtttgagtcggaagtggacgttttagttttattatgttttatagggaaagtcgtcgggagtatagaagcgttgttattatcgattcgcgtagtttttcgggaaaacggttattcgagtggtcgcgatggtaatattttagaggattttttttttagttgtttatggagaaaggatcggatagcgttattttaatttagggaagaa

SEQ ID NO: 9414 - DNA, 1013 bp, Artificial Sequence
  chemically treated genomic DNA (Homo sapiens) CpG-island No: 9414
  misc_feature (448)..(448): n is either a, c, g or t
ttcttccctaaattaaaataacgctatccgatcctttctccataaacaactaaaaaaaaaatcctctaaaatattaccatcgcgaccactcgaataaccgttttcccgaaaaactacgcgaatcgataataacaacgcttctatactcccgacgactttccctataaaacataataaaactaaaacgtccacttccgactcaaacgaaattcaaacgacgcgcaaaccgcgcgatacccgaatactaaaaccgtcccgaaccaaaaaactaaaaacctaaacccgacactataaacatcttaaacaccgtaacgcgatacgaaccgaaaacgaaaatctcccgaaataacgacgccgaaaatacgaacaaataacccgaaccaaacgacgactccgataacgaacgacgcgacgacccgcgaaataacgttaaaaacgcgaaccctanaccgaaaaaaaaaaacgaccgaaaaacgccaacgaccgacgataaaaaccgaaacgataacgccgccgaaaaaaacgccgctcgccgcgccgaatcacgtaacgcgatcacgtaacgcgcaaccgaacccgcgacgacgacgataaaaaaaaacgaaaactcgaccgaaacgcgaaaaaaaacgacgacgacgacgatacgaaactactaaaaacgaaaaaacacgaaaaaaccgctaaaactaccgccacgaccgcccgaaaataaacgaacgcgaaaccactatcgccgccgcgcaatcccgcgaaaaaaaacgccgacccgaacgtcgtccctaccccgccgaacgtatatacccctacgataaaccccgaaatctacgcgacgaacttaataaacgcgacgaacgaaaatcgaaacgataactacgaaaatcttaaaaaaaaacgacgcaaaaaaacgtctaacccgaacccgacgaccgtaaccgctacttaactataaaaaccttttatctccgcgtataaaaaaataaaacgaaaactaaacgcgaaacgaacgtacg

SEQ ID NO: 9415 - DNA, 1013 bp, Artificial Sequence
  chemically treated genomic DNA (Homo sapiens) CpG-island No: 9415
  misc_feature (448)..(448): n is either a, c, g or t
tttttttttgagttaaaatgacgttattcggttttttttttatggataattgaagaagagattttttgggatgttattatcgcggttattcgggtgatcgttttttcggggagttgcgcgggtcggtggtgatagcgtttttgtgttttcggcggttttttttgtaagatataatgggattgggacgtttattttcggtttaaacgaagtttagacggcgcgtaagtcgcgcggtgttcgggtgttgaggtcgtttcgagttaggagattggaggtttaggttcggtattgtgggtattttgggtatcgtggcgcggtgcgggtcgggggcgggggtttttcggggtggcgacgtcgggggtgcgagtaggtggttcgggttaggcggcggtttcggtggcgggcggcgcggcggttcgcggggtggcgttggggacgcgagttttgngtcggggagggagggcggtcggggggcgttaacggtcggcggtgggggtcggggcggtagcgtcgtcgggggaggcgtcgttcgtcgcgtcgggttacgtggcgcggttacgtggcgcgtagtcgggttcgcggcggcggcggtgaaggaaggcggagattcggtcgagacgcggggggaggcggcggcggcggcgatgcggggttgttggaggcggagaggtacggaggagtcgttggggttgtcgttacggtcgttcggaggtgagcgggcgcggggttattgtcgtcgtcgcgtagtttcgcgggagggggcgtcggttcgagcgtcgtttttgtttcgtcgggcgtgtgtgtttttgcggtgggtttcggggtttgcgcggcgggtttggtgggcgcggcgggcgggggtcggggcggtggttgcgggagttttgggagggggcggcgtaagggggcgtttgattcgggttcggcggtcgtggtcgttgtttggttgtgggagttttttgttttcgcgtgtgagaaaatggggcgaaagttgagcgcggggcgggcgtgcg

SEQ ID NO: 9416 - DNA, 1013 bp, Artificial Sequence
  chemically treated genomic DNA (Homo sapiens) CpG-island No: 9416
  misc_feature (566)..(566): n is either a, c, g or t
cgcacgcccgccccgcgctcaactttcgccccattttctcacacgcgaaaacaaaaaactcccacaaccaaacaacgaccacgaccgccgaacccgaatcaaacgcccccttacgccgccccctcccaaaactcccgcaaccaccgccccgacccccgcccgccgcgcccaccaaacccgccgcgcaaaccccgaaacccaccgcaaaaacacacacgcccgacgaaacaaaaacgacgctcgaaccgacgccccctcccgcgaaactacgcgacgacgacaataaccccgcgcccgctcacctccgaacgaccgtaacgacaaccccaacgactcctccgtacctctccgcctccaacaaccccgcatcgccgccgccgccgcctccccccgcgtctcgaccgaatctccgccttccttcaccgccgccgccgcgaacccgactacgcgccacgtaaccgcgccacgtaacccgacgcgacgaacgacgcctcccccgacgacgctaccgccccgacccccaccgccgaccgttaacgccccccgaccgccctccctccccgacncaaaactcgcgtccccaacgccaccccgcgaaccgccgcgccgcccgccaccgaaaccgccgcctaacccgaaccacctactcgcacccccgacgtcgccaccccgaaaaacccccgcccccgacccgcaccgcgccacgatacccaaaatacccacaataccgaacctaaacctccaatctcctaactcgaaacgacctcaacacccgaacaccgcgcgacttacgcgccgtctaaacttcgtttaaaccgaaaataaacgtcccaatcccattatatcttacaaaaaaaaccgccgaaaacacaaaaacgctatcaccaccgacccgcgcaactccccgaaaaaacgatcacccgaataaccgcgataataacatcccaaaaaatctcttcttcaattatccataaaaaaaaaaccgaataacgtcattttaactcaaaaaaaaa

SEQ ID NO: 9417 - DNA, 505 bp, Artificial Sequence
  chemically treated genomic DNA (Homo sapiens) CpG-island No: 9417
cgtttagtcgagcgttagttggtcggttcggttcgcgcgttagacggcggtgttcggtcgtgttcggtttttgttttttttatttttcgttttttatcgcgtttagttgcgtcgacgttttcgttcgtttttatattatttttgtttttacgttttatttgtcggtaggcggatttagttcgtgtttaattgttcgtcggatttcgttgtttggggagttttatttttttcgcggttttcggtcgggattttttattcggcggttggcggttcgtgatttcgttttttcggttcgttttgggttcgtttttcgtcggttggttttatttataatagcgtttttagcgcgatggcgtatcggcgtaggcgtattttgtcggtaacgtcgaggcgtttttgtatttgtgggtcgaggtgtgtggcgagcgttcgagcggttggggaaagtggggtgtgggaatattgaggggttttaaagaaaggggagaggaagagaaaagtttta

SEQ ID NO: 9418 - DNA, 505 bp, Artificial Sequence
  chemically treated genomic DNA (Homo sapiens) CpG-island No: 9418
taaaacttttctcttcctctcccctttctttaaaacccctcaatattcccacaccccactttccccaaccgctcgaacgctcgccacacacctcgacccacaaatacaaaaacgcctcgacgttaccgacaaaatacgcctacgccgatacgccatcgcgctaaaaacgctattataaataaaaccaaccgacgaaaaacgaacccaaaacgaaccgaaaaaacgaaatcacgaaccgccaaccgccgaataaaaaatcccgaccgaaaaccgcgaaaaaaataaaactccccaaacaacgaaatccgacgaacaattaaacacgaactaaatccgcctaccgacaaataaaacgtaaaaacaaaaataatataaaaacgaacgaaaacgtcgacgcaactaaacgcgataaaaaacgaaaaataaaaaaaacaaaaaccgaacacgaccgaacaccgccgtctaacgcgcgaaccgaaccgaccaactaacgctcgactaaacg

SEQ ID NO: 9419 - DNA, 505 bp, Artificial Sequence
  chemically treated genomic DNA (Homo sapiens) CpG-island No: 9419
tggggttttttttttttttttttttttttttgggattttttagtgtttttatattttattttttttagtcgttcggacgttcgttatatatttcggtttatagatgtagaagcgtttcggcgttgtcggtagagtgcgtttgcgtcgatacgttatcgcgttagggacgttattgtgggtggagttagtcggcgggaggcgggtttagagcgggtcgagggggcggggttacgagtcgttagtcgtcgggtggagggtttcggtcgggagtcgcggaaagagtagggttttttagataacggggttcgacgagtagttgggtacgggttgagttcgtttgtcggtaggtaggacgtgaaggtaggggtggtgtgggggcggacgggggcgtcggcgtagttgggcgcggtggggagcggagaatggggagggtagggatcgggtacggtcgagtatcgtcgtttggcgcgcggatcggatcgattagttgacgttcggttgggcg

SEQ ID NO: 9420 - DNA, 505 bp, Artificial Sequence
  chemically treated genomic DNA (Homo sapiens) CpG-island No: 9420
cgcccaaccgaacgtcaactaatcgatccgatccgcgcgccaaacgacgatactcgaccgtacccgatccctaccctccccattctccgctccccaccgcgcccaactacgccgacgcccccgtccgcccccacaccacccctaccttcacgtcctacctaccgacaaacgaactcaacccgtacccaactactcgtcgaaccccgttatctaaaaaaccctactctttccgcgactcccgaccgaaaccctccacccgacgactaacgactcgtaaccccgccccctcgacccgctctaaacccgcctcccgccgactaactccacccacaataacgtccctaacgcgataacgtatcgacgcaaacgcactctaccgacaacgccgaaacgcttctacatctataaaccgaaatatataacgaacgtccgaacgactaaaaaaaataaaatataaaaacactaaaaaatcccaaaaaaaaaaaaaaaaaaaaaaaaaacccca

SEQ ID NO: 9421 - DNA, 915 bp, Artificial Sequence
  chemically treated genomic DNA (Homo sapiens) CpG-island No: 9421
gggtattgttttatatcgtaattttcgttagagtagtcgttttcgtatatatatcgtttatttaggtattggtcgcggtttcggtagttttcggggtagttgcgcgtgttgtagtttttttttgagtagtttgcgttatatacgtatacgttattttcgtaaaggtcgtgtttacggtagttttcgggatagcgacggtttttatagtttttatcggtgaagttcgggttgtatacgtagtggttatttacgtagcgttcgcgttcgcgatagtcgttaggataggcgcgcgtgtcgtagtttcggtttgtgtatttcggttaatatatgtagcggttatttttatagcggtttcggttacgatagtttttaggatagttgcgtatatcgtagttttcgtcgttgtagttcgtattgtaaatatatacgtcgttttcgtagcgttcgcgatttttatagtcgcgtgggtaggcgcgcgagtcgtaatcggttttagtgtatttcggttagtatacgtagcggtcgttttcgtagcggtttttttggttgtagtcgttagggtagttgcgtacgtcgtagtcgttttcgttgtagttcgtgtcgtaaatgtattcgtcgttttcgtagcgttcgcggtttcggtagtttttcggatatgttcgcgtgttgtagttttcgtttgtgtattcgggttagtatacgtagcggtcgtttacgtagcgttcgttttcgttatagttttaggggtagtttcgcgtattatagttttcgttagtgtagtcggggttatatacgtagcgttcgtttttgtagcgttttcgttggttgtagtttcgagggtagttttttattttatagttttcgttagtgtagtcggggttatatacgtagcgtttatttttatagcgttttttt

SEQ ID NO: 9422 - DNA, 915 bp, Artificial Sequence
  chemically treated genomic DNA (Homo sapiens) CpG-island No: 9422
aaaaaaacgctataaaaataaacgctacgtatataaccccgactacactaacgaaaactataaaataaaaaactaccctcgaaactacaaccaacgaaaacgctacaaaaacgaacgctacgtatataaccccgactacactaacgaaaactataatacgcgaaactacccctaaaactataacgaaaacgaacgctacgtaaacgaccgctacgtatactaacccgaatacacaaacgaaaactacaacacgcgaacatatccgaaaaactaccgaaaccgcgaacgctacgaaaacgacgaatacatttacgacacgaactacaacgaaaacgactacgacgtacgcaactaccctaacgactacaaccaaaaaaaccgctacgaaaacgaccgctacgtatactaaccgaaatacactaaaaccgattacgactcgcgcgcctacccacgcgactataaaaatcgcgaacgctacgaaaacgacgtatatatttacaatacgaactacaacgacgaaaactacgatatacgcaactatcctaaaaactatcgtaaccgaaaccgctataaaaataaccgctacatatattaaccgaaatacacaaaccgaaactacgacacgcgcgcctatcctaacgactatcgcgaacgcgaacgctacgtaaataaccactacgtatacaacccgaacttcaccgataaaaactataaaaaccgtcgctatcccgaaaactaccgtaaacacgacctttacgaaaataacgtatacgtatataacgcaaactactcaaaaaaaaactacaacacgcgcaactaccccgaaaactaccgaaaccgcgaccaatacctaaataaacgatatatatacgaaaacgactactctaacgaaaattacgatataaaacaataccc

SEQ ID NO: 9423 - DNA, 915 bp, Artificial Sequence
  chemically treated genomic DNA (Homo sapiens) CpG-island No: 9423
gagggggcgttgtgagaatgggcgttgcgtgtgtaatttcggttatattggcgaggattgtggggtgaggagttgttttcggggttgtagttagcggggacgttgtaaggacgggcgttgcgtgtgtgatttcggttatattggcgaggattgtggtacgcggagttgtttttgggattgtggcgagggcgggcgttgcgtggacggtcgttgcgtgtgttggttcgggtatataggcgaggattgtagtacgcggatatgttcgagggattgtcggggtcgcgggcgttgcgaggacggcgaatgtatttgcgatacgggttatagcggggacgattgcggcgtgcgtagttgttttggcgattgtaattaaaggggtcgttgcgaggacggtcgttgcgtgtgttggtcggggtatattggaatcgattgcggttcgcgcgtttgtttacgcgattgtagaggtcgcgggcgttgcgagaacggcgtgtgtgtttgtaatgcgggttatagcggcgaggattgcggtgtgcgtagttgttttggggattgtcgtggtcggggtcgttgtgagagtggtcgttgtatgtgttggtcggggtatataggtcgggattgcggtacgcgcgtttgttttggcgattgtcgcgggcgcgggcgttgcgtggatggttattgcgtgtgtaattcgggttttatcggtgaggattgtgggagtcgtcgttgtttcggggattgtcgtgggtacggtttttgcgaggatggcgtgtgcgtgtgtgacgtaggttatttaggggaagattgtagtacgcgtagttgtttcgggggttgtcgaggtcgcggttagtgtttagatgggcggtgtgtgtgcgaggacggttattttggcgaggattgcggtgtgaggtagtgttt

SEQ ID NO: 9424 - DNA, 915 bp, Artificial Sequence
  chemically treated genomic DNA (Homo sapiens) CpG-island No: 9424
aaacactacctcacaccgcaatcctcgccaaaataaccgtcctcgcacacacaccgcccatctaaacactaaccgcgacctcgacaacccccgaaacaactacgcgtactacaatcttcccctaaataacctacgtcacacacgcacacgccatcctcgcaaaaaccgtacccacgacaatccccgaaacaacgacgactcccacaatcctcaccgataaaacccgaattacacacgcaataaccatccacgcaacgcccgcgcccgcgacaatcgccaaaacaaacgcgcgtaccgcaatcccgacctatataccccgaccaacacatacaacgaccactctcacaacgaccccgaccacgacaatccccaaaacaactacgcacaccgcaatcctcgccgctataacccgcattacaaacacacacgccgttctcgcaacgcccgcgacctctacaatcgcgtaaacaaacgcgcgaaccgcaatcgattccaatataccccgaccaacacacgcaacgaccgtcctcgcaacgacccctttaattacaatcgccaaaacaactacgcacgccgcaatcgtccccgctataacccgtatcgcaaatacattcgccgtcctcgcaacgcccgcgaccccgacaatccctcgaacatatccgcgtactacaatcctcgcctatatacccgaaccaacacacgcaacgaccgtccacgcaacgcccgccctcgccacaatcccaaaaacaactccgcgtaccacaatcctcgccaatataaccgaaatcacacacgcaacgcccgtccttacaacgtccccgctaactacaaccccgaaaacaactcctcaccccacaatcctcgccaatataaccgaaattacacacgcaacgcccattctcacaacgccccctc

SEQ ID NO: 9425 - DNA, 685 bp, Artificial Sequence
  chemically treated genomic DNA (Homo sapiens) CpG-island No: 9425
gcggagaagaaaagaaggcggagtttgtcgatttggaggcggggttttgttagagttggggcggtgtttatagaggaggcggggttttagggattaaatcgaggttgttcggttgggggcgttatattttgagggtgagggggtttggagcgattgagggttcggcgtttggtcgggatttcggaaagcggcgtttttgggggtgtgggttttggaggggtttttgaggaattggatttcgagtttgttcgtaaggcgagacgtttcgtggaggcggagtttacgatgtatttaagtttgacggttttagaaacgggtgtgtagggcgtttattgggttcgcggtatgattgtagaaagagtttgggagatcgaggggcgtagagtggggtcggattaggggcgtttttagggattttagtagttttcgtggtgttgcgcggcgatgatgatgattacggtgaggatggtatagagtattatggtcgcgatgtttacggttagggagatgaaggagaagtttcgggtttcgcgtgaagcgatttcggtcgatattatgttttcgcgggttaaggtcgtgcgtatttacggaggaggggtgggggaaggaggttaaagagttgcggtttcgttcgaacgttttagtttttttttaagatggtttttagaacgtttagaattttttg

SEQ ID NO: 9426 - DNA, 685 bp, Artificial Sequence
  chemically treated genomic DNA (Homo sapiens) CpG-island No: 9426
caaaaaattctaaacgttctaaaaaccatcttaaaaaaaaactaaaacgttcgaacgaaaccgcaactctttaacctccttcccccacccctcctccgtaaatacgcacgaccttaacccgcgaaaacataatatcgaccgaaatcgcttcacgcgaaacccgaaacttctccttcatctccctaaccgtaaacatcgcgaccataatactctataccatcctcaccgtaatcatcatcatcgccgcgcaacaccacgaaaactactaaaatccctaaaaacgcccctaatccgaccccactctacgcccctcgatctcccaaactctttctacaatcataccgcgaacccaataaacgccctacacacccgtttctaaaaccgtcaaacttaaatacatcgtaaactccgcctccacgaaacgtctcgccttacgaacaaactcgaaatccaattcctcaaaaacccctccaaaacccacacccccaaaaacgccgctttccgaaatcccgaccaaacgccgaaccctcaatcgctccaaaccccctcaccctcaaaatataacgcccccaaccgaacaacctcgatttaatccctaaaaccccgcctcctctataaacaccgccccaactctaacaaaaccccgcctccaaatcgacaaactccgccttcttttcttctccgc

SEQ ID NO: 9427 - DNA, 685 bp, Artificial Sequence
  chemically treated genomic DNA (Homo sapiens) CpG-island No: 9427
tagggagttttgggcgttttggggattattttagagaaaggttgaggcgttcgaacgaggtcgtagttttttgattttttttttttatttttttttcgtaggtgcgtacggttttggttcgcggagatatggtgtcggtcgagatcgttttacgcgaggttcggaattttttttttatttttttggtcgtgggtatcgcggttatggtgttttgtattatttttatcgtagttattattatcgtcgcgtagtattacgagaattattgggatttttaaaaacgtttttggttcggttttattttgcgtttttcgattttttaggttttttttgtagttatatcgcggatttaatgggcgttttgtatattcgtttttggggtcgttagatttggatatatcgtaaatttcgtttttacggaacgtttcgttttgcgagtaagttcggaatttagttttttaggaatttttttaaaatttatatttttagggacgtcgtttttcgggatttcggttaaacgtcggatttttagtcgttttaggtttttttatttttaaagtgtagcgtttttaatcgagtaatttcggtttggtttttaaaatttcgttttttttataagtatcgttttagttttgataaaatttcgtttttaggtcggtaggtttcgtttttttttttttttcgt

SEQ ID NO: 9428 - DNA, 685 bp, Artificial Sequence
  chemically treated genomic DNA (Homo sapiens) CpG-island No: 9428
acgaaaaaaaaaaaaaaacgaaacctaccgacctaaaaacgaaattttatcaaaactaaaacgatacttataaaaaaaacgaaattttaaaaaccaaaccgaaattactcgattaaaaacgctacactttaaaaataaaaaaacctaaaacgactaaaaatccgacgtttaaccgaaatcccgaaaaacgacgtccctaaaaatataaattttaaaaaaattcctaaaaaactaaattccgaacttactcgcaaaacgaaacgttccgtaaaaacgaaatttacgatatatccaaatctaacgaccccaaaaacgaatatacaaaacgcccattaaatccgcgatataactacaaaaaaaacctaaaaaatcgaaaaacgcaaaataaaaccgaaccaaaaacgtttttaaaaatcccaataattctcgtaatactacgcgacgataataataactacgataaaaataatacaaaacaccataaccgcgatacccacgaccaaaaaaataaaaaaaaaattccgaacctcgcgtaaaacgatctcgaccgacaccatatctccgcgaaccaaaaccgtacgcacctacgaaaaaaaaataaaaaaaaaaaatcaaaaaactacgacctcgttcgaacgcctcaacctttctctaaaataatccccaaaacgcccaaaactcccta

SEQ ID NO: 9429 - DNA, 534 bp, Artificial Sequence
  chemically treated genomic DNA (Homo sapiens) CpG-island No: 9429
cgcggtacggtgtaggatttggagcgttatttgcgggtttacggttatttattgcgggttaattagatttatacgtcggtggcgcgttatatttatgaatatttgtagcggcgtttgttggtcgtcgttttagtcggttttttcgtattttcgtttcgttattttcgttttatcgttagttttgatttcggtattaggaaacgggattttaattagggaatttacggtttttcgtttgaaggcgtcgatcgggtggttgcgtttcgttattttaagttagaggtgttgggtagtttcgtcgatggcgcgtttttcgtgtttttcgacgggtttcgcggttagttcgagcgcgtggtgttgcgttggcggttttagtcgtttgtagagggtttcggcggtgagttgattgtgtcgggtattacgcgtatcgttagtttgttcgattttaggttcggtattatttattacgtggaggtttacggggtgcgggcggggtagatttttaagttttacgtttttattattattataggt

SEQ ID NO: 9430 - DNA, 534 bp, Artificial Sequence
  chemically treated genomic DNA (Homo sapiens) CpG-island No: 9430
acctataataataataaaaacgtaaaacttaaaaatctaccccgcccgcaccccgtaaacctccacgtaataaataataccgaacctaaaatcgaacaaactaacgatacgcgtaatacccgacacaatcaactcaccgccgaaaccctctacaaacgactaaaaccgccaacgcaacaccacgcgctcgaactaaccgcgaaacccgtcgaaaaacacgaaaaacgcgccatcgacgaaactacccaacacctctaacttaaaataacgaaacgcaaccacccgatcgacgccttcaaacgaaaaaccgtaaattccctaattaaaatcccgtttcctaataccgaaatcaaaactaacgataaaacgaaaataacgaaacgaaaatacgaaaaaaccgactaaaacgacgaccaacaaacgccgctacaaatattcataaatataacgcgccaccgacgtataaatctaattaacccgcaataaataaccgtaaacccgcaaataacgctccaaatcctacaccgtaccgcg

SEQ ID NO: 9431 - DNA, 534 bp, Artificial Sequence
  chemically treated genomic DNA (Homo sapiens) CpG-island No: 9431
atttgtggtggtgatgaaggcgtaggatttggaggtttgtttcgttcgtatttcgtggatttttacgtggtaggtggtgtcgggtttgaggtcgggtaggttgacggtgcgcgtggtgttcggtatagttagtttatcgtcggggttttttgtaggcggttgaggtcgttagcgtagtattacgcgttcgaattggtcgcggagttcgtcgagagatacgagaagcgcgttatcggcggaattgtttagtatttttggtttggggtggcgggacgtagttattcggtcgacgtttttaggcgagaggtcgtagattttttggttggagtttcgttttttggtgtcgggattagggttggcggtggggcgggggtggcggggcgggggtgcgggggagtcggttggggcggcggttaatagacgtcgttgtaagtatttatggatgtggcgcgttatcgacgtgtaagtttggttggttcgtagtgggtagtcgtgagttcgtaggtggcgttttaggttttgtatcgtgtcgcg

SEQ ID NO: 9432 - DNA, 534 bp, Artificial Sequence
  chemically treated genomic DNA (Homo sapiens) CpG-island No: 9432
cgcgacacgatacaaaacctaaaacgccacctacgaactcacgactacccactacgaaccaaccaaacttacacgtcgataacgcgccacatccataaatacttacaacgacgtctattaaccgccgccccaaccgactcccccgcacccccgccccgccacccccgccccaccgccaaccctaatcccgacaccaaaaaacgaaactccaaccaaaaaatctacgacctctcgcctaaaaacgtcgaccgaataactacgtcccgccaccccaaaccaaaaatactaaacaattccgccgataacgcgcttctcgtatctctcgacgaactccgcgaccaattcgaacgcgtaatactacgctaacgacctcaaccgcctacaaaaaaccccgacgataaactaactataccgaacaccacgcgcaccgtcaacctacccgacctcaaacccgacaccacctaccacgtaaaaatccacgaaatacgaacgaaacaaacctccaaatcctacgccttcatcaccaccacaaat

SEQ ID NO: 9433 - DNA, 601 bp, Artificial Sequence
  chemically treated genomic DNA (Homo sapiens) CpG-island No: 9433
gttatttttggcggcgcgggaaggagcggtggaagtagtttagttattgttggggttgggggtagttcgagagttgcgggattaggttgggttagcgtcggcggacgtcgtttattaacgtaattattgggatttgttgacgttgttggaaggggttgggttattagaggttcgttataaagttacgtcgggtcgcgaggttgggtttttttcgcgcgtacggacggtgttagtaagcgtgttttcgtatgggggcggggttttgtcgcgttgtcggacgttgttagtcggagtaggttttcgtgggggcggagtttgtttgtaggttcggatttggttcgtagatttggttgcgcgggggggcggggtttatttttattgtcggagtttttcgggagtaggagtaggaggaggttcgatttttcgcggtcgtaggttttttgtaggtatgcgcgggtttcggtttaattttgcgataatgcgaggaagatacggagtggttgtcgggcgcggaggtagggttttaacggatgattggttttgtgattgggtggttttgggagtttgcggttttgtttttaatatttcgatttcgtttttt

SEQ ID NO: 9434 - DNA, 601 bp, Artificial Sequence
  chemically treated genomic DNA (Homo sapiens) CpG-island No: 9434
aaaaaacgaaatcgaaatattaaaaacaaaaccgcaaactcccaaaaccacccaatcacaaaaccaatcatccgttaaaaccctacctccgcgcccgacaaccactccgtatcttcctcgcattatcgcaaaattaaaccgaaacccgcgcatacctacaaaaaacctacgaccgcgaaaaatcgaacctcctcctactcctactcccgaaaaactccgacaataaaaataaaccccgcccccccgcgcaaccaaatctacgaaccaaatccgaacctacaaacaaactccgcccccacgaaaacctactccgactaacaacgtccgacaacgcgacaaaaccccgcccccatacgaaaacacgcttactaacaccgtccgtacgcgcgaaaaaaacccaacctcgcgacccgacgtaactttataacgaacctctaataacccaaccccttccaacaacgtcaacaaatcccaataattacgttaataaacgacgtccgccgacgctaacccaacctaatcccgcaactctcgaactacccccaaccccaacaataactaaactacttccaccgctccttcccgcgccgccaaaaataac

SEQ ID NO: 9435 - DNA, 601 bp, Artificial Sequence
  chemically treated genomic DNA (Homo sapiens) CpG-island No: 9435
aggaggcgggatcggaatgttggaggtagaatcgtaagtttttagggttatttaattatagggttagttattcgttgagattttgttttcgcgttcggtagttatttcgtatttttttcgtattatcgtagggttgggtcgaggttcgcgtatgtttgtagaaaatttacggtcgcgaggggtcgggtttttttttgtttttattttcgagaggtttcggtaatgagaataggtttcgttttttcgcgtagttaagtttacggattaagttcgagtttgtagataagtttcgtttttacgagggtttgtttcggttgatagcgttcggtagcgcggtagagtttcgtttttatgcgggggtacgtttattgatatcgttcgtgcgcgcgggaagggtttagtttcgcggttcggcgtggttttgtgacgggtttttggtggtttagttttttttagtagcgttagtagattttagtggttacgttggtgagcgacgttcgtcggcgttagtttagtttggtttcgtagttttcgggttgtttttagttttagtagtagttgggttatttttatcgttttttttcgcgtcgttaggaatagt

SEQ ID NO: 9436 - DNA, 601 bp, Artificial Sequence
  chemically treated genomic DNA (Homo sapiens) CpG-island No: 9436
actattcctaacgacgcgaaaaaaaacgataaaaataacccaactactactaaaactaaaaacaacccgaaaactacgaaaccaaactaaactaacgccgacgaacgtcgctcaccaacgtaaccactaaaatctactaacgctactaaaaaaaactaaaccaccaaaaacccgtcacaaaaccacgccgaaccgcgaaactaaacccttcccgcgcgcacgaacgatatcaataaacgtacccccgcataaaaacgaaactctaccgcgctaccgaacgctatcaaccgaaacaaaccctcgtaaaaacgaaacttatctacaaactcgaacttaatccgtaaacttaactacgcgaaaaaacgaaacctattctcattaccgaaacctctcgaaaataaaaacaaaaaaaaacccgacccctcgcgaccgtaaattttctacaaacatacgcgaacctcgacccaaccctacgataatacgaaaaaaatacgaaataactaccgaacgcgaaaacaaaatctcaacgaataactaaccctataattaaataaccctaaaaacttacgattctacctccaacattccgatcccgcctcct

SEQ ID NO: 9437 - DNA, 608 bp, Artificial Sequence
  chemically treated genomic DNA (Homo sapiens) CpG-island No: 9437
ttcgcgcgtagaaggatcgttcgttattttattttttttatagttttaagtcgcgtggattttttttagacggtcggagtttttttttcgttttttttattcggtttcggcgtcgggttttttttcgttttaggaagttcgtttttttagttagcggtttcgattgtattggtttcgcggtagttttggtttaggcggttagcgttggatagcggtcggggaatttcgtgttgcgcggcgcggtcgaggggcgggtttggttcggagagtatcgcggtttcggttttttgtcgtgcgtttcgcgcgttttgtatcgttgagcgaagtagagacgtaaggaaatggtagtagagcgcggggcgagggtagaggggagttattttttttagagtttgggttggttgggttttcggtattttcggacgtgcgttaggtttttattttgaagacgcgttcgttttgggaatatgatttcggaagtagtcgtagtcgtcgtcggacgaggggcgtggagaggcggtgtttcggtagtttagggatggcgtaggttttggggttttaggaagacggcgtcgttggcgttttgagttttgttgtcgtttttggtt

SEQ ID NO: 9438 - DNA, 608 bp, Artificial Sequence
  chemically treated genomic DNA (Homo sapiens) CpG-island No: 9438
aaccaaaaacgacaacaaaactcaaaacgccaacgacgccgtcttcctaaaaccccaaaacctacgccatccctaaactaccgaaacaccgcctctccacgcccctcgtccgacgacgactacgactacttccgaaatcatattcccaaaacgaacgcgtcttcaaaataaaaacctaacgcacgtccgaaaataccgaaaacccaaccaacccaaactctaaaaaaaataactcccctctaccctcgccccgcgctctactaccatttccttacgtctctacttcgctcaacgatacaaaacgcgcgaaacgcacgacaaaaaaccgaaaccgcgatactctccgaaccaaacccgcccctcgaccgcgccgcgcaacacgaaattccccgaccgctatccaacgctaaccgcctaaaccaaaactaccgcgaaaccaatacaatcgaaaccgctaactaaaaaaacgaacttcctaaaacgaaaaaaaacccgacgccgaaaccgaataaaaaaaacgaaaaaaaaactccgaccgtctaaaaaaaatccacgcgacttaaaactataaaaaaaataaaataacgaacgatccttctacgcgcgaa

SEQ ID NO: 9439 - DNA, 608 bp, Artificial Sequence
  chemically treated genomic DNA (Homo sapiens) CpG-island No: 9439
agttagaggcggtagtaagatttaagacgttaacggcgtcgtttttttggggttttagggtttgcgttatttttgggttgtcggggtatcgtttttttacgtttttcgttcggcggcggttgcgattgttttcgaggttatgtttttaggacgggcgcgtttttagggtggaagtttggcgtacgttcggaggtgtcgaggatttaattagtttaaattttgggggaaatgatttttttttgttttcgtttcgcgttttgttattatttttttacgtttttgtttcgtttagcgatgtaaaacgcgcgaggcgtacggtagagggtcgaagtcgcggtatttttcgggttaggttcgtttttcggtcgcgtcgcgtagtacgggatttttcggtcgttgtttagcgttggtcgtttgagttaaggttgtcgcggagttagtatagtcggggtcgttggttggaagggcgagttttttaaggcggggggaagttcggcgtcggggtcgggtaggaaaggcgggggaggggtttcggtcgtttggaaggaatttacgcggtttgaggttgtgggggaagtagggtggcgagcggtttttttgcgcgcggg

SEQ ID NO: 9440 - DNA, 608 bp, Artificial Sequence
  chemically treated genomic DNA (Homo sapiens) CpG-island No: 9440
cccgcgcgcaaaaaaaccgctcgccaccctacttcccccacaacctcaaaccgcgtaaattccttccaaacgaccgaaacccctcccccgcctttcctacccgaccccgacgccgaacttccccccgccttaaaaaactcgcccttccaaccaacgaccccgactatactaactccgcgacaaccttaactcaaacgaccaacgctaaacaacgaccgaaaaatcccgtactacgcgacgcgaccgaaaaacgaacctaacccgaaaaataccgcgacttcgaccctctaccgtacgcctcgcgcgttttacatcgctaaacgaaacaaaaacgtaaaaaaataataacaaaacgcgaaacgaaaacaaaaaaaaatcatttcccccaaaatttaaactaattaaatcctcgacacctccgaacgtacgccaaacttccaccctaaaaacgcgcccgtcctaaaaacataacctcgaaaacaatcgcaaccgccgccgaacgaaaaacgtaaaaaaacgataccccgacaacccaaaaataacgcaaaccctaaaaccccaaaaaaacgacgccgttaacgtcttaaatcttactaccgcctctaact

SEQ ID NO: 9441 - DNA, 562 bp, Artificial Sequence
  chemically treated genomic DNA (Homo sapiens) CpG-island No: 9441
  misc_feature (358)..(358): n is either a, c, g or t
  misc_feature (449)..(449): n is either a, c, g or t
  misc_feature (509)..(509): n is either a, c, g or t
gttattcggcggtattggtgttttcggtaattatcgttttagcgtttggtatgtcgtagattattgcgtatggtcgatggcgagtttggagtcggattcgttaatattgttcgttacgtttaatttcgggttggattttttcgatgaggtggtgcgatgaacgtttgggaagttaatttcgacgggttggtagggttgacgtattattacgcgggtttgtcgtttggtaatgaagtttttattcgttatcgtttttaggtgtttaattcgcgattggcggcgaagtagggtttattgaaaatgaaagtttttgtcgatgcgggatttttttaggtcgtgatttcgtcgtacgagcgtncgtttatttcggtgttgcgttagttgggatttagtggtagcgatgagtaggtattggaaaaaagtgtacgttaggtatcgtattggttttntagcgttaagttcgtttcggtaatgtgggtagttaatgcggtaacgatcgcgttatttgncgatacgtttgatggtaaaagtgtattttatcggttgttaatttgaataaata

SEQ ID NO: 9442 - DNA, 562 bp, Artificial Sequence
  chemically treated genomic DNA (Homo sapiens) CpG-island No: 9442
  misc_feature (54)..(54): n is either a, c, g or t
  misc_feature (114)..(114): n is either a, c, g or t
  misc_feature (205)..(205): n is either a, c, g or t
tatttattcaaattaacaaccgataaaatacacttttaccatcaaacgtatcgncaaataacgcgatcgttaccgcattaactacccacattaccgaaacgaacttaacgctanaaaaccaatacgatacctaacgtacacttttttccaatacctactcatcgctaccactaaatcccaactaacgcaacaccgaaataaacgnacgctcgtacgacgaaatcacgacctaaaaaaatcccgcatcgacaaaaactttcattttcaataaaccctacttcgccgccaatcgcgaattaaacacctaaaaacgataacgaataaaaacttcattaccaaacgacaaacccgcgtaataatacgtcaaccctaccaacccgtcgaaattaacttcccaaacgttcatcgcaccacctcatcgaaaaaatccaacccgaaattaaacgtaacgaacaatattaacgaatccgactccaaactcgccatcgaccatacgcaataatctacgacataccaaacgctaaaacgataattaccgaaaacaccaataccgccgaataac

SEQ ID NO: 9443 - DNA, 562 bp, Artificial Sequence
  chemically treated genomic DNA (Homo sapiens) CpG-island No: 9443
  misc_feature (54)..(54): n is either a, c, g or t
  misc_feature (114)..(114): n is either a, c, g or t
  misc_feature (205)..(205): n is either a, c, g or t
tatttgtttaggttggtaatcggtaagatgtatttttgttattaagcgtatcgntagatggcgcgatcgttgtcgtattggttatttatattgtcgaagcgaatttgacgttgnaaagttagtgcggtgtttggcgtgtatttttttttagtatttgtttatcgttattattgaattttaattgacgtagtatcggaataaacgnacgttcgtgcggcgggattacggtttgggggaatttcgtatcggtaagggtttttatttttagtaagttttgtttcgtcgttagtcgcgggttagatatttgaaaacggtgacgggtagaggttttattattaaacgataggttcgcgtaatgatgcgttagttttattagttcgtcgaaattgattttttaggcgtttatcgtattattttatcggaaaaatttagttcggggttaagcgtggcgggtaatgttaacgagttcgattttaggttcgttatcggttatgcgtagtaatttgcggtatattaggcgttggggcgatggttatcggaagtattaatgtcgtcgaatggt

SEQ ID NO: 9444 - DNA, 562 bp, Artificial Sequence
  chemically treated genomic DNA (Homo sapiens) CpG-island No: 9444
  misc_feature (358)..(358): n is either a, c, g or t
  misc_feature (449)..(449): n is either a, c, g or t
  misc_feature (509)..(509): n is either a, c, g or t
accattcgacgacattaatacttccgataaccatcgccccaacgcctaatataccgcaaattactacgcataaccgataacgaacctaaaatcgaactcgttaacattacccgccacgcttaaccccgaactaaatttttccgataaaataatacgataaacgcctaaaaaatcaatttcgacgaactaataaaactaacgcatcattacgcgaacctatcgtttaataataaaacctctacccgtcaccgttttcaaatatctaacccgcgactaacgacgaaacaaaacttactaaaaataaaaacccttaccgatacgaaattcccccaaaccgtaatcccgccgcacgaacgtncgtttattccgatactacgtcaattaaaattcaataataacgataaacaaatactaaaaaaaaatacacgccaaacaccgcactaactttncaacgtcaaattcgcttcgacaatataaataaccaatacgacaacgatcgcgccatctancgatacgcttaataacaaaaatacatcttaccgattaccaacctaaacaaata

SEQ ID NO: 9445 - DNA, 806 bp, Artificial Sequence
  chemically treated genomic DNA (Homo sapiens) CpG-island No: 9445
tcgttggcggtggcggtgatttatcgttcggagatgttaattttcgatgagtttatttttggtgtcgattcggtggcgagggatatgttttggtagttgatggtcgatttttcgcgttaggataaagtgattatttttatttttatttattttatgaacgaagcggaacgttgcgatcgtattttattgatgtacgtcggaaaagtgtttgttagcggtatatcgtaggaattggttgagaaacgcggagtcgttagtttggaagaggtatttatcgtttatttgtaggaagcggtagggtagagtaacgaagtcgaagcgtcgttcgtggtatacgatattatttacgcgtcgcgttagggatttagtttgcgtcgtttgtttagttatagtcgtcgcgaagcgttggaattgcgacgcgatttagtacgttcgacgttggcgttgatgggaacggtgattttgatgttgataatgggttacggtattagtatggatgtggaaaatttgcgttttgcggtgttcgatcgcgattagatcgttagtagttaggcgtggatatttaagtttttcggttttcgttattttatcgaatagtcgtcggttattagttatgacgagtttgatcgtcggatgcgtgcgggcgatattacggtggcgattgatatttcgtttaatttcggggtcgataatcgggttggtaagtttgtggaaattcgcgtttgggatcgacgggacgattgtcgaattcgtgttgaaatcgttaaaaggatgattataattcgagttcggtattttgagttaaa

SEQ ID NO: 9446 - DNA, 806 bp, Artificial Sequence
  chemically treated genomic DNA (Homo sapiens) CpG-island No: 9446
tttaactcaaaataccgaactcgaattataatcatccttttaacgatttcaacacgaattcgacaatcgtcccgtcgatcccaaacgcgaatttccacaaacttaccaacccgattatcgaccccgaaattaaacgaaatatcaatcgccaccgtaatatcgcccgcacgcatccgacgatcaaactcgtcataactaataaccgacgactattcgataaaataacgaaaaccgaaaaacttaaatatccacgcctaactactaacgatctaatcgcgatcgaacaccgcaaaacgcaaattttccacatccatactaataccgtaacccattatcaacatcaaaatcaccgttcccatcaacgccaacgtcgaacgtactaaatcgcgtcgcaattccaacgcttcgcgacgactataactaaacaaacgacgcaaactaaatccctaacgcgacgcgtaaataatatcgtataccacgaacgacgcttcgacttcgttactctaccctaccgcttcctacaaataaacgataaatacctcttccaaactaacgactccgcgtttctcaaccaattcctacgatataccgctaacaaacacttttccgacgtacatcaataaaatacgatcgcaacgttccgcttcgttcataaaataaataaaaataaaaataatcactttatcctaacgcgaaaaatcgaccatcaactaccaaaacatatccctcgccaccgaatcgacaccaaaaataaactcatcgaaaattaacatctccgaacgataaatcaccgccaccgccaacga

SEQ ID NO: 9447 - DNA, 806 bp, Artificial Sequence
  chemically treated genomic DNA (Homo sapiens) CpG-island No: 9447
tttagtttagggtatcgagttcgaattataattatttttttaacggttttagtacgggttcggtaatcgtttcgtcgattttagacgcggatttttataggtttattaattcgattatcggtttcgaaattgggcgggatgttaatcgttatcgtgatatcgttcgtacgtattcgacgattaagttcgttataattggtgatcggcggttgttcgataaagtaacgggaatcggagagtttgagtgtttacgtttggttattgacggtttggtcgcggtcgagtatcgtaaagcgtaggttttttatatttatattgatgtcgtaatttattattagtattaggattatcgtttttattagcgttagcgtcgaacgtattggatcgcgtcgtagttttagcgtttcgcggcggttgtagttaaatagacggcgtaggttaaatttttgacgcggcgcgtgggtggtgtcgtgtattacgggcggcgtttcggtttcgttgttttgttttgtcgttttttgtaaataggcgataaatgttttttttagattggcggtttcgcgttttttaattagtttttgcggtgtatcgttggtaagtattttttcggcgtgtattagtgagatgcggtcgtaacgtttcgtttcgtttataaagtgggtggagatgaagatagttattttgttttggcgcgagagatcgattattaattgttagaatatatttttcgttatcggatcgatattagaagtaggtttatcgaggattaatattttcgggcgatgaattatcgttatcgttagcga

SEQ ID NO: 9448 - DNA, 806 bp, Artificial Sequence
  chemically treated genomic DNA (Homo sapiens) CpG-island No: 9448
tcgctaacgataacgataattcatcgcccgaaaatattaatcctcgataaacctacttctaatatcgatccgataacgaaaaatatattctaacaattaataatcgatctctcgcgccaaaacaaaataactatcttcatctccacccactttataaacgaaacgaaacgttacgaccgcatctcactaatacacgccgaaaaaatacttaccaacgatacaccgcaaaaactaattaaaaaacgcgaaaccgccaatctaaaaaaaacatttatcgcctatttacaaaaaacgacaaaacaaaacaacgaaaccgaaacgccgcccgtaatacacgacaccacccacgcgccgcgtcaaaaatttaacctacgccgtctatttaactacaaccgccgcgaaacgctaaaactacgacgcgatccaatacgttcgacgctaacgctaataaaaacgataatcctaatactaataataaattacgacatcaatataaatataaaaaacctacgctttacgatactcgaccgcgaccaaaccgtcaataaccaaacgtaaacactcaaactctccgattcccgttactttatcgaacaaccgccgatcaccaattataacgaacttaatcgtcgaatacgtacgaacgatatcacgataacgattaacatcccgcccaatttcgaaaccgataatcgaattaataaacctataaaaatccgcgtctaaaatcgacgaaacgattaccgaacccgtactaaaaccgttaaaaaaataattataattcgaactcgataccctaaactaaa

SEQ ID NO: 9449 - DNA, 677 bp, Artificial Sequence
  chemically treated genomic DNA (Homo sapiens) CpG-island No: 9449
gtgagcgtcgggtaggcgcggtatagaatattaacgatagtagcgtttttagtaagcgttttttggtcgcgcgcgggtacgtgtaggatttttttgtcgcgttgttggtttcgggcgcggcgcgtcgcgtatcgtttatttatcgaggttattacgttcgcgtacgcgtcgtgaggtattgcgtgcgcgtttttttggagtagattggcgcgttttaggtcgcgtttcgcgcgtagattttgtttttcggcgttggtttcgattcgttttattttcgtttaaaaatcgcgggtcgtttggttcgggttgtagtttgggaggtggatttttcggacgtggcgcggcgtaaagtagaaaggattggagagacgttagagttgtgcgcgttaatcgggtttttcgagaggggggagttcgcgttcgcgttgtgttttgagagcgtagattattgtattttgggtttggatttgcggtagttttagcgagtggaggaggttttgggcgtcgcggggttcgacgtagttttatttattttgtttttggtcgaggcggtgttgatttatttcgagtcggagagtgtcgcggtttttatcgtttgggtagtttagcgtttttttaatgtttttttcgtggtttatgagtagatgaggttttaagacgtttttggttagtttatg

SEQ ID NO: 9450 - DNA, 677 bp, Artificial Sequence
  chemically treated genomic DNA (Homo sapiens) CpG-island No: 9450
cataaactaaccaaaaacgtcttaaaacctcatctactcataaaccacgaaaaaaacattaaaaaaacgctaaactacccaaacgataaaaaccgcgacactctccgactcgaaataaatcaacaccgcctcgaccaaaaacaaaataaataaaactacgtcgaaccccgcgacgcccaaaacctcctccactcgctaaaactaccgcaaatccaaacccaaaatacaataatctacgctctcaaaacacaacgcgaacgcgaactcccccctctcgaaaaacccgattaacgcgcacaactctaacgtctctccaatcctttctactttacgccgcgccacgtccgaaaaatccacctcccaaactacaacccgaaccaaacgacccgcgatttttaaacgaaaataaaacgaatcgaaaccaacgccgaaaaacaaaatctacgcgcgaaacgcgacctaaaacgcgccaatctactccaaaaaaacgcgcacgcaatacctcacgacgcgtacgcgaacgtaataacctcgataaataaacgatacgcgacgcgccgcgcccgaaaccaacaacgcgacaaaaaaatcctacacgtacccgcgcgcgaccaaaaaacgcttactaaaaacgctactatcgttaatattctataccgcgcctacccgacgctcac

SEQ ID NO: 9451 - DNA, 677 bp, Artificial Sequence
  chemically treated genomic DNA (Homo sapiens) CpG-island No: 9451
tatgaattggttaaaggcgttttgaggttttatttgtttatagattacgaaaagggtattaggaaaacgttgggttgtttaggcgatgagggtcgcggtatttttcggttcgaggtaggttagtatcgtttcggttaggagtagagtgggtgaggttgcgtcgagtttcgcggcgtttagggttttttttattcgttggagttgtcgtaagtttagatttaggatgtagtagtttgcgtttttaaagtatagcgcggacgcgggtttttttttttcgaaaggttcggttaacgcgtatagttttggcgtttttttaattttttttgttttgcgtcgcgttacgttcggaaaatttattttttagattgtagttcgggttaggcggttcgcggtttttaagcgaaaatagagcgagtcgaagttagcgtcgagagataagatttgcgcgcgaagcgcggtttggggcgcgttaatttgttttaaaaaagcgcgtacgtagtgttttacggcgcgtgcgcggacgtagtagtttcggtgaatgagcggtgcgcggcgcgtcgcgttcggaattagtaacgcggtaaaggggttttgtacgtattcgcgcgcggttagggaacgtttgttgagggcgttgttgtcgttggtgttttgtatcgcgtttgttcgacgtttat

SEQ ID NO: 9452 - DNA, 677 bp, Artificial Sequence
  chemically treated genomic DNA (Homo sapiens) CpG-island No: 9452
ataaacgtcgaacaaacgcgatacaaaacaccaacgacaacaacgccctcaacaaacgttccctaaccgcgcgcgaatacgtacaaaacccctttaccgcgttactaattccgaacgcgacgcgccgcgcaccgctcattcaccgaaactactacgtccgcgcacgcgccgtaaaacactacgtacgcgcttttttaaaacaaattaacgcgccccaaaccgcgcttcgcgcgcaaatcttatctctcgacgctaacttcgactcgctctattttcgcttaaaaaccgcgaaccgcctaacccgaactacaatctaaaaaataaattttccgaacgtaacgcgacgcaaaacaaaaaaaattaaaaaaacgccaaaactatacgcgttaaccgaacctttcgaaaaaaaaaaacccgcgtccgcgctatactttaaaaacgcaaactactacatcctaaatctaaacttacgacaactccaacgaataaaaaaaaccctaaacgccgcgaaactcgacgcaacctcacccactctactcctaaccgaaacgatactaacctacctcgaaccgaaaaataccgcgaccctcatcgcctaaacaacccaacgttttcctaatacccttttcgtaatctataaacaaataaaacctcaaaacgcctttaaccaattcata

SEQ ID NO: 9453 - DNA, 596 bp, Artificial Sequence
  chemically treated genomic DNA (Homo sapiens) CpG-island No: 9453
  misc_feature (11)..(11): n is either a, c, g or t
  misc_feature (83)..(83): n is either a, c, g or t
  misc_feature (96)..(96): n is either a, c, g or t
  misc_feature (113)..(113): n is either a, c, g or t
  misc_feature (324)..(324): n is either a, c, g or t
  misc_feature (353)..(353): n is either a, c, g or t
  misc_feature (456)..(456): n is either a, c, g or t
tgttacgcgancggttcgtttttcgtcgtttcgtggagggcgtcggcgttttttgttaggcgggtaaaggatatagtttcggnttttagaacgttngcggtattggggcgggnaggggttcgttacgttcgttattttgaaataatcgttattcggggcgtcgcgtttgggtcgttacgtttcggtttgtaggttcggtttttattggtcgtattacgtagaggttcgttttcgtttgcgcggtcggtttttgcggggcgagagggtgggggcgaaggggaagttacgtttcggaggtgcggtgtggggtatcgggcggggttngcgggaatcggcgttttacggagttgttngttgttagattaatttcgggtttttattattattgcgtcgcgtttttaggcgtcgagaattatcgttttcggtatgttatgaaattggtttcggcgttgaggncggggttcggttttttattcgttttcgtcgcgcgcgaatcgcggtcgcgagttatggaggaggaggtatcgttttcggggttgggttgtagtaagtcgtatttggagaagttgattttgggtattacgcgtattttaggt

SEQ ID NO: 9454 - DNA, 596 bp, Artificial Sequence
  chemically treated genomic DNA (Homo sapiens) CpG-island No: 9454
  misc_feature (141)..(141): n is either a, c, g or t
  misc_feature (244)..(244): n is either a, c, g or t
  misc_feature (273)..(273): n is either a, c, g or t
  misc_feature (484)..(484): n is either a, c, g or t
  misc_feature (501)..(501): n is either a, c, g or t
  misc_feature (514)..(514): n is either a, c, g or t
  misc_feature (586)..(586): n is either a, c, g or t
acctaaaatacgcgtaatacccaaaatcaacttctccaaatacgacttactacaacccaaccccgaaaacgatacctcctcctccataactcgcgaccgcgattcgcgcgcgacgaaaacgaataaaaaaccgaaccccgncctcaacgccgaaaccaatttcataacataccgaaaacgataattctcgacgcctaaaaacgcgacgcaataataataaaaacccgaaattaatctaacaacnaacaactccgtaaaacgccgattcccgcnaaccccgcccgataccccacaccgcacctccgaaacgtaacttccccttcgcccccaccctctcgccccgcaaaaaccgaccgcgcaaacgaaaacgaacctctacgtaatacgaccaataaaaaccgaacctacaaaccgaaacgtaacgacccaaacgcgacgccccgaataacgattatttcaaaataacgaacgtaacgaacccctncccgccccaataccgcnaacgttctaaaanccgaaactatatcctttacccgcctaacaaaaaacgccgacgccctccacgaaacgacgaaaaacgaaccgntcgcgtaaca

SEQ ID NO: 9455 - DNA, 596 bp, Artificial Sequence
  chemically treated genomic DNA (Homo sapiens) CpG-island No: 9455
  misc_feature (141)..(141): n is either a, c, g or t
  misc_feature (244)..(244): n is either a, c, g or t
  misc_feature (273)..(273): n is either a, c, g or t
  misc_feature (484)..(484): n is either a, c, g or t
  misc_feature (501)..(501): n is either a, c, g or t
  misc_feature (514)..(514): n is either a, c, g or t
  misc_feature (586)..(586): n is either a, c, g or t
atttaggatgcgcgtgatgtttagggttagtttttttaggtgcggtttgttgtagtttagtttcggggacgatgtttttttttttatggttcgcgatcgcgattcgcgcgcggcgggagcgggtggagggtcggatttcgnttttagcgtcgaggttaattttatggtatgtcgggaacggtagttttcggcgtttgaaagcgcggcgtagtgatgatgggggttcggggttggtttgatagtnagtagtttcgtggggcgtcggttttcgtnggtttcgttcggtgttttatatcgtattttcgggacgtagtttttttttcgtttttattttttcgtttcgtaggggtcggtcgcgtaggcgggggcgggtttttgcgtggtgcggttaatggggatcgagtttgtaggtcgaggcgtggcggtttaggcgcgacgtttcgagtggcggttgttttaagatggcggacgtggcgggtttttnttcgttttagtgtcgtnggcgttttggagntcgggattgtattttttgttcgtttgatagggggcgtcggcgttttttacgggacggcgaggggcgagtcgntcgcgtggta

SEQ ID NO: 9456 - DNA, 596 bp, Artificial Sequence
  chemically treated genomic DNA (Homo sapiens) CpG-island No: 9456
  misc_feature (11)..(11): n is either a, c, g or t
  misc_feature (83)..(83): n is either a, c, g or t
  misc_feature (96)..(96): n is either a, c, g or t
  misc_feature (113)..(113): n is either a, c, g or t
  misc_feature (324)..(324): n is either a, c, g or t
  misc_feature (353)..(353): n is either a, c, g or t
  misc_feature (456)..(456): n is either a, c, g or t
taccacgcgancgactcgcccctcgccgtcccgtaaaaaacgccgacgccccctatcaaacgaacaaaaaatacaatcccganctccaaaacgccnacgacactaaaacgaanaaaaacccgccacgtccgccatcttaaaacaaccgccactcgaaacgtcgcgcctaaaccgccacgcctcgacctacaaactcgatccccattaaccgcaccacgcaaaaacccgcccccgcctacgcgaccgacccctacgaaacgaaaaaataaaaacgaaaaaaaaactacgtcccgaaaatacgatataaaacaccgaacgaaaccnacgaaaaccgacgccccacgaaactactnactatcaaaccaaccccgaacccccatcatcactacgccgcgctttcaaacgccgaaaactaccgttcccgacataccataaaattaacctcgacgctaaaancgaaatccgaccctccacccgctcccgccgcgcgcgaatcgcgatcgcgaaccataaaaaaaaaaacatcgtccccgaaactaaactacaacaaaccgcacctaaaaaaactaaccctaaacatcacgcgcatcctaaat

SEQ ID NO: 9457 - DNA, 1163 bp, Artificial Sequence
  chemically treated genomic DNA (Homo sapiens) CpG-island No: 9457
gaggggcgggtacggggagtgaggggtttttaggtttagcgggtgcggggtcgggtgaggagacggagtttattttcgttcggaatttagaagtatggcgggtttttacgcgtagttttttaggggtttcgggagttcgcggtttgggttattttcggttttttttaggcggggggcggttgttgtcgttaggttcgggcgtgggtgcgggcggtgggtattttacgggggtaggggaggcgagagtttgaggagattcgggagggggttcgtggacgcggttggttcgggatggagttggcgcggttatagtgggggacgaggtagggtacgcggcgtttttcgggttcggttttttttttagcgtacgggcggtcggaggaattggagtttttatttcggatacggtttcgcgggcgaaggttttttttcgtcgtttcggttcggtttttttttcgtcgtcgttagtagaggtcgttgttttacgcgtcgggtttcgttggcgtcggggttttttgggacggtttggtcgcggtttgcgggtgtaggcgtttcggcggttatcgcgtttttagggggtttcgcggacgggggcgcggggttgcggggaggaggcgggcgggtttttcgggcgatatcgcggggcgggcggcgggaagttcggatttagcggttttttgggtaatcggtttttttcggcgcggttcgcgcggttttaggtggcgggaggcggcggttggcgggaagggtcgcgcgggttcgggggcggcgttttaggtagtagcgttaggtggcgttcgtgggcggcggggttttcggggaggcgtttgttttcgtttacgtcgggttcggttttcgcgagtttttttttggattttagcgcgaagtcgtcgcggaaatttttcgggcgggtatcggagttttggggcggggcggtcgggtttagagggcgggcgggagtaggcgggcggcgagggcgggtagtagtagcgggagtaggggcgtttcgggcgtcggggtcgttggggacgaacgcggcgggttaggtttcgaagttcgggtcgcggtggtcgttttaggcgttcgttttggggtgggggtgggggtatttttcgggatcgaattcgtcgtagtttttttttttgtgttttttttttttgttg

SEQ ID NO: 9458 - DNA, 1163 bp, Artificial Sequence
  chemically treated genomic DNA (Homo sapiens) CpG-island No: 9458
caacaaaaaaaaaaaacacaaaaaaaaaaactacgacgaattcgatcccgaaaaatacccccacccccaccccaaaacgaacgcctaaaacgaccaccgcgacccgaacttcgaaacctaacccgccgcgttcgtccccaacgaccccgacgcccgaaacgcccctactcccgctactactacccgccctcgccgcccgcctactcccgcccgccctctaaacccgaccgccccgccccaaaactccgatacccgcccgaaaaatttccgcgacgacttcgcgctaaaatccaaaaaaaaactcgcgaaaaccgaacccgacgtaaacgaaaacaaacgcctccccgaaaaccccgccgcccacgaacgccacctaacgctactacctaaaacgccgcccccgaacccgcgcgacccttcccgccaaccgccgcctcccgccacctaaaaccgcgcgaaccgcgccgaaaaaaaccgattacccaaaaaaccgctaaatccgaacttcccgccgcccgccccgcgatatcgcccgaaaaacccgcccgcctcctccccgcaaccccgcgcccccgtccgcgaaaccccctaaaaacgcgataaccgccgaaacgcctacacccgcaaaccgcgaccaaaccgtcccaaaaaaccccgacgccaacgaaacccgacgcgtaaaacaacgacctctactaacgacgacgaaaaaaaaaccgaaccgaaacgacgaaaaaaaaccttcgcccgcgaaaccgtatccgaaataaaaactccaattcctccgaccgcccgtacgctaaaaaaaaaaccgaacccgaaaaacgccgcgtaccctacctcgtcccccactataaccgcgccaactccatcccgaaccaaccgcgtccacgaaccccctcccgaatctcctcaaactctcgcctcccctacccccgtaaaatacccaccgcccgcacccacgcccgaacctaacgacaacaaccgccccccgcctaaaaaaaaccgaaaataacccaaaccgcgaactcccgaaacccctaaaaaactacgcgtaaaaacccgccatacttctaaattccgaacgaaaataaactccgtctcctcacccgaccccgcacccgctaaacctaaaaacccctcactccccgtacccgcccctc

SEQ ID NO: 9459 - DNA, 1163 bp, Artificial Sequence
  chemically treated genomic DNA (Homo sapiens) CpG-island No: 9459
tagtaggggaaaggagtataaagagggaggttgcggcgagttcggtttcgaaagatgtttttatttttattttagagcgggcgtttgaggcggttatcgcggttcgggtttcggggtttgattcgtcgcgttcgtttttagcggtttcggcgttcggggcgtttttgttttcgttgttgttgttcgttttcgtcgttcgtttgttttcgttcgttttttgagttcggtcgtttcgttttagagtttcgatgttcgttcggggagttttcgcggcggtttcgcgttggaatttagaaggaagttcgcgaaggtcgggttcggcgtgggcgggagtaggcgttttttcgggagtttcgtcgtttacgggcgttatttggcgttgttatttgaggcgtcgttttcgggttcgcgcggtttttttcgttaatcgtcgtttttcgttatttggagtcgcgcgggtcgcgtcggaggaggtcggttgtttaggaaatcgttgagttcgggtttttcgtcgttcgtttcgcggtgtcgttcgaggggttcgttcgtttttttttcgtagtttcgcgttttcgttcgcgaggttttttggggacgcggtggtcgtcgaggcgtttatattcgtaggtcgcggttaggtcgttttaggaggtttcggcgttaacgggattcggcgcgtgggatagcggtttttgttggcggcggcgggagggaggtcggatcggggcgacggggagaagttttcgttcgcgggatcgtgttcggggtgggggttttagttttttcgatcgttcgtgcgttgggagggaggtcgagttcggggaacgtcgcgtgttttgtttcgttttttattgtggtcgcgttagttttatttcgggttagtcgcgtttacgggttttttttcgagtttttttaggttttcgttttttttattttcgtgggatgtttatcgttcgtatttacgttcgagtttggcggtagtagtcgtttttcgtttgaagggagtcggaggtgatttaggtcgcgggttttcgaggtttttgaagggttgcgcgtggggattcgttatgtttttgggtttcgaacgggggtgagtttcgtttttttattcggtttcgtattcgttgggtttggggattttttatttttcgtgttcgtttttt

SEQ ID NO: 9460 - DNA, 1163 bp, Artificial Sequence
  chemically treated genomic DNA (Homo sapiens) CpG-island No: 9460
aaaaaacgaacacgaaaaataaaaaatccccaaacccaacgaatacgaaaccgaataaaaaaacgaaactcacccccgttcgaaacccaaaaacataacgaatccccacgcgcaacccttcaaaaacctcgaaaacccgcgacctaaatcacctccgactcccttcaaacgaaaaacgactactaccgccaaactcgaacgtaaatacgaacgataaacatcccacgaaaataaaaaaaacgaaaacctaaaaaaactcgaaaaaaaacccgtaaacgcgactaacccgaaataaaactaacgcgaccacaataaaaaacgaaacaaaacacgcgacgttccccgaactcgacctccctcccaacgcacgaacgatcgaaaaaactaaaacccccaccccgaacacgatcccgcgaacgaaaacttctccccgtcgccccgatccgacctccctcccgccgccgccaacaaaaaccgctatcccacgcgccgaatcccgttaacgccgaaacctcctaaaacgacctaaccgcgacctacgaatataaacgcctcgacgaccaccgcgtccccaaaaaacctcgcgaacgaaaacgcgaaactacgaaaaaaaaacgaacgaacccctcgaacgacaccgcgaaacgaacgacgaaaaacccgaactcaacgatttcctaaacaaccgacctcctccgacgcgacccgcgcgactccaaataacgaaaaacgacgattaacgaaaaaaaccgcgcgaacccgaaaacgacgcctcaaataacaacgccaaataacgcccgtaaacgacgaaactcccgaaaaaacgcctactcccgcccacgccgaacccgaccttcgcgaacttccttctaaattccaacgcgaaaccgccgcgaaaactccccgaacgaacatcgaaactctaaaacgaaacgaccgaactcaaaaaacgaacgaaaacaaacgaacgacgaaaacgaacaacaacaacgaaaacaaaaacgccccgaacgccgaaaccgctaaaaacgaacgcgacgaatcaaaccccgaaacccgaaccgcgataaccgcctcaaacgcccgctctaaaataaaaataaaaacatctttcgaaaccgaactcgccgcaacctccctctttatactcctttcccctacta

SEQ ID NO: 9461 - DNA, 1027 bp, Artificial Sequence
  chemically treated genomic DNA (Homo sapiens) CpG-island No: 9461
  misc_feature (965)..(965): n is either a, c, g or t
  misc_feature (1015)..(1015): n is either a, c, g or t
tttcggcggcggcgcgggagtgcgaggtcggcggggaggtcgggttttgcggtttcgtcggggtttttgtagcgttttttcgttagggggtagcgtcgggtcggcggcgcgggcgggaagttttagcggtcgggacgcggtggtgtcgttttttttttgcggtgagggatcgcgtcgcgttatttcgtttttagcgtagttcgtagcggcgaggttatcgggtgggatacgggtgttcgcgcgtcgcgtcgtagttcgcggggatttggcgtttcgtttcgggaggggatttggttttcgggcgtcggtttttcgtttacgcggcgttttttttgtagttcgttagggtcgttcgttcgtcgtcgtttgcggaacgcggaggggtagtacggttacgttcggttattcgaatttgtttttcggcgtcgcgtgatcgtgttaggttttcgtcggtttcgtcgtgtcgatttcgggcgtttttatagtggttcggaggtcgttgttgttcggatgttcgggttttacgaggtttttttagttcgataagttcgtcgattttacgggtacgggcggaggagagggaatcgtcgcgttcgtttcgcgcgtcgtcgtcgatttcggtgggtcgcgttttttcgcgtacgtcgcgttttggcgcggggagaggtttttcggggttcgttcgggttagcgtttcgcgggggtggcggtcgttcgtttagttttttttcgattttttttttttgttagggttgttggggttgataggttttcgggtaattacgtcggggaattttttacgttcgtcgatcgttgcggggtttagtagtcgtttcgtgcgttgagttttttgttatgagtgattttattgcgaggcgtttcgggttacgaagtaagatcgggggtcgtatttcgggttttcgttttgtttttattaatttttcgcgcgtggaaaggggatagtngtttaaaaatttttttttaaaaaaaatttttaaatattagggcgaattanaataaaatattt

SEQ ID NO: 9462 - DNA, 1027 bp, Artificial Sequence
  chemically treated genomic DNA (Homo sapiens) CpG-island No: 9462
  misc_feature (13)..(13): n is either a, c, g or t
  misc_feature (63)..(63): n is either a, c, g or t
aaatattttattntaattcgccctaatatttaaaaattttttttaaaaaaaaatttttaaacnactatcccctttccacgcgcgaaaaattaataaaaacaaaacgaaaacccgaaatacgacccccgatcttacttcgtaacccgaaacgcctcgcaataaaatcactcataacaaaaaactcaacgcacgaaacgactactaaaccccgcaacgatcgacgaacgtaaaaaattccccgacgtaattacccgaaaacctatcaaccccaacaaccctaacaaaaaaaaaaaatcgaaaaaaaactaaacgaacgaccgccacccccgcgaaacgctaacccgaacgaaccccgaaaaacctctccccgcgccaaaacgcgacgtacgcgaaaaaacgcgacccaccgaaatcgacgacgacgcgcgaaacgaacgcgacgattccctctcctccgcccgtacccgtaaaatcgacgaacttatcgaactaaaaaaacctcgtaaaacccgaacatccgaacaacaacgacctccgaaccactataaaaacgcccgaaatcgacacgacgaaaccgacgaaaacctaacacgatcacgcgacgccgaaaaacaaattcgaataaccgaacgtaaccgtactacccctccgcgttccgcaaacgacgacgaacgaacgaccctaacgaactacaaaaaaaacgccgcgtaaacgaaaaaccgacgcccgaaaaccaaatcccctcccgaaacgaaacgccaaatccccgcgaactacgacgcgacgcgcgaacacccgtatcccacccgataacctcgccgctacgaactacgctaaaaacgaaataacgcgacgcgatccctcaccgcaaaaaaaaaacgacaccaccgcgtcccgaccgctaaaacttcccgcccgcgccgccgacccgacgctaccccctaacgaaaaaacgctacaaaaaccccgacgaaaccgcaaaacccgacctccccgccgacctcgcactcccgcgccgccgccgaaa

SEQ ID NO: 9463 - DNA, 1027 bp, Artificial Sequence
  chemically treated genomic DNA (Homo sapiens) CpG-island No: 9463
  misc_feature (13)..(13): n is either a, c, g or t
  misc_feature (63)..(63): n is either a, c, g or t
gggtgttttgttntggttcgttttggtatttgggggttttttttgaaaaggagtttttaagtngttgttttttttttacgcgcgggaggttggtgagggtagggcggggattcggagtgcggttttcggttttgtttcgtggttcgaaacgtttcgtaatggagttatttatgataggggatttagcgtacggggcggttgttgagtttcgtagcgatcggcgggcgtgaggggtttttcggcgtggttgttcgggagtttgttagttttagtagttttgataggaaagggaagtcgagaggaggttgagcgaacggtcgttattttcgcgggacgttgattcgggcggatttcgaggggttttttttcgcgttagagcgcggcgtgcgcggggaagcgcgatttatcggggtcggcgacggcgcgcggggcgggcgcggcggttttttttttttcgttcgtgttcgtgggatcggcgggtttgtcgggttgggagagtttcgtggaattcgggtattcgggtagtagcggttttcgagttattgtggaggcgttcggggtcggtacggcgaggtcgacggggatttgatacggttacgcggcgtcggggagtaggttcgagtggtcgggcgtggtcgtgttgttttttcgcgtttcgtaggcggcgacgggcgagcggttttagcgggttgtagggaggacgtcgcgtggacggagagtcggcgttcgggggttagattttttttcgggacggggcgttaggttttcgcgagttgcggcgcgacgcgcgggtattcgtgttttattcggtggtttcgtcgttgcgggttgcgttgagagcggggtggcgcgacgcggttttttatcgtagggggaagacggtattatcgcgtttcggtcgttggagtttttcgttcgcgtcgtcggttcgacgttgttttttggcgggagagcgttgtaggggtttcggcgaggtcgtaggattcgattttttcgtcggtttcgtattttcgcgtcgtcgtcgagg

SEQ ID NO: 9464 - DNA, 1027 bp, Artificial Sequence
  chemically treated genomic DNA (Homo sapiens) CpG-island No: 9464
  misc_feature (965)..(965): n is either a, c, g or t
  misc_feature (1015)..(1015): n is either a, c, g or t
cctcgacgacgacgcgaaaatacgaaaccgacgaaaaaatcgaatcctacgacctcgccgaaacccctacaacgctctcccgccaaaaaacaacgtcgaaccgacgacgcgaacgaaaaactccaacgaccgaaacgcgataataccgtcttccccctacgataaaaaaccgcgtcgcgccaccccgctctcaacgcaacccgcaacgacgaaaccaccgaataaaacacgaatacccgcgcgtcgcgccgcaactcgcgaaaacctaacgccccgtcccgaaaaaaaatctaacccccgaacgccgactctccgtccacgcgacgtcctccctacaacccgctaaaaccgctcgcccgtcgccgcctacgaaacgcgaaaaaacaacacgaccacgcccgaccactcgaacctactccccgacgccgcgtaaccgtatcaaatccccgtcgacctcgccgtaccgaccccgaacgcctccacaataactcgaaaaccgctactacccgaatacccgaattccacgaaactctcccaacccgacaaacccgccgatcccacgaacacgaacgaaaaaaaaaaaaccgccgcgcccgccccgcgcgccgtcgccgaccccgataaatcgcgcttccccgcgcacgccgcgctctaacgcgaaaaaaaacccctcgaaatccgcccgaatcaacgtcccgcgaaaataacgaccgttcgctcaacctcctctcgacttccctttcctatcaaaactactaaaactaacaaactcccgaacaaccacgccgaaaaacccctcacgcccgccgatcgctacgaaactcaacaaccgccccgtacgctaaatcccctatcataaataactccattacgaaacgtttcgaaccacgaaacaaaaccgaaaaccgcactccgaatccccgccctaccctcaccaacctcccgcgcgtaaaaaaaaaacaacnacttaaaaactccttttcaaaaaaaacccccaaataccaaaacgaaccanaacaaaacaccc

SEQ ID NO: 9465 - DNA, 695 bp, Artificial Sequence
  chemically treated genomic DNA (Homo sapiens) CpG-island No: 9465
aaatcgttttttagcgtttttgtttagggttttttcgtttcgcggttcggttttttttattcggaagtgttggtttcggtattggtttagttttacgtaggagtcgttgcgtagcgtttttaggaggttattcgatatagtgtagagaagcggattataatgcggcgattttcggtacgaggttgcgttcgcgatggcggaagcggaaacgcgcggaggcgagtattttattggatttaattcgagggcggcgtgtcgttattaagttgcgcgggggtatagacgttcgggtcgggcgtcgcggggcggaagacgagggcggcgaggtcgggtttcgggcgtttggagaagatggtgttgcggcggttgttggtcgttttgttgtatagttcgtagttggtggaacgtttgttagagtcgcggtttattcgacgtgcggcgtagtttacggttttcgtattgttgtaggtttagttgcggggttaggacgcggttcgtcgtttgtaggatttcgcggttgggttcgtgggttttttgtgtcgtcgcgttgagcgatttagagacgtttttatttaggagttacgtcgcggttttcgaggtcgttcggggttattattaggtagttagaggggttttggcgtaaatatttaattttgggttgtgcggggtcgaggtcgtttgttttttttttcggg

SEQ ID NO: 9466 - DNA, 695 bp, Artificial Sequence
  chemically treated genomic DNA (Homo sapiens) CpG-island No: 9466
cccgaaaaaaaaaacaaacgacctcgaccccgcacaacccaaaattaaatatttacgccaaaacccctctaactacctaataataaccccgaacgacctcgaaaaccgcgacgtaactcctaaataaaaacgtctctaaatcgctcaacgcgacgacacaaaaaacccacgaacccaaccgcgaaatcctacaaacgacgaaccgcgtcctaaccccgcaactaaacctacaacaatacgaaaaccgtaaactacgccgcacgtcgaataaaccgcgactctaacaaacgttccaccaactacgaactatacaacaaaacgaccaacaaccgccgcaacaccatcttctccaaacgcccgaaacccgacctcgccgccctcgtcttccgccccgcgacgcccgacccgaacgtctatacccccgcgcaacttaataacgacacgccgccctcgaattaaatccaataaaatactcgcctccgcgcgtttccgcttccgccatcgcgaacgcaacctcgtaccgaaaatcgccgcattataatccgcttctctacactatatcgaataacctcctaaaaacgctacgcaacgactcctacgtaaaactaaaccaataccgaaaccaacacttccgaataaaaaaaaccgaaccgcgaaacgaaaaaaccctaaacaaaaacgctaaaaaacgattt

SEQ ID NO: 9467 - DNA, 695 bp, Artificial Sequence
  chemically treated genomic DNA (Homo sapiens) CpG-island No: 9467
ttcggaaggaaaagtaagcggtttcggtttcgtatagtttaggattaaatgtttgcgttagggtttttttggttatttggtggtggtttcgagcggtttcggaggtcgcggcgtagtttttgggtgaaggcgtttttaaatcgtttagcgcggcggtatagggagtttacgggtttagtcgcgaggttttgtaggcggcgggtcgcgttttggtttcgtagttgggtttgtagtagtgcgaaggtcgtgagttgcgtcgtacgtcggataggtcgcgattttgatagacgttttattagttgcgggttgtgtagtagggcggttagtagtcgtcgtagtattattttttttaagcgttcggaattcgatttcgtcgttttcgtttttcgtttcgcggcgttcgattcggacgtttatgttttcgcgtagtttgatgacgatacgtcgttttcggattgggtttaatgagatgttcgttttcgcgcgttttcgttttcgttatcgcggacgtagtttcgtgtcgggagtcgtcgtattgtggttcgtttttttgtattatgtcgggtggttttttgaaggcgttgcgtagcgatttttacgtggagttgagttagtatcgggattagtattttcgggtgagggaggtcgggtcgcgagacgggaaggttttgggtaagaacgttgagaaacggttt

SEQ ID NO: 9468 - DNA, 695 bp, Artificial Sequence
  chemically treated genomic DNA (Homo sapiens) CpG-island No: 9468
aaaccgtttctcaacgttcttacccaaaaccttcccgtctcgcgacccgacctccctcacccgaaaatactaatcccgatactaactcaactccacgtaaaaatcgctacgcaacgccttcaaaaaaccacccgacataatacaaaaaaacgaaccacaatacgacgactcccgacacgaaactacgtccgcgataacgaaaacgaaaacgcgcgaaaacgaacatctcattaaacccaatccgaaaacgacgtatcgtcatcaaactacgcgaaaacataaacgtccgaatcgaacgccgcgaaacgaaaaacgaaaacgacgaaatcgaattccgaacgcttaaaaaaaataatactacgacgactactaaccgccctactacacaacccgcaactaataaaacgtctatcaaaatcgcgacctatccgacgtacgacgcaactcacgaccttcgcactactacaaacccaactacgaaaccaaaacgcgacccgccgcctacaaaacctcgcgactaaacccgtaaactccctataccgccgcgctaaacgatttaaaaacgccttcacccaaaaactacgccgcgacctccgaaaccgctcgaaaccaccaccaaataaccaaaaaaaccctaacgcaaacatttaatcctaaactatacgaaaccgaaaccgcttacttttccttccgaa

SEQ ID NO: 9469 - DNA, 793 bp, Artificial Sequence
  chemically treated genomic DNA (Homo sapiens) CpG-island No: 9469
ttcgacggcgttatgcggggttcgagcggggttttgtggttgtttttggttttgcgtatcggtgaggtttcgttgtgagagttaaaggcgggcgggggtttcggggcgtcgcggttcggttgagtaggtttcggggttggaaatgtgtttgagtttgcggtttcggggtagtgagacgggggaggtaggggttcggggtcgagtgaggacggcggagggaattagtattgaagcgtagacggggaagtttggaaggttttttggaggaggcggtttcgaatattcgaggttttcgacgttttaaggagaagcgcgggttgaggcgtggtggggaggtttcggggtgtggagaggagttttcggagggcggtttttttcgacgggcgtaggaatttaggaagattttgggggttcggagtagttttttttttcgagttttcgcgggagaagatttagagggattgatcggtaggcgcgggagttcgttcgggggtttttggtatatgtagggatggaggtggagacggaggtcgggttttttcgcgtcggcgtttcggggagttagggttcgggatggtgggacgggaggcgggatttcggggagcggttcgcggggatcgcgggcggcgatcgtcgaggggatggagttcgtggtatcgttgtggtcgtaggcgacgtatttattaatgtaaacgatgaagttatcgttattttcgtttcgtttgaattttgtagtttttcgtttgggtggtggggggtttggagcgttgcggaggggagggtagttcgattt

SEQ ID NO: 9470 - DNA, 793 bp, Artificial Sequence
  chemically treated genomic DNA (Homo sapiens) CpG-island No: 9470
aaatcgaactaccctcccctccgcaacgctccaaaccccccaccacccaaacgaaaaactacaaaattcaaacgaaacgaaaataacgataacttcatcgtttacattaataaatacgtcgcctacgaccacaacgataccacgaactccatcccctcgacgatcgccgcccgcgatccccgcgaaccgctccccgaaatcccgcctcccgtcccaccatcccgaaccctaactccccgaaacgccgacgcgaaaaaacccgacctccgtctccacctccatccctacatataccaaaaacccccgaacgaactcccgcgcctaccgatcaatccctctaaatcttctcccgcgaaaactcgaaaaaaaaaactactccgaacccccaaaatcttcctaaattcctacgcccgtcgaaaaaaaccgccctccgaaaactcctctccacaccccgaaacctccccaccacgcctcaacccgcgcttctccttaaaacgtcgaaaacctcgaatattcgaaaccgcctcctccaaaaaaccttccaaacttccccgtctacgcttcaatactaattccctccgccgtcctcactcgaccccgaacccctacctcccccgtctcactaccccgaaaccgcaaactcaaacacatttccaaccccgaaacctactcaaccgaaccgcgacgccccgaaacccccgcccgcctttaactctcacaacgaaacctcaccgatacgcaaaaccaaaaacaaccacaaaaccccgctcgaaccccgcataacgccgtcgaa

SEQ ID NO: 9471 - DNA, 793 bp, Artificial Sequence
  chemically treated genomic DNA (Homo sapiens) CpG-island No: 9471
aagtcgaattgttttttttttcgtagcgttttaagttttttattatttaggcgggaaattgtaaagtttagacggggcgggggtggcggtggttttatcgtttgtattgatgagtgcgtcgtttgcggttatagcggtgttacgaattttattttttcggcggtcgtcgttcgcgattttcgcgagtcgtttttcgaggtttcgtttttcgttttattatttcgggttttgatttttcggggcgtcgacgcgaggggattcggttttcgtttttatttttatttttgtatgtgttagaaattttcgggcggattttcgcgtttgtcggttagtttttttgaattttttttcgcgggggttcgggagaaagagttgtttcgagtttttaaagtttttttgagtttttgcgttcgtcgggaggggtcgtttttcgggagtttttttttatatttcgaggtttttttattacgttttagttcgcgtttttttttggagcgtcggaagtttcgggtgttcgaggtcgttttttttaagaagttttttagattttttcgtttgcgttttagtgttagtttttttcgtcgtttttattcgatttcgagtttttgtttttttcgttttattgtttcggagtcgtaggtttaggtatatttttagtttcgggatttgtttagtcgggtcgcggcgtttcgggattttcgttcgtttttggtttttatagcggggttttatcggtgcgtagagttaggagtagttatagagtttcgttcggatttcgtatggcgtcgtcggg

SEQ ID NO: 9472 - DNA, 793 bp, Artificial Sequence
  chemically treated genomic DNA (Homo sapiens) CpG-island No: 9472
cccgacgacgccatacgaaatccgaacgaaactctataactactcctaactctacgcaccgataaaaccccgctataaaaaccaaaaacgaacgaaaatcccgaaacgccgcgacccgactaaacaaatcccgaaactaaaaatatacctaaacctacgactccgaaacaataaaacgaaaaaaacaaaaactcgaaatcgaataaaaacgacgaaaaaaactaacactaaaacgcaaacgaaaaaatctaaaaaacttcttaaaaaaaacgacctcgaacacccgaaacttccgacgctccaaaaaaaaacgcgaactaaaacgtaataaaaaaacctcgaaatataaaaaaaaactcccgaaaaacgacccctcccgacgaacgcaaaaactcaaaaaaactttaaaaactcgaaacaactctttctcccgaacccccgcgaaaaaaaattcaaaaaaactaaccgacaaacgcgaaaatccgcccgaaaatttctaacacatacaaaaataaaaataaaaacgaaaaccgaatcccctcgcgtcgacgccccgaaaaatcaaaacccgaaataataaaacgaaaaacgaaacctcgaaaaacgactcgcgaaaatcgcgaacgacgaccgccgaaaaaataaaattcgtaacaccgctataaccgcaaacgacgcactcatcaatacaaacgataaaaccaccgccacccccgccccgtctaaactttacaatttcccgcctaaataataaaaaacttaaaacgctacgaaaaaaaaaacaattcgactt

SEQ ID NO: 9473 - DNA, 573 bp, Artificial Sequence
  chemically treated genomic DNA (Homo sapiens) CpG-island No: 9473
ggaggcgtggttttcgcgagcgtttgttttcgttcgtcgcgttcgcgtaggcgtattaggggttttcgtttcgcgaggtttttcgtcgggcggcgggagttagacgagtacgtagggtatttttcgggttttcgggaggcggttttgggcgttttttttttgtcgtcgtcgcggtttcggttgttttttgcgtagttgggtagggttcgggtttttatatcgtttttttcgggaatgcgggcgttttggagtcggggagtcggggcgatcgtagggagggtagtttttcggggtggaggttttcgggcgtcgcgttttcgtttggaaattagtcgtcgttttcgtaggagttagtcggcgtggacgttttagtacgtttttttttggtgttgtcggtcgttttgtaatttcgagaagaaagttagagacgtcgtggtttatagaggcgtttagtttttttcgtttatatttacgttgtttttttatcgcgtttttttttttttttttgggtgtttttttttttttttaggaaagcggatttggaggaataggtttcgtgattgttatttaatt

SEQ ID NO: 9474 - DNA, 573 bp, Artificial Sequence
  chemically treated genomic DNA (Homo sapiens) CpG-island No: 9474
aattaaataacaatcacgaaacctattcctccaaatccgctttcctaaaaaaaaaaaaaaacacccaaaaaaaaaaaaaaaaacgcgataaaaaaacaacgtaaatataaacgaaaaaaactaaacgcctctataaaccacgacgtctctaactttcttctcgaaattacaaaacgaccgacaacaccaaaaaaaaacgtactaaaacgtccacgccgactaactcctacgaaaacgacgactaatttccaaacgaaaacgcgacgcccgaaaacctccaccccgaaaaactaccctccctacgatcgccccgactccccgactccaaaacgcccgcattcccgaaaaaaacgatataaaaacccgaaccctacccaactacgcaaaaaacaaccgaaaccgcgacgacgacaaaaaaaaaacgcccaaaaccgcctcccgaaaacccgaaaaataccctacgtactcgtctaactcccgccgcccgacgaaaaacctcgcgaaacgaaaacccctaatacgcctacgcgaacgcgacgaacgaaaacaaacgctcgcgaaaaccacgcctcc

SEQ ID NO: 9475 - DNA, 573 bp, Artificial Sequence
  chemically treated genomic DNA (Homo sapiens) CpG-island No: 9475
agttggatgatagttacgaaatttgtttttttaaattcgtttttttggagaggagagaaagtatttagggagaaaaagaagaacgcgatgaggaagtaacgtgagtgtgagcgaggaaaattaagcgtttttgtgggttacggcgtttttgatttttttttcggaattgtagggcgatcggtagtattaagaaggagcgtgttggggcgtttacgtcggttgatttttgcgggggcgacggttggtttttaggcgagggcgcggcgttcgaggatttttatttcggagagttgttttttttgcggtcgtttcggtttttcggttttagagcgttcgtattttcgagagaggcgatgtgggggttcgggttttgtttagttacgtagaaagtagtcggggtcgcggcggcggtagaaaggggacgtttagggtcgtttttcgggagttcgaggggtgttttgcgtgttcgtttagttttcgtcgttcggcgaaggatttcgcgggacggggatttttagtgcgtttgcgcgagcgcggcgggcggaggtagacgttcgcggaggttacgttttt

SEQ ID NO: 9476 - DNA, 573 bp, Artificial Sequence
  chemically treated genomic DNA (Homo sapiens) CpG-island No: 9476
aaaaacgtaacctccgcgaacgtctacctccgcccgccgcgctcgcgcaaacgcactaaaaatccccgtcccgcgaaatccttcgccgaacgacgaaaactaaacgaacacgcaaaacacccctcgaactcccgaaaaacgaccctaaacgtcccctttctaccgccgccgcgaccccgactactttctacgtaactaaacaaaacccgaacccccacatcgcctctctcgaaaatacgaacgctctaaaaccgaaaaaccgaaacgaccgcaaaaaaaacaactctccgaaataaaaatcctcgaacgccgcgccctcgcctaaaaaccaaccgtcgcccccgcaaaaatcaaccgacgtaaacgccccaacacgctccttcttaatactaccgatcgccctacaattccgaaaaaaaaatcaaaaacgccgtaacccacaaaaacgcttaattttcctcgctcacactcacgttacttcctcatcgcgttcttctttttctccctaaatactttctctcctctccaaaaaaacgaatttaaaaaaacaaatttcgtaactatcatccaact

SEQ ID NO: 9477 - DNA, 627 bp, Artificial Sequence
  chemically treated genomic DNA (Homo sapiens) CpG-island No: 9477
cgtcgcgattacggttaagacggtatcgggttttgggaataacgtgaatagaattatttaggaagtcgcgggagcgcgcgaatacgggagaagggaagtaggttgttatagaagagtaattcgagcggggttttagggtagtcgtatatacgaggtttcgagttttcggtgttagcggtattttagggtttttttcgtgttcggaaatcgtcgtagtttgtgggagagttatttattttttgtagcggtcgggaattttcgtaattcgtttcgtacggtttttaaagtcgttttcgttatggttgcgttagcgtcggtcgagatttcgttttttttcgacgtttcgtcgtaggttatattttaagtattcgtttcgttttttttagagttttcgtcgtaggttatatttttagattttcgtttcgtttttttagaggtattcgtcgtaggttatatttttagtatttcgtttcgttttgtttttggatatatatcgggttttgttatcgaagcggtggagcgattggtagcgttcgtttcggtttgttttattggtcggtattttagggttaataaataattgtgtttattgataagtttatatattagtataaacgggtacgttaa

SEQ ID NO: 9478 - DNA, 627 bp, Artificial Sequence
  chemically treated genomic DNA (Homo sapiens) CpG-island No: 9478
ttaacgtacccgtttatactaatatataaacttatcaataaacacaattatttattaaccctaaaataccgaccaataaaacaaaccgaaacgaacgctaccaatcgctccaccgcttcgataacaaaacccgatatatatccaaaaacaaaacgaaacgaaatactaaaaatataacctacgacgaatacctctaaaaaaacgaaacgaaaatctaaaaatataacctacgacgaaaactctaaaaaaaacgaaacgaatacttaaaatataacctacgacgaaacgtcgaaaaaaaacgaaatctcgaccgacgctaacgcaaccataacgaaaacgactttaaaaaccgtacgaaacgaattacgaaaattcccgaccgctacaaaaaataaataactctcccacaaactacgacgatttccgaacacgaaaaaaaccctaaaataccgctaacaccgaaaactcgaaacctcgtatatacgactaccctaaaaccccgctcgaattactcttctataacaacctacttcccttctcccgtattcgcgcgctcccgcgacttcctaaataattctattcacgttattcccaaaacccgataccgtcttaaccgtaatcgcgacg

SEQ ID NO: 9479 - DNA, 627 bp, Artificial Sequence
  chemically treated genomic DNA (Homo sapiens) CpG-island No: 9479
ttaacgtgttcgtttgtattgatgtatgaatttgttaataaatataattgtttgttaattttgggatgtcggttagtggggtaggtcgaagcgggcgttgttagtcgttttatcgtttcggtggtagaattcggtgtgtgtttaggggtaggacggggcggggtgttgggggtgtggtttgcggcgggtgtttttggaagggcggggcgagggtttgggggtgtggtttgcggcggggattttggggagggcggggcgagtgtttggggtgtggtttgcggcggggcgtcggggaaaggcggggtttcggtcggcgttgacgtagttatggcggaggcggttttggaagtcgtgcggagcgagttacgagaattttcggtcgttgtaaggggtgagtggtttttttataggttgcggcgattttcgaatacgggaggggttttgggatgtcgttgatatcgggggttcggaatttcgtgtgtgcgattgttttgaggtttcgttcgggttgtttttttgtggtaatttgttttttttttttcgtgttcgcgcgttttcgcggttttttgggtgattttgtttacgttgtttttaaggttcggtgtcgttttgatcgtggtcgcggcg

SEQ ID NO: 9480 - DNA, 627 bp, Artificial Sequence
  chemically treated genomic DNA (Homo sapiens) CpG-island No: 9480
cgccgcgaccacgatcaaaacgacaccgaaccttaaaaacaacgtaaacaaaatcacccaaaaaaccgcgaaaacgcgcgaacacgaaaaaaaaaaaacaaattaccacaaaaaaacaacccgaacgaaacctcaaaacaatcgcacacacgaaattccgaacccccgatatcaacgacatcccaaaacccctcccgtattcgaaaatcgccgcaacctataaaaaaaccactcaccccttacaacgaccgaaaattctcgtaactcgctccgcacgacttccaaaaccgcctccgccataactacgtcaacgccgaccgaaaccccgcctttccccgacgccccgccgcaaaccacaccccaaacactcgccccgccctccccaaaatccccgccgcaaaccacacccccaaaccctcgccccgcccttccaaaaacacccgccgcaaaccacacccccaacaccccgccccgtcctacccctaaacacacaccgaattctaccaccgaaacgataaaacgactaacaacgcccgcttcgacctaccccactaaccgacatcccaaaattaacaaacaattatatttattaacaaattcatacatcaatacaaacgaacacgttaa

SEQ ID NO: 9481 - DNA, 511 bp, Artificial Sequence
  chemically treated genomic DNA (Homo sapiens) CpG-island No: 9481
cgttggggtagttggcgttttggttttttatttcgtggggaaaatggttttgagttcgattggtttgaggtttagataggtgatttcgcgaagcgggtgggtaggcgcggttttaggggcgggaggcgggtagttttcgtgattggtcggcggagggggcggtgtagcgattcgaggagggaagaggattttaagcgttatggtcgttgtcgttcgagttcgggtcgcgtatttgttgaggtaattgtaacgcgtagcgtgagtgcggggtcggcgggcgggtaggggatcgtagggtgtttacgtagttttttgggtgtgattcgtttagattttgcgtagtttttttcgtttatttttaagaattcggagaatttggatatcgttttgggtttttatcgcgcgttaggcggaatagcgaggttatagagtgcgcgatgtagttttttagggcgtagtgaggtagtttttattttgtttgtttatcgttaaagaaattgaggtttagaga

SEQ ID NO: 9482 - DNA, 511 bp, Artificial Sequence
  chemically treated genomic DNA (Homo sapiens) CpG-island No: 9482
tctctaaacctcaatttctttaacgataaacaaacaaaataaaaactacctcactacgccctaaaaaactacatcgcgcactctataacctcgctattccgcctaacgcgcgataaaaacccaaaacgatatccaaattctccgaattcttaaaaataaacgaaaaaaactacgcaaaatctaaacgaatcacacccaaaaaactacgtaaacaccctacgatcccctacccgcccgccgaccccgcactcacgctacgcgttacaattacctcaacaaatacgcgacccgaactcgaacgacaacgaccataacgcttaaaatcctcttccctcctcgaatcgctacaccgccccctccgccgaccaatcacgaaaactacccgcctcccgcccctaaaaccgcgcctacccacccgcttcgcgaaatcacctatctaaacctcaaaccaatcgaactcaaaaccattttccccacgaaataaaaaaccaaaacgccaactaccccaacg

SEQ ID NO: 9483 - DNA, 511 bp, Artificial Sequence
  chemically treated genomic DNA (Homo sapiens) CpG-island No: 9483
tttttgggttttagtttttttaacggtagataagtagagtaaaggttgttttattgcgttttgagaggttgtatcgcgtattttgtgatttcgttgtttcgtttggcgcgcggtgggagtttagggcggtatttaaatttttcgaatttttgaaagtaagcggagaagattgcgtaggatttgagcgggttatatttagggggttgcgtgggtattttgcggttttttgttcgttcgtcggtttcgtatttacgttgcgcgttgtagttgttttagtaagtacgcgattcgggttcgggcggtagcggttatggcgtttggagttttttttttttttcgggtcgttatatcgtttttttcgtcggttaattacggaggttgttcgtttttcgtttttggggtcgcgtttgtttattcgtttcgcggggttatttgtttaaattttaagttagtcgggtttaaggttattttttttacggagtaaagaattagaacgttagttgttttagcg

SEQ ID NO: 9484 - DNA, 511 bp, Artificial Sequence
  chemically treated genomic DNA (Homo sapiens) CpG-island No: 9484
cgctaaaacaactaacgttctaattctttactccgtaaaaaaaataaccttaaacccgactaacttaaaatttaaacaaataaccccgcgaaacgaataaacaaacgcgaccccaaaaacgaaaaacgaacaacctccgtaattaaccgacgaaaaaaacgatataacgacccgaaaaaaaaaaaaaactccaaacgccataaccgctaccgcccgaacccgaatcgcgtacttactaaaacaactacaacgcgcaacgtaaatacgaaaccgacgaacgaacaaaaaaccgcaaaatacccacgcaaccccctaaatataacccgctcaaatcctacgcaatcttctccgcttactttcaaaaattcgaaaaatttaaataccgccctaaactcccaccgcgcgccaaacgaaacaacgaaatcacaaaatacgcgatacaacctctcaaaacgcaataaaacaacctttactctacttatctaccgttaaaaaaactaaaacccaaaaa

SEQ ID NO: 9485 - DNA, 1078 bp, Artificial Sequence
  chemically treated genomic DNA (Homo sapiens) CpG-island No: 9485
  misc_feature (407)..(407): n is either a, c, g or t
  misc_feature (544)..(544): n is either a, c, g or t
  misc_feature (655)..(655): n is either a, c, g or t
  misc_feature (737)..(737): n is either a, c, g or t
  misc_feature (927)..(927): n is either a, c, g or t
  misc_feature (946)..(946): n is either a, c, g or t
  misc_feature (959)..(959): n is either a, c, g or t
agcgggcggggagtagcgattcgacgcggttgggttttttagtagggcgcgtcgggtgtggggagggggcgcggcgtgagatagtgggggatattgcgtgaggaaagttttgcgttttttttcggggtattaggatttgcgtttttttttcgggtttaggtcgcgcgcgggattcgataattcggtcgagggtttcgcgatttatttgcggttagagcgttgtttatttgggcgtcgtcgaagtcgtttagacgcgagggcgcggtcgttggcgggcggggagcggggaggcgggattcggcgcgacggggttgtttcgtttttcgatgatgcggcggtcgtcgattcgtttttacgttgttatttattttttattatggttgtagtataaagtaataagtttcggnaggtcgttttttttttgaggagcggtttcggcggtcggagaaggcgtaggaggaggaagaggcggaggaagaggaggggaatcgtcgttttttaaatatttttttcgagggggttgtgcgcggttttcggttttcgngttttcggacgttcgcgtcgggagttcgaattcgggttgttcgcggtttttttttttttttttttcgtttcgcgtagacgaggaataaagttgtcgagagcgattgggttnggagggttgtagttcgggtcgggtgttttggtcgcggcggcgtcggcgtcggggtagtttcgtttcgggcgcgttgatgggngggaggcggcggcggcggagtttatagcggcggttcgagtagtagaggcggcggcggcggcggttgggcggttcgaggggatgtagtagtagtcgggagggacggtcgagtttagtagatagagattaggagcggcggtcgaggcgatcgggtttcgtagcgttcggatttgagttagatttatttggtntcgttttttcgatcggcgngtcgaggcgtttngaggattggggacgcggaagatttaagtgattttcggagatttttgggcggcggttgcgtaagtttttgagaggagggggcgatttttagcgtcgtgggggaggaggtttcgtttgttt

SEQ ID NO: 9486 - DNA, 1078 bp, Artificial Sequence
  chemically treated genomic DNA (Homo sapiens) CpG-island No: 9486
  misc_feature (120)..(120): n is either a, c, g or t
  misc_feature (133)..(133): n is either a, c, g or t
  misc_feature (152)..(152): n is either a, c, g or t
  misc_feature (342)..(342): n is either a, c, g or t
  misc_feature (424)..(424): n is either a, c, g or t
  misc_feature (535)..(535): n is either a, c, g or t
  misc_feature (672)..(672): n is either a, c, g or t
aaacaaacgaaacctcctcccccacgacgctaaaaatcgccccctcctctcaaaaacttacgcaaccgccgcccaaaaatctccgaaaatcacttaaatcttccgcgtccccaatcctcnaaacgcctcgacncgccgatcgaaaaaacganaccaaataaatctaactcaaatccgaacgctacgaaacccgatcgcctcgaccgccgctcctaatctctatctactaaactcgaccgtccctcccgactactactacatcccctcgaaccgcccaaccgccgccgccgccgcctctactactcgaaccgccgctataaactccgccgccgccgcctcccncccatcaacgcgcccgaaacgaaactaccccgacgccgacgccgccgcgaccaaaacacccgacccgaactacaaccctccnaacccaatcgctctcgacaactttattcctcgtctacgcgaaacgaaaaaaaaaaaaaaaaaaaccgcgaacaacccgaattcgaactcccgacgcgaacgtccgaaaacncgaaaaccgaaaaccgcgcacaaccccctcgaaaaaaatatttaaaaaacgacgattcccctcctcttcctccgcctcttcctcctcctacgccttctccgaccgccgaaaccgctcctcaaaaaaaaaacgacctnccgaaacttattactttatactacaaccataataaaaaataaataacaacgtaaaaacgaatcgacgaccgccgcatcatcgaaaaacgaaacaaccccgtcgcgccgaatcccgcctccccgctccccgcccgccaacgaccgcgccctcgcgtctaaacgacttcgacgacgcccaaataaacaacgctctaaccgcaaataaatcgcgaaaccctcgaccgaattatcgaatcccgcgcgcgacctaaacccgaaaaaaaaacgcaaatcctaataccccgaaaaaaaacgcaaaactttcctcacgcaatatcccccactatctcacgccgcgccccctccccacacccgacgcgccctactaaaaaacccaaccgcgtcgaatcgctactccccgcccgct

SEQ ID NO: 9487 - DNA, 1078 bp, Artificial Sequence
  chemically treated genomic DNA (Homo sapiens) CpG-island No: 9487
  misc_feature (120)..(120): n is either a, c, g or t
  misc_feature (133)..(133): n is either a, c, g or t
  misc_feature (152)..(152): n is either a, c, g or t
  misc_feature (342)..(342): n is either a, c, g or t
  misc_feature (424)..(424): n is either a, c, g or t
  misc_feature (535)..(535): n is either a, c, g or t
  misc_feature (672)..(672): n is either a, c, g or t
gggtaggcggagtttttttttttacggcgttgagggtcgttttttttttttaggggtttgcgtagtcgtcgtttaggggttttcgagaattatttggatttttcgcgtttttagtttttngggcgtttcggtncgtcggtcgggaggacggnattaggtgggtttggtttaggttcgggcgttgcgaagttcgatcgtttcggtcgtcgtttttggtttttgtttattgggttcggtcgtttttttcgattgttgttgtattttttcgggtcgtttagtcgtcgtcgtcgtcgtttttgttgttcgggtcgtcgttgtgggtttcgtcgtcgtcgttttttntttattagcgcgttcggagcggagttgtttcggcgtcggcgtcgtcgcggttagagtattcggttcgggttgtagttttttnggtttagtcgttttcggtaattttgtttttcgtttgcgcggggcggaggagggggaagagggggtcgcggatagttcgggttcggattttcggcgcgggcgttcgagggtncgaaagtcgagagtcgcgtatagttttttcggagagagtgtttgggaagcggcgatttttttttttttttttcgtttttttttttttttgcgtttttttcggtcgtcggagtcgttttttagggaggaagcggtttntcggggtttgttgttttgtgttgtaattatggtgaggaatgagtgatagcgtgggggcgagtcggcggtcgtcgtattatcggggggcggggtagtttcgtcgcgtcgggtttcgttttttcgtttttcgttcgttagcggtcgcgttttcgcgtttgagcggtttcggcggcgtttaggtgagtagcgttttggtcgtaagtgggtcgcggagttttcggtcgggttgtcgggtttcgcgcgcggtttggattcgaagagggggcgtaagttttggtgtttcggagagaagcgtagggttttttttacgtagtgttttttattgttttacgtcgcgttttttttttatattcgacgcgttttattaggagatttagtcgcgtcgggtcgttgtttttcgttcgtt

SEQ ID NO: 9488 - DNA, 1078 bp, Artificial Sequence
  chemically treated genomic DNA (Homo sapiens) CpG-island No: 9488
  misc_feature (407)..(407): n is either a, c, g or t
  misc_feature (544)..(544): n is either a, c, g or t
  misc_feature (655)..(655): n is either a, c, g or t
  misc_feature (737)..(737): n is either a, c, g or t
  misc_feature (927)..(927): n is either a, c, g or t
  misc_feature (946)..(946): n is either a, c, g or t
  misc_feature (959)..(959): n is either a, c, g or t
aacgaacgaaaaacaacgacccgacgcgactaaatctcctaataaaacgcgtcgaatataaaaaaaaaacgcgacgtaaaacaataaaaaacactacgtaaaaaaaaccctacgcttctctccgaaacaccaaaacttacgccccctcttcgaatccaaaccgcgcgcgaaacccgacaacccgaccgaaaactccgcgacccacttacgaccaaaacgctactcacctaaacgccgccgaaaccgctcaaacgcgaaaacgcgaccgctaacgaacgaaaaacgaaaaaacgaaacccgacgcgacgaaactaccccgccccccgataatacgacgaccgccgactcgcccccacgctatcactcattcctcaccataattacaacacaaaacaacaaaccccganaaaccgcttcctccctaaaaaacgactccgacgaccgaaaaaaacgcaaaaaaaaaaaaaaacgaaaaaaaaaaaaaaaaatcgccgcttcccaaacactctctccgaaaaaactatacgcgactctcgactttcgnaccctcgaacgcccgcgccgaaaatccgaacccgaactatccgcgaccccctcttccccctcctccgccccgcgcaaacgaaaaacaaaattaccgaaaacgactaaaccnaaaaaactacaacccgaaccgaatactctaaccgcgacgacgccgacgccgaaacaactccgctccgaacgcgctaataaanaaaaaacgacgacgacgaaacccacaacgacgacccgaacaacaaaaacgacgacgacgacgactaaacgacccgaaaaaatacaacaacaatcgaaaaaaacgaccgaacccaataaacaaaaaccaaaaacgacgaccgaaacgatcgaacttcgcaacgcccgaacctaaaccaaacccacctaatnccgtcctcccgaccgacgnaccgaaacgcccnaaaaactaaaaacgcgaaaaatccaaataattctcgaaaacccctaaacgacgactacgcaaacccctaaaaaaaaaaaacgaccctcaacgccgtaaaaaaaaaaactccgcctaccc

SEQ ID NO: 9489 - DNA, 523 bp, Artificial Sequence
  chemically treated genomic DNA (Homo sapiens) CpG-island No: 9489
  misc_feature (60)..(60): n is either a, c, g or t
gcgtgtcgagttagggtcggaggaagtcggcggagcggcgaggaagaggaggaggagganggaaggggagtttcgtttgcgggtcgtatcgtacggtagtttaggggcgtcgcgattttttcggttgcgtttagtttttcgcgtttgtatcgcgttttcggtcgtcgggtttagtcgagtcgttttttcgcgggtttcgcgtcgtcgtcgtcgcggtttggttgattagtcgcgggcgggcgggcgggcgtagcgcgtagggcggaggtagtagcggcgttgggtcgggaggaggtcggttagggtgcggagcggtttcggttcgtttttagaggggagatggcgttttacgtagataatagttttcgttaggcggtgatgaagaattttttcgaaaggattttttaggtgagaacgcggcggtcgtttgtttttggtcggatttttgtttcgtaggttgcgtttttttttgtttttttattttttttttgatatagttcgtttcgagtattttattttttgt

SEQ ID NO: 9490 - DNA, 523 bp, Artificial Sequence
  chemically treated genomic DNA (Homo sapiens) CpG-island No: 9490
  misc_feature (464)..(464): n is either a, c, g or t
acaaaaaataaaatactcgaaacgaactatatcaaaaaaaaaataaaaaaacaaaaaaaaacgcaacctacgaaacaaaaatccgaccaaaaacaaacgaccgccgcgttctcacctaaaaaatcctttcgaaaaaattcttcatcaccgcctaacgaaaactattatctacgtaaaacgccatctcccctctaaaaacgaaccgaaaccgctccgcaccctaaccgacctcctcccgacccaacgccgctactacctccgccctacgcgctacgcccgcccgcccgcccgcgactaatcaaccaaaccgcgacgacgacgacgcgaaacccgcgaaaaaacgactcgactaaacccgacgaccgaaaacgcgatacaaacgcgaaaaactaaacgcaaccgaaaaaatcgcgacgcccctaaactaccgtacgatacgacccgcaaacgaaactccccttccntcctcctcctcctcttcctcgccgctccgccgacttcctccgaccctaactcgacacgc

SEQ ID NO: 9491 - DNA, 523 bp, Artificial Sequence
  chemically treated genomic DNA (Homo sapiens) CpG-island No: 9491
  misc_feature (464)..(464): n is either a, c, g or t
gtaagaagtggggtgttcggggcgaattgtgttaggaaggaggtggggggataggggaagacgtagtttgcgaggtagaaattcggttaagggtaggcggtcgtcgcgtttttatttggggggttttttcggggggattttttattatcgtttggcggaagttgttatttacgtaggacgttattttttttttgggagcgggtcggggtcgtttcgtattttggtcggttttttttcggtttagcgtcgttgttgttttcgttttgcgcgttgcgttcgttcgttcgttcgcgattaattagttaaatcgcggcggcggcggcgcggggttcgcgggggggcggttcggttgggttcggcggtcgagagcgcggtataggcgcgaggggttggacgtagtcgggagggtcgcggcgtttttaggttgtcgtgcgatgcggttcgtaggcggaattttttttttntttttttttttttttttttcgtcgtttcgtcggtttttttcggttttggttcgatacgt

SEQ ID NO: 9492 - DNA, 523 bp, Artificial Sequence
  chemically treated genomic DNA (Homo sapiens) CpG-island No: 9492
  misc_feature (60)..(60): n is either a, c, g or t
acgtatcgaaccaaaaccgaaaaaaaccgacgaaacgacgaaaaaaaaaaaaaaaaaaanaaaaaaaaaattccgcctacgaaccgcatcgcacgacaacctaaaaacgccgcgaccctcccgactacgtccaacccctcgcgcctataccgcgctctcgaccgccgaacccaaccgaaccgcccccccgcgaaccccgcgccgccgccgccgcgatttaactaattaatcgcgaacgaacgaacgaacgcaacgcgcaaaacgaaaacaacaacgacgctaaaccgaaaaaaaaccgaccaaaatacgaaacgaccccgacccgctcccaaaaaaaaaataacgtcctacgtaaataacaacttccgccaaacgataataaaaaatccccccgaaaaaaccccccaaataaaaacgcgacgaccgcctacccttaaccgaatttctacctcgcaaactacgtcttcccctatccccccacctccttcctaacacaattcgccccgaacaccccacttcttac

SEQ ID NO: 9493 - DNA, 579 bp, Artificial Sequence
  chemically treated genomic DNA (Homo sapiens) CpG-island No: 9493
  misc_feature (252)..(252): n is either a, c, g or t
cggtttcgggtagggagcgagcgagtgttttacgtcgttcgtaggatcgagtgagttacgcggtcgttagacgaggtcggtggcgtacgtattcgagattcgatgtagtgtatcgtttcggcgtcgcggttttcgtcgcgtagatatcgtattcgtagtatcgttttggttcggttggtttacgcgcggattgtttttggtttttgggtcgcgtcggtttaagttttttcgagagcgcgttcggagcggggntgggcgggcgcgcggggttcgaggttttttgtagtcgcgtttcgtttcggtcgtttttcgcggttttattggttgtcgggaataggtggtggggtcggcgtagcgtttcgaattaggaattgtcgggaagcgtcgcggtcgttggttcgagttttcgatgtttgtttttttttagttagcggggttattgacggtttttgttgtacgttcggattcggatttagattcgagcgtcgtaagaaggttcgttgggagtttcgcgtaattgggtagtgattcgatttttgacgaagtgataatgggttatgtatatattaagtgaatatt

SEQ ID NO: 9494 - DNA, 579 bp, Artificial Sequence
  chemically treated genomic DNA (Homo sapiens) CpG-island No: 9494
  misc_feature (328)..(328): n is either a, c, g or t
aatattcacttaatatatacataacccattatcacttcgtcaaaaatcgaatcactacccaattacgcgaaactcccaacgaaccttcttacgacgctcgaatctaaatccgaatccgaacgtacaacaaaaaccgtcaataaccccgctaactaaaaaaaaacaaacatcgaaaactcgaaccaacgaccgcgacgcttcccgacaattcctaattcgaaacgctacgccgaccccaccacctattcccgacaaccaataaaaccgcgaaaaacgaccgaaacgaaacgcgactacaaaaaacctcgaaccccgcgcgcccgcccanccccgctccgaacgcgctctcgaaaaaacttaaaccgacgcgacccaaaaaccaaaaacaatccgcgcgtaaaccaaccgaaccaaaacgatactacgaatacgatatctacgcgacgaaaaccgcgacgccgaaacgatacactacatcgaatctcgaatacgtacgccaccgacctcgtctaacgaccgcgtaactcactcgatcctacgaacgacgtaaaacactcgctcgctccctacccgaaaccg

SEQ ID NO: 9495 - DNA, 579 bp, Artificial Sequence
  chemically treated genomic DNA (Homo sapiens) CpG-island No: 9495
  misc_feature (328)..(328): n is either a, c, g or t
aatatttatttaatatatgtatagtttattgttatttcgttagaagtcgggttattgtttagttgcgcgagatttttaacgggtttttttgcgacgttcgggtttgggttcgggttcggacgtgtaatagaagtcgttagtggtttcgttggttaaaaaagggtaagtatcggaggttcgagttagcggtcgcggcgtttttcgatagtttttaattcggggcgttacgtcggttttattatttgttttcggtagttaatggggtcgcggggggcggtcggggcggagcgcggttataaaaggtttcgggtttcgcgcgttcgtttantttcgtttcgggcgcgttttcgggaaggtttggatcgacgcggtttagaggttaggaatagttcgcgcgtggattagtcgggttagggcgatgttgcgggtgcggtgtttgcgcggcgggagtcgcggcgtcgaggcggtgtattatatcggatttcgggtgcgtgcgttatcggtttcgtttggcggtcgcgtgatttattcgattttgcgggcggcgtggagtattcgttcgttttttgttcggagtcg

SEQ ID NO: 9496 - DNA, 579 bp, Artificial Sequence
  chemically treated genomic DNA (Homo sapiens) CpG-island No: 9496
  misc_feature (252)..(252): n is either a, c, g or t
cgactccgaacaaaaaacgaacgaatactccacgccgcccgcaaaatcgaataaatcacgcgaccgccaaacgaaaccgataacgcacgcacccgaaatccgatataatacaccgcctcgacgccgcgactcccgccgcgcaaacaccgcacccgcaacatcgccctaacccgactaatccacgcgcgaactattcctaacctctaaaccgcgtcgatccaaaccttcccgaaaacgcgcccgaaacgaaantaaacgaacgcgcgaaacccgaaaccttttataaccgcgctccgccccgaccgccccccgcgaccccattaactaccgaaaacaaataataaaaccgacgtaacgccccgaattaaaaactatcgaaaaacgccgcgaccgctaactcgaacctccgatacttacccttttttaaccaacgaaaccactaacgacttctattacacgtccgaacccgaacccaaacccgaacgtcgcaaaaaaacccgttaaaaatctcgcgcaactaaacaataacccgacttctaacgaaataacaataaactatacatatattaaataaatatt

SEQ ID NO: 9497 - DNA, 1478 bp, Artificial Sequence
  chemically treated genomic DNA (Homo sapiens) CpG-island No: 9497
  misc_feature (306)..(306): n is either a, c, g or t
  misc_feature (317)..(317): n is either a, c, g or t
  misc_feature (417)..(417): n is either a, c, g or t
  misc_feature (524)..(524): n is either a, c, g or t
  misc_feature (636)..(636): n is either a, c, g or t
  misc_feature (668)..(668): n is either a, c, g or t
  misc_feature (910)..(910): n is either a, c, g or t
  misc_feature (917)..(917): n is either a, c, g or t
  misc_feature (1470)..(1470): n is either a, c, g or t
aaacgttttcggggtagttaaatggcgttagaagcggtcgaggttttatcgatagtgggtaaattcgttaagtttatttatttttcggttaaatttttcgggtttacgtagcgttgggtttagagcgttcggtcggttagtggtttttataattacgatttcgcggtttttattggcgtcgtttaatagcgttaatatttgggttattacgcggttttcgggtgttcgattgtttcgttggggatataaggcgtttatttcgtttaggaagaggaggttgggttcgcggttggttagttttcgggncgcgttggaangattcgtcgtacgtttttttcggtttttttaggtcgggaattttgtagcgtcggggcgttgattgttagtagtttcgcgttcgtttcgcgcgttacggtntcgtattagttgggttttgtttatttcggggggtttcgttagtagtatttcgcgaggtatcgttaagtttagcgcggttagggcgcgcgggtagcggagcgggaggncggaggagttttcgtagcgagtcggtcgttttcgaaagattttttaggggtatttcgggttgcggttgggttttcgacggaggtttttcgttaaggttgacgcgggtacganggggtgattagtttagcgggatcgggattggngcgtttcgtcgacgatgtgtaaggtagttattaggttaggagcgtttggcggagcgattattacgtggtttagggagatcggtcggttttttagtagtttttgtgtcgtttttagtatcgcggttgtatttcgggtatcgggcgcgtttgtcggttttcgtaatatcggttatacggcgacgcgtcgtaggggcggatagggtattaggaggaggcgatttaggttgagattttttcgggantttcgancgtttcgatcgtcgtttcggggttcgcgtatagcgggtttagttgtataaagtcgttcgtttcgtttcgtcgaggttaggtagtgtagaggtaggagtcgtcgtcgggtagcgagattttaattgtcgagtttaagcgcgcgtttagggcgtggagggcggtcgggtttaggcggtagcgttgggtgtttcggtttttagcgtttaagggtagtagttttaagagcggttttttagggaagggattcgagttcggagttatcgtatatagatgaattaggtagacgaaattagattaggaaatttattcggtttataaaaagcggaatatcgagttcgtaggtcggaagtagattgcgcgtatgcgttagggaagattgcgttgttagtagttgagtgaaggtcgaaagggttaatggaaacgttagacgacgttcgggtttttgggtagagcgttggtgttcgttttcgtgaaatcgagttgtttaatttagagttttttcgagatggttttcgttataggtgtttgggaggcggtttaagtttattttatntaggttat

SEQ ID NO: 9498 - DNA, 1478 bp, Artificial Sequence
  chemically treated genomic DNA (Homo sapiens) CpG-island No: 9498
  misc_feature (9)..(9): n is either a, c, g or t
  misc_feature (562)..(562): n is either a, c, g or t
  misc_feature (569)..(569): n is either a, c, g or t
  misc_feature (811)..(811): n is either a, c, g or t
  misc_feature (843)..(843): n is either a, c, g or t
  misc_feature (955)..(955): n is either a, c, g or t
  misc_feature (1062)..(1062): n is either a, c, g or t
  misc_feature (1162)..(1162): n is either a, c, g or t
  misc_feature (1173)..(1173): n is either a, c, g or t
ataacctanataaaataaacttaaaccgcctcccaaacacctataacgaaaaccatctcgaaaaaactctaaattaaacaactcgatttcacgaaaacgaacaccaacgctctacccaaaaacccgaacgtcgtctaacgtttccattaaccctttcgaccttcactcaactactaacaacgcaatcttccctaacgcatacgcgcaatctacttccgacctacgaactcgatattccgctttttataaaccgaataaatttcctaatctaatttcgtctacctaattcatctatatacgataactccgaactcgaatcccttccctaaaaaaccgctcttaaaactactacccttaaacgctaaaaaccgaaacacccaacgctaccgcctaaacccgaccgccctccacgccctaaacgcgcgcttaaactcgacaattaaaatctcgctacccgacgacgactcctacctctacactacctaacctcgacgaaacgaaacgaacgactttatacaactaaacccgctatacgcgaaccccgaaacgacgatcgaaacgntcgaaantcccgaaaaaatctcaacctaaatcgcctcctcctaataccctatccgcccctacgacgcgtcgccgtataaccgatattacgaaaaccgacaaacgcgcccgatacccgaaatacaaccgcgatactaaaaacgacacaaaaactactaaaaaaccgaccgatctccctaaaccacgtaataatcgctccgccaaacgctcctaacctaataactaccttacacatcgtcgacgaaacgcnccaatcccgatcccgctaaactaatcaccccntcgtacccgcgtcaaccttaacgaaaaacctccgtcgaaaacccaaccgcaacccgaaatacccctaaaaaatctttcgaaaacgaccgactcgctacgaaaactcctccgncctcccgctccgctacccgcgcgccctaaccgcgctaaacttaacgatacctcgcgaaatactactaacgaaaccccccgaaataaacaaaacccaactaatacganaccgtaacgcgcgaaacgaacgcgaaactactaacaatcaacgccccgacgctacaaaattcccgacctaaaaaaaccgaaaaaaacgtacgacgaatcnttccaacgcgncccgaaaactaaccaaccgcgaacccaacctcctcttcctaaacgaaataaacgccttatatccccaacgaaacaatcgaacacccgaaaaccgcgtaataacccaaatattaacgctattaaacgacgccaataaaaaccgcgaaatcgtaattataaaaaccactaaccgaccgaacgctctaaacccaacgctacgtaaacccgaaaaatttaaccgaaaaataaataaacttaacgaatttacccactatcgataaaacctcgaccgcttctaacgccatttaactaccccgaaaacgttt

SEQ ID NO: 9499 - DNA, 1478 bp, Artificial Sequence
  chemically treated genomic DNA (Homo sapiens) CpG-island No: 9499
  misc_feature (9)..(9): n is either a, c, g or t
  misc_feature (562)..(562): n is either a, c, g or t
  misc_feature (569)..(569): n is either a, c, g or t
  misc_feature (811)..(811): n is either a, c, g or t
  misc_feature (843)..(843): n is either a, c, g or t
  misc_feature (955)..(955): n is either a, c, g or t
  misc_feature (1062)..(1062): n is either a, c, g or t
  misc_feature (1162)..(1162): n is either a, c, g or t
  misc_feature (1173)..(1173): n is either a, c, g or t
atgatttangtgaagtgagtttaagtcgttttttagatatttgtaacgaagattatttcgggaaagttttgggttaggtaattcgattttacgaaagcggatattaacgttttatttagaggttcgagcgtcgtttaacgtttttattggttttttcggtttttatttagttgttagtaacgtagttttttttagcgtatgcgcgtaatttgttttcggtttgcgagttcggtgtttcgttttttgtgggtcgggtgggttttttaatttggtttcgtttgtttggtttatttgtgtgcgatggtttcggattcggattttttttttgaagggtcgtttttaaagttgttatttttagacgttagagatcggggtatttagcgttgtcgtttgggttcggtcgttttttacgttttgggcgcgcgtttgggttcggtagttaagatttcgttattcgacggcggtttttgtttttgtattgtttggtttcggcgggacggagcggacggttttgtgtagttggattcgttgtgcgcgagtttcggggcggcggtcggggcgntcgagantttcggaggagttttagtttgaatcgtttttttttagtgttttgttcgtttttgcggcgcgtcgtcgtgtggtcggtgttgcgagagtcggtaggcgcgttcggtgttcggaatatagtcgcggtgttggaggcggtataggagttgttgagaaatcgatcgatttttttgggttacgtggtggtcgtttcgttaggcgtttttggtttggtggttgttttgtatatcgtcggcgggacgtnttagtttcgatttcgttgggttggttattttntcgtattcgcgttagttttggcggggagttttcgtcggaagtttagtcgtagttcgaggtgtttttgggaggtttttcggaggcggtcgattcgttgcgggagttttttcgntttttcgtttcgttattcgcgcgttttgatcgcgttgggtttagcggtgtttcgcggggtgttattggcggggtttttcggagtgggtaagatttagttggtgcggngtcgtggcgcgcgaggcgggcgcggagttgttggtagttagcgtttcggcgttgtagggttttcggtttggggagatcgaggagaacgtgcggcgggttnttttagcgcgnttcgggaattggttagtcgcggatttagttttttttttttggacgagatggacgttttgtgtttttagcggggtagtcgagtattcgagagtcgcgtagtggtttaggtgttgacgttgttggacggcgttagtggggatcgcgaggtcgtggttgtgggagttattaatcggtcggacgttttagatttagcgttgcgtagattcgggagatttgatcgagaggtgaatgggtttggcgggtttgtttattgtcggtggaatttcggtcgtttttggcgttatttggttgtttcggaggcgttt

SEQ ID NO: 9500 - DNA, 1478 bp, Artificial Sequence
  chemically treated genomic DNA (Homo sapiens) CpG-island No: 9500
  misc_feature (306)..(306): n is either a, c, g or t
  misc_feature (317)..(317): n is either a, c, g or t
  misc_feature (417)..(417): n is either a, c, g or t
  misc_feature (524)..(524): n is either a, c, g or t
  misc_feature (636)..(636): n is either a, c, g or t
  misc_feature (668)..(668): n is either a, c, g or t
  misc_feature (910)..(910): n is either a, c, g or t
  misc_feature (917)..(917): n is either a, c, g or t
  misc_feature (1470)..(1470): n is either a, c, g or t
aaacgcctccgaaacaaccaaataacgccaaaaacgaccgaaattccaccgacaataaacaaacccgccaaacccattcacctctcgatcaaatctcccgaatctacgcaacgctaaatctaaaacgtccgaccgattaataactcccacaaccacgacctcgcgatccccactaacgccgtccaacaacgtcaacacctaaaccactacgcgactctcgaatactcgactaccccgctaaaaacacaaaacgtccatctcgtccaaaaaaaaaaaactaaatccgcgactaaccaattcccgaancgcgctaaaanaacccgccgcacgttctcctcgatctccccaaaccgaaaaccctacaacgccgaaacgctaactaccaacaactccgcgcccgcctcgcgcgccacgacnccgcaccaactaaatcttacccactccgaaaaaccccgccaataacaccccgcgaaacaccgctaaacccaacgcgatcaaaacgcgcgaataacgaaacgaaaaancgaaaaaactcccgcaacgaatcgaccgcctccgaaaaacctcccaaaaacacctcgaactacgactaaacttccgacgaaaactccccgccaaaactaacgcgaatacganaaaataaccaacccaacgaaatcgaaactaanacgtcccgccgacgatatacaaaacaaccaccaaaccaaaaacgcctaacgaaacgaccaccacgtaacccaaaaaaatcgatcgatttctcaacaactcctataccgcctccaacaccgcgactatattccgaacaccgaacgcgcctaccgactctcgcaacaccgaccacacgacgacgcgccgcaaaaacgaacaaaacactaaaaaaaaacgattcaaactaaaactcctccgaaantctcgancgccccgaccgccgccccgaaactcgcgcacaacgaatccaactacacaaaaccgtccgctccgtcccgccgaaaccaaacaatacaaaaacaaaaaccgccgtcgaataacgaaatcttaactaccgaacccaaacgcgcgcccaaaacgtaaaaaacgaccgaacccaaacgacaacgctaaataccccgatctctaacgtctaaaaataacaactttaaaaacgacccttcaaaaaaaaaatccgaatccgaaaccatcgcacacaaataaaccaaacaaacgaaaccaaattaaaaaacccacccgacccacaaaaaacgaaacaccgaactcgcaaaccgaaaacaaattacgcgcatacgctaaaaaaaactacgttactaacaactaaataaaaaccgaaaaaaccaataaaaacgttaaacgacgctcgaacctctaaataaaacgttaatatccgctttcgtaaaatcgaattacctaacccaaaactttcccgaaataatcttcgttacaaatatctaaaaaacgacttaaactcacttcacntaaatcat

SEQ ID NO: 9501 - DNA, 638 bp, Artificial Sequence
  chemically treated genomic DNA (Homo sapiens) CpG-island No: 9501
gtttttgggtttcgcggggatcgcgtcgtcgttttcgtgagttatttttacgtttttcggggttcgtttgtcgttttcgtcgacgtttagagttcggttcgggtttaatttttttacgggtttttcggcggtagcggcggcgagcggcggcgtgtagcggcgagagtttttatcgttcgggtttcgatgagtaattttcggaataatcgggtgatggtggaaggggttggcgttcgggtagtgcgcggttcggattggaagtgggggaagtaggacggcggcgagggttatgtgggtatcgttcggagtttcgagagtttcgaggaggtggtggtagtgtgggataacggtatagttgttaattatcgttgtttcggggtttacgattttcgtattttggatagcgcgtttatcggtaagtcgcggttatttggttagggtttgcgcgcgcggggggaaggggcgagttgcggtgggcgtcggtgtcgcggggagaggtttgtagtgggatatttggtgggtagcgttcggttggagcgagcggaaaggtaaagcgttaaaggaattttaggtttcgaacgggtgaataaatatttttagaaaagattttttatttttaagggaaatgatggtagtat

SEQ ID NO: 9502 - DNA, 638 bp, Artificial Sequence
  chemically treated genomic DNA (Homo sapiens) CpG-island No: 9502
atactaccatcatttcccttaaaaataaaaaatcttttctaaaaatatttattcacccgttcgaaacctaaaattcctttaacgctttacctttccgctcgctccaaccgaacgctacccaccaaatatcccactacaaacctctccccgcgacaccgacgcccaccgcaactcgccccttccccccgcgcgcgcaaaccctaaccaaataaccgcgacttaccgataaacgcgctatccaaaatacgaaaatcgtaaaccccgaaacaacgataattaacaactataccgttatcccacactaccaccacctcctcgaaactctcgaaactccgaacgatacccacataaccctcgccgccgtcctacttcccccacttccaatccgaaccgcgcactacccgaacgccaaccccttccaccatcacccgattattccgaaaattactcatcgaaacccgaacgataaaaactctcgccgctacacgccgccgctcgccgccgctaccgccgaaaaacccgtaaaaaaattaaacccgaaccgaactctaaacgtcgacgaaaacgacaaacgaaccccgaaaaacgtaaaaataactcacgaaaacgacgacgcgatccccgcgaaacccaaaaac

SEQ ID NO: 9503 - DNA, 638 bp, Artificial Sequence
  chemically treated genomic DNA (Homo sapiens) CpG-island No: 9503
gtgttgttattattttttttgggggtagagggttttttttgaaagtgtttgtttattcgttcggaatttagaatttttttggcgttttgttttttcgttcgttttagtcgggcgttgtttattaggtgttttattgtagattttttttcgcgatatcgacgtttatcgtagttcgtttttttttttcgcgcgcgtaagttttggttaggtggtcgcggtttatcggtgggcgcgttgtttaggatgcggaggtcgtaagtttcggagtagcggtagttggtagttgtgtcgttgttttatattattattattttttcggggttttcgaagtttcggacggtgtttatatggttttcgtcgtcgttttgttttttttatttttagttcgggtcgcgtattattcgagcgttaattttttttattattattcggttatttcgggagttatttatcggggttcgggcggtaggggttttcgtcgttgtacgtcgtcgttcgtcgtcgttgtcgtcggggggttcgtgagggagttgggttcgggtcggattttaggcgtcggcgggggcggtaggcgagtttcgggggacgtgagaataatttacgggggcggcggcgcggttttcgcggagtttaaagat

SEQ ID NO: 9504 - DNA, 638 bp, Artificial Sequence
  chemically treated genomic DNA (Homo sapiens) CpG-island No: 9504
atctttaaactccgcgaaaaccgcgccgccgcccccgtaaattattctcacgtcccccgaaactcgcctaccgcccccgccgacgcctaaaatccgacccgaacccaactccctcacgaaccccccgacgacaacgacgacgaacgacgacgtacaacgacgaaaacccctaccgcccgaaccccgataaataactcccgaaataaccgaataataataaaaaaaattaacgctcgaataatacgcgacccgaactaaaaataaaaaaaacaaaacgacgacgaaaaccatataaacaccgtccgaaacttcgaaaaccccgaaaaaataataataatataaaacaacgacacaactaccaactaccgctactccgaaacttacgacctccgcatcctaaacaacgcgcccaccgataaaccgcgaccacctaaccaaaacttacgcgcgcgaaaaaaaaaaacgaactacgataaacgtcgatatcgcgaaaaaaaatctacaataaaacacctaataaacaacgcccgactaaaacgaacgaaaaaacaaaacgccaaaaaaattctaaattccgaacgaataaacaaacactttcaaaaaaaaccctctacccccaaaaaaaataataacaacac

SEQ ID NO: 9505 - DNA, 576 bp, Artificial Sequence
  chemically treated genomic DNA (Homo sapiens) CpG-island No: 9505
  misc_feature (249)..(249): n is either a, c, g or t
gttttcgtgttcgtgtttgttcgaattggcggcggtttgggtagaaaacgttttttttttttttttttttttttttttttttttttttttttttttttttttttttttttttcgcgggtttcggcgaagatttcgtcgttattgtttttgttttcgttgttttttagggaggtatcgtcggcgttcggttcggcgttgttatttcgggtttggatcgcgcggcgtagagcgcgtggggtcggattcggngtggtcgcgcggggacgtcggcgtcggggattttcggcgtttttgggtcgttggttgtttataaaagtcgcgcgagtagaggtggcggcggcgcgtaggggcggggggtcgcgtgggggtttttacgtcggtagtgggtaattttaggagatggcgaagaacgtttttttttcgcgcggggaaagtacgttagttttagttagtcggttcgggaacggtagttcggcgttcgcggtcgggagaagagaattggacgtgttattagtaggataggtaatggttttaaagttttaggttaatggttattagtagaggtagagttcgttt

SEQ ID NO: 9506 - DNA, 576 bp, Artificial Sequence
  chemically treated genomic DNA (Homo sapiens) CpG-island No: 9506
  misc_feature (328)..(328): n is either a, c, g or t
aaacgaactctacctctactaataaccattaacctaaaactttaaaaccattacctatcctactaataacacgtccaattctcttctcccgaccgcgaacgccgaactaccgttcccgaaccgactaactaaaactaacgtactttccccgcgcgaaaaaaaaacgttcttcgccatctcctaaaattacccactaccgacgtaaaaacccccacgcgaccccccgcccctacgcgccgccgccacctctactcgcgcgacttttataaacaaccaacgacccaaaaacgccgaaaatccccgacgccgacgtccccgcgcgaccacnccgaatccgaccccacgcgctctacgccgcgcgatccaaacccgaaataacaacgccgaaccgaacgccgacgatacctccctaaaaaacaacgaaaacaaaaacaataacgacgaaatcttcgccgaaacccgcgaaaaaaaaaaaaaaaaaaaaaaaaaaaaaaaaaaaaaaaaaaaaaaaaaaaaaaaaaaaaaacgttttctacccaaaccgccgccaattcgaacaaacacgaacacgaaaac

SEQ ID NO: 9507 - DNA, 576 bp, Artificial Sequence
  chemically treated genomic DNA (Homo sapiens) CpG-island No: 9507
  misc_feature (328)..(328): n is either a, c, g or t
gagcgagttttgtttttgttaatggttattggtttggggttttgaaattattgtttgttttgttaatgatacgtttagtttttttttttcggtcgcggacgtcgggttgtcgttttcgggtcggttgattgggattggcgtatttttttcgcgcgggggaggggcgtttttcgttattttttggggttgtttattgtcggcgtgggggtttttacgcggtttttcgtttttgcgcgtcgtcgttatttttgttcgcgcgatttttgtaggtagttagcggtttaggggcgtcgggggttttcggcgtcgacgttttcgcgcggttatntcgggttcggttttacgcgttttgcgtcgcgcggtttaagttcggaatggtagcgtcgggtcgggcgtcggcggtgtttttttggggggtagcggaggtagaggtagtggcggcgggattttcgtcggggttcgcgggaggaggaggaggagagggagaaggaggaggggaagaaggaggaagaggaggagagggaggcgttttttgtttagatcgtcgttagttcgagtaggtacgggtacggggat

SEQ ID NO: 9508 - DNA, 576 bp, Artificial Sequence
  chemically treated genomic DNA (Homo sapiens) CpG-island No: 9508
  misc_feature (249)..(249): n is either a, c, g or t
atccccgtacccgtacctactcgaactaacgacgatctaaacaaaaaacgcctccctctcctcctcttcctccttcttcccctcctccttctccctctcctcctcctcctcccgcgaaccccgacgaaaatcccgccgccactacctctacctccgctaccccccaaaaaaacaccgccgacgcccgacccgacgctaccattccgaacttaaaccgcgcgacgcaaaacgcgtaaaaccgaacccganataaccgcgcgaaaacgtcgacgccgaaaacccccgacgcccctaaaccgctaactacctacaaaaatcgcgcgaacaaaaataacgacgacgcgcaaaaacgaaaaaccgcgtaaaaacccccacgccgacaataaacaaccccaaaaaataacgaaaaacgcccctcccccgcgcgaaaaaaatacgccaatcccaatcaaccgacccgaaaacgacaacccgacgtccgcgaccgaaaaaaaaaaactaaacgtatcattaacaaaacaaacaataatttcaaaaccccaaaccaataaccattaacaaaaacaaaactcgctc

SEQ ID NO: 9509 - DNA, 569 bp, Artificial Sequence
  chemically treated genomic DNA (Homo sapiens) CpG-island No: 9509
gtcgggtagcgtaaaggtttcgtcgggttttagaaaggtcgggtaggttacgtcgggttggtttttgtcgtcgtggtagaggcggttgcggtttaggttttagttttacgattcggcgttattgtttattagcgtcgtgtagtttacggagtgtaggggagtacgggtcgtggttatattaattatagcgtgggtgtcgcgttgtcgagtcggttagttgatttgttaggcgtgtaggtcgcgggcgtggtttattttgtcgcggatgtcgtcggtgttttgggttacggggtgtcggtggaaggtgagtcggtcgtcgtttttgacgaagacgttgagcgagcggttttcggggttttacgcgtgtcgtagttgtatagttagtttcgtcgttggtatgtttaatagttggtttagtcgcgtcggtcgttcgggttttgtatttcgtagttttcgtttggtcggtcgtagcgtcggttttcgtatttttattgatttgaggtttttcgagagtttttggtttatgttttattgcggggaggaggtcgttgtaggttatcgttatttcg

SEQ ID NO: 9510 - DNA, 569 bp, Artificial Sequence
  chemically treated genomic DNA (Homo sapiens) CpG-island No: 9510
cgaaataacgataacctacaacgacctcctccccgcaataaaacataaaccaaaaactctcgaaaaacctcaaatcaataaaaatacgaaaaccgacgctacgaccgaccaaacgaaaactacgaaatacaaaacccgaacgaccgacgcgactaaaccaactattaaacataccaacgacgaaactaactatacaactacgacacgcgtaaaaccccgaaaaccgctcgctcaacgtcttcgtcaaaaacgacgaccgactcaccttccaccgacaccccgtaacccaaaacaccgacgacatccgcgacaaaataaaccacgcccgcgacctacacgcctaacaaatcaactaaccgactcgacaacgcgacacccacgctataattaatataaccacgacccgtactcccctacactccgtaaactacacgacgctaataaacaataacgccgaatcgtaaaactaaaacctaaaccgcaaccgcctctaccacgacgacaaaaaccaacccgacgtaacctacccgacctttctaaaacccgacgaaacctttacgctacccgac

SEQ ID NO: 9511 - DNA, 569 bp, Artificial Sequence
  chemically treated genomic DNA (Homo sapiens) CpG-island No: 9511
cgaggtagcggtggtttgtagcggtttttttttcgtagtgaagtatgggttagaagttttcggggagttttaagttagtggaggtgcgagagtcggcgttgcggtcggttaagcgggagttgcggggtgtagagttcgggcggtcggcgcggttggattagttgttggatatgttagcggcggggttggttgtgtagttgcggtacgcgtggaatttcgaggatcgttcgtttaacgttttcgttaaggacgacgatcggtttattttttatcggtatttcgtggtttagagtatcgacggtattcgcggtaaggtgggttacgttcgcggtttgtacgtttggtagattaattggtcggttcggtagcgcggtatttacgttgtagttggtgtggttacggttcgtgtttttttgtatttcgtgggttatacggcgttggtaggtagtgacgtcgagtcgtggggttgggatttgggtcgtagtcgtttttattacgacggtaagaattagttcggcgtggtttattcggtttttttggggttcgacgaggtttttgcgttgttcgat

SEQ ID NO: 9512 - DNA, 569 bp, Artificial Sequence
  chemically treated genomic DNA (Homo sapiens) CpG-island No: 9512
atcgaacaacgcaaaaacctcgtcgaaccccaaaaaaaccgaataaaccacgccgaactaattcttaccgtcgtaataaaaacgactacgacccaaatcccaaccccacgactcgacgtcactacctaccaacgccgtataacccacgaaatacaaaaaaacacgaaccgtaaccacaccaactacaacgtaaataccgcgctaccgaaccgaccaattaatctaccaaacgtacaaaccgcgaacgtaacccaccttaccgcgaataccgtcgatactctaaaccacgaaataccgataaaaaataaaccgatcgtcgtccttaacgaaaacgttaaacgaacgatcctcgaaattccacgcgtaccgcaactacacaaccaaccccgccgctaacatatccaacaactaatccaaccgcgccgaccgcccgaactctacaccccgcaactcccgcttaaccgaccgcaacgccgactctcgcacctccactaacttaaaactccccgaaaacttctaacccatacttcactacgaaaaaaaaaccgctacaaaccaccgctacctcg

SEQ ID NO: 9513 - DNA, 610 bp, Artificial Sequence
  chemically treated genomic DNA (Homo sapiens) CpG-island No: 9513
ttatcgcgattgtatttttttatcgataaaaggtggtttttagggtattttttttagatggcggcggcggttttcgacggtttttttattagtatttttcgcgggcggcggttttcgttagcgcggcgcggttttagtaattagagtaatcgtcgtacgtttttattcgtcgttaggttttacgcgttttagttagttgggcgggttcggtttagacgagggatcgggggcggggtttaggcgcgagttcgtttatatcgcgcgtttcgcgtgttgtttcgttttttatttttgtttttgtcgtcgtcggttaatgagggcgcgtatcgcgcggtaggtcgagatggcgttatgtcgcgtttggttaatcggaggcggcgtaatttgcgcggcgacgtttcgaaaggcgttagggcgatgttgcgtggtgcgggttggggcgtggggatgggcgcgggtcggtttcggcgtgggtggggttaggggtcgtttaggaggcgttttggggtcgggatcggcgtcggggtcggggttggggttggtttatcgtagtagttttagtttttgcgttttttttggattgaggtgtgttcgttttgaggagaagttt

SEQ ID NO: 9514 - DNA, 610 bp, Artificial Sequence
  chemically treated genomic DNA (Homo sapiens) CpG-island No: 9514
aaacttctcctcaaaacgaacacacctcaatccaaaaaaaacgcaaaaactaaaactactacgataaaccaaccccaaccccgaccccgacgccgatcccgaccccaaaacgcctcctaaacgacccctaaccccacccacgccgaaaccgacccgcgcccatccccacgccccaacccgcaccacgcaacatcgccctaacgcctttcgaaacgtcgccgcgcaaattacgccgcctccgattaaccaaacgcgacataacgccatctcgacctaccgcgcgatacgcgccctcattaaccgacgacgacaaaaacaaaaataaaaaacgaaacaacacgcgaaacgcgcgatataaacgaactcgcgcctaaaccccgcccccgatccctcgtctaaaccgaacccgcccaactaactaaaacgcgtaaaacctaacgacgaataaaaacgtacgacgattactctaattactaaaaccgcgccgcgctaacgaaaaccgccgcccgcgaaaaatactaataaaaaaaccgtcgaaaaccgccgccgccatctaaaaaaaataccctaaaaaccaccttttatcgataaaaaaatacaatcgcgataa

SEQ ID NO: 9515 - DNA, 610 bp, Artificial Sequence
  chemically treated genomic DNA (Homo sapiens) CpG-island No: 9515
aggtttttttttaaagcgagtatattttagtttagggagggcgtaggagttggggttgttgcggtgaattaattttaatttcgatttcgacgtcgatttcggttttagagcgttttttaggcgatttttggttttatttacgtcggagtcggttcgcgtttatttttacgttttaattcgtattacgtaatatcgttttagcgtttttcggggcgtcgtcgcgtaggttgcgtcgttttcgattggttaaacgcggtatagcgttatttcggtttatcgcgcggtgcgcgtttttattggtcggcggcggtaggagtaggggtagggggcggggtagtacgcggggcgcgcggtatgggcggattcgcgtttgagtttcgttttcggtttttcgtttgggtcgagttcgtttagttggttgagacgcgtggagtttggcggcgagtgggggcgtgcgacggttattttggttattggggtcgcgtcgcgttggcgagagtcgtcgttcgcgagggatgttggtgaggaagtcgtcgggagtcgtcgtcgttatttgagggaggtattttggaaattattttttatcggtggggaagtgtagtcgcggtgg

SEQ ID NO: 9516 - DNA, 610 bp, Artificial Sequence
  chemically treated genomic DNA (Homo sapiens) CpG-island No: 9516
ccaccgcgactacacttccccaccgataaaaaataatttccaaaatacctccctcaaataacgacgacgactcccgacgacttcctcaccaacatccctcgcgaacgacgactctcgccaacgcgacgcgaccccaataaccaaaataaccgtcgcacgcccccactcgccgccaaactccacgcgtctcaaccaactaaacgaactcgacccaaacgaaaaaccgaaaacgaaactcaaacgcgaatccgcccataccgcgcgccccgcgtactaccccgccccctacccctactcctaccgccgccgaccaataaaaacgcgcaccgcgcgataaaccgaaataacgctataccgcgtttaaccaatcgaaaacgacgcaacctacgcgacgacgccccgaaaaacgctaaaacgatattacgtaatacgaattaaaacgtaaaaataaacgcgaaccgactccgacgtaaataaaaccaaaaatcgcctaaaaaacgctctaaaaccgaaatcgacgtcgaaatcgaaattaaaattaattcaccgcaacaaccccaactcctacgccctccctaaactaaaatatactcgctttaaaaaaaaacct

SEQ ID NO: 9517 - DNA, 921 bp, Artificial Sequence
  chemically treated genomic DNA (Homo sapiens) CpG-island No: 9517
tataaacgcgtttcgagatcgtttggtattaataaagggtgcgtcgtttgttagggtcggggtcgtttgtgtttagtcgggttcgtttcgattttttgtaattttcgtttttaggacgggaacgcgtttacgtttagttcgcggtttcggttttaggttttcggtacgcgtcgttttttttagttgcgacgttgcggtttttcggacgtcgggatttatagttgcgcggtggggacggttcgcgtcggatcggttcgtttgatcgtgcgcggtgggtacggggtgatgtggaggttgggtattgttttgggcgcgagatttgcggagttgtttttttcggattttgatgatcgcgcgtgtttttagaaagggggcgtggatgtggcgtgatcggtaattgttttttgtttcgtttcgtttacgtttcgagtttcgtttagtagcgtattgtggcggtatttttcgagttgcggtcggtgagcgtttcgcgaaggcgacggcgttacgttcgagtgtatcgtgtcggaggtcgagattacggggcgttgggagttcggaggtcgttcgttgagattcggagcgcggttcgtattcgataggaaggtttgttcgtttggttattttttcgggtttttcgttgtttcgtttaggttcgaatagatttcgtttatcgggataagtttcgttttggtttcgacgggtttcgttttacggttttgtgagtttcgtttttgttttttttttcgtttttagtttttagtttcggatttttaggtttttcgttcgtatttttgtttcgtttattttagtatatattaacggcgttcgaatcgatttagggtttgttgggtttttattttcgtttttaacgttttttagaggtggtttcggtttcgttagcgatttttttatttttaggga

SEQ ID NO: 9518 - DNA, 921 bp, Artificial Sequence
  chemically treated genomic DNA (Homo sapiens) CpG-island No: 9518
tccctaaaaataaaaaaatcgctaacgaaaccgaaaccacctctaaaaaacgttaaaaacgaaaataaaaacccaacaaaccctaaatcgattcgaacgccgttaatatatactaaaataaacgaaacaaaaatacgaacgaaaaacctaaaaatccgaaactaaaaactaaaaacgaaaaaaaaaacaaaaacgaaactcacaaaaccgtaaaacgaaacccgtcgaaaccaaaacgaaacttatcccgataaacgaaatctattcgaacctaaacgaaacaacgaaaaacccgaaaaaataaccaaacgaacaaaccttcctatcgaatacgaaccgcgctccgaatctcaacgaacgacctccgaactcccaacgccccgtaatctcgacctccgacacgatacactcgaacgtaacgccgtcgccttcgcgaaacgctcaccgaccgcaactcgaaaaataccgccacaatacgctactaaacgaaactcgaaacgtaaacgaaacgaaacaaaaaacaattaccgatcacgccacatccacgccccctttctaaaaacacgcgcgatcatcaaaatccgaaaaaaacaactccgcaaatctcgcgcccaaaacaatacccaacctccacatcaccccgtacccaccgcgcacgatcaaacgaaccgatccgacgcgaaccgtccccaccgcgcaactataaatcccgacgtccgaaaaaccgcaacgtcgcaactaaaaaaaacgacgcgtaccgaaaacctaaaaccgaaaccgcgaactaaacgtaaacgcgttcccgtcctaaaaacgaaaattacaaaaaatcgaaacgaacccgactaaacacaaacgaccccgaccctaacaaacgacgcaccctttattaataccaaacgatctcgaaacgcgtttata

SEQ ID NO: 9519 - DNA, 921 bp, Artificial Sequence
  chemically treated genomic DNA (Homo sapiens) CpG-island No: 9519
tttttgggggtgagggggtcgttagcgaggtcggagttatttttgaggagcgttggggacgaaggtgggggtttagtaggttttgggtcggttcggacgtcgttagtgtatgttagggtgggcggaatagggatgcggacgggaagtttagaggttcgggattaggggttgggggcgggggaaagaatagggacgaggtttatagggtcgtggggcggggttcgtcggagttagggcggggtttgtttcggtgggcgggatttgttcgagtttgggcggggtagcgaggggttcgaaaaggtaattaggcgggtagatttttttgtcggatgcggatcgcgtttcgggttttagcgggcggttttcgagtttttagcgtttcgtggtttcgattttcgatacggtgtattcgaacgtagcgtcgtcgttttcgcgggacgtttatcgatcgtagttcggagagtatcgttatagtacgttattgggcggagttcggagcgtgagcggagcggggtagagggtagttatcggttacgttatatttacgttttttttttagaagtacgcgcggttattagggttcggggaagatagtttcgtaagtttcgcgtttaaagtagtgtttagtttttatattatttcgtatttatcgcgtacggttaggcggatcggttcggcgcgggtcgtttttatcgcgtagttgtaggtttcggcgttcgaggggtcgtagcgtcgtagttggagaaggcggcgcgtgtcgagggtttggagtcggagtcgcgggttaggcgtaagcgcgttttcgttttaggggcgggagttgtagagggtcggggcgagttcggttgggtataggcgatttcggttttggtaggcggcgtattttttgttgatgttaagcggtttcgaggcgcgtttatg

SEQ ID NO: 9520 - DNA, 921 bp, Artificial Sequence
  chemically treated genomic DNA (Homo sapiens) CpG-island No: 9520
cataaacgcgcctcgaaaccgcttaacatcaacaaaaaatacgccgcctaccaaaaccgaaatcgcctatacccaaccgaactcgccccgaccctctacaactcccgcccctaaaacgaaaacgcgcttacgcctaacccgcgactccgactccaaaccctcgacacgcgccgccttctccaactacgacgctacgacccctcgaacgccgaaacctacaactacgcgataaaaacgacccgcgccgaaccgatccgcctaaccgtacgcgataaatacgaaataatataaaaactaaacactactttaaacgcgaaacttacgaaactatcttccccgaaccctaataaccgcgcgtacttctaaaaaaaaaacgtaaatataacgtaaccgataactaccctctaccccgctccgctcacgctccgaactccgcccaataacgtactataacgatactctccgaactacgatcgataaacgtcccgcgaaaacgacgacgctacgttcgaatacaccgtatcgaaaatcgaaaccacgaaacgctaaaaactcgaaaaccgcccgctaaaacccgaaacgcgatccgcatccgacaaaaaaatctacccgcctaattaccttttcgaacccctcgctaccccgcccaaactcgaacaaatcccgcccaccgaaacaaaccccgccctaactccgacgaaccccgccccacgaccctataaacctcgtccctattctttcccccgcccccaacccctaatcccgaacctctaaacttcccgtccgcatccctattccgcccaccctaacatacactaacgacgtccgaaccgacccaaaacctactaaacccccaccttcgtccccaacgctcctcaaaaataactccgacctcgctaacgaccccctcacccccaaaaa

SEQ ID NO: 9521 - DNA, 582 bp, Artificial Sequence
  chemically treated genomic DNA (Homo sapiens) CpG-island No: 9521
ggcgtttggagaagaggcgtacgggtaggtgaggtgttgcggggtttcgcgtgggggtacgtcgcggggttgagtgagttacggttcgttcgttcgtattgtgcggttcggcgcggcgcggcggcggcggcgtaggggaggtgcggaggagtaggaggagggagcgcgggtgcggcgtcgggcgtgttggcggttgcggagggaggttgttagggagagtcgggcgagtcgcggtgcgttcgggagaacgcgggggatatggggcggcggcgcggggggcgtagacgcgggggaggaggagcggggagggtaggcgggtagggggagaggggcgtgttagggtgcgtggcgtggagggggcgagacgggaggtgagtgcggtcgggtgggggggaggagaggagtgaggcgagtgtcgttaggtggcgtaagggcggaggggggaggatacggaggtgcgagcgagataggagaggtgtaggggaggtgtgggtgaaggagatgtggggcggggaggcgggtgatagagagtgcgcgcggggggggggagagggagaaggggagcgtagggggagagagttg

SEQ ID NO: 9522 - DNA, 582 bp, Artificial Sequence
  chemically treated genomic DNA (Homo sapiens) CpG-island No: 9522
caactctctccccctacgctccccttctccctctccccccccccgcgcgcactctctatcacccgcctccccgccccacatctccttcacccacacctcccctacacctctcctatctcgctcgcacctccgtatcctcccccctccgcccttacgccacctaacgacactcgcctcactcctctcctcccccccacccgaccgcactcacctcccgtctcgccccctccacgccacgcaccctaacacgcccctctccccctacccgcctaccctccccgctcctcctcccccgcgtctacgccccccgcgccgccgccccatatcccccgcgttctcccgaacgcaccgcgactcgcccgactctccctaacaacctccctccgcaaccgccaacacgcccgacgccgcacccgcgctccctcctcctactcctccgcacctcccctacgccgccgccgccgcgccgcgccgaaccgcacaatacgaacgaacgaaccgtaactcactcaaccccgcgacgtacccccacgcgaaaccccgcaacacctcacctacccgtacgcctcttctccaaacgcc

SEQ ID NO: 9523 - DNA, 582 bp, Artificial Sequence
  chemically treated genomic DNA (Homo sapiens) CpG-island No: 9523
taattttttttttttacgtttttttttttttttttttttttttcgcgcgtattttttgttattcgttttttcgttttatattttttttatttatattttttttgtattttttttatttcgttcgtattttcgtattttttttttttcgtttttacgttatttagcgatattcgttttatttttttttttttttttattcggtcgtatttatttttcgtttcgttttttttacgttacgtattttggtacgtttttttttttttgttcgtttgtttttttcgttttttttttttcgcgtttgcgtttttcgcgtcgtcgttttatgtttttcgcgttttttcgagcgtatcgcgattcgttcggttttttttgatagttttttttcgtagtcgttagtacgttcgacgtcgtattcgcgttttttttttttgttttttcgtattttttttgcgtcgtcgtcgtcgcgtcgcgtcgggtcgtataatgcgagcgggcggatcgtgatttatttagtttcgcggcgtgtttttacgcggggtttcgtagtattttatttgttcgtgcgttttttttttaggcgtt

SEQ ID NO: 9524 - DNA, 582 bp, Artificial Sequence
  chemically treated genomic DNA (Homo sapiens) CpG-island No: 9524
aacgcctaaaaaaaaaacgcacgaacaaataaaatactacgaaaccccgcgtaaaaacacgccgcgaaactaaataaatcacgatccgcccgctcgcattatacgacccgacgcgacgcgacgacgacgacgcaaaaaaaatacgaaaaaacaaaaaaaaaaaacgcgaatacgacgtcgaacgtactaacgactacgaaaaaaaactatcaaaaaaaaccgaacgaatcgcgatacgctcgaaaaaacgcgaaaaacataaaacgacgacgcgaaaaacgcaaacgcgaaaaaaaaaaaacgaaaaaaacaaacgaacaaaaaaaaaaaaacgtaccaaaatacgtaacgtaaaaaaaacgaaacgaaaaataaatacgaccgaataaaaaaaaaaaaaaaaataaaacgaatatcgctaaataacgtaaaaacgaaaaaaaaaaaatacgaaaatacgaacgaaataaaaaaaatacaaaaaaaatataaataaaaaaaatataaaacgaaaaaacgaataacaaaaaatacgcgcgaaaaaaaaaaaaaaaaaaaaaaaaacgtaaaaaaaaaaaatta

SEQ ID NO: 9525 - DNA, 712 bp, Artificial Sequence
  chemically treated genomic DNA (Homo sapiens) CpG-island No: 9525
acgagtacgagtaaggcgacgatttcgaagggggtttacgtaggtattaaggtagtaacgaaagcgttaatgtacgtcgcgacgtttgattggtagcgaggtaagcgagcgaagtagggaagcgtatcgtaacggttgttagggtcggaaatcgacggtaacgtatcggtttcgtacgtcggtaatgtatatgaagcgtatcgtagatagatgttatgcgagggacggaacgcgattcgtagttatcggaacgggaggatatttacgttacgtaatcgacggaacgtatcgcgatgtcgtagcgaacgtacgtgtaggagcggtacgcgaacgcgatgggaacggtcggttaggtaaggtaacgttagtttttgcgatcgttgcgttaaacgtaacgcgaaggtaaggttacgtgtaagtaatcggcgagcgacgcgtaacggtacggtaacggttacgcgtatgtacgggcgaagcgtacgcgatgtggaatcggaatcggtaagcgataggtattttataggcgtaaaggtatgggtaagcggagacgtaaacgggaaacgaacgcgttacgcgacggttggtcggatagggtaaagttataagtattagtgtacgcgttgacggcgtaggttttagtttaaacgaatacggtatatcggtaagcggatacgtgcgatacgggaaaggcgtaataggagaggtgttatcg

SEQ ID NO: 9526 - DNA, 712 bp, Artificial Sequence
  chemically treated genomic DNA (Homo sapiens) CpG-island No: 9526
cgataacacctctcctattacgcctttcccgtatcgcacgtatccgcttaccgatataccgtattcgtttaaactaaaacctacgccgtcaacgcgtacactaatacttataactttaccctatccgaccaaccgtcgcgtaacgcgttcgtttcccgtttacgtctccgcttacccatacctttacgcctataaaatacctatcgcttaccgattccgattccacatcgcgtacgcttcgcccgtacatacgcgtaaccgttaccgtaccgttacgcgtcgctcgccgattacttacacgtaaccttaccttcgcgttacgtttaacgcaacgatcgcaaaaactaacgttaccttacctaaccgaccgttcccatcgcgttcgcgtaccgctcctacacgtacgttcgctacgacatcgcgatacgttccgtcgattacgtaacgtaaatatcctcccgttccgataactacgaatcgcgttccgtccctcgcataacatctatctacgatacgcttcatatacattaccgacgtacgaaaccgatacgttaccgtcgatttccgaccctaacaaccgttacgatacgcttccctacttcgctcgcttacctcgctaccaatcaaacgtcgcgacgtacattaacgctttcgttactaccttaatacctacgtaaacccccttcgaaatcgtcgccttactcgtactcgt

SEQ ID NO: 9527 - DNA, 712 bp, Artificial Sequence
  chemically treated genomic DNA (Homo sapiens) CpG-island No: 9527
cgataatattttttttgttgcgtttttttcgtgtcgtacgtgttcgtttatcggtatgtcgtgttcgtttgggttagagtttacgtcgttagcgcgtatattagtgtttatgattttgttttgttcgattagtcgtcgcgtagcgcgttcgtttttcgtttacgttttcgtttatttatgtttttacgtttgtgggatgtttgtcgtttgtcgatttcgattttatatcgcgtgcgtttcgttcgtgtatacgcgtggtcgttatcgtgtcgttacgcgtcgttcgtcgattgtttatacgtagttttgttttcgcgttgcgtttagcgtagcgatcgtaggagttagcgttgttttgtttgatcgatcgtttttatcgcgttcgcgtatcgtttttgtacgtacgttcgttacggtatcgcgatgcgtttcgtcgattgcgtgacgtgggtattttttcgtttcgatagttacgagtcgcgtttcgtttttcgtatagtatttatttgcggtacgttttatgtgtattgtcggcgtgcggagtcggtgcgttgtcgtcggttttcgattttagtagtcgttacggtacgtttttttatttcgttcgtttatttcgttattaattaagcgtcgcggcgtatattggcgttttcgttgttattttggtgtttgcgtgggtttttttcgaggtcgtcgttttattcgtattcgt

SEQ ID NO: 9528 - DNA, 712 bp, Artificial Sequence
  chemically treated genomic DNA (Homo sapiens) CpG-island No: 9528
acgaatacgaataaaacgacgacctcgaaaaaaacccacgcaaacaccaaaataacaacgaaaacgccaatatacgccgcgacgcttaattaataacgaaataaacgaacgaaataaaaaaacgtaccgtaacgactactaaaatcgaaaaccgacgacaacgcaccgactccgcacgccgacaatacacataaaacgtaccgcaaataaatactatacgaaaaacgaaacgcgactcgtaactatcgaaacgaaaaaatacccacgtcacgcaatcgacgaaacgcatcgcgataccgtaacgaacgtacgtacaaaaacgatacgcgaacgcgataaaaacgatcgatcaaacaaaacaacgctaactcctacgatcgctacgctaaacgcaacgcgaaaacaaaactacgtataaacaatcgacgaacgacgcgtaacgacacgataacgaccacgcgtatacacgaacgaaacgcacgcgatataaaatcgaaatcgacaaacgacaaacatcccacaaacgtaaaaacataaataaacgaaaacgtaaacgaaaaacgaacgcgctacgcgacgactaatcgaacaaaacaaaatcataaacactaatatacgcgctaacgacgtaaactctaacccaaacgaacacgacataccgataaacgaacacgtacgacacgaaaaaaacgcaacaaaaaaaatattatcg

SEQ ID NO: 9529 - DNA, 511 bp, Artificial Sequence
  chemically treated genomic DNA (Homo sapiens) CpG-island No: 9529
  misc_feature (168)..(168): n is either a, c, g or t
aacgacggggagtatcgttcgttattttttgtgagtttcgacgcgatagcgatattttcgttagtcgagggtatttttatggttaacgcgattttaggttagagcgaagggtatcgcgtgggcgaattttaacggttagcgtcgttttacgttatagggaattttcgnttagtttaggacggagttgttgcgtgtttatcgtcgcggcggtatcggcgggatgggtatgatacgtgggaatcgttcgtagtggatgaggcgattaagtattggaagtaatcgaggatcgacgtatttcgttatattgatcgttttaatcgcgggttagttcgatttatcgacgtattcgttagatcgtattaatcgatacggttttattgggttaattaaacgattttgtgagattgtgtatcgcgtcgcgtattgttcgcgttaatgtaggcgcgcgaaattatcgacggggattttttattcgtagaaagtattagttgtaatttacggtatcgcggcg

SEQ ID NO: 9530 - DNA, 511 bp, Artificial Sequence
  chemically treated genomic DNA (Homo sapiens) CpG-island No: 9530
  misc_feature (344)..(344): n is either a, c, g or t
cgccgcgataccgtaaattacaactaatactttctacgaataaaaaatccccgtcgataatttcgcgcgcctacattaacgcgaacaatacgcgacgcgatacacaatctcacaaaatcgtttaattaacccaataaaaccgtatcgattaatacgatctaacgaatacgtcgataaatcgaactaacccgcgattaaaacgatcaatataacgaaatacgtcgatcctcgattacttccaatacttaatcgcctcatccactacgaacgattcccacgtatcatacccatcccgccgataccgccgcgacgataaacacgcaacaactccgtcctaaactaancgaaaattccctataacgtaaaacgacgctaaccgttaaaattcgcccacgcgatacccttcgctctaacctaaaatcgcgttaaccataaaaataccctcgactaacgaaaatatcgctatcgcgtcgaaactcacaaaaaataacgaacgatactccccgtcgtt

SEQ ID NO: 9531 - DNA, 511 bp, Artificial Sequence
  chemically treated genomic DNA (Homo sapiens) CpG-island No: 9531
  misc_feature (344)..(344): n is either a, c, g or t
cgtcgcggtgtcgtgggttgtagttggtgttttttgcgggtggagagttttcgtcgatgatttcgcgcgtttatattagcgcggatagtgcgcgacgcgatgtatagttttataggatcgtttagttggtttagtgggatcgtatcggttaatgcggtttgacgagtgcgtcgatgggtcgggttagttcgcggttggagcgattagtatagcgaggtgcgtcgattttcgattgtttttagtgtttagtcgttttatttattacggacggtttttacgtattatatttatttcgtcggtgtcgtcgcgacggtaggtacgtagtagtttcgttttggattggncgagagttttttgtgacgtaggacggcgttgatcgttgaggttcgtttacgcggtatttttcgttttagtttagggtcgcgttgattatagaggtgttttcgattaacgggaatatcgttgtcgcgtcgaagtttatagagagtggcgagcggtatttttcgtcgtt

SEQ ID NO: 9532 - DNA, 511 bp, Artificial Sequence
  chemically treated genomic DNA (Homo sapiens) CpG-island No: 9532
  misc_feature (168)..(168): n is either a, c, g or t
aacgacgaaaaataccgctcgccactctctataaacttcgacgcgacaacgatattcccgttaatcgaaaacacctctataatcaacgcgaccctaaactaaaacgaaaaataccgcgtaaacgaacctcaacgatcaacgccgtcctacgtcacaaaaaactctcgnccaatccaaaacgaaactactacgtacctaccgtcgcgacgacaccgacgaaataaatataatacgtaaaaaccgtccgtaataaataaaacgactaaacactaaaaacaatcgaaaatcgacgcacctcgctatactaatcgctccaaccgcgaactaacccgacccatcgacgcactcgtcaaaccgcattaaccgatacgatcccactaaaccaactaaacgatcctataaaactatacatcgcgtcgcgcactatccgcgctaatataaacgcgcgaaatcatcgacgaaaactctccacccgcaaaaaacaccaactacaacccacgacaccgcgacg

SEQ ID NO: 9533 - DNA, 689 bp, Artificial Sequence
  chemically treated genomic DNA (Homo sapiens) CpG-island No: 9533
  misc_feature (654)..(654): n is either a, c, g or t
ttgtatgtttcgttattttataaatattaacgtagggttcgggattttagatttttttttatcgtatttcgtagatgatttttatagaattatttttttcgcgttgtcgtattatttttcgttacgaggataagggaattgggacgacgggttcgtacgtagaatatgagtacgagttatcgatgttattgggtacgatagtatttagaagaaattacgtatagtattatgaagcggtacgcggacgagacgtagtattggtattaaatttagttttcgtttcgtacgtatttcggtattttgacgttgtagttattgtttttattgtaacgttagaagattatcgattagttattattgcgttatacgcggtggtggatcgttcgattagttattagtcgtgtacgttatacgtttttcgtaacgtcgcgtttatttttatttatatacgttacgtgcgtattgattcgataattgtcgttaacgtatataagattaattttttttatttcgttttatattcgaggcgttttcgacgttgtttcgattttgtaggtattaacgaggtgtttttattgtttgtattatttaacgcgattacgcgttaggatatatcgtatgatatttgatcgatttatcgcgcgcgtattgatnttagcgagtttcgttgtcggattcgtattatcgtt

SEQ ID NO: 9534 - DNA, 689 bp, Artificial Sequence
  chemically treated genomic DNA (Homo sapiens) CpG-island No: 9534
  misc_feature (36)..(36): n is either a, c, g or t
aacgataatacgaatccgacaacgaaactcgctaanatcaatacgcgcgcgataaatcgatcaaatatcatacgatatatcctaacgcgtaatcgcgttaaataatacaaacaataaaaacacctcgttaatacctacaaaatcgaaacaacgtcgaaaacgcctcgaatataaaacgaaataaaaaaaattaatcttatatacgttaacgacaattatcgaatcaatacgcacgtaacgtatataaataaaaataaacgcgacgttacgaaaaacgtataacgtacacgactaataactaatcgaacgatccaccaccgcgtataacgcaataataactaatcgataatcttctaacgttacaataaaaacaataactacaacgtcaaaataccgaaatacgtacgaaacgaaaactaaatttaataccaatactacgtctcgtccgcgtaccgcttcataatactatacgtaatttcttctaaatactatcgtacccaataacatcgataactcgtactcatattctacgtacgaacccgtcgtcccaattcccttatcctcgtaacgaaaaataatacgacaacgcgaaaaaaataattctataaaaatcatctacgaaatacgataaaaaaaaatctaaaatcccgaaccctacgttaatatttataaaataacgaaacatacaa

SEQ ID NO: 9535 - DNA, 689 bp, Artificial Sequence
  chemically treated genomic DNA (Homo sapiens) CpG-island No: 9535
  misc_feature (36)..(36): n is either a, c, g or t
agcgatagtgcgagttcgataacgggattcgttagngttaatgcgcgcgcgatgagtcgattaaatattatgcgatgtgttttagcgcgtgatcgcgttgaatagtgtagataatggaagtatttcgttggtgtttgtaggatcgaggtaacgtcggaagcgtttcgaatatgagacggggtgagaggagttggttttgtgtacgttggcgatagttgtcgggttaatgcgtacgtaacgtgtgtgagtggaggtgggcgcgacgttacgggaagcgtgtgacgtgtacgattggtggttgatcggacgatttattatcgcgtatggcgtagtagtggttagtcggtggttttttagcgttatagtggaggtagtggttatagcgttaaggtatcggaatgcgtacggaacgaggattgagtttaatattaatgttgcgtttcgttcgcgtgtcgttttatggtattgtacgtagttttttttggatattatcgtatttagtggtatcggtggttcgtatttatattttacgtgcgagttcgtcgttttagtttttttgttttcgtgacggagaatagtgcgataacgcgagggaggtagttttataagaattatttgcgagatacggtgggaagggatttggagtttcgagttttacgttagtgtttgtggaatggcgggatatgtag

SEQ ID NO: 9536 - DNA, 689 bp, Artificial Sequence
  chemically treated genomic DNA (Homo sapiens) CpG-island No: 9536
  misc_feature (654)..(654): n is either a, c, g or t
ctacatatcccgccattccacaaacactaacgtaaaactcgaaactccaaatcccttcccaccgtatctcgcaaataattcttataaaactacctccctcgcgttatcgcactattctccgtcacgaaaacaaaaaaactaaaacgacgaactcgcacgtaaaatataaatacgaaccaccgataccactaaatacgataatatccaaaaaaaactacgtacaataccataaaacgacacgcgaacgaaacgcaacattaatattaaactcaatcctcgttccgtacgcattccgataccttaacgctataaccactacctccactataacgctaaaaaaccaccgactaaccactactacgccatacgcgataataaatcgtccgatcaaccaccaatcgtacacgtcacacgcttcccgtaacgtcgcgcccacctccactcacacacgttacgtacgcattaacccgacaactatcgccaacgtacacaaaaccaactcctctcaccccgtctcatattcgaaacgcttccgacgttacctcgatcctacaaacaccaacgaaatacttccattatctacactattcaacgcgatcacgcgctaaaacacatcgcataatatttaatcgactcatcgcgcgcgcattaacnctaacgaatcccgttatcgaactcgcactatcgct

SEQ ID NO: 9537 - DNA, 504 bp, Artificial Sequence
  chemically treated genomic DNA (Homo sapiens) CpG-island No: 9537
gttatacgtcgttatttattattttcgtcgtcgatattttttttaattcgacgattattacgtttatagttacgtttatgttgtcgtagaatattatatttttatcgaagtacgtatgacgtttcgtcgtacgaagtacgcgtaagttttttcgttttatcgattgttagtatgatatattgttattaattatttatcgttcgtattatcgtttttcgattcgtagtttgttaggttcgttcgttcgtcgttgtttagacgtatcgaataagtaagttattatattttatattatgaacgttcgtatattcgttttttttttaattttatcgtttcgttacgtttttacgtacgacgtcgacgtagtacgtttatttcgtttttatcgattttttagtcgtattattatttcgtcgagttcgtttttcgagtaataagtatatttttcgtagtaatgcgatcgagtttttttttcgttaattcgtattattttatcgattattg

SEQ ID NO: 9538 - DNA, 504 bp, Artificial Sequence
  chemically treated genomic DNA (Homo sapiens) CpG-island No: 9538
caataatcgataaaataatacgaattaacgaaaaaaaaactcgatcgcattactacgaaaaatatacttattactcgaaaaacgaactcgacgaaataataatacgactaaaaaatcgataaaaacgaaataaacgtactacgtcgacgtcgtacgtaaaaacgtaacgaaacgataaaattaaaaaaaaaacgaatatacgaacgttcataatataaaatataataacttacttattcgatacgtctaaacaacgacgaacgaacgaacctaacaaactacgaatcgaaaaacgataatacgaacgataaataattaataacaatatatcatactaacaatcgataaaacgaaaaaacttacgcgtacttcgtacgacgaaacgtcatacgtacttcgataaaaatataatattctacgacaacataaacgtaactataaacgtaataatcgtcgaattaaaaaaaatatcgacgacgaaaataataaataacgacgtataac

SEQ ID NO: 9539 - DNA, 504 bp, Artificial Sequence
  chemically treated genomic DNA (Homo sapiens) CpG-island No: 9539
tagtggtcggtggggtagtgcgaattgacgaggggaggattcgatcgtattattgcggggggtgtgtttgttattcgaagggcgggttcgacggggtgatgatgcggttaggagatcgatggggacggagtgggcgtgttgcgtcgacgtcgtgcgtgggggcgtaacgagacggtgaagttggagggggagcgagtgtgcgaacgtttatgatgtagaatgtagtagtttgtttgttcgatacgtttgggtaacgacgagcgagcgggtttagtagattgcgggtcggagggcggtagtgcggacgatgaatggttagtagtagtgtgttatgttagtagtcgatgaaacggaggagtttacgcgtgtttcgtacgacggagcgttatgcgtgtttcgatagaagtgtaatgttttacgataatataggcgtggttatggacgtggtggtcgtcgggttgaagaagatgtcgacggcgggagtggtgaatagcggcgtgtggt

SEQ ID NO: 9540 - DNA, 504 bp, Artificial Sequence
  chemically treated genomic DNA (Homo sapiens) CpG-island No: 9540
accacacgccgctattcaccactcccgccgtcgacatcttcttcaacccgacgaccaccacgtccataaccacgcctatattatcgtaaaacattacacttctatcgaaacacgcataacgctccgtcgtacgaaacacgcgtaaactcctccgtttcatcgactactaacataacacactactactaaccattcatcgtccgcactaccgccctccgacccgcaatctactaaacccgctcgctcgtcgttacccaaacgtatcgaacaaacaaactactacattctacatcataaacgttcgcacactcgctccccctccaacttcaccgtctcgttacgcccccacgcacgacgtcgacgcaacacgcccactccgtccccatcgatctcctaaccgcatcatcaccccgtcgaacccgcccttcgaataacaaacacaccccccgcaataatacgatcgaatcctcccctcgtcaattcgcactaccccaccgaccacta

SEQ ID NO: 9541 - DNA, 549 bp, Artificial Sequence
  chemically treated genomic DNA (Homo sapiens) CpG-island No: 9541
  misc_feature (114)..(114): n is either a, c, g or t
  misc_feature (275)..(275): n is either a, c, g or t
  misc_feature (521)..(521): n is either a, c, g or t
tatacgcgcgtatatgcgtaagttttcgttaatatgaatgcgaacgttatcgttttaggatagatatacggtacgttgattgtatgcggatcgttttcgtaagttacgtttatngttacggttcggcgtcggttatgttacgtgatttgtttcgagggtaacgttcgttttcgtttatttattgttagggttacgcgtttcgttcgtatttgataggttttcgatgcgttatacgggaacgtatgcgacgttgtcgttgttggtcgcgtcggttnttttttttgcgatattcgttcgttatttatttgaacgttattttagttatcgtttgtagttatgtttttatcgttcgcgtttgttatacgcgtttattatttatttttcgtttaggttacgtcgcggcgcgattcgttgttatttcgacgtagcgtatattagttgtacgcgatcgtacgcgtagatatttttgtgcggggtgttaatttcgcgcggttttcgatgttacgtatgttttttcgttnttttattttgcgcgttatcgtattcgtt

SEQ ID NO: 9542 - DNA, 549 bp, Artificial Sequence
  chemically treated genomic DNA (Homo sapiens) CpG-island No: 9542
  misc_feature (29)..(29): n is either a, c, g or t
  misc_feature (275)..(275): n is either a, c, g or t
  misc_feature (436)..(436): n is either a, c, g or t
aacgaatacgataacgcgcaaaataaaanaacgaaaaaacatacgtaacatcgaaaaccgcgcgaaattaacaccccgcacaaaaatatctacgcgtacgatcgcgtacaactaatatacgctacgtcgaaataacaacgaatcgcgccgcgacgtaacctaaacgaaaaataaataataaacgcgtataacaaacgcgaacgataaaaacataactacaaacgataactaaaataacgttcaaataaataacgaacgaatatcgcaaaaaaaanaaccgacgcgaccaacaacgacaacgtcgcatacgttcccgtataacgcatcgaaaacctatcaaatacgaacgaaacgcgtaaccctaacaataaataaacgaaaacgaacgttaccctcgaaacaaatcacgtaacataaccgacgccgaaccgtaacnataaacgtaacttacgaaaacgatccgcatacaatcaacgtaccgtatatctatcctaaaacgataacgttcgcattcatattaacgaaaacttacgcatatacgcgcgtata

SEQ ID NO: 9543 - DNA, 549 bp, Artificial Sequence
  chemically treated genomic DNA (Homo sapiens) CpG-island No: 9543
  misc_feature (29)..(29): n is either a, c, g or t
  misc_feature (275)..(275): n is either a, c, g or t
  misc_feature (436)..(436): n is either a, c, g or t
agcgagtgcgatagcgcgtagagtagganagcgagaggatatgcgtagtatcgagagtcgcgcgagattgatatttcgtatagagatgtttgcgcgtgcgatcgcgtatagttgatgtacgttacgtcggggtagtaacgagtcgcgtcgcggcgtggtttggacggagggtgagtagtggacgcgtatagtaagcgcggacgatgagagtatgattataagcggtagttggagtagcgtttaagtaggtgacggacgagtgtcgtaggagaggnggtcgacgcggttagtagcgatagcgtcgtatgcgttttcgtatggcgtatcgaaagtttgttaggtgcgagcgagacgcgtgattttgataatagatagacgaggacggacgttgttttcggaataggttacgtggtatagtcggcgtcgagtcgtagtngtgagcgtagtttacgagagcgattcgtatgtagttagcgtgtcgtatgtttattttaaaacgatagcgttcgtatttatattagcgagagtttacgtatgtgcgcgcgtgtg

SEQ ID NO: 9544 - DNA, 549 bp, Artificial Sequence
  chemically treated genomic DNA (Homo sapiens) CpG-island No: 9544
  misc_feature (114)..(114): n is either a, c, g or t
  misc_feature (275)..(275): n is either a, c, g or t
  misc_feature (521)..(521): n is either a, c, g or t
cacacgcgcgcacatacgtaaactctcgctaatataaatacgaacgctatcgttttaaaataaacatacgacacgctaactacatacgaatcgctctcgtaaactacgctcacnactacgactcgacgccgactataccacgtaacctattccgaaaacaacgtccgtcctcgtctatctattatcaaaatcacgcgtctcgctcgcacctaacaaactttcgatacgccatacgaaaacgcatacgacgctatcgctactaaccgcgtcgaccncctctcctacgacactcgtccgtcacctacttaaacgctactccaactaccgcttataatcatactctcatcgtccgcgcttactatacgcgtccactactcaccctccgtccaaaccacgccgcgacgcgactcgttactaccccgacgtaacgtacatcaactatacgcgatcgcacgcgcaaacatctctatacgaaatatcaatctcgcgcgactctcgatactacgcatatcctctcgctntcctactctacgcgctatcgcactcgct

SEQ ID NO: 9545 - DNA, 640 bp, Artificial Sequence
  chemically treated genomic DNA (Homo sapiens) CpG-island No: 9545
  misc_feature (247)..(247): n is either a, c, g or t
cgcgtagcgttatatggttacgtgtttttgaatcggaacgtgtaggttaacggtatcgtataacggttacgtaagcgtgatttttttaattatgacgcggaagcgtaacgcgcggcgtggtagtataacgtgtgcggtagtatcgtatagttttcggtatacgtggaacgttatcgtttagagtgattagttaaaattatattgtttattcgttatgcgatcggcgaggtgttataggagtgttttnggtgattattttatcgggtggcgcgatcgcgtatgcgatattagattagcgatacgtttgcgcggagtgtaacgtcgcggtattttatgacgaaggtttttagttgtcgcgtagttatcggagcggtaagtagtgtgtttcgttgtgagttttattttattcgtcgaaagcgttgtgatggatttgtacggggggtaaggtagcgatatgacggtaaagaacgtacgagagagacggcggtagtggcggatcgaggtagcgtagcgattagggtagtaggcgagttagaaacgagcgagggagttcggaggaacgaacgaaggttgttcgtagaaacggtcgcggatcgaggtatgacgtaagacggaggggcgcgacgatttacgagggacg

SEQ ID NO: 9546 - DNA, 640 bp, Artificial Sequence
  chemically treated genomic DNA (Homo sapiens) CpG-island No: 9546
  misc_feature (394)..(394): n is either a, c, g or t
cgtccctcgtaaatcgtcgcgcccctccgtcttacgtcatacctcgatccgcgaccgtttctacgaacaaccttcgttcgttcctccgaactccctcgctcgtttctaactcgcctactaccctaatcgctacgctacctcgatccgccactaccgccgtctctctcgtacgttctttaccgtcatatcgctaccttaccccccgtacaaatccatcacaacgctttcgacgaataaaataaaactcacaacgaaacacactacttaccgctccgataactacgcgacaactaaaaaccttcgtcataaaataccgcgacgttacactccgcgcaaacgtatcgctaatctaatatcgcatacgcgatcgcgccacccgataaaataatcaccnaaaacactcctataacacctcgccgatcgcataacgaataaacaatataattttaactaatcactctaaacgataacgttccacgtataccgaaaactatacgatactaccgcacacgttatactaccacgccgcgcgttacgcttccgcgtcataattaaaaaaatcacgcttacgtaaccgttatacgataccgttaacctacacgttccgattcaaaaacacgtaaccatataacgctacgcg

SEQ ID NO: 9547 - DNA, 640 bp, Artificial Sequence
  chemically treated genomic DNA (Homo sapiens) CpG-island No: 9547
  misc_feature (394)..(394): n is either a, c, g or t
cgtttttcgtagatcgtcgcgttttttcgttttacgttatatttcggttcgcggtcgtttttacgagtaattttcgttcgttttttcgagttttttcgttcgtttttagttcgtttattgttttagtcgttacgttgtttcgattcgttattgtcgtcgtttttttcgtacgttttttatcgttatgtcgttattttatttttcgtataggtttattataacgttttcggcgggtaggataaggtttataacgagatatattgtttatcgtttcggtggttacgcggtagttaagagttttcgttataagatatcgcgacgttatatttcgcgtaagcgtgtcgttagtttggtatcgtatacgcggtcgcgttattcggtagagtagttattnaggatatttttgtagtatttcgtcgatcgtatgacggatgaatagtgtaattttggttaattattttagacggtggcgttttacgtgtgtcgggagttatacggtattatcgtatacgttgtattgttacgtcgcgcgttacgttttcgcgttatagttaaagaggttacgtttacgtagtcgttgtgcggtatcgttgatttatacgtttcgatttagggatacgtgattatgtaacgttacgcg

SEQ ID NO: 9548 - DNA, 640 bp, Artificial Sequence
  chemically treated genomic DNA (Homo sapiens) CpG-island No: 9548
  misc_feature (247)..(247): n is either a, c, g or t
cgcgtaacgttacataatcacgtatccctaaatcgaaacgtataaatcaacgataccgcacaacgactacgtaaacgtaacctctttaactataacgcgaaaacgtaacgcgcgacgtaacaatacaacgtatacgataataccgtataactcccgacacacgtaaaacgccaccgtctaaaataattaaccaaaattacactattcatccgtcatacgatcgacgaaatactacaaaaatatcctnaataactactctaccgaataacgcgaccgcgtatacgataccaaactaacgacacgcttacgcgaaatataacgtcgcgatatcttataacgaaaactcttaactaccgcgtaaccaccgaaacgataaacaatatatctcgttataaaccttatcctacccgccgaaaacgttataataaacctatacgaaaaataaaataacgacataacgataaaaaacgtacgaaaaaaacgacgacaataacgaatcgaaacaacgtaacgactaaaacaataaacgaactaaaaacgaacgaaaaaactcgaaaaaacgaacgaaaattactcgtaaaaacgaccgcgaaccgaaatataacgtaaaacgaaaaaacgcgacgatctacgaaaaacg

SEQ ID NO: 9549 - DNA, 521 bp, Artificial Sequence
  chemically treated genomic DNA (Homo sapiens) CpG-island No: 9549
  misc_feature (102)..(102): n is either a, c, g or t
  misc_feature (213)..(213): n is either a, c, g or t
  misc_feature (329)..(329): n is either a, c, g or t
tacgtcgcgcgggattaaggagcgggaagaacgtattaggggcgtacgtagggtaaaggttttaatttttttatttttttggtatttaaaaaagagcgcganggaacgttgttacgcgatattatgttattcgaggcgtttaaatttttcgggcgattgttttaattttataacgaagtaacgtatcgtattatgtatgacgaggtgggagtngtatcgtagggttatgttttttttgaaaggagcgttacggacgttcgttagcgatttattttcgttattttacgcgggtatcgtatgtaaacgacgtcggcgacgtacgtattgantttaagtatggttgatattttgcgtgcgtaagtttttacgtacgcgtcgttatttagagtcggagggatcgttttaatttagtatagttgtgtatttacgttcgttcgtagcgtacggggacgtgcgttgtattatattaattttgtatcgatacgaatgttgacgggatcgtagcgacgtattttcgtacg

SEQ ID NO: 9550 - DNA, 521 bp, Artificial Sequence
  chemically treated genomic DNA (Homo sapiens) CpG-island No: 9550
  misc_feature (193)..(193): n is either a, c, g or t
  misc_feature (309)..(309): n is either a, c, g or t
  misc_feature (420)..(420): n is either a, c, g or t
cgtacgaaaatacgtcgctacgatcccgtcaacattcgtatcgatacaaaattaatataatacaacgcacgtccccgtacgctacgaacgaacgtaaatacacaactatactaaattaaaacgatccctccgactctaaataacgacgcgtacgtaaaaacttacgcacgcaaaatatcaaccatacttaaantcaatacgtacgtcgccgacgtcgtttacatacgatacccgcgtaaaataacgaaaataaatcgctaacgaacgtccgtaacgctcctttcaaaaaaaacataaccctacgatacnactcccacctcgtcatacataatacgatacgttacttcgttataaaattaaaacaatcgcccgaaaaatttaaacgcctcgaataacataatatcgcgtaacaacgttccntcgcgctcttttttaaataccaaaaaaataaaaaaattaaaacctttaccctacgtacgcccctaatacgttcttcccgctccttaatcccgcgcgacgta

SEQ ID NO: 9551 - DNA, 521 bp, Artificial Sequence
  chemically treated genomic DNA (Homo sapiens) CpG-island No: 9551
  misc_feature (193)..(193): n is either a, c, g or t
  misc_feature (309)..(309): n is either a, c, g or t
  misc_feature (420)..(420): n is either a, c, g or t
cgtgcgaaggtacgtcgttacgatttcgttagtattcgtgtcggtgtaagattggtatggtgtagcgtacgttttcgtacgttacgagcgaacgtgagtatataattatgttaggttgaggcgattttttcgattttgagtgacggcgcgtgcgtgaggatttacgtacgtagggtattaattatatttaagnttagtgcgtgcgtcgtcggcgtcgtttgtatgcggtgttcgcgtagggtgacggaggtgggtcgttagcgagcgttcgtagcgttttttttaaaggaaatatgattttgcgatgtngtttttatttcgttatatatggtgcggtgcgttatttcgttatggggttgaggtagtcgttcgagaggtttgagcgtttcggatgatatagtatcgcgtaatagcgttttntcgcgtttttttttaggtattagagaagtgggagggttgggatttttgttttacgtgcgtttttagtgcgtttttttcgttttttgatttcgcgcggcgta

SEQ ID NO: 9552 - DNA, 521 bp, Artificial Sequence
  chemically treated genomic DNA (Homo sapiens) CpG-island No: 9552
  misc_feature (102)..(102): n is either a, c, g or t
  misc_feature (213)..(213): n is either a, c, g or t
  misc_feature (329)..(329): n is either a, c, g or t
tacgccgcgcgaaatcaaaaaacgaaaaaaacgcactaaaaacgcacgtaaaacaaaaatcccaaccctcccacttctctaatacctaaaaaaaaacgcganaaaacgctattacgcgatactatatcatccgaaacgctcaaacctctcgaacgactacctcaaccccataacgaaataacgcaccgcaccatatataacgaaataaaaacnacatcgcaaaatcatatttcctttaaaaaaaacgctacgaacgctcgctaacgacccacctccgtcaccctacgcgaacaccgcatacaaacgacgccgacgacgcacgcactaancttaaatataattaataccctacgtacgtaaatcctcacgcacgcgccgtcactcaaaatcgaaaaaatcgcctcaacctaacataattatatactcacgttcgctcgtaacgtacgaaaacgtacgctacaccataccaatcttacaccgacacgaatactaacgaaatcgtaacgacgtaccttcgcacg

SEQ ID NO: 9553 - DNA, 528 bp, Artificial Sequence
  chemically treated genomic DNA (Homo sapiens) CpG-island No: 9553
agtttagtcgagacgtcgttaatatttggtttgtatcgttacgaattcgatttttgtcgtttaattaggatggttttcgtttaacgattttttacgtacgaacgattagtatgtttgttacggatttcgtttgttaataacgttttttacgttcgtttgttacgcgattattttaggtattgacgttttgaacgttagttgttgatttcggtatcgaattttagttggttacgaagcgttcgtcgatcggtcgcgtatttaatttcggtagcgagtttcgttacggtcgtagcgatttttcgtcgttagtatttagcgtttttttttaggtatttagtacgtcgtgtttttatggagttacgttttaattgtttattttttttttttcgtttcgtttattttcgtattagtgatatagttgcgagaacgatgttagtacgttagttttatcgtagtattttggtagttacgtattagttataacgttttacgacgtatttatatacgttcgttttaggtttattttta

SEQ ID NO: 9554 - DNA, 528 bp, Artificial Sequence
  chemically treated genomic DNA (Homo sapiens) CpG-island No: 9554
taaaaataaacctaaaacgaacgtatataaatacgtcgtaaaacgttataactaatacgtaactaccaaaatactacgataaaactaacgtactaacatcgttctcgcaactatatcactaatacgaaaataaacgaaacgaaaaaaaaaaaataaacaattaaaacgtaactccataaaaacacgacgtactaaatacctaaaaaaaaacgctaaatactaacgacgaaaaatcgctacgaccgtaacgaaactcgctaccgaaattaaatacgcgaccgatcgacgaacgcttcgtaaccaactaaaattcgataccgaaatcaacaactaacgttcaaaacgtcaatacctaaaataatcgcgtaacaaacgaacgtaaaaaacgttattaacaaacgaaatccgtaacaaacatactaatcgttcgtacgtaaaaaatcgttaaacgaaaaccatcctaattaaacgacaaaaatcgaattcgtaacgatacaaaccaaatattaacgacgtctcgactaaact

SEQ ID NO: 9555 - DNA, 528 bp, Artificial Sequence
  chemically treated genomic DNA (Homo sapiens) CpG-island No: 9555
tgagaatgagtttggaacggacgtatgtaagtgcgtcgtggggcgttgtggttagtgcgtagttattaggatgttacgatggagttggcgtattagtatcgttttcgtagttatgttattggtacgaggatagacggagcggaagagaaaaggtaggtagttagagcgtagttttatgaggatacgacgtattaagtgtttgaggagagacgttggatgttagcggcggggggtcgttacggtcgtagcgagattcgttgtcgaggttaaatacgcgatcggtcgacgggcgtttcgtagttagttagagttcgatatcgggattagtaattggcgtttagagcgttagtatttaaggtaatcgcgtagtaaacgagcgtagagaacgttgttaataggcgaggttcgtgataggtatgttgatcgttcgtacgtgagaagtcgttggacggggattattttagttggacggtaggggtcgaattcgtgacgatgtagattaggtgttggcgacgtttcgattgggtt

SEQ ID NO: 9556 - DNA, 528 bp, Artificial Sequence
  chemically treated genomic DNA (Homo sapiens) CpG-island No: 9556
aacccaatcgaaacgtcgccaacacctaatctacatcgtcacgaattcgacccctaccgtccaactaaaataatccccgtccaacgacttctcacgtacgaacgatcaacatacctatcacgaacctcgcctattaacaacgttctctacgctcgtttactacgcgattaccttaaatactaacgctctaaacgccaattactaatcccgatatcgaactctaactaactacgaaacgcccgtcgaccgatcgcgtatttaacctcgacaacgaatctcgctacgaccgtaacgaccccccgccgctaacatccaacgtctctcctcaaacacttaatacgtcgtatcctcataaaactacgctctaactacctaccttttctcttccgctccgtctatcctcgtaccaataacataactacgaaaacgatactaatacgccaactccatcgtaacatcctaataactacgcactaaccacaacgccccacgacgcacttacatacgtccgttccaaactcattctca

SEQ ID NO: 9557 - DNA, 504 bp, Artificial Sequence
  chemically treated genomic DNA (Homo sapiens) CpG-island No: 9557
  misc_feature (133)..(133): n is either a, c, g or t
  misc_feature (174)..(174): n is either a, c, g or t
  misc_feature (199)..(199): n is either a, c, g or t
  misc_feature (202)..(202): n is either a, c, g or t
  misc_feature (303)..(303): n is either a, c, g or t
  misc_feature (341)..(341): n is either a, c, g or t
  misc_feature (351)..(351): n is either a, c, g or t
  misc_feature (388)..(388): n is either a, c, g or t
  misc_feature (475)..(475): n is either a, c, g or t
ggttttcgtgtataacgaggttttagagttcgtcgttttcgtaggttttttttttttatcggataatttcgtattagtcggttttatcgtcgtcgtaggtcgttatatatcgaagatgatttattttttttantcgcgcgcgaagtatcgaattttcgtaatgtagtttagttntcgacgtttttttcgttattttttntancgatacgaatttttcgatagcgattttgtttaatggtacgtattttttcgtacgttatttttcgttagttcgaggtatacgtatttttcgttaaagttagnttttacgtaacggtatattatatttacgtcgttcgttnattttatttntttcgtaattatatcgttattttttattcgcgcgtangttatttttattcgatttttacgtttacgtatacgtatgcgattttttacgttattttttatgttagtaacgtatagttatgtttangcgcgttttattttattttttatatattt

SEQ ID NO: 9558 - DNA, 504 bp, Artificial Sequence
  chemically treated genomic DNA (Homo sapiens) CpG-island No: 9558
  misc_feature (30)..(30): n is either a, c, g or t
  misc_feature (117)..(117): n is either a, c, g or t
  misc_feature (154)..(154): n is either a, c, g or t
  misc_feature (164)..(164): n is either a, c, g or t
  misc_feature (202)..(202): n is either a, c, g or t
  misc_feature (303)..(303): n is either a, c, g or t
  misc_feature (306)..(306): n is either a, c, g or t
  misc_feature (331)..(331): n is either a, c, g or t
  misc_feature (372)..(372): n is either a, c, g or t
aaatatataaaaaataaaataaaacgcgcntaaacataactatacgttactaacataaaaaataacgtaaaaaatcgcatacgtatacgtaaacgtaaaaatcgaataaaaataacntacgcgcgaataaaaaataacgatataattacgaaanaaataaaatnaacgaacgacgtaaatataatataccgttacgtaaaanctaactttaacgaaaaatacgtatacctcgaactaacgaaaaataacgtacgaaaaaatacgtaccattaaacaaaatcgctatcgaaaaattcgtatcgntanaaaaaataacgaaaaaaacgtcganaactaaactacattacgaaaattcgatacttcgcgcgcgantaaaaaaaataaatcatcttcgatatataacgacctacgacgacgataaaaccgactaatacgaaattatccgataaaaaaaaaaaacctacgaaaacgacgaactctaaaacctcgttatacacgaaaacc

SEQ ID NO: 9559 - DNA, 504 bp, Artificial Sequence
  chemically treated genomic DNA (Homo sapiens) CpG-island No: 9559
  misc_feature (30)..(30): n is either a, c, g or t
  misc_feature (117)..(117): n is either a, c, g or t
  misc_feature (154)..(154): n is either a, c, g or t
  misc_feature (164)..(164): n is either a, c, g or t
  misc_feature (202)..(202): n is either a, c, g or t
  misc_feature (303)..(303): n is either a, c, g or t
  misc_feature (306)..(306): n is either a, c, g or t
  misc_feature (331)..(331): n is either a, c, g or t
  misc_feature (372)..(372): n is either a, c, g or t
agatatgtgagagatggagtaggacgcgtntgagtatagttatgcgttgttgatataggagataacgtagagggtcgtatgcgtatgcgtagacgtgagggtcggatgaagatgatntacgcgcgagtgaagagtgacggtatgattgcgagangagtgaggtnggcgagcggcgtaggtatggtatgtcgttacgtagaanttggttttggcggggagtacgtgtgtttcgggttagcgaggagtggcgtacgaaggagtgcgtgttattagataaggtcgttatcgaagggttcgtatcgntgnggagggtgacgagaagggcgtcganggttagattgtattgcgagagttcggtgtttcgcgcgcggntggaaaggatggattattttcggtgtgtggcggtttgcggcgacgatggggtcggttgatgcgggattgttcgatggagggagaggatttgcgggggcgacgggttttagggtttcgttgtgtacgagaatt

SEQ ID NO: 9560 - DNA, 504 bp, Artificial Sequence
  chemically treated genomic DNA (Homo sapiens) CpG-island No: 9560
  misc_feature (133)..(133): n is either a, c, g or t
  misc_feature (174)..(174): n is either a, c, g or t
  misc_feature (199)..(199): n is either a, c, g or t
  misc_feature (202)..(202): n is either a, c, g or t
  misc_feature (303)..(303): n is either a, c, g or t
  misc_feature (341)..(341): n is either a, c, g or t
  misc_feature (351)..(351): n is either a, c, g or t
  misc_feature (388)..(388): n is either a, c, g or t
  misc_feature (475)..(475): n is either a, c, g or t
aattctcgtacacaacgaaaccctaaaacccgtcgcccccgcaaatcctctccctccatcgaacaatcccgcatcaaccgaccccatcgtcgccgcaaaccgccacacaccgaaaataatccatcctttccanccgcgcgcgaaacaccgaactctcgcaatacaatctaaccntcgacgcccttctcgtcaccctccncancgatacgaacccttcgataacgaccttatctaataacacgcactccttcgtacgccactcctcgctaacccgaaacacacgtactccccgccaaaaccaanttctacgtaacgacataccatacctacgccgctcgccnacctcactcntctcgcaatcataccgtcactcttcactcgcgcgtanatcatcttcatccgaccctcacgtctacgcatacgcatacgaccctctacgttatctcctatatcaacaacgcataactatactcanacgcgtcctactccatctctcacatatct

SEQ ID NO: 9561 - DNA, 689 bp, Artificial Sequence
  chemically treated genomic DNA (Homo sapiens) CpG-island No: 9561
acgttcggggtttgttttttgattcgcggaacgagaggaataattgatttaggtttggcgttgtttttattaaattttgttcgcgagttgcgaaggtttagagcgcgtaggtaagttgcggtttcggggttttcggggttcgcggtcggttttcgttagttcggagagtagtcgtcgcgtcgggttaggtacgtcgtatgtagtttcgcggcgttcgagttttgtggcggtcgcgcgcgttttttcgttcgtttcgtattcgtcgttcgttcgttcggttttttatcgcgtttttttttagtcgtcgttcgcgtcgtcgtcgtcgttttcgttttttcgcggtgggttacgtttttattgaaattcgagtcgttttttggacggcggcgttttttttgttaattagcgtcgcgcgttcgggtcgtttcgagtttcgcgcggttttcgacgttttcgagtagtcggagatatcggttcgggaggcgaaggttcggtcgcgatgcggtcgtagggatgtagcgatagttttcgaataaggtttggtttcgcgtttcgcgttattttttttttatttttcggcgagcgaagttggttaatcggtcgttgagcgattgcgttacgttggtttatgtttagtaagaaaataaatggatcgaggttttaattttgttttttcgttaaagatattt

SEQ ID NO: 9562 - DNA, 689 bp, Artificial Sequence
  chemically treated genomic DNA (Homo sapiens) CpG-island No: 9562
aaatatctttaacgaaaaaacaaaattaaaacctcgatccatttattttcttactaaacataaaccaacgtaacgcaatcgctcaacgaccgattaaccaacttcgctcgccgaaaaataaaaaaaaaataacgcgaaacgcgaaaccaaaccttattcgaaaactatcgctacatccctacgaccgcatcgcgaccgaaccttcgcctcccgaaccgatatctccgactactcgaaaacgtcgaaaaccgcgcgaaactcgaaacgacccgaacgcgcgacgctaattaacaaaaaaaacgccgccgtccaaaaaacgactcgaatttcaataaaaacgtaacccaccgcgaaaaaacgaaaacgacgacgacgacgcgaacgacgactaaaaaaaaacgcgataaaaaaccgaacgaacgaacgacgaatacgaaacgaacgaaaaaacgcgcgcgaccgccacaaaactcgaacgccgcgaaactacatacgacgtacctaacccgacgcgacgactactctccgaactaacgaaaaccgaccgcgaaccccgaaaaccccgaaaccgcaacttacctacgcgctctaaaccttcgcaactcgcgaacaaaatttaataaaaacaacgccaaacctaaatcaattattcctctcgttccgcgaatcaaaaaacaaaccccgaacgt

SEQ ID NO: 9563 - DNA, 689 bp, Artificial Sequence
  chemically treated genomic DNA (Homo sapiens) CpG-island No: 9563
aagtgtttttagcgggagggtagggttagagtttcggtttatttgtttttttattgaatataaattaacgtaacgtagtcgtttagcgatcggttggttagtttcgttcgtcggggagtagggaggaggtggcgcggggcgcgggattaggttttattcgaaggttgtcgttgtatttttacggtcgtatcgcggtcgagttttcgtttttcgggtcggtgttttcggttgttcgaaggcgtcgggagtcgcgcggaattcggggcggttcgggcgcgcggcgttgattggtagagagggcgtcgtcgtttaggaaacggttcgggttttagtgggggcgtgatttatcgcgagaaggcgggggcggcggcggcggcgcgggcggcggttggaggagagcgcggtggagagtcgagcgggcgggcggcgggtgcggagcgggcgagggagcgcgcgcggtcgttataaagttcgggcgtcgcggggttgtatgcggcgtatttggttcggcgcggcgattgtttttcgggttggcgggggtcggtcgcgagtttcgggggtttcgaggtcgtagtttgtttgcgcgttttgagttttcgtaattcgcgagtaaagtttggtggaggtaacgttaagtttgagttagttatttttttcgtttcgcgagttagagggtaggtttcgggcgt

SEQ ID NO: 9564 - DNA, 689 bp, Artificial Sequence
  chemically treated genomic DNA (Homo sapiens) CpG-island No: 9564
acgcccgaaacctaccctctaactcgcgaaacgaaaaaaataactaactcaaacttaacgttacctccaccaaactttactcgcgaattacgaaaactcaaaacgcgcaaacaaactacgacctcgaaacccccgaaactcgcgaccgacccccgccaacccgaaaaacaatcgccgcgccgaaccaaatacgccgcatacaaccccgcgacgcccgaactttataacgaccgcgcgcgctccctcgcccgctccgcacccgccgcccgcccgctcgactctccaccgcgctctcctccaaccgccgcccgcgccgccgccgccgcccccgccttctcgcgataaatcacgcccccactaaaacccgaaccgtttcctaaacgacgacgccctctctaccaatcaacgccgcgcgcccgaaccgccccgaattccgcgcgactcccgacgccttcgaacaaccgaaaacaccgacccgaaaaacgaaaactcgaccgcgatacgaccgtaaaaatacaacgacaaccttcgaataaaacctaatcccgcgccccgcgccacctcctccctactccccgacgaacgaaactaaccaaccgatcgctaaacgactacgttacgttaatttatattcaataaaaaaacaaataaaccgaaactctaaccctaccctcccgctaaaaacactt

SEQ ID NO: 9565 - DNA, 577 bp, Artificial Sequence
  chemically treated genomic DNA (Homo sapiens) CpG-island No: 9565
gtttttcgggggcgaatttacgtagcgaatggagaattagtttgaggtagtcgtacgttaggtttaggtagaggtcgttgtagtattacgtttttgtaaggtttcgcgttttagtcgtcggggtaatagatatttcgtttagttgtgtttgggtaagtatttgggtttttgattcgtttcgatttgggtcgtttattatttgtatagtcgaaacgattttagggttgggttcggcgttggcggggttgttttttttttttgttcggtcgttttttattttgatgttagtttcgttatttacgtttcgggcggcgttcgttttcgttttgcgcgcgcggtgttcgcggttatacgggggcgttggcgttcgatgcgtttttttttgcgtagaattcggagaataaagggcgtttcgggatttcggttttttttatttggagttatttgtttttcgggcgttgttttagcgttaggttagtattcggttttcgcgaaggagttaatttttgtttagcgttgtttttagaaatttgttaaagaaatcgttttttatttgatggtttttttttttagtttg

SEQ ID NO: 9566 - DNA, 577 bp, Artificial Sequence
  chemically treated genomic DNA (Homo sapiens) CpG-island No: 9566
caaactaaaaaaaaaaaccatcaaataaaaaacgatttctttaacaaatttctaaaaacaacgctaaacaaaaattaactccttcgcgaaaaccgaatactaacctaacgctaaaacaacgcccgaaaaacaaataactccaaataaaaaaaaccgaaatcccgaaacgccctttattctccgaattctacgcaaaaaaaaacgcatcgaacgccaacgcccccgtataaccgcgaacaccgcgcgcgcaaaacgaaaacgaacgccgcccgaaacgtaaataacgaaactaacatcaaaataaaaaacgaccgaacaaaaaaaaaaaacaaccccgccaacgccgaacccaaccctaaaatcgtttcgactatacaaataataaacgacccaaatcgaaacgaatcaaaaacccaaatacttacccaaacacaactaaacgaaatatctattaccccgacgactaaaacgcgaaaccttacaaaaacgtaatactacaacgacctctacctaaacctaacgtacgactacctcaaactaattctccattcgctacgtaaattcgcccccgaaaaac

SEQ ID NO: 9567 - DNA, 577 bp, Artificial Sequence
  chemically treated genomic DNA (Homo sapiens) CpG-island No: 9567
taagttggggagaaagattattaagtggggagcgatttttttaatagatttttaagagtagcgttgagtaaaaattaattttttcgcggaggtcggatgttggtttggcgttggggtagcgttcgggaagtaggtggttttaggtgagggaggtcgaggtttcggggcgttttttgtttttcgggttttgcgtagggaggagcgtatcgggcgttagcgttttcgtgtggtcgcgagtatcgcgcgcgtaaagcgggggcgagcgtcgttcggggcgtgggtgacggggttggtattaaggtagagggcggtcgggtagggaggaggggtagtttcgttagcgtcgagtttagttttgaagtcgtttcggttgtgtagatgatgagcgatttaggtcgaggcgaattaggagtttaggtgtttgtttaagtatagttggacgaaatgtttgttatttcgacggttggggcgcgggattttgtagggacgtggtgttgtagcggtttttgtttgggtttggcgtgcggttattttaggttaattttttattcgttgcgtggattcgttttcgggaggt

SEQ ID NO: 9568 - DNA, 577 bp, Artificial Sequence
  chemically treated genomic DNA (Homo sapiens) CpG-island No: 9568
acctcccgaaaacgaatccacgcaacgaataaaaaattaacctaaaataaccgcacgccaaacccaaacaaaaaccgctacaacaccacgtccctacaaaatcccgcgccccaaccgtcgaaataacaaacatttcgtccaactatacttaaacaaacacctaaactcctaattcgcctcgacctaaatcgctcatcatctacacaaccgaaacgacttcaaaactaaactcgacgctaacgaaactacccctcctccctacccgaccgccctctaccttaataccaaccccgtcacccacgccccgaacgacgctcgcccccgctttacgcgcgcgatactcgcgaccacacgaaaacgctaacgcccgatacgctcctccctacgcaaaacccgaaaaacaaaaaacgccccgaaacctcgacctccctcacctaaaaccacctacttcccgaacgctaccccaacgccaaaccaacatccgacctccgcgaaaaaattaatttttactcaacgctactcttaaaaatctattaaaaaaatcgctccccacttaataatctttctccccaactta

SEQ ID NO: 9569 - DNA, 859 bp, Artificial Sequence
  chemically treated genomic DNA (Homo sapiens) CpG-island No: 9569
  misc_feature (719)..(719): n is either a, c, g or t
atcgtgtatcgttatatgattaatttttcgcgcggtttttgcgcggcgtattatattttgcgcgagttagtttatattgtgtggtttttttcgtattatagttaagttttttatcgtttttattgcgcgtcggcgtttattcgtttgttttcggattagtttttatttttaatacgatacgcgttcgagcgattagtcgagtatttcgacgagtttttttttacgcgatcggattagcgacgagagtgaaatatagtttatcgcgaagtatagacgttttcgatataagttatttgatggttatagattgtagatcggtacgtttagcgttagttttatgtatttttattttgattttatttcgattatagttcgtcgcgggtttagagtcgtttgttatgtatcgcgcgaatcgcgacggaacggtttattgcgaattttcgtcgatcgtagggtttcggaggtgttcgatttacggttcggatcgtgatagtcgcgcggttatggtattattttgttcgcggacggtgttttcgattacgacgtggaagtatttgatttatgtatttttgcggtataagcgagtttgtttgtggaacgtcggtttgaacgtcgattcgtatacgttatggttttagttacgagattatttgtggtgcgttgaaacgatatatattcgcgatagttggtgtcgttgcgtgcgaacgcggattgagcgntatgacgacgttgatatatattttagagggtcgcggttttttcgtttcgtggtgaagattagatatagagaatagaatgtttgtgttacgaaagggtttgtaagtttacggagcgatggttttagagtaataggagtata

SEQ ID NO: 9570 - DNA, 859 bp, Artificial Sequence
  chemically treated genomic DNA (Homo sapiens) CpG-island No: 9570
  misc_feature (141)..(141): n is either a, c, g or t
tatactcctattactctaaaaccatcgctccgtaaacttacaaaccctttcgtaacacaaacattctattctctatatctaatcttcaccacgaaacgaaaaaaccgcgaccctctaaaatatatatcaacgtcgtcatancgctcaatccgcgttcgcacgcaacgacaccaactatcgcgaatatatatcgtttcaacgcaccacaaataatctcgtaactaaaaccataacgtatacgaatcgacgttcaaaccgacgttccacaaacaaactcgcttataccgcaaaaatacataaatcaaatacttccacgtcgtaatcgaaaacaccgtccgcgaacaaaataataccataaccgcgcgactatcacgatccgaaccgtaaatcgaacacctccgaaaccctacgatcgacgaaaattcgcaataaaccgttccgtcgcgattcgcgcgatacataacaaacgactctaaacccgcgacgaactataatcgaaataaaatcaaaataaaaatacataaaactaacgctaaacgtaccgatctacaatctataaccatcaaataacttatatcgaaaacgtctatacttcgcgataaactatatttcactctcgtcgctaatccgatcgcgtaaaaaaaaactcgtcgaaatactcgactaatcgctcgaacgcgtatcgtattaaaaataaaaactaatccgaaaacaaacgaataaacgccgacgcgcaataaaaacgataaaaaacttaactataatacgaaaaaaaccacacaatataaactaactcgcgcaaaatataatacgccgcgcaaaaaccgcgcgaaaaattaatcatataacgatacacgat

SEQ ID NO: 9571 - DNA, 859 bp, Artificial Sequence
  chemically treated genomic DNA (Homo sapiens) CpG-island No: 9571
  misc_feature (141)..(141): n is either a, c, g or t
tatgtttttgttgttttgaaattatcgtttcgtggatttgtaggttttttcgtgatataagtattttgttttttatatttagtttttattacggggcggaaggatcgcgattttttggagtgtgtattagcgtcgttatgncgtttagttcgcgttcgtacgtagcgatattagttatcgcgagtgtgtgtcgttttagcgtattataggtggtttcgtggttgaggttatgacgtgtgcgaatcgacgtttaagtcggcgttttataggtaagttcgtttgtgtcgtagaggtgtatgagttagatgtttttacgtcgtgatcgagagtatcgttcgcggataaggtgatgttatggtcgcgcgattgttacggttcgagtcgtagatcgaatattttcggaattttacggtcggcggaagttcgtagtgagtcgtttcgtcgcgattcgcgcgatgtatggtagacgattttagattcgcggcgggttatagtcgggatgaggttagggtaggagtgtatgaggttggcgttgggcgtatcgatttgtagtttgtgattattaagtggtttgtatcggggacgtttgtatttcgcgatgaattgtgttttattttcgtcgttagttcgatcgcgtgagaagagattcgtcgggatgttcggttagtcgttcgggcgcgtgtcgtgttggaggtggggattaattcggagatagacgaatgggcgtcggcgcgtagtggagacgatgaggagtttggttgtggtgcgaagaggattatataatgtgaattggttcgcgtagggtgtgatgcgtcgcgtagaggtcgcgcgagggattgattatgtggcgatgtacgat

SEQ ID NO: 9572 - DNA, 859 bp, Artificial Sequence
  chemically treated genomic DNA (Homo sapiens) CpG-island No: 9572
  misc_feature (719)..(719): n is either a, c, g or t
atcgtacatcgccacataatcaatccctcgcgcgacctctacgcgacgcatcacaccctacgcgaaccaattcacattatataatcctcttcgcaccacaaccaaactcctcatcgtctccactacgcgccgacgcccattcgtctatctccgaattaatccccacctccaacacgacacgcgcccgaacgactaaccgaacatcccgacgaatctcttctcacgcgatcgaactaacgacgaaaataaaacacaattcatcgcgaaatacaaacgtccccgatacaaaccacttaataatcacaaactacaaatcgatacgcccaacgccaacctcatacactcctaccctaacctcatcccgactataacccgccgcgaatctaaaatcgtctaccatacatcgcgcgaatcgcgacgaaacgactcactacgaacttccgccgaccgtaaaattccgaaaatattcgatctacgactcgaaccgtaacaatcgcgcgaccataacatcaccttatccgcgaacgatactctcgatcacgacgtaaaaacatctaactcatacacctctacgacacaaacgaacttacctataaaacgccgacttaaacgtcgattcgcacacgtcataacctcaaccacgaaaccacctataatacgctaaaacgacacacactcgcgataactaatatcgctacgtacgaacgcgaactaaacgncataacgacgctaatacacactccaaaaaatcgcgatccttccgccccgtaataaaaactaaatataaaaaacaaaatacttatatcacgaaaaaacctacaaatccacgaaacgataatttcaaaacaacaaaaacata

SEQ ID NO: 9573 - DNA, 503 bp, Artificial Sequence
  chemically treated genomic DNA (Homo sapiens) CpG-island No: 9573
  misc_feature (52)..(52): n is either a, c, g or t
tgatttttttttttttttaagttcgcgtttttttacgcgtggtttttttttnttgtcgggagggtcgcgatggaggtttcgtttaggtttttttatgtgtcgtcgttattgttttttttcgttttcgttattttagtttttcgtagttttttttattggcggtcgcggtcgtcgcggtagttagtttcgttttttttttcgttcgtttttagtttcgttcggtagggggcgcgtcgggtttagcgttacgttatcgtttagtagttttttcgattggcgggcggggcggttataaagggagggcgtaggcggcgttcggatttttttcgtcgttattttaaatttagttttatataacgtttcgtcgtcgttgttgtcgcgattcggattgcgcgttagtatttttttgtcgatagtttcgttattatggaggatatgaacgagtatagtaatatagaggaattcgtagagggatttaagattaacgcgagtaagaattagta

SEQ ID NO: 9574 - DNA, 503 bp, Artificial Sequence
  chemically treated genomic DNA (Homo sapiens) CpG-island No: 9574
  misc_feature (452)..(452): n is either a, c, g or t
tactaattcttactcgcgttaatcttaaatccctctacgaattcctctatattactatactcgttcatatcctccataataacgaaactatcgacaaaaaaatactaacgcgcaatccgaatcgcgacaacaacgacgacgaaacgttatataaaactaaatttaaaataacgacgaaaaaaatccgaacgccgcctacgccctccctttataaccgccccgcccgccaatcgaaaaaactactaaacgataacgtaacgctaaacccgacgcgccccctaccgaacgaaactaaaaacgaacgaaaaaaaaaacgaaactaactaccgcgacgaccgcgaccgccaataaaaaaaactacgaaaaactaaaataacgaaaacgaaaaaaaacaataacgacgacacataaaaaaacctaaacgaaacctccatcgcgaccctcccgacaanaaaaaaaaaccacgcgtaaaaaaacgcgaacttaaaaaaaaaaaaaaatca

SEQ ID NO: 9575 - DNA, 503 bp, Artificial Sequence
  chemically treated genomic DNA (Homo sapiens) CpG-island No: 9575
  misc_feature (452)..(452): n is either a, c, g or t
tgttgatttttgttcgcgttgattttggatttttttgcgaatttttttatattgttgtattcgtttatattttttatagtgacggagttgtcggtaggggggtgttggcgcgtagttcgggtcgcggtagtagcggcggcggagcgttgtatggagttggatttaaaatggcggcggaagagattcgggcgtcgtttgcgttttttttttatagtcgtttcgttcgttaatcgggagggttgttgggcggtgacgtggcgttgggttcggcgcgttttttgtcgggcggagttgggagcgagcgaagggaggagcggggttagttgtcgcggcggtcgcggtcgttaatgggagaggttgcgggaggttaaagtagcgggagcggaggggaataatggcggcggtatatgggaaagtttgggcgggatttttatcgcggttttttcggtaanggagagaggttacgcgtgaggggacgcgggtttgggagaagagaagaatta

SEQ ID NO: 9576 - DNA, 503 bp, Artificial Sequence
  chemically treated genomic DNA (Homo sapiens) CpG-island No: 9576
  misc_feature (52)..(52): n is either a, c, g or t
taattcttctcttctcccaaacccgcgtcccctcacgcgtaacctctctccnttaccgaaaaaaccgcgataaaaatcccgcccaaactttcccatataccgccgccattattcccctccgctcccgctactttaacctcccgcaacctctcccattaacgaccgcgaccgccgcgacaactaaccccgctcctcccttcgctcgctcccaactccgcccgacaaaaaacgcgccgaacccaacgccacgtcaccgcccaacaaccctcccgattaacgaacgaaacgactataaaaaaaaaacgcaaacgacgcccgaatctcttccgccgccattttaaatccaactccatacaacgctccgccgccgctactaccgcgacccgaactacgcgccaacacccccctaccgacaactccgtcactataaaaaatataaacgaatacaacaatataaaaaaattcgcaaaaaaatccaaaatcaacgcgaacaaaaatcaaca

SEQ ID NO: 9577 - DNA, 800 bp, Artificial Sequence
  chemically treated genomic DNA (Homo sapiens) CpG-island No: 9577
  misc_feature (522)..(522): n is either a, c, g or t
tggttttcgcgcgattgttttagtttacgatattttcggttttttttaaaggtttttaaggttgtgtaacgcggagcgtgagaggaaggtataaagggtagcgagagggcgggatcgaggaggaaagggaaaaaaaaaaaattagggggataggggtggggggacgcgcgaagggcgcgttttcgcgttacgtgatcgggacgcgtcgttttttcgtcggttattttaggtggttcgcggcggcgttattaaagcgaggaggaggcgagagcggtcgtcgttggtgtttatttttttttagtgtagcgggagagagcgggagtgtgcgtcgcgcgagagtgggaggcgaagggggtagtttagggagaggcgtaggagtttttgtagttacgcgcgcgttttttttgttttgtgtgtttcgcgaggtagagcgggcgcgcggtagcggcggggattattttgttgttagtttcggttcgcggtagcggcgggtgtagtttcggcggtagcggcggagatatntagtattatgtcggaggagtagttcggcggggacggggcggcggtagcggtaacggcggcggtaggcggttcggcgggcgagtaggagggagttatggtggcggcgatatagggggtagcggcggcggcgggaagcggagtcgggatcgggggcggaatcgcgtttggaggtatcgaagggggtagcgtcgagtcggagggggcgaagattgacgttagtaagaattaggaggatgaagggtgagtaagaggtattttaggatagttaggtttaatta

SEQ ID NO: 9578 - DNA, 800 bp, Artificial Sequence
  chemically treated genomic DNA (Homo sapiens) CpG-island No: 9578
  misc_feature (279)..(279): n is either a, c, g or t
taattaaacctaactatcctaaaatacctcttactcacccttcatcctcctaattcttactaacgtcaatcttcgccccctccgactcgacgctacccccttcgatacctccaaacgcgattccgcccccgatcccgactccgcttcccgccgccgccgctaccccctatatcgccgccaccataactccctcctactcgcccgccgaaccgcctaccgccgccgttaccgctaccgccgccccgtccccgccgaactactcctccgacataatactanatatctccgccgctaccgccgaaactacacccgccgctaccgcgaaccgaaactaacaacaaaataatccccgccgctaccgcgcgcccgctctacctcgcgaaacacacaaaacaaaaaaaacgcgcgcgtaactacaaaaactcctacgcctctccctaaactacccccttcgcctcccactctcgcgcgacgcacactcccgctctctcccgctacactaaaaaaaaataaacaccaacgacgaccgctctcgcctcctcctcgctttaataacgccgccgcgaaccacctaaaataaccgacgaaaaaacgacgcgtcccgatcacgtaacgcgaaaacgcgcccttcgcgcgtccccccacccctatccccctaattttttttttttccctttcctcctcgatcccgccctctcgctaccctttataccttcctctcacgctccgcgttacacaaccttaaaaacctttaaaaaaaaccgaaaatatcgtaaactaaaacaatcgcgcgaaaacca

SEQ ID NO: 9579 - DNA, 800 bp, Artificial Sequence
  chemically treated genomic DNA (Homo sapiens) CpG-island No: 9579
  misc_feature (279)..(279): n is either a, c, g or t
tagttgggtttgattattttgggatgttttttatttattttttatttttttggtttttattggcgttaattttcgtttttttcgattcggcgttgtttttttcggtgtttttagacgcggtttcgttttcggtttcggtttcgtttttcgtcgtcgtcgttgttttttgtgtcgtcgttattatggtttttttttgttcgttcgtcgagtcgtttatcgtcgtcgttgtcgttgtcgtcgtttcgttttcgtcgaattgttttttcgatatagtgttangtgttttcgtcgttgtcgtcgagattatattcgtcgttgtcgcgaatcgaaattagtagtaaagtaattttcgtcgttgtcgcgcgttcgttttatttcgcgaagtatataagatagggaaggcgcgcgcgtggttgtaaaggtttttgcgtttttttttgggttgtttttttcgttttttattttcgcgcggcgtatattttcgttttttttcgttgtattaaaaaagaataagtattagcggcggtcgttttcgtttttttttcgttttaatggcgtcgtcgcggattatttaaaatggtcgacggaagaacggcgcgtttcggttacgtgacgcgagagcgcgtttttcgcgcgtttttttatttttatttttttagttttttttttttttttttttttttcggtttcgttttttcgttattttttatattttttttttacgtttcgcgttgtatagttttgggggtttttaaaaggaatcggaagtgtcgtgagttaagatagtcgcgcggggatta

SEQ ID NO: 9580 - DNA, 800 bp, Artificial Sequence
  chemically treated genomic DNA (Homo sapiens) CpG-island No: 9580
  misc_feature (522)..(522): n is either a, c, g or t
taatccccgcgcgactatcttaactcacgacacttccgattccttttaaaaacccccaaaactatacaacgcgaaacgtaaaaaaaaaatataaaaaataacgaaaaaacgaaaccgaaaaaaaaaaaaaaaaaaaaaaaactaaaaaaataaaaataaaaaaacgcgcgaaaaacgcgctctcgcgtcacgtaaccgaaacgcgccgttcttccgtcgaccattttaaataatccgcgacgacgccattaaaacgaaaaaaaaacgaaaacgaccgccgctaatacttattcttttttaatacaacgaaaaaaaacgaaaatatacgccgcgcgaaaataaaaaacgaaaaaaacaacccaaaaaaaaacgcaaaaacctttacaaccacgcgcgcgccttccctatcttatatacttcgcgaaataaaacgaacgcgcgacaacgacgaaaattactttactactaatttcgattcgcgacaacgacgaatataatctcgacgacaacgacgaaaacacntaacactatatcgaaaaaacaattcgacgaaaacgaaacgacgacaacgacaacgacgacgataaacgactcgacgaacgaacaaaaaaaaaccataataacgacgacacaaaaaacaacgacgacgacgaaaaacgaaaccgaaaccgaaaacgaaaccgcgtctaaaaacaccgaaaaaaacaacgccgaatcgaaaaaaacgaaaattaacgccaataaaaaccaaaaaaataaaaaataaataaaaaacatcccaaaataatcaaacccaacta

SEQ ID NO: 9581 - DNA, 531 bp, Artificial Sequence
  chemically treated genomic DNA (Homo sapiens) CpG-island No: 9581
gtcgtaaagttttcgtcggtcgttattttgattcgtttttttatttttttattcgttaggtttgatagttcggtttttaaatttattttcggtttcggtcgcggtttcggttattcgaataattcgatatggcgttaatggttgcggttggcggggaacgaagtatatagaaaagcgtgcgataagtcgttggaaatggtttcgatgacggcgaagttttgcgggggcggtagcggaggaaggatatcgatgatattagtcgaagttgtattattagagatcggtagaaatgaatgaggtgtcggtcgtttttcggtagtcgtttttatagtttggatcgttttttacgtcgtagggaacgttgggagtcgttttatgatttaatcgtttcgtttttcgcgtataggtcgtaacgttcgttggcgttttaggatcgtcgcgtttttattttttttcgcgttatttttttaggttagggtttatttattattggaatgttttattttgtatttttttgattttatttttttt

SEQ ID NO: 9582 - DNA, 531 bp, Artificial Sequence
  chemically treated genomic DNA (Homo sapiens) CpG-island No: 9582
aaaaaaaataaaatcaaaaaaatacaaaataaaacattccaataataaataaaccctaacctaaaaaaataacgcgaaaaaaaataaaaacgcgacgatcctaaaacgccaacgaacgttacgacctatacgcgaaaaacgaaacgattaaatcataaaacgactcccaacgttccctacgacgtaaaaaacgatccaaactataaaaacgactaccgaaaaacgaccgacacctcattcatttctaccgatctctaataatacaacttcgactaatatcatcgatatccttcctccgctaccgcccccgcaaaacttcgccgtcatcgaaaccatttccaacgacttatcgcacgcttttctatatacttcgttccccgccaaccgcaaccattaacgccatatcgaattattcgaataaccgaaaccgcgaccgaaaccgaaaataaatttaaaaaccgaactatcaaacctaacgaataaaaaaataaaaaaacgaatcaaaataacgaccgacgaaaactttacgac

SEQ ID NO: 9583 - DNA, 531 bp, Artificial Sequence
  chemically treated genomic DNA (Homo sapiens) CpG-island No: 9583
gaagaaggtgaggttaagagagtgtagaatgaggtattttaatggtgggtgggttttgatttgagagagtggcgcggggaggggtgaaagcgcggcgattttggaacgttagcgggcgttgcggtttatgcgcgaggggcggggcgattaggttatagagcggtttttagcgttttttgcggcgtaggaggcggtttagattataaaagcggttgtcggaaagcggtcggtattttatttatttttatcggtttttagtagtgtagtttcggttggtgttatcggtgtttttttttcgttgtcgttttcgtaaggtttcgtcgttatcgaggttatttttagcgatttgtcgtacgtttttttatatatttcgtttttcgttaatcgtaattattgacgttatgtcgggttattcgagtgatcgagatcgcggtcgggatcgagggtgagtttgggagtcgagttgttaggtttggcgggtggggggatgggagggcgggttagggtggcggtcggcgggggttttgcggt

SEQ ID NO: 9584 - DNA, 531 bp, Artificial Sequence
  chemically treated genomic DNA (Homo sapiens) CpG-island No: 9584
accgcaaaacccccgccgaccgccaccctaacccgccctcccatccccccacccgccaaacctaacaactcgactcccaaactcaccctcgatcccgaccgcgatctcgatcactcgaataacccgacataacgtcaataattacgattaacgaaaaacgaaatatataaaaaaacgtacgacaaatcgctaaaaataacctcgataacgacgaaaccttacgaaaacgacaacgaaaaaaaaacaccgataacaccaaccgaaactacactactaaaaaccgataaaaataaataaaataccgaccgctttccgacaaccgcttttataatctaaaccgcctcctacgccgcaaaaaacgctaaaaaccgctctataacctaatcgccccgcccctcgcgcataaaccgcaacgcccgctaacgttccaaaatcgccgcgctttcacccctccccgcgccactctctcaaatcaaaacccacccaccattaaaatacctcattctacactctcttaacctcaccttcttc

SEQ ID NO: 9585 - DNA, 576 bp, Artificial Sequence
  chemically treated genomic DNA (Homo sapiens) CpG-island No: 9585
ttcggagatgtttacgtttttaaagagtttttacgtttgtaattaaaagagggggaaggcggggtttggcgttgttacgtggttgtattatttcggattatcgagagagcggttcgtattattttttcgttgacgtcggcggagggatataaaacgaaatagtttatcggaagtgcgttgttcgtatttcgggattcgttcgggttgtcggttgatgtggatcgttcgattcgcgtgtttgataattttttgaggggttttggtcggcggagaatggtttttaaattttttaaatcgttttcgttttacgttttgtgaaaggaagtgtttttttgatgattaattagcggcgagaagtttttttaacgttcgttttttttttacgttttttttttcgcgttttggttcgtgcgttcgcgttttagtgtcgggtttgcgtggatcggtttttttaggatatcgtcgttttttcggtcgcgtcggagttcggcggcgatttgtttttgaaatatggtaggttcggatgttggtgagtgtttttttggggttttagtatgtgtggattgaaatcgttta

SEQ ID NO: 9586 - DNA, 576 bp, Artificial Sequence
  chemically treated genomic DNA (Homo sapiens) CpG-island No: 9586
taaacgatttcaatccacacatactaaaaccccaaaaaaacactcaccaacatccgaacctaccatatttcaaaaacaaatcgccgccgaactccgacgcgaccgaaaaaacgacgatatcctaaaaaaaccgatccacgcaaacccgacactaaaacgcgaacgcacgaaccaaaacgcgaaaaaaaaaacgtaaaaaaaaaacgaacgttaaaaaaacttctcgccgctaattaatcatcaaaaaaacacttcctttcacaaaacgtaaaacgaaaacgatttaaaaaatttaaaaaccattctccgccgaccaaaacccctcaaaaaattatcaaacacgcgaatcgaacgatccacatcaaccgacaacccgaacgaatcccgaaatacgaacaacgcacttccgataaactatttcgttttatatccctccgccgacgtcaacgaaaaaataatacgaaccgctctctcgataatccgaaataatacaaccacgtaacaacgccaaaccccgccttccccctcttttaattacaaacgtaaaaactctttaaaaacgtaaacatctccgaa

SEQ ID NO: 9587 - DNA, 576 bp, Artificial Sequence
  chemically treated genomic DNA (Homo sapiens) CpG-island No: 9587
tggacggttttagtttatatatattgggattttagggagatatttattagtattcgagtttgttatgttttagaggtaggtcgtcgtcggatttcgacgcggtcgggaaggcgacggtgttttggaaggatcgatttacgtagattcgatattggggcgcggacgtacgaattaaagcgcggggaaggaggcgtgaaagaaggacggacgttaaaagagtttttcgtcgttgattggttattagaggagtatttttttttataggacgtgaaacgggggcggtttgggaagtttagagattatttttcgtcgattaaaattttttaaaggattattagatacgcgggtcggacggtttatattagtcggtagttcgggcgggtttcggggtgcgagtagcgtattttcggtgagttatttcgttttgtattttttcgtcgacgttaacgggaaagtagtgcggatcgttttttcggtggttcggggtggtatagttacgtgataacgttaggtttcgtttttttttttttttggttatagacgtgagggttttttggagacgtaaatattttcgag

SEQ ID NO: 9588 - DNA, 576 bp, Artificial Sequence
  chemically treated genomic DNA (Homo sapiens) CpG-island No: 9588
ctcgaaaatatttacgtctccaaaaaaccctcacgtctataaccaaaaaaaaaaaaaaacgaaacctaacgttatcacgtaactataccaccccgaaccaccgaaaaaacgatccgcactactttcccgttaacgtcgacgaaaaaatacaaaacgaaataactcaccgaaaatacgctactcgcaccccgaaacccgcccgaactaccgactaatataaaccgtccgacccgcgtatctaataatcctttaaaaaattttaatcgacgaaaaataatctctaaacttcccaaaccgcccccgtttcacgtcctataaaaaaaaatactcctctaataaccaatcaacgacgaaaaactcttttaacgtccgtccttctttcacgcctccttccccgcgctttaattcgtacgtccgcgccccaatatcgaatctacgtaaatcgatccttccaaaacaccgtcgccttcccgaccgcgtcgaaatccgacgacgacctacctctaaaacataacaaactcgaatactaataaatatctccctaaaatcccaatatatataaactaaaaccgtcca

SEQ ID NO: 9589 - DNA, 841 bp, Artificial Sequence
  chemically treated genomic DNA (Homo sapiens) CpG-island No: 9589
cgagaggtttcggatcgcgaagtttgtacgtgggtcgattcggtcgatgttgttatttttcgtcgttagtcggcgggtgggatttacgtcggagagtagatttttaatcggcgagggagttcgggaggttacgttgttagttttcggtttatatatggtcggtaagcggaggggaagagagtatcgttaggttttatgttcgcgtttggatttacggttcgtaggtttcggtagcgattcggggtttagagtcggtcggtaatagcgttagttcgttttcgcgttgttcggcgttttagttcgtatttattttgacgttttcgttttcgttttcgtttttttagcggttttcgtcggtagtgtcgtcgttttttatttttcgtattgggttttttacggagaaagcgtcggcgtttacggaagaaagcgagtcgtgttagtgtttgttattgcgtggggtcggcgtcggttcgggttttgttttagtaatttttttttattttaggagttcgagtttttcgtcgtcgtcgtcgtcgtcgttatttcgagtcgggtgtgagcgtgtgtgagagggagagttagcgaggagttagtacggcggaggtgagttattgggtttgttttcgttgatcggcgcggagtaggatgggatcgtggttgattgtgcgtcgagtcgaggttacgtttttttaggcggcggcggcgacgcgcgcgggtaagaagtgggcggggaacgcggtcggtggcgttgcggggttgagggagaggcggaggggggggcggaggggggcggaaggatgttttgtatatgtagtttatagaaattttatggttttattaa

SEQ ID NO: 9590 - DNA, 841 bp, Artificial Sequence
  chemically treated genomic DNA (Homo sapiens) CpG-island No: 9590
ttaataaaaccataaaatttctataaactacatatacaaaacatccttccgcccccctccgcccccccctccgcctctccctcaaccccgcaacgccaccgaccgcgttccccgcccacttcttacccgcgcgcgtcgccgccgccgcctaaaaaaacgtaacctcgactcgacgcacaatcaaccacgatcccatcctactccgcgccgatcaacgaaaacaaacccaataactcacctccgccgtactaactcctcgctaactctccctctcacacacgctcacacccgactcgaaataacgacgacgacgacgacgacgaaaaactcgaactcctaaaataaaaaaaaattactaaaacaaaacccgaaccgacgccgaccccacgcaataacaaacactaacacgactcgctttcttccgtaaacgccgacgctttctccgtaaaaaacccaatacgaaaaataaaaaacgacgacactaccgacgaaaaccgctaaaaaaacgaaaacgaaaacgaaaacgtcaaaataaatacgaactaaaacgccgaacaacgcgaaaacgaactaacgctattaccgaccgactctaaaccccgaatcgctaccgaaacctacgaaccgtaaatccaaacgcgaacataaaacctaacgatactctcttcccctccgcttaccgaccatatataaaccgaaaactaacaacgtaacctcccgaactccctcgccgattaaaaatctactctccgacgtaaatcccacccgccgactaacgacgaaaaataacaacatcgaccgaatcgacccacgtacaaacttcgcgatccgaaacctctcg

SEQ ID NO: 9591 - DNA, 841 bp, Artificial Sequence
  chemically treated genomic DNA (Homo sapiens) CpG-island No: 9591
ttagtggagttatgaggtttttataaattgtatatataggatattttttcgttttttttcgttttttttttcgttttttttttagtttcgtagcgttatcgatcgcgtttttcgtttattttttattcgcgcgcgtcgtcgtcgtcgtttgagggggcgtggtttcggttcggcgtatagttagttacggttttattttgtttcgcgtcggttaacgagagtaaatttagtgatttattttcgtcgtgttaatttttcgttagtttttttttttatatacgtttatattcggttcgagatggcggcggcggcggcggcggcgggggattcggatttttggggtgaggagaagttgttggggtagggttcgggtcggcgtcggttttacgtagtggtaggtattaatacggttcgttttttttcgtagacgtcgacgtttttttcgtggaagatttagtgcggaaggtggggggcggcggtattgtcggcggggatcgttgggaaggcgaggacgaggacgaggacgttaaggtgggtgcgggttagggcgtcgggtagcgcggaagcgggttggcgttgttgtcggtcgattttgggtttcgggtcgttgtcggggtttgcgggtcgtgggtttaggcgcgagtatagggtttggcggtgtttttttttttttcgtttgtcggttatgtgtgggtcgaagattggtagcgtggtttttcggattttttcgtcggttgagagtttgtttttcggcgtggattttattcgtcggttggcgacgaaaggtgatagtatcggtcgggtcggtttacgtgtaagtttcgcggttcggagtttttcg

SEQ ID NO: 9592 - DNA, 841 bp, Artificial Sequence
  chemically treated genomic DNA (Homo sapiens) CpG-island No: 9592
cgaaaaactccgaaccgcgaaacttacacgtaaaccgacccgaccgatactatcacctttcgtcgccaaccgacgaataaaatccacgccgaaaaacaaactctcaaccgacgaaaaaatccgaaaaaccacgctaccaatcttcgacccacacataaccgacaaacgaaaaaaaaaaaaacaccgccaaaccctatactcgcgcctaaacccacgacccgcaaaccccgacaacgacccgaaacccaaaatcgaccgacaacaacgccaacccgcttccgcgctacccgacgccctaacccgcacccaccttaacgtcctcgtcctcgtcctcgccttcccaacgatccccgccgacaataccgccgccccccaccttccgcactaaatcttccacgaaaaaaacgtcgacgtctacgaaaaaaaacgaaccgtattaatacctaccactacgtaaaaccgacgccgacccgaaccctaccccaacaacttctcctcaccccaaaaatccgaatcccccgccgccgccgccgccgccgccatctcgaaccgaatataaacgtatataaaaaaaaaaactaacgaaaaattaacacgacgaaaataaatcactaaatttactctcgttaaccgacgcgaaacaaaataaaaccgtaactaactatacgccgaaccgaaaccacgccccctcaaacgacgacgacgacgcgcgcgaataaaaaataaacgaaaaacgcgatcgataacgctacgaaactaaaaaaaaaacgaaaaaaaaaacgaaaaaaaacgaaaaaatatcctatatatacaatttataaaaacctcataactccactaa

SEQ ID NO: 9593 - DNA, 1003 bp, Artificial Sequence
  chemically treated genomic DNA (Homo sapiens) CpG-island No: 9593
agcgttttttttcgtcggtcgcgtcgatttttttggtttagattaagggttagatgtagaaagtagttttaggttcgcggtcgcggcgttgtttatttcgtcgttttcgttttttgtagtcgtcgttttatttcgtttttagtcggatttttaggttttttgtttttcgcgagcggtcgttcgagtattagtttcgtcgtcgtagagacgttcgttacgtcggtgtcggagtcggagcggggagttaggttgcgtgcgattagtcgtagagtagagagcgttcggggcgggggtcgtagacggataggggttttgggcggtcggggagtatgttcgcgcggttacgttgaatggcgttttttttgcgatttttcgttcggttgcgatcgtcggggatgttgtttcgcgcgtttttgtttttgttgttgtttagttttttgttaggtgggcgcgtttttttttgtttttttttatcgttgtggggcgggagcgggcgcgagtgggatggggaaagaggaaacgatggggcgtggggagcgcgcggcggggtttttcgtggtggcgttgattttcggttttcgttttcgttttgcggtttgttcggaatcgttagttgtagatattagttgtttgcggtttttgcgttgtttgggtagggttgcgggagttttttcgggcgtacgttttttcgcgtcgcgcgttcgtggttgcggagttttggcggtcgttgtttattttggttttttttttttcgcgttattgtttcggtttcggtcgcgttcgcgttttcgcgatcggtcggatttcgggtcgttagttcgtcggggtcgtcgcggttgtacgtggttttatttatattgtttttttagtggtagtttcgtcgtgtagggggcgtcgcggtttttcgcggtttttcgtgtttgttgtgggagtttttttattttttagggttgcgagagggaataggtgaatttataattttaatcggtattagtttgtcgga

SEQ ID NO: 9594 - DNA, 1003 bp, Artificial Sequence
  chemically treated genomic DNA (Homo sapiens) CpG-island No: 9594
tccgacaaactaataccgattaaaattataaattcacctattccctctcgcaaccctaaaaaataaaaaaactcccacaacaaacacgaaaaaccgcgaaaaaccgcgacgccccctacacgacgaaactaccactaaaaaaacaatataaataaaaccacgtacaaccgcgacgaccccgacgaactaacgacccgaaatccgaccgatcgcgaaaacgcgaacgcgaccgaaaccgaaacaataacgcgaaaaaaaaaaaaccaaaataaacaacgaccgccaaaactccgcaaccacgaacgcgcgacgcgaaaaaacgtacgcccgaaaaaactcccgcaaccctacccaaacaacgcaaaaaccgcaaacaactaatatctacaactaacgattccgaacaaaccgcaaaacgaaaacgaaaaccgaaaatcaacgccaccacgaaaaaccccgccgcgcgctccccacgccccatcgtttcctctttccccatcccactcgcgcccgctcccgccccacaacgataaaaaaaaacaaaaaaaaacgcgcccacctaacaaaaaactaaacaacaacaaaaacaaaaacgcgcgaaacaacatccccgacgatcgcaaccgaacgaaaaatcgcaaaaaaaacgccattcaacgtaaccgcgcgaacatactccccgaccgcccaaaacccctatccgtctacgacccccgccccgaacgctctctactctacgactaatcgcacgcaacctaactccccgctccgactccgacaccgacgtaacgaacgtctctacgacgacgaaactaatactcgaacgaccgctcgcgaaaaacaaaaaacctaaaaatccgactaaaaacgaaataaaacgacgactacaaaaaacgaaaacgacgaaataaacaacgccgcgaccgcgaacctaaaactactttctacatctaacccttaatctaaaccaaaaaaatcgacgcgaccgacgaaaaaaaacgct

SEQ ID NO: 9595 - DNA, 1003 bp, Artificial Sequence
  chemically treated genomic DNA (Homo sapiens) CpG-island No: 9595
ttcggtaagttggtgtcgattggggttatgagtttatttattttttttcgtagttttaaaaagtgggggaatttttataatagatacgggaagtcgcgaggaatcgcggcgttttttgtacggcgaggttgttattaaggaaataatataaataaagttacgtgtagtcgcggcggtttcggcgggttggcgattcggagttcggtcggtcgcggaggcgcggacgcggtcggagtcgggataatggcgcgagaaggaagagattagagtggatagcggtcgttagaatttcgtagttacgggcgcgcggcgcggaggggcgtgcgttcggagaagttttcgtagttttgtttaagtagcgtagaggtcgtaagtaattagtgtttgtagttggcggtttcggataggtcgtagggcgagagcgggggtcgggggttagcgttattacggaggatttcgtcgcgcgttttttacgttttatcgttttttttttttttattttattcgcgttcgttttcgttttatagcggtaagagaaagtagaagaaagcgcgtttatttggtaaaggattgagtagtagtaggagtaggagcgcgcggagtagtattttcggcggtcgtagtcgggcgaggggtcgtagaggaggcgttatttagcgtagtcgcgcgggtatgtttttcggtcgtttagagtttttgttcgtttgcggttttcgtttcgggcgttttttgttttgcggttggtcgtacgtagtttggtttttcgtttcggtttcggtatcggcgtggcgagcgtttttgcggcggcgaggttggtgttcggacggtcgttcgcgagaagtaaggggtttgagagttcggttgggggcggagtgaggcggcggttgtagagggcgggggcggcggagtggatagcgtcgcggtcgcgggtttgggattattttttatatttggtttttggtttgggttagggaggtcggcgcggtcggcggagggagacgtt

SEQ ID NO: 9596 - DNA, 1003 bp, Artificial Sequence
  chemically treated genomic DNA (Homo sapiens) CpG-island No: 9596
aacgtctccctccgccgaccgcgccgacctccctaacccaaaccaaaaaccaaatataaaaaataatcccaaacccgcgaccgcgacgctatccactccgccgcccccgccctctacaaccgccgcctcactccgcccccaaccgaactctcaaaccccttacttctcgcgaacgaccgtccgaacaccaacctcgccgccgcaaaaacgctcgccacgccgataccgaaaccgaaacgaaaaaccaaactacgtacgaccaaccgcaaaacaaaaaacgcccgaaacgaaaaccgcaaacgaacaaaaactctaaacgaccgaaaaacatacccgcgcgactacgctaaataacgcctcctctacgacccctcgcccgactacgaccgccgaaaatactactccgcgcgctcctactcctactactactcaatcctttaccaaataaacgcgctttcttctactttctcttaccgctataaaacgaaaacgaacgcgaataaaataaaaaaaaaaaaaacgataaaacgtaaaaaacgcgcgacgaaatcctccgtaataacgctaacccccgacccccgctctcgccctacgacctatccgaaaccgccaactacaaacactaattacttacgacctctacgctacttaaacaaaactacgaaaacttctccgaacgcacgcccctccgcgccgcgcgcccgtaactacgaaattctaacgaccgctatccactctaatctcttccttctcgcgccattatcccgactccgaccgcgtccgcgcctccgcgaccgaccgaactccgaatcgccaacccgccgaaaccgccgcgactacacgtaactttatttatattatttccttaataacaacctcgccgtacaaaaaacgccgcgattcctcgcgacttcccgtatctattataaaaattcccccactttttaaaactacgaaaaaaaataaataaactcataaccccaatcgacaccaacttaccgaa

SEQ ID NO: 9597 - DNA, 653 bp, Artificial Sequence
  chemically treated genomic DNA (Homo sapiens) CpG-island No: 9597
gtttgaatagcgtttagttgtttcgtttttaaaatgttaggacggtcgcggtttcgtttagagttttttttcggttgttggttcgggttcgttcgcgtcgttgggggttttgatttttgtcgagtcgggtttgggtagcgtttttcgcgtttcgcgagttcgcgttttcgttatcgggaaacgtcgtagtcggcgattcgcggtcgttttgggttcggcgtcggtttagttaggatttcgggagcgtacgggacgggtttcgttaggtaaggatcgcgggagtatttcgggattcgttgtcgcggcgtttgcggggttggagtatagtattgtcggtgtcgtcggggcgtcgcgcgggttatcggtcgtaggcggaggatttgttcgttgaagtcgggtcgagttttgtcgcggcggcgaggagattcgcgtggatattgggatcgatttttttttcggcggtattgcgttcggggcgcgtttcggtcggcggggagggtcggattcgcgcggtaggggatagtagtttcggtgggagtcgtacgggagtcgcgtcgtagcggttcgagttttattgcggggttcggggtttagaaatcgggagagtgtggtgttgtgtttaggtattttcgttgttttgagttttatttttt

SEQ ID NO: 9598 - DNA, 653 bp, Artificial Sequence
  chemically treated genomic DNA (Homo sapiens) CpG-island No: 9598
aaaaaataaaactcaaaacaacgaaaatacctaaacacaacaccacactctcccgatttctaaaccccgaaccccgcaataaaactcgaaccgctacgacgcgactcccgtacgactcccaccgaaactactatcccctaccgcgcgaatccgaccctccccgccgaccgaaacgcgccccgaacgcaataccgccgaaaaaaaaatcgatcccaatatccacgcgaatctcctcgccgccgcgacaaaactcgacccgacttcaacgaacaaatcctccgcctacgaccgataacccgcgcgacgccccgacgacaccgacaatactatactccaaccccgcaaacgccgcgacaacgaatcccgaaatactcccgcgatccttacctaacgaaacccgtcccgtacgctcccgaaatcctaactaaaccgacgccgaacccaaaacgaccgcgaatcgccgactacgacgtttcccgataacgaaaacgcgaactcgcgaaacgcgaaaaacgctacccaaacccgactcgacaaaaatcaaaacccccaacgacgcgaacgaacccgaaccaacaaccgaaaaaaaactctaaacgaaaccgcgaccgtcctaacattttaaaaacgaaacaactaaacgctattcaaac

SEQ ID NO: 9599 - DNA, 653 bp, Artificial Sequence
  chemically treated genomic DNA (Homo sapiens) CpG-island No: 9599
gggaggtgaggtttagaatagcgagggtgtttgagtatagtattatattttttcggtttttgagtttcgagtttcgtagtggaattcgggtcgttgcgacgcggttttcgtgcggtttttatcgaggttgttgttttttgtcgcgcgggttcggtttttttcgtcgatcgaggcgcgtttcgggcgtagtgtcgtcgaggaggggatcggttttagtgtttacgcgggttttttcgtcgtcgcggtagggttcggttcgattttagcgagtagatttttcgtttgcggtcggtgattcgcgcgacgtttcggcggtatcgataatgttgtgttttagtttcgtaggcgtcgcggtagcgggtttcgggatgttttcgcggtttttatttggcgaggttcgtttcgtgcgttttcggggttttggttgggtcggcgtcgagtttagggcgatcgcggatcgtcggttacggcgtttttcggtgacgggggcgcgggttcgcggggcgcggggggcgttgtttaggttcggttcggtaggagttagagtttttagcggcgcgggcgagttcgggttagtagtcgagagggggttttgagcggagtcgcggtcgttttggtattttaaaggcgaggtagttggacgttgtttaagt

SEQ ID NO: 9600 - DNA, 653 bp, Artificial Sequence
  chemically treated genomic DNA (Homo sapiens) CpG-island No: 9600
acttaaacaacgtccaactacctcgcctttaaaataccaaaacgaccgcgactccgctcaaaaccccctctcgactactaacccgaactcgcccgcgccgctaaaaactctaactcctaccgaaccgaacctaaacaacgccccccgcgccccgcgaacccgcgcccccgtcaccgaaaaacgccgtaaccgacgatccgcgatcgccctaaactcgacgccgacccaaccaaaaccccgaaaacgcacgaaacgaacctcgccaaataaaaaccgcgaaaacatcccgaaacccgctaccgcgacgcctacgaaactaaaacacaacattatcgataccgccgaaacgtcgcgcgaatcaccgaccgcaaacgaaaaatctactcgctaaaatcgaaccgaaccctaccgcgacgacgaaaaaacccgcgtaaacactaaaaccgatcccctcctcgacgacactacgcccgaaacgcgcctcgatcgacgaaaaaaaccgaacccgcgcgacaaaaaacaacaacctcgataaaaaccgcacgaaaaccgcgtcgcaacgacccgaattccactacgaaactcgaaactcaaaaaccgaaaaaatataatactatactcaaacaccctcgctattctaaacctcacctccc

SEQ ID NO: 9601 - DNA, 719 bp, Artificial Sequence
  chemically treated genomic DNA (Homo sapiens) CpG-island No: 9601
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattgcgtgcgttatttatttttttgttcgtttatatttaacggtttttttgaggagtttattttttatcgtttttttgtcgagtaggcgttgga

SEQ ID NO: 9602 - DNA, 719 bp, Artificial Sequence
  chemically treated genomic DNA (Homo sapiens) CpG-island No: 9602
tccaacgcctactcgacaaaaaaacgataaaaaataaactcctcaaaaaaaccgttaaatataaacgaacaaaaaaataaataacgcacgcaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 9603 - DNA, 719 bp, Artificial Sequence
  chemically treated genomic DNA (Homo sapiens) CpG-island No: 9603
tttagcgtttgttcggtaagaaaacgatggaaaatgaattttttaaagaagtcgttgaatatggacgggtaaaaaagtggatagcgtacgtagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 9604 - DNA, 719 bp, Artificial Sequence
  chemically treated genomic DNA (Homo sapiens) CpG-island No: 9604
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactacgtacgctatccacttttttacccgtccatattcaacgacttctttaaaaaattcattttccatcgttttcttaccgaacaaacgctaaa

SEQ ID NO: 9605 - DNA, 935 bp, Artificial Sequence
  chemically treated genomic DNA (Homo sapiens) CpG-island No: 9605
cggcggttcggtcggaaggggtcgttgtttgtttagcgtagttatttcgtcgttgtagtcgtcgcggttcgtattttttacggtcgggttggtttagtttcgttaagttttaatagttttttttcgagcgagcgtcgggaacgagtattattagggttggagcggacggttttagaagagtttagttgttgcgcgcgtcggagaggtttttgggaaatttttacggtttagggattttcgaaagtagagcgaggagttttcgtacgcgttagtttgcgagtgagcgtttagttcggtatttgtttttttagcgtcgtcgtttttttatttttcggattcgcgtcgttcgcgcgttcgttcgtttttgcgatgaattcggttttaggtaattagacggacgtggcgggtttgtttttggttaatagtagcgaggcgttggagcgagtcgtgcgttgttgtatttaggcgttcgtggtgatcgacgacggtttcgcggagggaggttcggacgagcgtagtttgtatataatgcgcgtggtgtagatcgcggttatgtgcgtgtttttatttatcgtggttttcggtattttttttttcggttgtaatttgtttattaagttcgagggtatgattaattttttcgtgaaggatcggaggtcgtttaaggaggtggaggcggtggtcgtggggttttattgattcgttttttgttttcgcggtaatcgtttttacgtttgtttattttgttagttcggttgtgttttttattattagagattgggcgaagtaaatttgtcggagttaattatttttttcgatttcggtttttcggaaagaagcgatcggtttttttttcgttttttgaaagtttttatgtttggtagtcggaggagagcgtttagattttgaatttagtagaaagtggtaagaagagg

SEQ ID NO: 9606 - DNA, 935 bp, Artificial Sequence
  chemically treated genomic DNA (Homo sapiens) CpG-island No: 9606
cctcttcttaccactttctactaaattcaaaatctaaacgctctcctccgactaccaaacataaaaactttcaaaaaacgaaaaaaaaaccgatcgcttctttccgaaaaaccgaaatcgaaaaaaataattaactccgacaaatttacttcgcccaatctctaataataaaaaacacaaccgaactaacaaaataaacaaacgtaaaaacgattaccgcgaaaacaaaaaacgaatcaataaaaccccacgaccaccgcctccacctccttaaacgacctccgatccttcacgaaaaaattaatcataccctcgaacttaataaacaaattacaaccgaaaaaaaaaataccgaaaaccacgataaataaaaacacgcacataaccgcgatctacaccacgcgcattatatacaaactacgctcgtccgaacctccctccgcgaaaccgtcgtcgatcaccacgaacgcctaaatacaacaacgcacgactcgctccaacgcctcgctactattaaccaaaaacaaacccgccacgtccgtctaattacctaaaaccgaattcatcgcaaaaacgaacgaacgcgcgaacgacgcgaatccgaaaaataaaaaaacgacgacgctaaaaaaacaaataccgaactaaacgctcactcgcaaactaacgcgtacgaaaactcctcgctctactttcgaaaatccctaaaccgtaaaaatttcccaaaaacctctccgacgcgcgcaacaactaaactcttctaaaaccgtccgctccaaccctaataatactcgttcccgacgctcgctcgaaaaaaaactattaaaacttaacgaaactaaaccaacccgaccgtaaaaaatacgaaccgcgacgactacaacgacgaaataactacgctaaacaaacaacgaccccttccgaccgaaccgccg

SEQ ID NO: 9607 - DNA, 935 bp, Artificial Sequence
  chemically treated genomic DNA (Homo sapiens) CpG-island No: 9607
tttttttttgttattttttgttgagtttagagtttgggcgttttttttcgattgttaggtatgaggatttttagagggcgagggagaaatcggtcgttttttttcgaaaggtcgaagtcgagagaaataattgatttcgataggtttgtttcgtttagtttttgatagtgaggggtatagtcgggttagtaaagtgggtaggcgtgggagcggttgtcgcgggggtagagggcgggttagtagggttttacgattatcgtttttatttttttagacggttttcggttttttacgaggaagttgattatgttttcggatttgatgagtagattgtagtcgaggaagaagatgtcgaagattacggtgagtgagagtacgtatatgatcgcgatttgtattacgcgtattatgtataggttacgttcgttcgggttttttttcgcgaagtcgtcgtcggttattacggacgtttgggtgtagtagcgtacggttcgttttagcgtttcgttgttgttggttaggaataggttcgttacgttcgtttggttgtttagggtcggatttatcgtaggaacgggcgggcgcgcgagcggcgcgggttcgaggggtgggaaggcggcggcgttggaggaataggtgtcgggttgagcgtttattcgtagattagcgcgtgcgagggtttttcgttttgttttcgaaagtttttgggtcgtgggagttttttaggagttttttcgacgcgcgtagtagttaggtttttttaaagtcgttcgttttagttttggtggtgttcgttttcggcgttcgttcgagggggggttgttggaatttggcggggttggattagttcggtcgtgggaggtgcgggtcgcggcggttgtagcggcggggtggttgcgttgagtaaatagcggtttttttcggtcgagtcgtcg

SEQ ID NO: 9608 - DNA, 935 bp, Artificial Sequence
  chemically treated genomic DNA (Homo sapiens) CpG-island No: 9608
cgacgactcgaccgaaaaaaaccgctatttactcaacgcaaccaccccgccgctacaaccgccgcgacccgcacctcccacgaccgaactaatccaaccccgccaaattccaacaaccccccctcgaacgaacgccgaaaacgaacaccaccaaaactaaaacgaacgactttaaaaaaacctaactactacgcgcgtcgaaaaaactcctaaaaaactcccacgacccaaaaactttcgaaaacaaaacgaaaaaccctcgcacgcgctaatctacgaataaacgctcaacccgacacctattcctccaacgccgccgccttcccacccctcgaacccgcgccgctcgcgcgcccgcccgttcctacgataaatccgaccctaaacaaccaaacgaacgtaacgaacctattcctaaccaacaacaacgaaacgctaaaacgaaccgtacgctactacacccaaacgtccgtaataaccgacgacgacttcgcgaaaaaaaacccgaacgaacgtaacctatacataatacgcgtaatacaaatcgcgatcatatacgtactctcactcaccgtaatcttcgacatcttcttcctcgactacaatctactcatcaaatccgaaaacataatcaacttcctcgtaaaaaaccgaaaaccgtctaaaaaaataaaaacgataatcgtaaaaccctactaacccgccctctacccccgcgacaaccgctcccacgcctacccactttactaacccgactatacccctcactatcaaaaactaaacgaaacaaacctatcgaaatcaattatttctctcgacttcgacctttcgaaaaaaaacgaccgatttctccctcgccctctaaaaatcctcatacctaacaatcgaaaaaaaacgcccaaactctaaactcaacaaaaaataacaaaaaaaaa

SEQ ID NO: 9609 - DNA, 594 bp, Artificial Sequence
  chemically treated genomic DNA (Homo sapiens) CpG-island No: 9609
ttgcgatcgagtggtcgacgtttttagtgggagtgaggtttagtacgcgagttcggtttttttttttggagttaggtgggtgcgcgtttttaggtttattcggcggcgtaaggcgggagaagttaggtgtttttaataaatatggtcgttacgttagcgttaattcggttcgggagtcgcgttgtcgtttgggaatcgtaggtttggcgttattcggttcggaattacgtgatgtaggaggtgttcgaggcggcggggttcgcgcgggtggagtttttcggcgttcgagcggggtgggggttgttcggttgagattttcggcgggtttcggtttttgcgtgtatcgtttgcgtgttcgcgttcgcggttttggcgttgttggtgaggagtcggggagcgaggcggggaggttgggagcggggcgttttttttgaggttagagggggttgggtagggtcggttcggcgggaagggggtcggtcgcgcgttattagcgtttggtttttgagtcgcggcgttggcggtgggggtttttcggtttcggttttttttggtagggttcggttgtgtaggtggtcgggtagggtcgagggt

SEQ ID NO: 9610 - DNA, 594 bp, Artificial Sequence
  chemically treated genomic DNA (Homo sapiens) CpG-island No: 9610
accctcgaccctacccgaccacctacacaaccgaaccctaccaaaaaaaaccgaaaccgaaaaacccccaccgccaacgccgcgactcaaaaaccaaacgctaataacgcgcgaccgacccccttcccgccgaaccgaccctacccaaccccctctaacctcaaaaaaaacgccccgctcccaacctccccgcctcgctccccgactcctcaccaacaacgccaaaaccgcgaacgcgaacacgcaaacgatacacgcaaaaaccgaaacccgccgaaaatctcaaccgaacaacccccaccccgctcgaacgccgaaaaactccacccgcgcgaaccccgccgcctcgaacacctcctacatcacgtaattccgaaccgaataacgccaaacctacgattcccaaacgacaacgcgactcccgaaccgaattaacgctaacgtaacgaccatatttattaaaaacacctaacttctcccgccttacgccgccgaataaacctaaaaacgcgcacccacctaactccaaaaaaaaaaaccgaactcgcgtactaaacctcactcccactaaaaacgtcgaccactcgatcgcaa

SEQ ID NO: 9611 - DNA, 594 bp, Artificial Sequence
  chemically treated genomic DNA (Homo sapiens) CpG-island No: 9611
gttttcggttttgttcggttatttgtatagtcgggttttgttaggaggggtcggggtcgaaaagtttttatcgttagcgtcgcggtttagggattaggcgttgatagcgcgcggtcgatttttttttcgtcgggtcggttttgtttagttttttttggttttagaagaggcgtttcgtttttagttttttcgtttcgtttttcggttttttattagtagcgttagaatcgcgagcgcgagtacgtaggcggtgtacgtagaggtcgggattcgtcggaaattttaatcgggtagtttttatttcgttcgaacgtcgaggggttttattcgcgcgagtttcgtcgtttcgggtattttttgtattacgtggtttcgggtcgggtgacgttaaatttgcgatttttaagcggtagcgcggttttcgagtcgggttgacgttggcgtggcggttatgtttattgagggtatttggtttttttcgttttgcgtcgtcgggtgagtttgaaagcgcgtatttatttggttttaggaagagggatcgagttcgcgtgttgggttttatttttattgggggcgtcggttattcgatcgtaa

SEQ ID NO: 9612 - DNA, 594 bp, Artificial Sequence
  chemically treated genomic DNA (Homo sapiens) CpG-island No: 9612
ttacgatcgaataaccgacgcccccaataaaaataaaacccaacacgcgaactcgatccctcttcctaaaaccaaataaatacgcgctttcaaactcacccgacgacgcaaaacgaaaaaaaccaaataccctcaataaacataaccgccacgccaacgtcaacccgactcgaaaaccgcgctaccgcttaaaaatcgcaaatttaacgtcacccgacccgaaaccacgtaatacaaaaaatacccgaaacgacgaaactcgcgcgaataaaacccctcgacgttcgaacgaaataaaaactacccgattaaaatttccgacgaatcccgacctctacgtacaccgcctacgtactcgcgctcgcgattctaacgctactaataaaaaaccgaaaaacgaaacgaaaaaactaaaaacgaaacgcctcttctaaaaccaaaaaaaactaaacaaaaccgacccgacgaaaaaaaaatcgaccgcgcgctatcaacgcctaatccctaaaccgcgacgctaacgataaaaacttttcgaccccgacccctcctaacaaaacccgactatacaaataaccgaacaaaaccgaaaac

SEQ ID NO: 9613 - DNA, 529 bp, Artificial Sequence
  chemically treated genomic DNA (Homo sapiens) CpG-island No: 9613
ggcggtcggcggcggggttaggtttggggtttgtcggcgatttcgcgtttggttcgcgagtttaggtgttcggagttagggagggagcggggcgcggattcgggcggggagggtaggggttatcgggcggggtaggagtagcgatgggatacgttcgtttcgggggagtgtttcggtttggtcgtcgtagttttaagggtcgggcggcgtagggttttaaagtgcggggtcgttcggttgttagttcgggttcgaggtcgaggtcgggcgggatttagagcgggagtcggcgcgggatttgggattcggagcgggattcggagcgggatttaggagtcggcgcggggttatggcgaggcgcgggttagggtggcggacgtttttgttgttcgtgttgttggcgggcgcggttagggcggtttttattttcgtcggggatagatttgttatcggtttttgcggggggacgggttgcgtttttggggcgtaggtgggtatcggcggggaggtagttttggggggacgggag

SEQ ID NO: 9614 - DNA, 529 bp, Artificial Sequence
  chemically treated genomic DNA (Homo sapiens) CpG-island No: 9614
ctcccgtccccccaaaactacctccccgccgatacccacctacgccccaaaaacgcaacccgtccccccgcaaaaaccgataacaaatctatccccgacgaaaataaaaaccgccctaaccgcgcccgccaacaacacgaacaacaaaaacgtccgccaccctaacccgcgcctcgccataaccccgcgccgactcctaaatcccgctccgaatcccgctccgaatcccaaatcccgcgccgactcccgctctaaatcccgcccgacctcgacctcgaacccgaactaacaaccgaacgaccccgcactttaaaaccctacgccgcccgacccttaaaactacgacgaccaaaccgaaacactcccccgaaacgaacgtatcccatcgctactcctaccccgcccgataacccctaccctccccgcccgaatccgcgccccgctccctccctaactccgaacacctaaactcgcgaaccaaacgcgaaatcgccgacaaaccccaaacctaaccccgccgccgaccgcc

SEQ ID NO: 9615 - DNA, 529 bp, Artificial Sequence
  chemically treated genomic DNA (Homo sapiens) CpG-island No: 9615
ttttcgtttttttagggttgttttttcgtcggtgtttatttgcgttttagggacgtagttcgttttttcgtagaggtcggtagtaggtttgttttcggcggaagtagaggtcgttttggtcgcgttcgttagtagtacgagtagtagaagcgttcgttattttggttcgcgtttcgttatggtttcgcgtcggtttttgggtttcgtttcggatttcgtttcgagttttagatttcgcgtcggttttcgttttggatttcgttcggtttcggtttcgagttcgggttagtaatcgggcgatttcgtattttggggttttgcgtcgttcggtttttaaggttgcggcggttaggtcgggatattttttcggggcgggcgtgttttatcgttgtttttgtttcgttcggtgatttttgtttttttcgttcggattcgcgtttcgttttttttttggtttcgggtatttgaattcgcgggttaggcgcgaggtcgtcggtagattttaagtttgatttcgtcgtcggtcgtt

SEQ ID NO: 9616 - DNA, 529 bp, Artificial Sequence
  chemically treated genomic DNA (Homo sapiens) CpG-island No: 9616
aacgaccgacgacgaaatcaaacttaaaatctaccgacgacctcgcgcctaacccgcgaattcaaatacccgaaaccaaaaaaaaaacgaaacgcgaatccgaacgaaaaaaacaaaaatcaccgaacgaaacaaaaacaacgataaaacacgcccgccccgaaaaaatatcccgacctaaccgccgcaaccttaaaaaccgaacgacgcaaaaccccaaaatacgaaatcgcccgattactaacccgaactcgaaaccgaaaccgaacgaaatccaaaacgaaaaccgacgcgaaatctaaaactcgaaacgaaatccgaaacgaaacccaaaaaccgacgcgaaaccataacgaaacgcgaaccaaaataacgaacgcttctactactcgtactactaacgaacgcgaccaaaacgacctctacttccgccgaaaacaaacctactaccgacctctacgaaaaaacgaactacgtccctaaaacgcaaataaacaccgacgaaaaaacaaccctaaaaaaacgaaaa

SEQ ID NO: 9617 - DNA, 717 bp, Artificial Sequence
  chemically treated genomic DNA (Homo sapiens) CpG-island No: 9617
cgtcgcgggggtcgtagggtcggcgtcgggtttggtcggagcgagggggtattgggggtttcgggtcgtttcgcgttagagttttcggcgttttatttttattttaaggttttgtaggcgaggaggcggggatttcggcggtcgcgtcgcgggatttcgggcgggcgggggcggggcgggttgtgtttgaattatacggtgatcgcgcgggtcgtgcgcgcgtatatttttcgtacgttcgtagtttcgcgtcgcgcggttttttcgggagtggggtcggttcgtcggcggcggagacgaacgattttttttagggtgcgtttagtgtttcgttttatttggtcgtcgttagtttcgtcgttttattcggtcgcgttttcgtagtagttttcgtttatgatggcgttcggtacggttttcgttatgttttttcgcgagcgagcgcgcgtatgcgcgaggcggggataggcgggcgggcgtacgcgcggcgcgtttcggttcgggcgggaggcggggtttggaagaaggggcggggtttggaggaagggtagggtcgcgggttcggtattgggaataaaggggatcggcggaaggaacgtttttagtcgatttcggagcgatgttcgggtggattaggggtttagtttcggagagaggttttttattggattcgtgtatagttttttttttgcggcgtcggttttgcgagttttagtt

SEQ ID NO: 9618 - DNA, 717 bp, Artificial Sequence
  chemically treated genomic DNA (Homo sapiens) CpG-island No: 9618
aactaaaactcgcaaaaccgacgccgcaaaaaaaaaactatacacgaatccaataaaaaacctctctccgaaactaaacccctaatccacccgaacatcgctccgaaatcgactaaaaacgttccttccgccgatcccctttattcccaataccgaacccgcgaccctacccttcctccaaaccccgccccttcttccaaaccccgcctcccgcccgaaccgaaacgcgccgcgcgtacgcccgcccgcctatccccgcctcgcgcatacgcgcgctcgctcgcgaaaaaacataacgaaaaccgtaccgaacgccatcataaacgaaaactactacgaaaacgcgaccgaataaaacgacgaaactaacgacgaccaaataaaacgaaacactaaacgcaccctaaaaaaaatcgttcgtctccgccgccgacgaaccgaccccactcccgaaaaaaccgcgcgacgcgaaactacgaacgtacgaaaaatatacgcgcgcacgacccgcgcgatcaccgtataattcaaacacaacccgccccgcccccgcccgcccgaaatcccgcgacgcgaccgccgaaatccccgcctcctcgcctacaaaaccttaaaataaaaataaaacgccgaaaactctaacgcgaaacgacccgaaacccccaataccccctcgctccgaccaaacccgacgccgaccctacgacccccgcgacg

SEQ ID NO: 9619 - DNA, 717 bp, Artificial Sequence
  chemically treated genomic DNA (Homo sapiens) CpG-island No: 9619
aattggggttcgtagagtcggcgtcgtaggggaggggttgtgtacgaatttagtgggaaattttttttcggagttaagtttttggtttattcgggtatcgtttcgggatcgattgggggcgtttttttcgtcggttttttttgtttttagtgtcgagttcgcggttttgttttttttttaggtttcgtttttttttttaggtttcgtttttcgttcgggtcgaagcgcgtcgcgcgtgcgttcgttcgtttgttttcgtttcgcgtatgcgcgcgttcgttcgcgggagggtatggcgggggtcgtgtcgggcgttattatggacgaggattattacgggagcgcggtcgagtggggcgacgaggttgacggcggttaggtgaggcggggtattgggcgtattttagagagaatcgttcgttttcgtcgtcggcgggtcggttttattttcggagaggtcgcgcggcgcgaggttgcgggcgtgcggggggtgtgcgcgcgtacggttcgcgcggttatcgtgtggtttaagtatagttcgtttcgttttcgttcgttcggggtttcgcggcgcggtcgtcggggttttcgttttttcgtttgtaggattttggggtgggggtgaggcgtcggaggttttggcgcggggcggttcgaggtttttagtattttttcgtttcggttaggttcggcgtcggttttgcgattttcgcggcg

SEQ ID NO: 9620 - DNA, 717 bp, Artificial Sequence
  chemically treated genomic DNA (Homo sapiens) CpG-island No: 9620
cgccgcgaaaatcgcaaaaccgacgccgaacctaaccgaaacgaaaaaatactaaaaacctcgaaccgccccgcgccaaaacctccgacgcctcacccccaccccaaaatcctacaaacgaaaaaacgaaaaccccgacgaccgcgccgcgaaaccccgaacgaacgaaaacgaaacgaactatacttaaaccacacgataaccgcgcgaaccgtacgcgcgcacaccccccgcacgcccgcaacctcgcgccgcgcgacctctccgaaaataaaaccgacccgccgacgacgaaaacgaacgattctctctaaaatacgcccaataccccgcctcacctaaccgccgtcaacctcgtcgccccactcgaccgcgctcccgtaataatcctcgtccataataacgcccgacacgacccccgccataccctcccgcgaacgaacgcgcgcatacgcgaaacgaaaacaaacgaacgaacgcacgcgcgacgcgcttcgacccgaacgaaaaacgaaacctaaaaaaaaaaacgaaacctaaaaaaaaaacaaaaccgcgaactcgacactaaaaacaaaaaaaaccgacgaaaaaaacgcccccaatcgatcccgaaacgatacccgaataaaccaaaaacttaactccgaaaaaaaatttcccactaaattcgtacacaacccctcccctacgacgccgactctacgaaccccaatt

SEQ ID NO: 9621 - DNA, 553 bp, Artificial Sequence
  chemically treated genomic DNA (Homo sapiens) CpG-island No: 9621
  misc_feature (375)..(375): n is either a, c, g or t
aggagacgcgtgtcgagttgcgacggatagaaataggatgggagatgaaataaatgtcgggtcgcgcgtgtgaatttagtatagggaagggttggcgaatttatgcgcgagttatagatttgggagtgggggaatgggatacgacgagaatgattgcgtaaggcgttggggacgtttttcgaattgatgacgggggagtacggcggtagggaattgtatatgttacgagagttattatggcgtgtgtagtgatgtgggcgcgtgaggggagtggcgcgtgttttatggagatatggtgagtacgtgtgacgggatgatttatgacggcgatatagaggatgttatttggcgtgtcgtatacgagatttcgaggtnaggttggatcggcgatttatcgatgcgaggtgtttatgatcggacggtatagtgtaaggcggtcggtgatattttcgttttgcgttagcgcggatttttttagtcgcgtggtgaagatttgagtgggtttttttacgtgattaaaggagttatatttatattttttggtattggtttg

SEQ ID NO: 9622 - DNA, 553 bp, Artificial Sequence
  chemically treated genomic DNA (Homo sapiens) CpG-island No: 9622
  misc_feature (179)..(179): n is either a, c, g or t
caaaccaataccaaaaaatataaatataactcctttaatcacgtaaaaaaacccactcaaatcttcaccacgcgactaaaaaaatccgcgctaacgcaaaacgaaaatatcaccgaccgccttacactataccgtccgatcataaacacctcgcatcgataaatcgccgatccaacctnacctcgaaatctcgtatacgacacgccaaataacatcctctatatcgccgtcataaatcatcccgtcacacgtactcaccatatctccataaaacacgcgccactcccctcacgcgcccacatcactacacacgccataataactctcgtaacatatacaattccctaccgccgtactcccccgtcatcaattcgaaaaacgtccccaacgccttacgcaatcattctcgtcgtatcccattcccccactcccaaatctataactcgcgcataaattcgccaacccttccctatactaaattcacacgcgcgacccgacatttatttcatctcccatcctatttctatccgtcgcaactcgacacgcgtctcct

SEQ ID NO: 9623 - DNA, 553 bp, Artificial Sequence
  chemically treated genomic DNA (Homo sapiens) CpG-island No: 9623
  misc_feature (179)..(179): n is either a, c, g or t
taagttagtgttaggggatatgggtgtggtttttttaattacgtggggaagtttatttaggtttttattacgcggttggaaggattcgcgttggcgtaaggcgaggatattatcgatcgttttatattatatcgttcgattatggatatttcgtatcggtgagtcgtcgatttaatttngtttcggagtttcgtatacggtacgttagatagtattttttatgtcgtcgttatagattatttcgttatacgtatttattatgtttttatggaatacgcgttattttttttacgcgtttatattattatatacgttatgatgattttcgtaatatgtgtagttttttatcgtcgtgttttttcgttattaattcgaaaagcgtttttaacgttttgcgtaattattttcgtcgtattttatttttttatttttaggtttgtgattcgcgtatgggttcgttaatttttttttatgttgagtttatacgcgcgattcggtatttgttttattttttattttgtttttgttcgtcgtaattcgatacgcgtttttt

SEQ ID NO: 9624 - DNA, 553 bp, Artificial Sequence
  chemically treated genomic DNA (Homo sapiens) CpG-island No: 9624
  misc_feature (375)..(375): n is either a, c, g or t
aaaaaacgcgtatcgaattacgacgaacaaaaacaaaataaaaaataaaacaaataccgaatcgcgcgtataaactcaacataaaaaaaaattaacgaacccatacgcgaatcacaaacctaaaaataaaaaaataaaatacgacgaaaataattacgcaaaacgttaaaaacgcttttcgaattaataacgaaaaaacacgacgataaaaaactacacatattacgaaaatcatcataacgtatataataatataaacgcgtaaaaaaaataacgcgtattccataaaaacataataaatacgtataacgaaataatctataacgacgacataaaaaatactatctaacgtaccgtatacgaaactccgaaacnaaattaaatcgacgactcaccgatacgaaatatccataatcgaacgatataatataaaacgatcgataatatcctcgccttacgccaacgcgaatccttccaaccgcgtaataaaaacctaaataaacttccccacgtaattaaaaaaaccacacccatatcccctaacactaactta

SEQ ID NO: 9625 - DNA, 666 bp, Artificial Sequence
  chemically treated genomic DNA (Homo sapiens) CpG-island No: 9625
  misc_feature (603)..(603): n is either a, c, g or t
cgacgcgtttagaagtttttatcgtatttaatttagagtacgatcgttcgggaggagcgggtttatttagtttaggggagggattaggtcgattttcgcgtaatgagttttaggcggtcgcgtagcggtgtagtgggcgcggagttggtaattagcgacgattcgcggttgcggttttgcgggagttgtattatgcggttcggggcgagtcggttgatacgcgcgtttacggcgagtggagtcgggaatttagattttagacgtacggtcgaggatcggtagaattcgttggattggtagtttaggagcgggagggcggaggcggcgggcggggtcgttggaggtttgtaattttagcgtatttcggggaagatcgttcgtcggtgttcgtgtggtttcgcgtttttggggtggggttcgtttcgttatttcgtttcgtttgttttttggtttcggttcgtcgtcgttttcgatgaattttttcggtttttcgtcgagttcgtttgagcgcgtttttaatttggttttgggtttcgtcgttggtcgtacggagattgtgtcggtttcgttttttttcgttttttttatatttttattttttangcggggaggaagggttgtagttttacggtcgtcggaacgttttttcgatttagggagaattaa

SEQ ID NO: 9626 - DNA, 666 bp, Artificial Sequence
  chemically treated genomic DNA (Homo sapiens) CpG-island No: 9626
  misc_feature (64)..(64): n is either a, c, g or t
ttaattctccctaaatcgaaaaaacgttccgacgaccgtaaaactacaacccttcctccccgcntaaaaaataaaaatataaaaaaaacgaaaaaaaacgaaaccgacacaatctccgtacgaccaacgacgaaacccaaaaccaaattaaaaacgcgctcaaacgaactcgacgaaaaaccgaaaaaattcatcgaaaacgacgacgaaccgaaaccaaaaaacaaacgaaacgaaataacgaaacgaaccccaccccaaaaacgcgaaaccacacgaacaccgacgaacgatcttccccgaaatacgctaaaattacaaacctccaacgaccccgcccgccgcctccgccctcccgctcctaaactaccaatccaacgaattctaccgatcctcgaccgtacgtctaaaatctaaattcccgactccactcgccgtaaacgcgcgtatcaaccgactcgccccgaaccgcataatacaactcccgcaaaaccgcaaccgcgaatcgtcgctaattaccaactccgcgcccactacaccgctacgcgaccgcctaaaactcattacgcgaaaatcgacctaatccctcccctaaactaaataaacccgctcctcccgaacgatcgtactctaaattaaatacgataaaaacttctaaacgcgtcg

SEQ ID NO: 9627 - DNA, 666 bp, Artificial Sequence
  chemically treated genomic DNA (Homo sapiens) CpG-island No: 9627
  misc_feature (64)..(64): n is either a, c, g or t
ttgattttttttgggtcgggagggcgtttcggcggtcgtggggttgtagtttttttttttcgtntggaaggtgagggtgtgggaggagcgggagggggcgaggtcgatataattttcgtgcgattagcggcggagtttagagttaggttaggagcgcgtttaggcgagttcggcggaaggtcgagaaggtttatcggaggcggcggcgagtcgagattaggagatagacggggcggggtgacgaggcgggttttattttaggagcgcggggttatacggatatcggcgggcggtttttttcgggatgcgttgggattgtaggtttttagcggtttcgttcgtcgttttcgttttttcgtttttgagttgttaatttagcgggttttgtcggttttcggtcgtgcgtttggggtttggattttcggttttattcgtcgtgagcgcgcgtgttagtcgattcgtttcggatcgtatggtgtagttttcgtagggtcgtagtcgcgggtcgtcgttgattgttagtttcgcgtttattgtatcgttgcgcggtcgtttagggtttattgcgcggaagtcggtttggttttttttttgggttggatgggttcgtttttttcgagcggtcgtgttttgagttgaatgcgatagaggtttttgggcgcgtcg

SEQ ID NO: 9628 - DNA, 666 bp, Artificial Sequence
  chemically treated genomic DNA (Homo sapiens) CpG-island No: 9628
  misc_feature (603)..(603): n is either a, c, g or t
cgacgcgcccaaaaacctctatcgcattcaactcaaaacacgaccgctcgaaaaaaacgaacccatccaacccaaaaaaaaaaccaaaccgacttccgcgcaataaaccctaaacgaccgcgcaacgatacaataaacgcgaaactaacaatcaacgacgacccgcgactacgaccctacgaaaactacaccatacgatccgaaacgaatcgactaacacgcgcgctcacgacgaataaaaccgaaaatccaaaccccaaacgcacgaccgaaaaccgacaaaacccgctaaattaacaactcaaaaacgaaaaaacgaaaacgacgaacgaaaccgctaaaaacctacaatcccaacgcatcccgaaaaaaaccgcccgccgatatccgtataaccccgcgctcctaaaataaaacccgcctcgtcaccccgccccgtctatctcctaatctcgactcgccgccgcctccgataaaccttctcgaccttccgccgaactcgcctaaacgcgctcctaacctaactctaaactccgccgctaatcgcacgaaaattatatcgacctcgccccctcccgctcctcccacaccctcaccttccanacgaaaaaaaaaaactacaaccccacgaccgccgaaacgccctcccgacccaaaaaaaatcaa

SEQ ID NO: 9629 - DNA, 550 bp, Artificial Sequence
  chemically treated genomic DNA (Homo sapiens) CpG-island No: 9629
  misc_feature (300)..(301): n is either a, c, g or t
  misc_feature (305)..(305): n is either a, c, g or t
tttttcgtttgtcgcgtcgcgttttcgtttgttacgcgttagtagtagttttacgtcgttatcgcgcgtttatggttatgtttttcgtggttacgtattagtttttttagcgtttttgttgcgtgtttcgtcgtttgcgatcgagtttttattacgtttttgtttttttttatcgtattcgtagtatcgtttttgtttttcgatttagtttttcggttttcgttacgcgagttttttcgtatcggttttcgatcgtcgcgtttcgtcgatgatagagtatggttgagatatgatattttnntgangttacgtcgttttcgtatttttcgtttacggattcgtttttttttttttagacgtcgattcgtgcgttttgttttcgatcgtttttacgtatgtttttttttcgttttcgacgttttatttattatttcgatcgcgtttatttcgttttatattttgttttttcgttcggtacgacgattattatatgtattgagttagttagtcgtagtcgttagtttattaggaacgttgagtataacgattt

SEQ ID NO: 9630 - DNA, 550 bp, Artificial Sequence
  chemically treated genomic DNA (Homo sapiens) CpG-island No: 9630
  misc_feature (246)..(246): n is either a, c, g or t
  misc_feature (250)..(251): n is either a, c, g or t
aaatcgttatactcaacgttcctaataaactaacgactacgactaactaactcaatacatataataatcgtcgtaccgaacgaaaaaacaaaatataaaacgaaataaacgcgatcgaaataataaataaaacgtcgaaaacgaaaaaaaaacatacgtaaaaacgatcgaaaacaaaacgcacgaatcgacgtctaaaaaaaaaaaaacgaatccgtaaacgaaaaatacgaaaacgacgtaacntcannaaaatatcatatctcaaccatactctatcatcgacgaaacgcgacgatcgaaaaccgatacgaaaaaactcgcgtaacgaaaaccgaaaaactaaatcgaaaaacaaaaacgatactacgaatacgataaaaaaaaacaaaaacgtaataaaaactcgatcgcaaacgacgaaacacgcaacaaaaacgctaaaaaaactaatacgtaaccacgaaaaacataaccataaacgcgcgataacgacgtaaaactactactaacgcgtaacaaacgaaaacgcgacgcgacaaacgaaaaa

SEQ ID NO: 9631 - DNA, 550 bp, Artificial Sequence
  chemically treated genomic DNA (Homo sapiens) CpG-island No: 9631
  misc_feature (246)..(246): n is either a, c, g or t
  misc_feature (250)..(251): n is either a, c, g or t
gagtcgttatatttaacgtttttagtggattgacgattacgattaattaatttaatgtatgtaatagtcgtcgtgtcgagcggagggatagggtgtggggcgaggtagacgcggtcgaggtggtgagtggggcgtcggagacgaggagggggtatgcgtgggaacgatcgggagtagggcgtacgagtcggcgtttgagggagggagggcggattcgtggacgggaggtacgggagcggcgtggtnttannagaatgttatattttaattatattttattatcggcggagcgcgacggtcgagagtcggtgcgggagggttcgcgtgacgggagtcgagaggttgagtcggggggtaggggcggtattgcgagtgcgatgagagaaggtaggagcgtggtgagggttcggtcgtaggcggcggaatacgtaataggagcgttgaggaggttggtgcgtggttacggggagtatggttatgggcgcgcggtgacggcgtgaggttgttgttagcgcgtgataggcgaggacgcggcgcggtaggcgaggag

SEQ ID NO: 9632 - DNA, 550 bp, Artificial Sequence
  chemically treated genomic DNA (Homo sapiens) CpG-island No: 9632
  misc_feature (300)..(301): n is either a, c, g or t
  misc_feature (305)..(305): n is either a, c, g or t
ctcctcgcctaccgcgccgcgtcctcgcctatcacgcgctaacaacaacctcacgccgtcaccgcgcgcccataaccatactccccgtaaccacgcaccaacctcctcaacgctcctattacgtattccgccgcctacgaccgaaccctcaccacgctcctaccttctctcatcgcactcgcaataccgcccctaccccccgactcaacctctcgactcccgtcacgcgaaccctcccgcaccgactctcgaccgtcgcgctccgccgataataaaatataattaaaatataacattctnntaanaccacgccgctcccgtacctcccgtccacgaatccgccctccctccctcaaacgccgactcgtacgccctactcccgatcgttcccacgcataccccctcctcgtctccgacgccccactcaccacctcgaccgcgtctacctcgccccacaccctatccctccgctcgacacgacgactattacatacattaaattaattaatcgtaatcgtcaatccactaaaaacgttaaatataacgactc

SEQ ID NO: 9633 - DNA, 729 bp, Artificial Sequence
  chemically treated genomic DNA (Homo sapiens) CpG-island No: 9633
cggtagtcgcggtgttatgcgcggtggcgcgtttttttcggtttatttaggtagcggcgtcgggattgttttgcgttgcgggtcggtacggagagtttgcgagcgcggggagttggtgtttttgcgggttgcgtggcgtttttcgggttgtgtgggcgcgggtgtgcgtttagcgttggtcgcgtaggcgtgcgtggttcggggtagtttttgtttttcggtgtttgggggtgggcgtgtttgcgtgtcgggtatttgtatcgggcgtattttttttgattttagtggttcggtgtttttttcgtttcgaggtgaggagcgtttagcggttggagttcgatttgtttttttttttcgggtataatttggtaggcgcggcgtttcgcgtttcgcggtttttagagttttagttcggcgtttttttgtagcgtttttttattaggtttggaggagtcggtttttttttcgttgttcgcgtcgcgggcggaggcgtcgtcgtttgggtcggaggtgggcgttgttcgtttaggaaaggagcggagttgggtcggttcggttgcggggaaattttggtttacgtcggggtcgtttttgtttatagttattgttttcggtcgggtttcgcggtaggcgttataggtgcgaggcgagggcgtttacgatagtaattttttttgtttttttttttttttgttagttttttttttttaattttttagttcgggaatt

SEQ ID NO: 9634 - DNA, 729 bp, Artificial Sequence
  chemically treated genomic DNA (Homo sapiens) CpG-island No: 9634
aattcccgaactaaaaaattaaaaaaaaaaaactaacaaaaaaaaaaaaaaacaaaaaaaattactatcgtaaacgccctcgcctcgcacctataacgcctaccgcgaaacccgaccgaaaacaataactataaacaaaaacgaccccgacgtaaaccaaaatttccccgcaaccgaaccgacccaactccgctcctttcctaaacgaacaacgcccacctccgacccaaacgacgacgcctccgcccgcgacgcgaacaacgaaaaaaaaaccgactcctccaaacctaataaaaaaacgctacaaaaaaacgccgaactaaaactctaaaaaccgcgaaacgcgaaacgccgcgcctaccaaattatacccgaaaaaaaaaaacaaatcgaactccaaccgctaaacgctcctcacctcgaaacgaaaaaaacaccgaaccactaaaatcaaaaaaaatacgcccgatacaaatacccgacacgcaaacacgcccacccccaaacaccgaaaaacaaaaactaccccgaaccacgcacgcctacgcgaccaacgctaaacgcacacccgcgcccacacaacccgaaaaacgccacgcaacccgcaaaaacaccaactccccgcgctcgcaaactctccgtaccgacccgcaacgcaaaacaatcccgacgccgctacctaaataaaccgaaaaaaacgcgccaccgcgcataacaccgcgactaccg

SEQ ID NO: 9635 - DNA, 729 bp, Artificial Sequence
  chemically treated genomic DNA (Homo sapiens) CpG-island No: 9635
ggttttcgagttgaaaggttgaaggggagggattagtagagaggagggaaagtagagggggttgttgtcgtgaacgttttcgtttcgtatttgtggcgtttgtcgcggggttcgatcggaggtagtggttgtggataagggcggtttcggcgtaggttaggattttttcgtagtcggatcggtttagtttcgttttttttttgggcgaatagcgtttattttcggtttaggcggcggcgttttcgttcgcggcgcggatagcgagagagaaatcggtttttttaaatttggtggaggagcgttgtagagaagcgtcgggttgaggttttgggggtcgcggggcgcgaaacgtcgcgtttattaggttatgttcgggagaaggagataggtcgggttttagtcgttgggcgttttttatttcgaagcgaggaaaatatcgggttattgagattaggggaggtgcgttcgatataggtattcggtacgtagatacgtttatttttaaatatcgagaaataaagattgtttcgagttacgtacgtttgcgcggttagcgttgggcgtatattcgcgtttatatagttcgaagggcgttacgtaattcgtaagaatattagtttttcgcgttcgtaggtttttcgtgtcggttcgtagcgtagagtagtttcggcgtcgttgtttaggtgggtcggggaaggcgcgttatcgcgtatggtatcgcggttgtcg

SEQ ID NO: 9636 - DNA, 729 bp, Artificial Sequence
  chemically treated genomic DNA (Homo sapiens) CpG-island No: 9636
cgacaaccgcgataccatacgcgataacgcgccttccccgacccacctaaacaacgacgccgaaactactctacgctacgaaccgacacgaaaaacctacgaacgcgaaaaactaatattcttacgaattacgtaacgcccttcgaactatataaacgcgaatatacgcccaacgctaaccgcgcaaacgtacgtaactcgaaacaatctttatttctcgatatttaaaaataaacgtatctacgtaccgaatacctatatcgaacgcacctcccctaatctcaataacccgatattttcctcgcttcgaaataaaaaacgcccaacgactaaaacccgacctatctccttctcccgaacataacctaataaacgcgacgtttcgcgccccgcgacccccaaaacctcaacccgacgcttctctacaacgctcctccaccaaatttaaaaaaaccgatttctctctcgctatccgcgccgcgaacgaaaacgccgccgcctaaaccgaaaataaacgctattcgcccaaaaaaaaaacgaaactaaaccgatccgactacgaaaaaatcctaacctacgccgaaaccgcccttatccacaaccactacctccgatcgaaccccgcgacaaacgccacaaatacgaaacgaaaacgttcacgacaacaaccccctctactttccctcctctctactaatccctccccttcaacctttcaactcgaaaacc

SEQ ID NO: 9637 - DNA, 797 bp, Artificial Sequence
  chemically treated genomic DNA (Homo sapiens) CpG-island No: 9637
ggttttagagcgtaatttatgttttcgaatgtttagagttttttagtttacggggaacggtgttttttttacgttcgagatcgcgtacgtaggtttcgtcgcgggttcgaattttgagggcggaattttttcgtcgcgtttcgtttcgggggaaggcgtttggtttcgggacgtcgagggcgcgtgtttataaataagggggcgggacgcggggagggggcgcgaggggcgtcggttcgggtttacgggatatttatttcgttcgttgtcgtttatttcgtttcggttagtttttttcggtttcggttttagggtttgttgtttttcggtcgtcgtcgtcgtcgtcgcgggatttagttagggtcgtcgtcgtcgttatcgggacgcgattttataatgtatttttttttttatttttatcggtttatattgtttcgcggtatgtcgcgtagggaggaagggcggacgagtggtttaagatatgacgttcgggtcgagggcggggaagtcggagaggcgttatggacgcgtaggggggatagcgggggattcgggggtcgcgacgaagtcgcggaggcgagtatgtcgcggtttgtggtagcgcgatttaagagtcgcgttcggttcggtattgagatgatagtatcggcgcggtcgttatttttgtatagacgggaagtttcgatttgaagttttcgttttttcgtcgaagttgaaacggataatgcggttttatttaaattttcgtttttttacggattattttattagttttgtgtaattcgtttttaaggtat

SEQ ID NO: 9638 - DNA, 797 bp, Artificial Sequence
  chemically treated genomic DNA (Homo sapiens) CpG-island No: 9638
ataccttaaaaacgaattacacaaaactaataaaataatccgtaaaaaaacgaaaatttaaataaaaccgcattatccgtttcaacttcgacgaaaaaacgaaaacttcaaatcgaaacttcccgtctatacaaaaataacgaccgcgccgatactatcatctcaataccgaaccgaacgcgactcttaaatcgcgctaccacaaaccgcgacatactcgcctccgcgacttcgtcgcgacccccgaatcccccgctatcccccctacgcgtccataacgcctctccgacttccccgccctcgacccgaacgtcatatcttaaaccactcgtccgcccttcctccctacgcgacataccgcgaaacaatataaaccgataaaaataaaaaaaaaaatacattataaaatcgcgtcccgataacgacgacgacgaccctaactaaatcccgcgacgacgacgacgacgaccgaaaaacaacaaaccctaaaaccgaaaccgaaaaaaactaaccgaaacgaaataaacgacaacgaacgaaataaatatcccgtaaacccgaaccgacgcccctcgcgccccctccccgcgtcccgcccccttatttataaacacgcgccctcgacgtcccgaaaccaaacgccttcccccgaaacgaaacgcgacgaaaaaattccgccctcaaaattcgaacccgcgacgaaacctacgtacgcgatctcgaacgtaaaaaaaacaccgttccccgtaaactaaaaaactctaaacattcgaaaacataaattacgctctaaaacc

SEQ ID NO: 9639 - DNA, 797 bp, Artificial Sequence
  chemically treated genomic DNA (Homo sapiens) CpG-island No: 9639
atgttttaaggacgaattgtataaagttggtgaggtaattcgtaggagaacggaggtttgggtggaatcgtattattcgttttaatttcggcgaaggggcgggaattttaagtcgagatttttcgtttgtataaagatggcggtcgcgtcggtgttgttattttagtgtcgagtcgagcgcggtttttgagtcgcgttgttataggtcgcggtatgttcgttttcgcggtttcgtcgcggttttcgagtttttcgttgttttttttgcgcgtttatggcgttttttcggttttttcgttttcggttcgggcgttatgttttgggttattcgttcgttttttttttttgcgcggtatgtcgcggggtagtgtgggtcggtgggggtgagaaaagagatgtattgtggggtcgcgtttcggtggcggcggcggcggttttggttggatttcgcggcggcggcggcggcggtcggagagtagtaagttttggagtcggagtcgggggaggttggtcgggacgggatgggcgatagcgggcggggtgagtgtttcgtgggttcgggtcggcgtttttcgcgtttttttttcgcgtttcgtttttttgtttgtaaatacgcgttttcgacgtttcgaggttaagcgttttttttcggggcggggcgcggcgggggagtttcgtttttagggttcgggttcgcggcggggtttgcgtgcgcggtttcgggcgtgggaaggatatcgtttttcgtgggttggaggattttgggtattcgaaggtatgagttacgttttgggatt

SEQ ID NO: 9640 - DNA, 797 bp, Artificial Sequence
  chemically treated genomic DNA (Homo sapiens) CpG-island No: 9640
aatcccaaaacgtaactcataccttcgaatacccaaaatcctccaacccacgaaaaacgatatccttcccacgcccgaaaccgcgcacgcaaaccccgccgcgaacccgaaccctaaaaacgaaactcccccgccgcgccccgccccgaaaaaaaacgcttaacctcgaaacgtcgaaaacgcgtatttacaaacaaaaaaacgaaacgcgaaaaaaaaacgcgaaaaacgccgacccgaacccacgaaacactcaccccgcccgctatcgcccatcccgtcccgaccaacctcccccgactccgactccaaaacttactactctccgaccgccgccgccgccgccgcgaaatccaaccaaaaccgccgccgccgccaccgaaacgcgaccccacaatacatctcttttctcacccccaccgacccacactaccccgcgacataccgcgcaaaaaaaaaaaacgaacgaataacccaaaacataacgcccgaaccgaaaacgaaaaaaccgaaaaaacgccataaacgcgcaaaaaaaacaacgaaaaactcgaaaaccgcgacgaaaccgcgaaaacgaacataccgcgacctataacaacgcgactcaaaaaccgcgctcgactcgacactaaaataacaacaccgacgcgaccgccatctttatacaaacgaaaaatctcgacttaaaattcccgccccttcgccgaaattaaaacgaataatacgattccacccaaacctccgttctcctacgaattacctcaccaactttatacaattcgtccttaaaacat

SEQ ID NO: 9641 - DNA, 909 bp, Artificial Sequence
  chemically treated genomic DNA (Homo sapiens) CpG-island No: 9641
aaatcgaagattatttatgttgttgtttaggtcgtagacgttttgtagtagtagtgttttacgttcgttcgcgtatcggtgatttattttgttaattagtaaggtaatttcgttagtttagtcgggtttttaacgataggagtacgattatgcgtattcgtggttaggatttaacgttgatcgagatgcgtcgcgtgcggatgttggagatggcggacgcgatggatatgttttgttaagggttggtttgcgtatttatagatttgcgtaagaattgattggtttcgatttttggagtggtgaattacgtagcgaggtgacgtcggtttttatttacgtagacgtggtttagttgtatgtatcgagacgttacgtcgtgaggtagataaagtatagggcggcgtttataatttatggtaatttcgtttatgtgttcgtcgaagcggtataaatcgtcgtgacgattagcggtttaatgatcgaagttaggttggtaagaatcgcgagcgatttttgaagttgtttttgatggtcgttatttatttgtttggatagtatggtttgtaacgcgggatttcgatgcgtcggaagcgagaagaattataatggggaaggttatttagtttcgcgtcgtaacgttagtaagacgtagtttagcgcgtcgggcgttatgtcggcgataatggtttgtttttcgtcgaaacgtttggtggcggaattaatgaataaagtttgaattacggcgtgtaagaatttcgaataatcgtagcgatacggcgattatcgtcgcgttttaacgaaagcggttttcgtcggaaattatttaaaacgttggcggattttttgttaagaatttggtggtgaaaaagaacggtttaagttacggcgaaatagttttgtcgcgcgtaa

SEQ ID NO: 9642 - DNA, 909 bp, Artificial Sequence
  chemically treated genomic DNA (Homo sapiens) CpG-island No: 9642
ttacgcgcgacaaaactatttcgccgtaacttaaaccgttctttttcaccaccaaattcttaacaaaaaatccgccaacgttttaaataatttccgacgaaaaccgctttcgttaaaacgcgacgataatcgccgtatcgctacgattattcgaaattcttacacgccgtaattcaaactttattcattaattccgccaccaaacgtttcgacgaaaaacaaaccattatcgccgacataacgcccgacgcgctaaactacgtcttactaacgttacgacgcgaaactaaataaccttccccattataattcttctcgcttccgacgcatcgaaatcccgcgttacaaaccatactatccaaacaaataaataacgaccatcaaaaacaacttcaaaaatcgctcgcgattcttaccaacctaacttcgatcattaaaccgctaatcgtcacgacgatttataccgcttcgacgaacacataaacgaaattaccataaattataaacgccgccctatactttatctacctcacgacgtaacgtctcgatacatacaactaaaccacgtctacgtaaataaaaaccgacgtcacctcgctacgtaattcaccactccaaaaatcgaaaccaatcaattcttacgcaaatctataaatacgcaaaccaacccttaacaaaacatatccatcgcgtccgccatctccaacatccgcacgcgacgcatctcgatcaacgttaaatcctaaccacgaatacgcataatcgtactcctatcgttaaaaacccgactaaactaacgaaattaccttactaattaacaaaataaatcaccgatacgcgaacgaacgtaaaacactactactacaaaacgtctacgacctaaacaacaacataaataatcttcgattt

SEQ ID NO: 9643 - DNA, 909 bp, Artificial Sequence
  chemically treated genomic DNA (Homo sapiens) CpG-island No: 9643
ttgcgcgcggtaggattatttcgtcgtaatttagatcgtttttttttattattaaatttttggtaaagggttcgttagcgttttgggtaattttcggcgaggatcgttttcgttggagcgcgacgatgatcgtcgtgtcgttgcggttattcggaatttttgtacgtcgtggtttaagttttgtttattggtttcgttattaaacgtttcggcgagaagtaggttattatcgtcggtatggcgttcgacgcgttgggttacgttttgttggcgttgcgacgcgaggttggatggttttttttattatgatttttttcgttttcggcgtatcgggatttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggacggggttgttatgaattgtaggcgtcgttttatattttgtttgttttacggcgtagcgtttcggtgtatgtagttgggttacgtttacgtgaatgaaggtcggcgttatttcgttacgtgatttattattttaagaatcggagttaattaatttttgcgtagatttgtgaatgcgtaaattaatttttggtagaatatatttatcgcgttcgttatttttagtattcgtacgcggcgtatttcggttagcgttgggttttggttacgggtgcgtatgatcgtgtttttgtcgttgaggattcggttaggttggcggggttgttttattggttagtagaatgaattatcgatacgcgagcgaacgtgaagtattgttgttgtaaaacgtttgcgatttgagtaataatatgaatggttttcggttt

SEQ ID NO: 9644 - DNA, 909 bp, Artificial Sequence
  chemically treated genomic DNA (Homo sapiens) CpG-island No: 9644
aaaccgaaaaccattcatattattactcaaatcgcaaacgttttacaacaacaatacttcacgttcgctcgcgtatcgataattcattctactaaccaataaaacaaccccgccaacctaaccgaatcctcaacgacaaaaacacgatcatacgcacccgtaaccaaaacccaacgctaaccgaaatacgccgcgtacgaatactaaaaataacgaacgcgataaatatattctaccaaaaattaatttacgcattcacaaatctacgcaaaaattaattaactccgattcttaaaataataaatcacgtaacgaaataacgccgaccttcattcacgtaaacgtaacccaactacatacaccgaaacgctacgccgtaaaacaaacaaaatataaaacgacgcctacaattcataacaaccccgtccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaaatcccgatacgccgaaaacgaaaaaaatcataataaaaaaaaccatccaacctcgcgtcgcaacgccaacaaaacgtaacccaacgcgtcgaacgccataccgacgataataacctacttctcgccgaaacgtttaataacgaaaccaataaacaaaacttaaaccacgacgtacaaaaattccgaataaccgcaacgacacgacgatcatcgtcgcgctccaacgaaaacgatcctcgccgaaaattacccaaaacgctaacgaaccctttaccaaaaatttaataataaaaaaaaacgatctaaattacgacgaaataatcctaccgcgcgcaa

SEQ ID NO: 9645 - DNA, 1048 bp, Artificial Sequence
  chemically treated genomic DNA (Homo sapiens) CpG-island No: 9645
cgcgcgcgtcgtggcgtgtttttattttggttataacgtttcggtggtggatattaacgtgcgtcgcgtttatgttcgcgtcgaggagggtcgttttttcgcgtcgttttttataaaacgcgagttggtataggtggaagtattgttttcggaggagaatgggttacgttttttcgtcgcgtttatggagttcggtgtattggtgtgtatagttaagaatttcgattgcgtcgtttgttttattaaagtttcgtgcgcgtggtagttcgcgggttgttcggaatttagcgaagaggaggtagcgcgggtaaagaagcgcgtgtagaagtttatcggtacggatcgttaggtgcgcgggttgtttttcgacgtttttcgcggtttattttattagttttttaagtcgatttggatgttgtgtgttcggacgcgacgtagcgttcgcgggcgtagttttcgttaatcgaggatggtttaatggatattaacgagtagggtttgttttatttgtcgtattaggtacgtgcgagaaatcgatgaggtgatcgaaggtttaatcgcggttagttagtaggcgggcgaggatgagttcgtaataaatggtcgttacggttatcgaggtagtggcgaagttgtttaacgtttggtttatgttgttaatattaaggtgataagtcgtgcggaatatggaggttttcgggattatgatgacggacgtcggtatcgtcgtggtgatgcgcggtagatgcgcgcgtttggaggttatcgcgtttaagagttttacgatgagatcgtcggcgaacgcgtcgacgtagtttgtggtttcgatttcgataaggataaggcgaacgaggttggttatcgtttttatcgcggtcgttacgagtattattcggcgcgaggaattaaagaggaacgcgaattcggaaacgtttaagaagttggtcgtcgcggcggcgaggtattatatcggcgtatagtcggggatgttcggtttcggagttagtttcgtggtataagggtatcgagttcgaattcgtgattatgt

SEQ ID NO: 9646 - DNA, 1048 bp, Artificial Sequence
  chemically treated genomic DNA (Homo sapiens) CpG-island No: 9646
acataatcacgaattcgaactcgatacccttataccacgaaactaactccgaaaccgaacatccccgactatacgccgatataatacctcgccgccgcgacgaccaacttcttaaacgtttccgaattcgcgttcctctttaattcctcgcgccgaataatactcgtaacgaccgcgataaaaacgataaccaacctcgttcgccttatccttatcgaaatcgaaaccacaaactacgtcgacgcgttcgccgacgatctcatcgtaaaactcttaaacgcgataacctccaaacgcgcgcatctaccgcgcatcaccacgacgataccgacgtccgtcatcataatcccgaaaacctccatattccgcacgacttatcaccttaatattaacaacataaaccaaacgttaaacaacttcgccactacctcgataaccgtaacgaccatttattacgaactcatcctcgcccgcctactaactaaccgcgattaaaccttcgatcacctcatcgatttctcgcacgtacctaatacgacaaataaaacaaaccctactcgttaatatccattaaaccatcctcgattaacgaaaactacgcccgcgaacgctacgtcgcgtccgaacacacaacatccaaatcgacttaaaaaactaataaaataaaccgcgaaaaacgtcgaaaaacaacccgcgcacctaacgatccgtaccgataaacttctacacgcgcttctttacccgcgctacctcctcttcgctaaattccgaacaacccgcgaactaccacgcgcacgaaactttaataaaacaaacgacgcaatcgaaattcttaactatacacaccaatacaccgaactccataaacgcgacgaaaaaacgtaacccattctcctccgaaaacaatacttccacctataccaactcgcgttttataaaaaacgacgcgaaaaaacgaccctcctcgacgcgaacataaacgcgacgcacgttaatatccaccaccgaaacgttataaccaaaataaaaacacgccacgacgcgcgcg

SEQ ID NO: 9647 - DNA, 1048 bp, Artificial Sequence
  chemically treated genomic DNA (Homo sapiens) CpG-island No: 9647
atatgattacgaattcgagttcggtatttttgtattacggagttaatttcggaatcgggtattttcgattatgcgtcggtgtggtatttcgtcgtcgcggcggttagttttttgggcgttttcggattcgcgtttttttttaatttttcgcgtcggatggtgttcgtggcggtcgcggtgggaacggtggttaatttcgttcgttttatttttatcggggtcggggttataagttacgtcggcgcgttcgtcggcggttttatcgtggggtttttgggcgcggtggtttttaagcgcgcgtatttatcgcgtattattacgacggtgtcggcgttcgttattatgatttcgggaatttttatgtttcgtacggtttattattttaatgttggtaatatggattaggcgttgaataatttcgttattgtttcgatggtcgtggcggttatttgttgcgggtttattttcgttcgtttgttgattgatcgcgattggattttcggttattttatcgatttttcgtacgtgtttagtgcggtaggtgaaataggttttgttcgttgatgtttattaagttattttcgattagcgagggttgcgttcgcgagcgttgcgtcgcgttcgggtatatagtatttaggtcggtttgggaaattggtggggtgagtcgcggaagacgtcgagaaatagttcgcgtatttggcggttcgtgtcggtgaatttttgtacgcgtttttttgttcgcgttgtttttttttcgttgggtttcggatagttcgcgagttgttacgcgtacgaggttttgatggggtaggcggcgtagtcggggtttttggttgtgtatattagtgtatcgagttttatgagcgcggcggaaaaacgtggtttattttttttcggaagtagtgtttttatttgtgttagttcgcgttttgtgggaggcggcgcgaggaagcggtttttttcggcgcgggtatagacgcggcgtacgttggtatttattatcgggacgttgtagttaaaatggaagtacgttacggcgcgcgcg

SEQ ID NO: 9648 - DNA, 1048 bp, Artificial Sequence
  chemically treated genomic DNA (Homo sapiens) CpG-island No: 9648
cgcgcgcgccgtaacgtacttccattttaactacaacgtcccgataataaataccaacgtacgccgcgtctatacccgcgccgaaaaaaaccgcttcctcgcgccgcctcccacaaaacgcgaactaacacaaataaaaacactacttccgaaaaaaaataaaccacgtttttccgccgcgctcataaaactcgatacactaatatacacaaccaaaaaccccgactacgccgcctaccccatcaaaacctcgtacgcgtaacaactcgcgaactatccgaaacccaacgaaaaaaaaacaacgcgaacaaaaaaacgcgtacaaaaattcaccgacacgaaccgccaaatacgcgaactatttctcgacgtcttccgcgactcaccccaccaatttcccaaaccgacctaaatactatatacccgaacgcgacgcaacgctcgcgaacgcaaccctcgctaatcgaaaataacttaataaacatcaacgaacaaaacctatttcacctaccgcactaaacacgtacgaaaaatcgataaaataaccgaaaatccaatcgcgatcaatcaacaaacgaacgaaaataaacccgcaacaaataaccgccacgaccatcgaaacaataacgaaattattcaacgcctaatccatattaccaacattaaaataataaaccgtacgaaacataaaaattcccgaaatcataataacgaacgccgacaccgtcgtaataatacgcgataaatacgcgcgcttaaaaaccaccgcgcccaaaaaccccacgataaaaccgccgacgaacgcgccgacgtaacttataaccccgaccccgataaaaataaaacgaacgaaattaaccaccgttcccaccgcgaccgccacgaacaccatccgacgcgaaaaattaaaaaaaaacgcgaatccgaaaacgcccaaaaaactaaccgccgcgacgacgaaataccacaccgacgcataatcgaaaatacccgattccgaaattaactccgtaatacaaaaataccgaactcgaattcgtaatcatat

SEQ ID NO: 9649 - DNA, 1175 bp, Artificial Sequence
  chemically treated genomic DNA (Homo sapiens) CpG-island No: 9649
acgcgatttattcggagcgcgggggcgttcgggcgcgttcgtaggttttttcgttcgttcgtacgtatttcgggcgattcgtttttcgtcgcgttttcgtatttagtttcgtttcggcgattttttttttagtttcggcgcgtggaatttcgtttttttttgagttttcgagtttggcgagcggagggcggggcggggcggggtacgcgggaggcggagtcgagtcggggaattttgttttgggatagtattcggtttcgtagagtagcgcggtagtttaagggtttcggcgtcgggggcggcggggaattttaaacgtaatcgggtttggagggattttcgcgtcgagttagtcgtcgttatcgttttcgcgtcgtttttgcgggtttggtaggcgttcggcgcgttcgtattgcgttcggtcgtcggttttcgcggttttatcgtgagttcgtcggttcgtcgttcgttcgttatgtaatcgtcgtcggtttcgcgcgcgtaggcgttcgtcgtaggttatgttgtttttgttcgtcgcgtttttggtcgtcgtttgttcgttgtcgttcgttcgcggcggggtcgcggacgcgttcggttttttcggggtgttttttaatgttttagttaacgcgtttttcgcggaagagtttatcgtttcgcggttgttggtttcggcggttttcgggtttttcgagcgttcgggttcggaggaggcggcggcggcggcggcgtcgtgtaatattagcgtgtagcggtagatgttgagttcgttgttcgtgcgttggggtcgttcgcggggtttttagtgcgatttattgtttttttttattaacgcgtacggtcgcgtttttttcgtcgtcgttttttatcgcgtcgggtcgtcgttgtttatcgagtatttggggttggcggcgggcggcgcgtagtaggatttgcgtttttgcgtgggttgcggttgggtgcgcggtcgtcgtatcggtcgttttcggttcgtcgtcgtttttagcgtcgtcgtcgttatcgtcggggcgtttatcgcgttgttagtttatttcgcggtcgagtcgttcgggtcgttgtggttgtagggcgagtcgttgtatttttgttgtttagattttagtttggaggagttgtagggcgagtcgggttggcggttgaatcgtaag

SEQ ID NO: 9650 - DNA, 1175 bp, Artificial Sequence
  chemically treated genomic DNA (Homo sapiens) CpG-island No: 9650
cttacgattcaaccgccaacccgactcgccctacaactcctccaaactaaaatctaaacaacaaaaatacaacgactcgccctacaaccacaacgacccgaacgactcgaccgcgaaataaactaacaacgcgataaacgccccgacgataacgacgacgacgctaaaaacgacgacgaaccgaaaacgaccgatacgacgaccgcgcacccaaccgcaacccacgcaaaaacgcaaatcctactacgcgccgcccgccgccaaccccaaatactcgataaacaacgacgacccgacgcgataaaaaacgacgacgaaaaaaacgcgaccgtacgcgttaataaaaaaaaacaataaatcgcactaaaaaccccgcgaacgaccccaacgcacgaacaacgaactcaacatctaccgctacacgctaatattacacgacgccgccgccgccgccgcctcctccgaacccgaacgctcgaaaaacccgaaaaccgccgaaaccaacaaccgcgaaacgataaactcttccgcgaaaaacgcgttaactaaaacattaaaaaacaccccgaaaaaaccgaacgcgtccgcgaccccgccgcgaacgaacgacaacgaacaaacgacgaccaaaaacgcgacgaacaaaaacaacataacctacgacgaacgcctacgcgcgcgaaaccgacgacgattacataacgaacgaacgacgaaccgacgaactcacgataaaaccgcgaaaaccgacgaccgaacgcaatacgaacgcgccgaacgcctaccaaacccgcaaaaacgacgcgaaaacgataacgacgactaactcgacgcgaaaatccctccaaacccgattacgtttaaaattccccgccgcccccgacgccgaaacccttaaactaccgcgctactctacgaaaccgaatactatcccaaaacaaaattccccgactcgactccgcctcccgcgtaccccgccccgccccgccctccgctcgccaaactcgaaaactcaaaaaaaaacgaaattccacgcgccgaaactaaaaaaaaaatcgccgaaacgaaactaaatacgaaaacgcgacgaaaaacgaatcgcccgaaatacgtacgaacgaacgaaaaaacctacgaacgcgcccgaacgcccccgcgctccgaataaatcgcgt

SEQ ID NO: 9651 - DNA, 1175 bp, Artificial Sequence
  chemically treated genomic DNA (Homo sapiens) CpG-island No: 9651
tttacggtttagtcgttagttcggttcgttttgtagtttttttaggttgaagtttaggtagtagaaatgtagcggttcgttttgtagttatagcggttcgggcggttcggtcgcggggtaggttggtagcgcggtgggcgtttcggcggtggcggcggcggcgttgggggcggcggcgggtcggaggcggtcggtgcggcgatcgcgtatttagtcgtagtttacgtagaggcgtaggttttgttgcgcgtcgttcgtcgttagttttaggtgttcgatgagtagcggcggttcgacgcggtggaaggcggcggcgaagaaagcgcggtcgtgcgcgttggtggagaagagtagtaggtcgtattggaagtttcgcgggcggttttagcgtacgagtagcgagtttagtatttgtcgttgtacgttgatgttgtacggcgtcgtcgtcgtcgtcgtttttttcgggttcgggcgttcggggggttcgggggtcgtcgaggttagtagtcgcggggcgatgggttttttcgcggaggacgcgttgattgaagtattggagggtatttcgaggaggtcgggcgcgttcgcggtttcgtcgcggacgggcggtagcgggtaggcggcggttaggagcgcggcgagtaggggtagtatggtttgcggcgggcgtttacgcgcgcgaggtcggcggcggttgtatggcgagcgggcgacgggtcggcgagtttacggtgggatcgcgggagtcggcggtcgggcgtagtgcgggcgcgtcgggcgtttgttaagttcgtaggggcggcgcggaggcggtgacggcggttggttcggcgcggggatttttttagattcggttgcgtttggggtttttcgtcgttttcggcgtcggggtttttgggttgtcgcgttgttttgcggggtcgggtgttattttagagtaggatttttcggttcggtttcgtttttcgcgtgtttcgtttcgtttcgtttttcgttcgttaggttcggggatttaggggagggcggggttttacgcgtcggggttgggagaggaatcgtcggggcggggttgggtgcgggggcgcggcggagagcggatcgttcggggtgcgtgcgggcgggcggggaagtttgcggacgcgttcgggcgttttcgcgtttcgggtgaatcgcgt

SEQ ID NO: 9652 - DNA, 1175 bp, Artificial Sequence
  chemically treated genomic DNA (Homo sapiens) CpG-island No: 9652
acgcgattcacccgaaacgcgaaaacgcccgaacgcgtccgcaaacttccccgcccgcccgcacgcaccccgaacgatccgctctccgccgcgcccccgcacccaaccccgccccgacgattcctctcccaaccccgacgcgtaaaaccccgccctcccctaaatccccgaacctaacgaacgaaaaacgaaacgaaacgaaacacgcgaaaaacgaaaccgaaccgaaaaatcctactctaaaataacacccgaccccgcaaaacaacgcgacaacccaaaaaccccgacgccgaaaacgacgaaaaaccccaaacgcaaccgaatctaaaaaaatccccgcgccgaaccaaccgccgtcaccgcctccgcgccgcccctacgaacttaacaaacgcccgacgcgcccgcactacgcccgaccgccgactcccgcgatcccaccgtaaactcgccgacccgtcgcccgctcgccatacaaccgccgccgacctcgcgcgcgtaaacgcccgccgcaaaccatactacccctactcgccgcgctcctaaccgccgcctacccgctaccgcccgtccgcgacgaaaccgcgaacgcgcccgacctcctcgaaataccctccaatacttcaatcaacgcgtcctccgcgaaaaaacccatcgccccgcgactactaacctcgacgacccccgaaccccccgaacgcccgaacccgaaaaaaacgacgacgacgacgacgccgtacaacatcaacgtacaacgacaaatactaaactcgctactcgtacgctaaaaccgcccgcgaaacttccaatacgacctactactcttctccaccaacgcgcacgaccgcgctttcttcgccgccgccttccaccgcgtcgaaccgccgctactcatcgaacacctaaaactaacgacgaacgacgcgcaacaaaacctacgcctctacgtaaactacgactaaatacgcgatcgccgcaccgaccgcctccgacccgccgccgcccccaacgccgccgccgccaccgccgaaacgcccaccgcgctaccaacctaccccgcgaccgaaccgcccgaaccgctataactacaaaacgaaccgctacatttctactacctaaacttcaacctaaaaaaactacaaaacgaaccgaactaacgactaaaccgtaaa

SEQ ID NO: 9653 - DNA, 681 bp, Artificial Sequence
  chemically treated genomic DNA (Homo sapiens) CpG-island No: 9653
agttcgcgattttgttgcgtagggcggggttcgggtcggttcgttcgcgcgtaggtgagtgagttagggcggagcgtagttgcgtcgggtttgggcgtttggggtcgtcgttttttatcgtcgttttttttatcgaggtcgaggcgtttcggagttatggtcggtttgaattgcggggtttttatcgtattgttaggggttttgttgttgggtgcggcgcgtttgtcgcgcggggtaggtgagtgtcgggttttggaggcggatggcgtggagtggtgagttagttagttagcggacgttcggcggagatgcggtcgagggacgtagggtgcggagggtgcggagggtgcggagagagggcggggacggcgtagttaaaatgcgcgggtggtttcgggattttcggattgttcggtttttgcgcgcgtcgcgtcgggcgcgtgggttttgtttttttggagttaattttgttttcggtacgtgagagtgttttcgatcggggagtttttcggttcgggaggatgagttcggtgttggtcgagaaggcgggaaaaggagttttcggtagtcgattttaggcgatatgtttaaggtggcgcgtcgtgcgttttagggtttttgtcgggatttttgaaagtatttaggtagggtgtgggaagagattttttttttttaggttcg

SEQ ID NO: 9654 - DNA, 681 bp, Artificial Sequence
  chemically treated genomic DNA (Homo sapiens) CpG-island No: 9654
cgaacctaaaaaaaaaaaatctcttcccacaccctacctaaatactttcaaaaatcccgacaaaaaccctaaaacgcacgacgcgccaccttaaacatatcgcctaaaatcgactaccgaaaactccttttcccgccttctcgaccaacaccgaactcatcctcccgaaccgaaaaactccccgatcgaaaacactctcacgtaccgaaaacaaaattaactccaaaaaaacaaaacccacgcgcccgacgcgacgcgcgcaaaaaccgaacaatccgaaaatcccgaaaccacccgcgcattttaactacgccgtccccgccctctctccgcaccctccgcaccctccgcaccctacgtccctcgaccgcatctccgccgaacgtccgctaactaactaactcaccactccacgccatccgcctccaaaacccgacactcacctaccccgcgcgacaaacgcgccgcacccaacaacaaaacccctaacaatacgataaaaaccccgcaattcaaaccgaccataactccgaaacgcctcgacctcgataaaaaaaacgacgataaaaaacgacgaccccaaacgcccaaacccgacgcaactacgctccgccctaactcactcacctacgcgcgaacgaaccgacccgaaccccgccctacgcaacaaaatcgcgaact

SEQ ID NO: 9655 - DNA, 681 bp, Artificial Sequence
  chemically treated genomic DNA (Homo sapiens) CpG-island No: 9655
cgagtttggagaggaaagatttttttttatattttgtttgggtgtttttaagaatttcggtaaagattttggggcgtacggcgcgttattttggatatgtcgtttgggatcggttatcgggagttttttttttcgttttttcggttagtatcgggtttattttttcggatcgggaggtttttcgatcggggatatttttacgtgtcgagggtaaggttgattttaggagggtaaggtttacgcgttcgacgcggcgcgcgtaggaatcgaatagttcgggggtttcggagttattcgcgtattttgattacgtcgttttcgtttttttttcgtatttttcgtatttttcgtattttgcgtttttcggtcgtattttcgtcgggcgttcgttggttggttagtttattattttacgttattcgtttttaaagttcggtatttatttgtttcgcgcggtaggcgcgtcgtatttagtagtagaatttttagtagtgcgatagagatttcgtagtttaggtcggttatgatttcgggacgtttcggtttcggtggggaaaacgacggtggggagcggcggttttaggcgtttaagttcggcgtagttgcgtttcgttttggtttatttatttgcgcgcgggcggatcggttcgagtttcgttttgcgtagtaggatcgcgagtt

SEQ ID NO: 9656 - DNA, 681 bp, Artificial Sequence
  chemically treated genomic DNA (Homo sapiens) CpG-island No: 9656
aactcgcgatcctactacgcaaaacgaaactcgaaccgatccgcccgcgcgcaaataaataaaccaaaacgaaacgcaactacgccgaacttaaacgcctaaaaccgccgctccccaccgtcgttttccccaccgaaaccgaaacgtcccgaaatcataaccgacctaaactacgaaatctctatcgcactactaaaaattctactactaaatacgacgcgcctaccgcgcgaaacaaataaataccgaactttaaaaacgaataacgtaaaataataaactaaccaaccaacgaacgcccgacgaaaatacgaccgaaaaacgcaaaatacgaaaaatacgaaaaatacgaaaaaaaaacgaaaacgacgtaatcaaaatacgcgaataactccgaaacccccgaactattcgattcctacgcgcgccgcgtcgaacgcgtaaaccttaccctcctaaaatcaaccttaccctcgacacgtaaaaatatccccgatcgaaaaacctcccgatccgaaaaaataaacccgatactaaccgaaaaaacgaaaaaaaaaactcccgataaccgatcccaaacgacatatccaaaataacgcgccgtacgccccaaaatctttaccgaaattcttaaaaacacccaaacaaaatataaaaaaaaatctttcctctccaaactcg

SEQ ID NO: 9657 - DNA, 522 bp, Artificial Sequence
  chemically treated genomic DNA (Homo sapiens) CpG-island No: 9657
aagtttacgcgttgcgtatgcgtattattcgtagtgtgggcgaagggcggtgttggaaggacgttttttagaaggtttttttagcgtagttgttttttttttcgtttataggtcgcgtgacgtgattttatttattacgtttttcggttttaaatagtagtttgttagcgtttttttgcggtttaattgggtattacgaatatgtatttagggttagagcgagcgagtaagtagaatgtggcgagttcggttgtcgtcgtcgttattttagcgcgtcgatagcgagggaagggaggaggagggagacgcgtagggaggggaggggagggaggaggttagataaggcgggggaagggggagtagcggtggtttaagtcgcgcggagtagcgtaatttgggtcgttttttgtttcgtcgtcgttttcggatcgagttagcggagttagtgttttagagattttgtaatattataaagcggacgaaggagtttatgttggggaatttggtagcggagtgattggg

SEQ ID NO: 9658 - DNA, 522 bp, Artificial Sequence
  chemically treated genomic DNA (Homo sapiens) CpG-island No: 9658
cccaatcactccgctaccaaattccccaacataaactccttcgtccgctttataatattacaaaatctctaaaacactaactccgctaactcgatccgaaaacgacgacgaaacaaaaaacgacccaaattacgctactccgcgcgacttaaaccaccgctactcccccttcccccgccttatctaacctcctccctcccctcccctccctacgcgtctccctcctcctcccttccctcgctatcgacgcgctaaaataacgacgacgacaaccgaactcgccacattctacttactcgctcgctctaaccctaaatacatattcgtaatacccaattaaaccgcaaaaaaacgctaacaaactactatttaaaaccgaaaaacgtaataaataaaatcacgtcacgcgacctataaacgaaaaaaaaaacaactacgctaaaaaaaccttctaaaaaacgtccttccaacaccgcccttcgcccacactacgaataatacgcatacgcaacgcgtaaactt

SEQ ID NO: 9659 - DNA, 522 bp, Artificial Sequence
  chemically treated genomic DNA (Homo sapiens) CpG-island No: 9659
tttagttatttcgttgttaagttttttaatatggattttttcgttcgttttgtggtgttatagggtttttaggatattgatttcgttggttcggttcggaggcggcggcgaagtagggagcgatttaggttgcgttgtttcgcgcggtttaagttatcgttatttttttttttttcgttttgtttagttttttttttttttttttttttttgcgcgttttttttttttttttttttttcgttgtcggcgcgttaaggtgacgacggcggtagtcggattcgttatattttgtttattcgttcgttttggttttgagtgtatgttcgtagtatttagttgggtcgtaggggggcgttggtaaattgttgtttgagatcgagaagcgtggtgggtggagttacgttacgcggtttgtgagcgggaggaagggtagttgcgttggaggggttttttgggaaacgtttttttagtatcgtttttcgtttatattgcggatggtgcgtatgcgtagcgcgtggattt

SEQ ID NO: 9660 - DNA, 522 bp, Artificial Sequence
  chemically treated genomic DNA (Homo sapiens) CpG-island No: 9660
aaatccacgcgctacgcatacgcaccatccgcaatataaacgaaaaacgatactaaaaaaacgtttcccaaaaaacccctccaacgcaactacccttcctcccgctcacaaaccgcgtaacgtaactccacccaccacgcttctcgatctcaaacaacaatttaccaacgcccccctacgacccaactaaatactacgaacatacactcaaaaccaaaacgaacgaataaacaaaatataacgaatccgactaccgccgtcgtcaccttaacgcgccgacaacgaaaaaaaaaaaaaaaaaaaaaacgcgcaaaaaaaaaaaaaaaaaaaaaaaactaaacaaaacgaaaaaaaaaaaaataacgataacttaaaccgcgcgaaacaacgcaacctaaatcgctccctacttcgccgccgcctccgaaccgaaccaacgaaatcaatatcctaaaaaccctataacaccacaaaacgaacgaaaaaatccatattaaaaaacttaacaacgaaataactaaa

SEQ ID NO: 9661 - DNA, 541 bp, Artificial Sequence
  chemically treated genomic DNA (Homo sapiens) CpG-island No: 9661
ttgcgtcgttttgatattcgttgtcgggggtttcggtagaaatttattatgttttttcgggaatgtgtgggtatttttttaaaacgttaaagatcgcggagggtttttttacgttaattttaggttgcgttttgttttcgtttttttttttacgttttttagttcgtttaacgttttcgttttttttgggtgtttttttttttttcggtttttagagaataacgcgagatagaaagtggttttttagtattagcgaaatcgtgcgtatagatacggggtttagtcgggacgttttagatttttcggtcgcggtagacgggttgttcgcggttttcgaaagtttttcggataatataggcgtttaggcgtcgtttttgtttttttttagcgttttgttgcgttttgggcgtagtattggttcggtttttgtattcgtattgcggcggcggcggggtttgaggatttggggttaagttaaattttataaaatatattattattttcgtttagagagtttacgaaagaaaagagtttaaaggtt

SEQ ID NO: 9662 - DNA, 541 bp, Artificial Sequence
  chemically treated genomic DNA (Homo sapiens) CpG-island No: 9662
aacctttaaactcttttctttcgtaaactctctaaacgaaaataataatatattttataaaatttaacttaaccccaaatcctcaaaccccgccgccgccgcaatacgaatacaaaaaccgaaccaatactacgcccaaaacgcaacaaaacgctaaaaaaaaacaaaaacgacgcctaaacgcctatattatccgaaaaactttcgaaaaccgcgaacaacccgtctaccgcgaccgaaaaatctaaaacgtcccgactaaaccccgtatctatacgcacgatttcgctaatactaaaaaaccactttctatctcgcgttattctctaaaaaccgaaaaaaaaaaaaacacccaaaaaaaacgaaaacgttaaacgaactaaaaaacgtaaaaaaaaaaacgaaaacaaaacgcaacctaaaattaacgtaaaaaaaccctccgcgatctttaacgttttaaaaaaatacccacacattcccgaaaaaacataataaatttctaccgaaacccccgacaacgaatatcaaaacgacgcaa

SEQ ID NO: 9663 - DNA, 541 bp, Artificial Sequence
  chemically treated genomic DNA (Homo sapiens) CpG-island No: 9663
aatttttaagtttttttttttcgtaagttttttgggcgagggtggtggtatgttttgtgaggtttagtttagttttaaatttttaagtttcgtcgtcgtcgtagtgcgggtgtaggaatcgggttagtattgcgtttagggcgtagtagagcgttggggaggaataaaggcggcgtttaggcgtttgtgttattcgagagattttcgggggtcgcgggtagttcgtttgtcgcgatcgaggggtttggggcgtttcggttgggtttcgtgtttgtgcgtacggtttcgttgatgttgaggggttattttttgtttcgcgttgttttttggggatcgggagaggaggaggtatttaaaaagagcgggggcgttgggcgagttgggggacgtgggagggggaacgggaataaagcgtagtttagggttagcgtgggaagatttttcgcggtttttggcgttttggaaagatatttatatattttcgggaaaatatggtgagtttttgtcggagttttcggtagcgggtgttagggcggcgtag

SEQ ID NO: 9664 - DNA, 541 bp, Artificial Sequence
  chemically treated genomic DNA (Homo sapiens) CpG-island No: 9664
ctacgccgccctaacacccgctaccgaaaactccgacaaaaactcaccatattttcccgaaaatatataaatatctttccaaaacgccaaaaaccgcgaaaaatcttcccacgctaaccctaaactacgctttattcccgttccccctcccacgtcccccaactcgcccaacgcccccgctctttttaaatacctcctcctctcccgatccccaaaaaacaacgcgaaacaaaaaataacccctcaacatcaacgaaaccgtacgcacaaacacgaaacccaaccgaaacgccccaaacccctcgatcgcgacaaacgaactacccgcgacccccgaaaatctctcgaataacacaaacgcctaaacgccgcctttattcctccccaacgctctactacgccctaaacgcaatactaacccgattcctacacccgcactacgacgacgacgaaacttaaaaatttaaaactaaactaaacctcacaaaacataccaccaccctcgcccaaaaaacttacgaaaaaaaaaaacttaaaaatt

SEQ ID NO: 9665 - DNA, 712 bp, Artificial Sequence
  chemically treated genomic DNA (Homo sapiens) CpG-island No: 9665
tttgcgaacggtgattgtttatttttggtcgtaatgagttattattcgtcgggttttcgggtcggttttagttttattttatatcgtcgtattttcggtttatcgtttttattatttttcggggtttttttttattcgtttagttttcgtttttttagtagtcgtttgttgggtttcgcgttttcgagtttttcggtgcgtttgggtagttttcgtagttttcgagcgggagcgggcgtttttttgcgtttgttttcggagcgtttcgatttttttatggtcgaggtttttaattaggagtttttggttacgcgtagtaacgagaagtaggagttgtaggagtttaacgatcgtttcgttaattttatcgagaaggtacgttttttggagtagtagaacgcggttttgcgcggggagttgagttaagttcggggttaggagtcggcgcgcgtcgattagttgtgttagtaggagttgcgcgagttgcggcgagagttggagttgttgggtcgcgagcgtgatcgggtgtaggtggagcgcgacgggttggcggaggatttggcggcgtttaagtagaggttagggggtagggttgggtcgttgtcgtcgaggcgaggtcgaagcggtcgtcgaggcggttgttttttttttttttcgttttttttttttattagtagtttaagggtgtggttttttttattaatttaggtgt

SEQ ID NO: 9666 - DNA, 712 bp, Artificial Sequence
  chemically treated genomic DNA (Homo sapiens) CpG-island No: 9666
acacctaaattaataaaaaaaaccacacccttaaactactaataaaaaaaaaaaacgaaaaaaaaaaaaaacaaccgcctcgacgaccgcttcgacctcgcctcgacgacaacgacccaaccctaccccctaacctctacttaaacgccgccaaatcctccgccaacccgtcgcgctccacctacacccgatcacgctcgcgacccaacaactccaactctcgccgcaactcgcgcaactcctactaacacaactaatcgacgcgcgccgactcctaaccccgaacttaactcaactccccgcgcaaaaccgcgttctactactccaaaaaacgtaccttctcgataaaattaacgaaacgatcgttaaactcctacaactcctacttctcgttactacgcgtaaccaaaaactcctaattaaaaacctcgaccataaaaaaatcgaaacgctccgaaaacaaacgcaaaaaaacgcccgctcccgctcgaaaactacgaaaactacccaaacgcaccgaaaaactcgaaaacgcgaaacccaacaaacgactactaaaaaaacgaaaactaaacgaataaaaaaaaaccccgaaaaataataaaaacgataaaccgaaaatacgacgatataaaataaaactaaaaccgacccgaaaacccgacgaataataactcattacgaccaaaaataaacaatcaccgttcgcaaa

SEQ ID NO: 9667 - DNA, 712 bp, Artificial Sequence
  chemically treated genomic DNA (Homo sapiens) CpG-island No: 9667
atatttgggttggtaaggggagttatatttttgggttgttgatggagaggggaagcgaggggagggaagagtagtcgtttcgacggtcgtttcgatttcgtttcgacggtagcggtttagttttgttttttgatttttgtttgagcgtcgttaggtttttcgttagttcgtcgcgttttatttgtattcggttacgttcgcggtttaatagttttagttttcgtcgtagttcgcgtagtttttgttggtatagttggtcggcgcgcgtcggtttttggtttcgggtttggtttagtttttcgcgtagggtcgcgttttgttgttttagaaagcgtattttttcgatgaagttggcgaagcggtcgttgagtttttgtagtttttgtttttcgttgttgcgcgtggttaggaatttttggttgagggtttcggttatggagaagtcgaggcgtttcgagggtaggcgtaggagggcgttcgttttcgttcgggggttacggaagttgtttaggcgtatcgaggagttcggggacgcggagtttagtaggcggttgttggagaagcgggagttggacgagtaggagaaggtttcgggggatagtgagggcggtggatcgaaggtacggcggtatgaggtggagttgaagtcggttcggaggttcgacgggtggtggtttattgcggttaaggatgggtagttatcgttcgtaga

SEQ ID NO: 9668 - DNA, 712 bp, Artificial Sequence
  chemically treated genomic DNA (Homo sapiens) CpG-island No: 9668
tctacgaacgataactacccatccttaaccgcaataaaccaccacccgtcgaacctccgaaccgacttcaactccacctcataccgccgtaccttcgatccaccgccctcactatcccccgaaaccttctcctactcgtccaactcccgcttctccaacaaccgcctactaaactccgcgtccccgaactcctcgatacgcctaaacaacttccgtaacccccgaacgaaaacgaacgccctcctacgcctaccctcgaaacgcctcgacttctccataaccgaaaccctcaaccaaaaattcctaaccacgcgcaacaacgaaaaacaaaaactacaaaaactcaacgaccgcttcgccaacttcatcgaaaaaatacgctttctaaaacaacaaaacgcgaccctacgcgaaaaactaaaccaaacccgaaaccaaaaaccgacgcgcgccgaccaactataccaacaaaaactacgcgaactacgacgaaaactaaaactattaaaccgcgaacgtaaccgaatacaaataaaacgcgacgaactaacgaaaaacctaacgacgctcaaacaaaaatcaaaaaacaaaactaaaccgctaccgtcgaaacgaaatcgaaacgaccgtcgaaacgactactcttccctcccctcgcttcccctctccatcaacaacccaaaaatataactccccttaccaacccaaatat

SEQ ID NO: 9669 - DNA, 782 bp, Artificial Sequence
  chemically treated genomic DNA (Homo sapiens) CpG-island No: 9669
gggattgggggaagttaaagttttaagttttaagttcgtttgtttttttcgggggtgttcggtcgtggcgttaagtttggttacggttattttttttaatacgaattcgatgaatttggaatgatatggtttttcgttagttcgtttttattattgatttcggatgtgtttttttcgtatattttatgtttatcggaaagttgttaacgtatggttatcgtcgggtatgggcgttgtttcgtagataggtagaatttgatgggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcggagttcggagagtaacggaatagtagagagtttcgtgaaaacgataaagcgtgattatattagtattatgtttaaattagacgggttaacggt

SEQ ID NO: 9670 - DNA, 782 bp, Artificial Sequence
  chemically treated genomic DNA (Homo sapiens) CpG-island No: 9670
accgttaacccgtctaatttaaacataatactaatataatcacgctttatcgttttcacgaaactctctactattccgttactctccgaactccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacatacccatcaaattctacctatctacgaaacaacgcccatacccgacgataaccatacgttaacaactttccgataaacataaaatatacgaaaaaaacacatccgaaatcaataataaaaacgaactaacgaaaaaccatatcattccaaattcatcgaattcgtattaaaaaaaataaccgtaaccaaacttaacgccacgaccgaacacccccgaaaaaaacaaacgaacttaaaacttaaaactttaacttcccccaatccc

SEQ ID NO: 9671 - DNA, 782 bp, Artificial Sequence
  chemically treated genomic DNA (Homo sapiens) CpG-island No: 9671
gtcgttaattcgtttggtttgggtatgatattgatgtagttacgttttatcgtttttacgaagttttttgttatttcgttatttttcggatttcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatatttattaagttttgtttgtttgcgaagtaacgtttatattcgacgataattatacgttggtagtttttcgataaatatggggtatacggagaaggtatattcggaattaatagtggggacgaattggcggggggttatattattttaagtttatcgggttcgtgttgggaaaagtgatcgtggttaaatttggcgttacggtcgaatattttcgggaggaataaacgggtttggaatttaaagttttaattttttttaatttt

SEQ ID NO: 9672 - DNA, 782 bp, Artificial Sequence
  chemically treated genomic DNA (Homo sapiens) CpG-island No: 9672
aaaattaaaaaaaattaaaactttaaattccaaacccgtttattcctcccgaaaatattcgaccgtaacgccaaatttaaccacgatcacttttcccaacacgaacccgataaacttaaaataatataaccccccgccaattcgtccccactattaattccgaatataccttctccgtataccccatatttatcgaaaaactaccaacgtataattatcgtcgaatataaacgttacttcgcaaacaaacaaaacttaataaatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacgaaatccgaaaaataacgaaataacaaaaaacttcgtaaaaacgataaaacgtaactacatcaatatcatacccaaaccaaacgaattaacgac

SEQ ID NO: 9673 - DNA, 1026 bp, Artificial Sequence
  chemically treated genomic DNA (Homo sapiens) CpG-island No: 9673
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggattttggtagttatagtatgcgtatatttatgtttcgattatgcgtttataaagtaggtgaatgcgtaatgtagtatttatatcgttatcgttttttattgttttcgcgaat

SEQ ID NO: 9674 - DNA, 1026 bp, Artificial Sequence
  chemically treated genomic DNA (Homo sapiens) CpG-island No: 9674
attcgcgaaaacaataaaaaacgataacgatataaatactacattacgcattcacctactttataaacgcataatcgaaacataaatatacgcatactataactaccaaaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 9675 - DNA, 1026 bp, Artificial Sequence
  chemically treated genomic DNA (Homo sapiens) CpG-island No: 9675
attcgcgagagtagtggaaagcgatgacgatgtgggtattatattgcgtatttatttattttgtgagcgtatggtcgaagtatggatatgcgtatgttgtgattgttaagattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 9676 - DNA, 1026 bp, Artificial Sequence
  chemically treated genomic DNA (Homo sapiens) CpG-island No: 9676
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatcttaacaatcacaacatacgcatatccatacttcgaccatacgctcacaaaataaataaatacgcaatataatacccacatcgtcatcgctttccactactctcgcgaat

SEQ ID NO: 9677 - DNA, 769 bp, Artificial Sequence
  chemically treated genomic DNA (Homo sapiens) CpG-island No: 9677
ttgatcgttatttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgatcgagcggtggtgttggggtcggacgtgaaacgttgttgtgcggtgtgaaagcgttgtttgtcgggttattgaggtttttggggtttggtgatcggatttgttgggggttttggggtcgtattcgggttttgtgtttttcggtttaagggtggttagttggttggtggatggtgtcgggggttttatcgggttttttattggtgttcgttgtttttttttgacgaattttgttgttgatttggatgtatat

SEQ ID NO: 9678 - DNA, 769 bp, Artificial Sequence
  chemically treated genomic DNA (Homo sapiens) CpG-island No: 9678
atatacatccaaatcaacaacaaaattcgtcaaaaaaaaacaacgaacaccaataaaaaacccgataaaacccccgacaccatccaccaaccaactaaccacccttaaaccgaaaaacacaaaacccgaatacgaccccaaaacccccaacaaatccgatcaccaaaccccaaaaacctcaataacccgacaaacaacgctttcacaccgcacaacaacgtttcacgtccgaccccaacaccaccgctcgatcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaataacgatcaa

SEQ ID NO: 9679 - DNA, 769 bp, Artificial Sequence
  chemically treated genomic DNA (Homo sapiens) CpG-island No: 9679
atgtgtatttagattagtaataagattcgttaaaaggaagtagcgaatattagtaaaagattcggtaaagttttcggtattatttattagttaattgattatttttgaatcggaaaatataaaattcgaatgcggttttaaagtttttaatagattcggttattaaattttagaagttttaatgattcggtagatagcgtttttatatcgtataataacgttttacgttcgattttagtattatcgttcgattatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggtggcgattag

SEQ ID NO: 9680 - DNA, 769 bp, Artificial Sequence
  chemically treated genomic DNA (Homo sapiens) CpG-island No: 9680
ctaatcgccacctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataatcgaacgataatactaaaatcgaacgtaaaacgttattatacgatataaaaacgctatctaccgaatcattaaaacttctaaaatttaataaccgaatctattaaaaactttaaaaccgcattcgaattttatattttccgattcaaaaataatcaattaactaataaataataccgaaaactttaccgaatcttttactaatattcgctacttccttttaacgaatcttattactaatctaaatacacat

SEQ ID NO: 9681 - DNA, 540 bp, Artificial Sequence
  chemically treated genomic DNA (Homo sapiens) CpG-island No: 9681
tacgaagtttttcgggagttgtatttttaagggtaggggcggggcgagtttcgagggggcgtgttttgagggcgtggtcgagatcggggcggggcgagtcggggcgggttcggacgggaagagtaggggttcggacgttgtagtaggcggggtattcggattggcggtttcgttggcgtaaggtcggttcggcggttagggatttggaaggttgcgaggttttgcgaggtcgaggttcggagtttgttggttttaggttcggttcgaggtaagaaagagtcgttttttcgtacggtcggaggattcgggcgtttcgagttcgattttttagttttcgttcggacgggaaacggagtacggagatgtttttgaggttttttttttgggaagcgtagtttcgatttttcgtttttgttttttagtaggtcggcgattattcgagcgttgggtatcggtttacgcgtatagaaggcgtttaataaatgtttattagtgaattagtaaaataaatcggtagtaaagagagacgagacgtatgtt

SEQ ID NO: 9682 - DNA, 540 bp, Artificial Sequence
  chemically treated genomic DNA (Homo sapiens) CpG-island No: 9682
aacatacgtctcgtctctctttactaccgatttattttactaattcactaataaacatttattaaacgccttctatacgcgtaaaccgatacccaacgctcgaataatcgccgacctactaaaaaacaaaaacgaaaaatcgaaactacgcttcccaaaaaaaaaacctcaaaaacatctccgtactccgtttcccgtccgaacgaaaactaaaaaatcgaactcgaaacgcccgaatcctccgaccgtacgaaaaaacgactctttcttacctcgaaccgaacctaaaaccaacaaactccgaacctcgacctcgcaaaacctcgcaaccttccaaatccctaaccgccgaaccgaccttacgccaacgaaaccgccaatccgaataccccgcctactacaacgtccgaacccctactcttcccgtccgaacccgccccgactcgccccgccccgatctcgaccacgccctcaaaacacgccccctcgaaactcgccccgcccctacccttaaaaatacaactcccgaaaaacttcgta

SEQ ID NO: 9683 - DNA, 540 bp, Artificial Sequence
  chemically treated genomic DNA (Homo sapiens) CpG-island No: 9683
agtatgcgtttcgtttttttttgttgtcgatttattttattgatttattagtgagtatttattgagcgttttttgtacgcgtgggtcgatgtttagcgttcggatggtcgtcgatttgttaagggataggggcgggaaatcggggttgcgttttttaggaaagagattttaggaatattttcgtgtttcgtttttcgttcggacggaggttgagaagtcgaattcggggcgttcgggtttttcggtcgtgcggggaggcggtttttttttatttcgggtcgggtttgggattagtaaatttcgaatttcgatttcgtagggtttcgtagttttttaggtttttggtcgtcggatcgattttgcgttagcgaagtcgttagttcgggtgtttcgtttgttgtagcgttcgggtttttatttttttcgttcgggttcgtttcggttcgtttcgtttcggtttcggttacgtttttaggatacgttttttcggggttcgtttcgtttttgtttttaaaggtatagttttcggggagtttcgta

SEQ ID NO: 9684 - DNA, 540 bp, Artificial Sequence
  chemically treated genomic DNA (Homo sapiens) CpG-island No: 9684
tacgaaactccccgaaaactatacctttaaaaacaaaaacgaaacgaaccccgaaaaaacgtatcctaaaaacgtaaccgaaaccgaaacgaaacgaaccgaaacgaacccgaacgaaaaaaataaaaacccgaacgctacaacaaacgaaacacccgaactaacgacttcgctaacgcaaaatcgatccgacgaccaaaaacctaaaaaactacgaaaccctacgaaatcgaaattcgaaatttactaatcccaaacccgacccgaaataaaaaaaaaccgcctccccgcacgaccgaaaaacccgaacgccccgaattcgacttctcaacctccgtccgaacgaaaaacgaaacacgaaaatattcctaaaatctctttcctaaaaaacgcaaccccgatttcccgcccctatcccttaacaaatcgacgaccatccgaacgctaaacatcgacccacgcgtacaaaaaacgctcaataaatactcactaataaatcaataaaataaatcgacaacaaaaaaaaacgaaacgcatact

SEQ ID NO: 9685 - DNA, 730 bp, Artificial Sequence
  chemically treated genomic DNA (Homo sapiens) CpG-island No: 9685
gcgattcgttttttgtgcggcgcggcgtaggttacggcggcggcggcggcggcggttaggagtgttttgttttcgttgggtcggaagggatcgggaaattttaagtcgggcgtttttttttcgggcgttttcgggttcgttagtcgtagttatcgcgggtttttcgtcgtttcgggtttcggggtcggtcgttcggtttggatttttgttggcgtcggggcggcggttgcggttggtcgagtttcggggtcggggaagaaagagcgtcgcgagtcgggggtcgtcgggatttgttcgcgatacggtcggggtcgtcgcgggtttgggcgttttttatttttttgtaggtgtcgtcgtagtttggcggtcggagttgggggagggggtagggaggtttggtgttcggttataggcggtgatttacggattttgttcgttcgaggttggtatttcgcgggggtagagttgcgttcgtttggggtaatttcgagtttaggagaattttaagagcggcgttttggtttcggttttcgcgtttttttcgaagaaaggagagttagggacggagggaggtcgggaggttgaatttcgggttcgtcgtcgaatcgtcggtttttcgatattatttggatttcggcggggatagtcgtttggaaggggaggaaggttagggacgtggaagagatggggttttaaaggcgtcgggacggagttggttttttagaggcgt

SEQ ID NO: 9686 - DNA, 730 bp, Artificial Sequence
  chemically treated genomic DNA (Homo sapiens) CpG-island No: 9686
acgcctctaaaaaaccaactccgtcccgacgcctttaaaaccccatctcttccacgtccctaaccttcctccccttccaaacgactatccccgccgaaatccaaataatatcgaaaaaccgacgattcgacgacgaacccgaaattcaacctcccgacctccctccgtccctaactctcctttcttcgaaaaaaacgcgaaaaccgaaaccaaaacgccgctcttaaaattctcctaaactcgaaattaccccaaacgaacgcaactctacccccgcgaaataccaacctcgaacgaacaaaatccgtaaatcaccgcctataaccgaacaccaaacctccctaccccctcccccaactccgaccgccaaactacgacgacacctacaaaaaaataaaaaacgcccaaacccgcgacgaccccgaccgtatcgcgaacaaatcccgacgacccccgactcgcgacgctctttcttccccgaccccgaaactcgaccaaccgcaaccgccgccccgacgccaacaaaaatccaaaccgaacgaccgaccccgaaacccgaaacgacgaaaaacccgcgataactacgactaacgaacccgaaaacgcccgaaaaaaaaacgcccgacttaaaatttcccgatcccttccgacccaacgaaaacaaaacactcctaaccgccgccgccgccgccgccgtaacctacgccgcgccgcacaaaaaacgaatcgc

SEQ ID NO: 9687 - DNA, 730 bp, Artificial Sequence
  chemically treated genomic DNA (Homo sapiens) CpG-island No: 9687
gcgtttttggggagttagtttcgtttcggcgtttttagagttttattttttttacgtttttggtttttttttttttttaggcggttgttttcgtcggggtttagatggtgtcggagggtcggcggttcgacggcgggttcggggtttagtttttcggttttttttcgtttttgattttttttttttcggagagggcgcgggggtcggggttaaagcgtcgtttttggggtttttttggattcggagttgttttaggcgggcgtagttttgttttcgcggggtgttagtttcgggcgggtaaggttcgtgagttatcgtttgtaatcgaatattaggtttttttgtttttttttttagtttcggtcgttaggttgcggcgatatttataagaaaatgaagggcgtttaggttcgcggcggtttcggtcgtatcgcgagtaggtttcggcggttttcggttcgcggcgttttttttttttcggtttcggggttcggttagtcgtaatcgtcgtttcggcgttagtaggaatttaggtcgagcgatcggtttcggagttcgaggcggcggagggttcgcggtagttgcgattggcgagttcgagagcgttcggggagggggcgttcggtttggaatttttcggtttttttcggtttagcgaggataaagtatttttggtcgtcgtcgtcgtcgtcgtcgtggtttacgtcgcgtcgtataaagggcgagtcgt

SEQ ID NO: 9688 - DNA, 730 bp, Artificial Sequence
  chemically treated genomic DNA (Homo sapiens) CpG-island No: 9688
acgactcgccctttatacgacgcgacgtaaaccacgacgacgacgacgacgacgaccaaaaatactttatcctcgctaaaccgaaaaaaaccgaaaaattccaaaccgaacgccccctccccgaacgctctcgaactcgccaatcgcaactaccgcgaaccctccgccgcctcgaactccgaaaccgatcgctcgacctaaattcctactaacgccgaaacgacgattacgactaaccgaaccccgaaaccgaaaaaaaaaaaacgccgcgaaccgaaaaccgccgaaacctactcgcgatacgaccgaaaccgccgcgaacctaaacgcccttcattttcttataaatatcgccgcaacctaacgaccgaaactaaaaaaaaaaacaaaaaaacctaatattcgattacaaacgataactcacgaaccttacccgcccgaaactaacaccccgcgaaaacaaaactacgcccgcctaaaacaactccgaatccaaaaaaaccccaaaaacgacgctttaaccccgacccccgcgccctctccgaaaaaaaaaaaatcaaaaacgaaaaaaaaccgaaaaactaaaccccgaacccgccgtcgaaccgccgaccctccgacaccatctaaaccccgacgaaaacaaccgcctaaaaaaaaaaaaaaaccaaaaacgtaaaaaaaataaaactctaaaaacgccgaaacgaaactaactccccaaaaacgc

SEQ ID NO: 9689 - DNA, 674 bp, Artificial Sequence
  chemically treated genomic DNA (Homo sapiens) CpG-island No: 9689
ttagtttcgggagcgtattttttttcggttttcgttttttagtatagtcgcgtagttgggttacgggatgcggcgtaatttgttcgtattttttagtcgaatttatttcgtttcgtttcgtttcgggcgcgggtttcggagttcgggtatttgcggggcgtttttttttcgcgggtagttcggttttgttgcgtttgtagaagtttaatttttgcgagggttttttttagatcgggtttttcgggtttcgtttagaagcgaggagcgatcgggttgcgggcgttacgggcgtcgcggttcgtaggtcgcgcgtcgtttcgtttcgttttcggtttcgcgaagattttgcgaggggtatttacggggttcggttttttcgtcgtcggcgcgttttttcgggggtttatggtgttttcggattcgtgagttcggtcgtagcgttgtatagtatcgtttagaaaatggacgtcggcggttcggttttgtcggttcggttcgttttcggcgcggggtagaggacgtagttcgttcgggaggaggtcggttcgattcgtagtttcgcgggttcggggttggggtaattgcggcgttaaggattaggttttaggagggcggcggcgggattcgtgagggtttcgtaaggttttatgttcgatttagtggttagtcggggt

SEQ ID NO: 9690 - DNA, 674 bp, Artificial Sequence
  chemically treated genomic DNA (Homo sapiens) CpG-island No: 9690
accccgactaaccactaaatcgaacataaaaccttacgaaaccctcacgaatcccgccgccgccctcctaaaacctaatccttaacgccgcaattaccccaaccccgaacccgcgaaactacgaatcgaaccgacctcctcccgaacgaactacgtcctctaccccgcgccgaaaacgaaccgaaccgacaaaaccgaaccgccgacgtccattttctaaacgatactatacaacgctacgaccgaactcacgaatccgaaaacaccataaacccccgaaaaaacgcgccgacgacgaaaaaaccgaaccccgtaaatacccctcgcaaaatcttcgcgaaaccgaaaacgaaacgaaacgacgcgcgacctacgaaccgcgacgcccgtaacgcccgcaacccgatcgctcctcgcttctaaacgaaacccgaaaaacccgatctaaaaaaaaccctcgcaaaaattaaacttctacaaacgcaacaaaaccgaactacccgcgaaaaaaaaacgccccgcaaatacccgaactccgaaacccgcgcccgaaacgaaacgaaacgaaataaattcgactaaaaaatacgaacaaattacgccgcatcccgtaacccaactacgcgactatactaaaaaacgaaaaccgaaaaaaaatacgctcccgaaactaa

SEQ ID NO: 9691 - DNA, 674 bp, Artificial Sequence
  chemically treated genomic DNA (Homo sapiens) CpG-island No: 9691
gtttcggttggttattgggtcgggtatggggttttacggggtttttacgggtttcgtcgtcgtttttttgaggtttggtttttggcgtcgtagttattttagtttcgggttcgcggggttgcgggtcgggtcgattttttttcggacgggttgcgttttttgtttcgcgtcgggggcgggtcgggtcggtagagtcgagtcgtcggcgtttattttttgggcggtgttgtgtagcgttgcggtcggatttacgggttcggaagtattatggattttcggggaaacgcgtcggcggcgaaggagtcgagtttcgtaagtgtttttcgtagggttttcgcggggtcgggggcggggcggggcgacgcgcggtttgcgggtcgcggcgttcgtggcgttcgtagttcgatcgtttttcgtttttggacggagttcggaaagttcggtttgagagaaattttcgtaagggttgagtttttgtaaacgtagtagaatcgagttgttcgcggggaggaagcgtttcgtaggtgttcggatttcggggttcgcgttcggagcggggcggggcggggtgggttcggttggagagtgcgggtaggttgcgtcgtatttcgtggtttaattgcgcggttgtgttagagggcgggggtcgaggaggaatgcgttttcggggttgg

SEQ ID NO: 9692 - DNA, 674 bp, Artificial Sequence
  chemically treated genomic DNA (Homo sapiens) CpG-island No: 9692
ccaaccccgaaaacgcattcctcctcgacccccgccctctaacacaaccgcgcaattaaaccacgaaatacgacgcaacctacccgcactctccaaccgaacccaccccgccccgccccgctccgaacgcgaaccccgaaatccgaacacctacgaaacgcttcctccccgcgaacaactcgattctactacgtttacaaaaactcaacccttacgaaaatttctctcaaaccgaactttccgaactccgtccaaaaacgaaaaacgatcgaactacgaacgccacgaacgccgcgacccgcaaaccgcgcgtcgccccgccccgcccccgaccccgcgaaaaccctacgaaaaacacttacgaaactcgactccttcgccgccgacgcgtttccccgaaaatccataatacttccgaacccgtaaatccgaccgcaacgctacacaacaccgcccaaaaaataaacgccgacgactcgactctaccgacccgacccgcccccgacgcgaaacaaaaaacgcaacccgtccgaaaaaaaatcgacccgacccgcaaccccgcgaacccgaaactaaaataactacgacgccaaaaaccaaacctcaaaaaaacgacgacgaaacccgtaaaaaccccgtaaaaccccatacccgacccaataaccaaccgaaac

SEQ ID NO: 9693 - DNA, 753 bp, Artificial Sequence
  chemically treated genomic DNA (Homo sapiens) CpG-island No: 9693
gttcggttcgggggtggcgaaggcggtgaatggagattcggggggggcgggggcggggtcgcggcgggcggggcggggcggggcgagtcgggtcgaggttcgggggcggggttaggcgcgcggttggtttgggtttaggtcgttgttgggtttcgtttcgttcggttacgtaggcggtagggttgcggtacgggtcgggcggtattatggcggcggcggcgtttgttgttgcggcggtttttttcgaggcgttagcggcgagtgcgattgtagagttcgaggtcggggattaggatagtcgcgaggttcgagtgttgtagagtttgcggggtaagatttgtaagcgggggttgggttgaggggacgttttggcggcgttgggcgcgaggttgagggggcggcgggttttcggcggtggcggcgtcgagttgcgttgggatcgcgggttcgggagggggtttgggtcgggcgcggttgaggttggaagggggtgtgttggggggcggcgtcgtttcgacggggcggcgtgggtcggggttgttgtttttcggagggagtgggagttggagatgggtttggggtgggagagttcggtttgcgtcggcgtgaggggttcggacgaggggagcggtttggatatagggacgttggagttcggtgcgcggtcggaattttagattttgattttttcgttttttttttttttatttgatttttgagttattattgttttttttttgtatttaagttttt

SEQ ID NO: 9694 - DNA, 753 bp, Artificial Sequence
  chemically treated genomic DNA (Homo sapiens) CpG-island No: 9694
aaaaacttaaatacaaaaaaaaaacaataataactcaaaaatcaaataaaaaaaaaaaaaacgaaaaaatcaaaatctaaaattccgaccgcgcaccgaactccaacgtccctatatccaaaccgctcccctcgtccgaacccctcacgccgacgcaaaccgaactctcccaccccaaacccatctccaactcccactccctccgaaaaacaacaaccccgacccacgccgccccgtcgaaacgacgccgccccccaacacacccccttccaacctcaaccgcgcccgacccaaaccccctcccgaacccgcgatcccaacgcaactcgacgccgccaccgccgaaaacccgccgccccctcaacctcgcgcccaacgccgccaaaacgtcccctcaacccaacccccgcttacaaatcttaccccgcaaactctacaacactcgaacctcgcgactatcctaatccccgacctcgaactctacaatcgcactcgccgctaacgcctcgaaaaaaaccgccgcaacaacaaacgccgccgccgccataataccgcccgacccgtaccgcaaccctaccgcctacgtaaccgaacgaaacgaaacccaacaacgacctaaacccaaaccaaccgcgcgcctaaccccgcccccgaacctcgacccgactcgccccgccccgccccgcccgccgcgaccccgcccccgccccccccgaatctccattcaccgccttcgccacccccgaaccgaac

SEQ ID NO: 9695 - DNA, 753 bp, Artificial Sequence
  chemically treated genomic DNA (Homo sapiens) CpG-island No: 9695
gaaagtttaggtgtagagaaaaggtaataatagtttaggagttagataaggaaggagaaagcgaaagagttagggtttgaggtttcgatcgcgtatcggattttagcgtttttgtgtttagatcgtttttttcgttcgagttttttacgtcggcgtagatcgggtttttttattttaggtttatttttagtttttatttttttcggagagtagtagtttcggtttacgtcgtttcgtcgaggcgacgtcgttttttaatatatttttttttagttttaatcgcgttcggtttaggttttttttcgggttcgcgattttagcgtagttcggcgtcgttatcgtcgagaattcgtcgtttttttagtttcgcgtttagcgtcgttagggcgtttttttagtttagttttcgtttatagattttgtttcgtaggttttgtaatattcgaatttcgcgattgttttggttttcggtttcgggttttgtagtcgtattcgtcgttggcgtttcggaagaagtcgtcgtagtagtaggcgtcgtcgtcgttatggtgtcgttcggttcgtgtcgtagttttgtcgtttgcgtagtcgggcgaggcggagtttagtagcggtttaggtttaggttagtcgcgcgtttggtttcgttttcgggtttcggttcgattcgtttcgtttcgtttcgttcgtcgcggtttcgttttcgtttttttcgggtttttatttatcgttttcgttattttcgagtcgggt

SEQ ID NO: 9696 - DNA, 753 bp, Artificial Sequence
  chemically treated genomic DNA (Homo sapiens) CpG-island No: 9696
acccgactcgaaaataacgaaaacgataaataaaaacccgaaaaaaacgaaaacgaaaccgcgacgaacgaaacgaaacgaaacgaatcgaaccgaaacccgaaaacgaaaccaaacgcgcgactaacctaaacctaaaccgctactaaactccgcctcgcccgactacgcaaacgacaaaactacgacacgaaccgaacgacaccataacgacgacgacgcctactactacgacgacttcttccgaaacgccaacgacgaatacgactacaaaacccgaaaccgaaaaccaaaacaatcgcgaaattcgaatattacaaaacctacgaaacaaaatctataaacgaaaactaaactaaaaaaacgccctaacgacgctaaacgcgaaactaaaaaaacgacgaattctcgacgataacgacgccgaactacgctaaaatcgcgaacccgaaaaaaaacctaaaccgaacgcgattaaaactaaaaaaaaatatattaaaaaacgacgtcgcctcgacgaaacgacgtaaaccgaaactactactctccgaaaaaaataaaaactaaaaataaacctaaaataaaaaaacccgatctacgccgacgtaaaaaactcgaacgaaaaaaacgatctaaacacaaaaacgctaaaatccgatacgcgatcgaaacctcaaaccctaactctttcgctttctccttccttatctaactcctaaactattattaccttttctctacacctaaactttc

SEQ ID NO: 9697 - DNA, 539 bp, Artificial Sequence
  chemically treated genomic DNA (Homo sapiens) CpG-island No: 9697
cgttcgggcgggggtcgcgcgtcgtcgttcgcgtcgtcgtcgttcgtttttcgcgtcgtttttttttttttttgtttttttttttttgttcggcgtgttcgtttcgcgttttttttttttttcgtttttttttttttttttttttttttttttttttttttcgttttgtttttttcggtttgcgcgttcgttgtcggttttgtttttttcgcgcgtttttcggttcgttttttcgttttcgtgtttttggtgtttttttgttttttttcgtttttttttgtttttgttcgtcggtgttttttttttttttttttttttgcgttgtttttttttttttttttttttcgttttttttttttcgtttcgttttttcgtttcgtttttttttttgtttgttttcgtttcgttttttcgttgtcgcggtcgtcgggtgttcgcgtttttttcgacgtttagtttaagtcggttatcgtttgttgtttgttcgttcgtcgttcgcgtttttagtttttatagattgattataagaaaataaataa

SEQ ID NO: 9698 - DNA, 539 bp, Artificial Sequence
  chemically treated genomic DNA (Homo sapiens) CpG-island No: 9698
ttatttattttcttataatcaatctataaaaactaaaaacgcgaacgacgaacgaacaaacaacaaacgataaccgacttaaactaaacgtcgaaaaaaacgcgaacacccgacgaccgcgacaacgaaaaaacgaaacgaaaacaaacaaaaaaaaaaacgaaacgaaaaaacgaaacgaaaaaaaaaaaacgaaaaaaaaaaaaaaaaaaaaacaacgcaaaaaaaaaaaaaaaaaaaaaacaccgacgaacaaaaacaaaaaaaaacgaaaaaaaacaaaaaaacaccaaaaacacgaaaacgaaaaaacgaaccgaaaaacgcgcgaaaaaaacaaaaccgacaacgaacgcgcaaaccgaaaaaaacaaaacgaaaaaaaaaaaaaaaaaaaaaaaaaaaaaaaaaaaaacgaaaaaaaaaaaaaacgcgaaacgaacacgccgaacaaaaaaaaaaaaacaaaaaaaaaaaaaaacgacgcgaaaaacgaacgacgacgacgcgaacgacgacgcgcgacccccgcccgaacg

SEQ ID NO: 9699 - DNA, 539 bp, Artificial Sequence
  chemically treated genomic DNA (Homo sapiens) CpG-island No: 9699
ttgtttgtttttttgtaattagtttataaggattggaggcgcgggcggcgagcggataagtagtaaacgatagtcgatttggattaagcgtcgagagaagcgcggatattcgacgatcgcggtagcgagagagcgagacgaggataagtagggaggggggcgagacgaaagaacgggacggagaggaggaggcggaaagagaggagggggagagatagcgtaggagaagaaagggagagaaagtatcggcgggtaaaagtagaggagagcgagggaaaataaaggaatattagaagtacgggaacgaagaggcggatcggaggacgcgcgaaaaaggtagaatcggtaacgagcgcgtaggtcggaagaggtaagacgaggagggagaggaaaaaaggaagggaagagaagggggcgaaagaggagagaaacgcgagacgaatacgtcgagtaaagaagaaaaaataagggaaaaaggaggcggcgcggggagcgggcggcggcggcgcgggcggcggcgcgcggttttcgttcgggcg

SEQ ID NO: 9700 - DNA, 539 bp, Artificial Sequence
  chemically treated genomic DNA (Homo sapiens) CpG-island No: 9700
cgcccgaacgaaaaccgcgcgccgccgcccgcgccgccgccgcccgctccccgcgccgcctcctttttcccttattttttcttctttactcgacgtattcgtctcgcgtttctctcctctttcgcccccttctcttcccttccttttttcctctccctcctcgtcttacctcttccgacctacgcgctcgttaccgattctacctttttcgcgcgtcctccgatccgcctcttcgttcccgtacttctaatattcctttattttccctcgctctcctctacttttacccgccgatactttctctccctttcttctcctacgctatctctccccctcctctctttccgcctcctcctctccgtcccgttctttcgtctcgcccccctccctacttatcctcgtctcgctctctcgctaccgcgatcgtcgaatatccgcgcttctctcgacgcttaatccaaatcgactatcgtttactacttatccgctcgccgcccgcgcctccaatccttataaactaattacaaaaaaacaaacaa

SEQ ID NO: 9701 - DNA, 546 bp, Artificial Sequence
  chemically treated genomic DNA (Homo sapiens) CpG-island No: 9701
atgttcgtgggtgcggggcgtcgggcgaagggagatttcgcgattttaggcgttttcgcggtgtttacggtaggcgtaaagcgtagtaagggatattttttaaagtcgtatttcgtcggacggttgttttcgttttcgttttttaggtagcggtgggataaagcgcggtttttttttcgtcggggtttagggagggaaggtcggattagggttcgcgtttttcggttgtatttttttcgcgtcgcgtcggtcgtatataggtggtttttcgttcgggaggggtaggtttcggtatttttatataataatagagttttgcgcgtcgggaacgcgttttttcgtcgtcgcggtttttattcggttacgtttttattcggtttttaattcgttcgtttcgcggcgtttgggtcgagtgttgttcgttggtttggttcgtatttttttaaagttatttgttggttttgtagcgcggtagagacgtttttttcgattttttgggagcgaggagttaggggggtttcggtaggtattcgtttttgttttttt

SEQ ID NO: 9702 - DNA, 546 bp, Artificial Sequence
  chemically treated genomic DNA (Homo sapiens) CpG-island No: 9702
aaaaaaacaaaaacgaatacctaccgaaacccccctaactcctcgctcccaaaaaatcgaaaaaaacgtctctaccgcgctacaaaaccaacaaataactttaaaaaaatacgaaccaaaccaacgaacaacactcgacccaaacgccgcgaaacgaacgaattaaaaaccgaataaaaacgtaaccgaataaaaaccgcgacgacgaaaaaacgcgttcccgacgcgcaaaactctattattatataaaaataccgaaacctacccctcccgaacgaaaaaccacctatatacgaccgacgcgacgcgaaaaaaatacaaccgaaaaacgcgaaccctaatccgaccttccctccctaaaccccgacgaaaaaaaaaccgcgctttatcccaccgctacctaaaaaacgaaaacgaaaacaaccgtccgacgaaatacgactttaaaaaatatcccttactacgctttacgcctaccgtaaacaccgcgaaaacgcctaaaatcgcgaaatctcccttcgcccgacgccccgcacccacgaacat

SEQ ID NO: 9703 - DNA, 546 bp, Artificial Sequence
  chemically treated genomic DNA (Homo sapiens) CpG-island No: 9703
gggggagtaaggacgagtgtttgtcgggatttttttggtttttcgtttttaaggagtcgaggggaacgtttttatcgcgttgtaaagttagtaggtaattttggggaggtgcgggttaggttagcgagtagtattcggtttaggcgtcgcggggcggacggattggaagtcggatggaggcgtggtcgggtgggggtcgcggcggcggggaggcgcgttttcggcgcgtagagttttattgttatataaaagtgtcgaagtttgtttttttcgagcggaaaattatttgtgtgcggtcggcgcggcgcgagagggatgtagtcggaaggcgcgggttttaattcggttttttttttttaaatttcggcggaaaagaggtcgcgttttgttttatcgttgtttgagaggcggaagcgggggtagtcgttcggcggggtgcggttttggggagtgttttttgttgcgttttgcgtttatcgtgaatatcgcgagggcgtttaaggtcgcggggttttttttcgttcgacgtttcgtatttacgggtat

SEQ ID NO: 9704 - DNA, 546 bp, Artificial Sequence
  chemically treated genomic DNA (Homo sapiens) CpG-island No: 9704
atacccgtaaatacgaaacgtcgaacgaaaaaaaaccccgcgaccttaaacgccctcgcgatattcacgataaacgcaaaacgcaacaaaaaacactccccaaaaccgcaccccgccgaacgactacccccgcttccgcctctcaaacaacgataaaacaaaacgcgacctcttttccgccgaaatttaaaaaaaaaaaaccgaattaaaacccgcgccttccgactacatccctctcgcgccgcgccgaccgcacacaaataattttccgctcgaaaaaaacaaacttcgacacttttatataacaataaaactctacgcgccgaaaacgcgcctccccgccgccgcgacccccacccgaccacgcctccatccgacttccaatccgtccgccccgcgacgcctaaaccgaatactactcgctaacctaacccgcacctccccaaaattacctactaactttacaacgcgataaaaacgttcccctcgactccttaaaaacgaaaaaccaaaaaaatcccgacaaacactcgtccttactccccc

SEQ ID NO: 9705 - DNA, 829 bp, Artificial Sequence
  chemically treated genomic DNA (Homo sapiens) CpG-island No: 9705
gggtaaggcgaggcggaattaaatttcgtttcgagagcggtagtttcgcgcgcggtgcgttcggtttatgtttgtttcgaggggcgtttggtaggtatttcgttttttttcgtagttcgatttttatgatagatacgtttagattcgtgtttttcgcgtcggaaatggcgattagtaagacggtggcgtggtttaacgagtagttggagttgggtaacgagcggttgttgttgatggattgtcggtcgtaggagttatacgagtcgtcgtatatcgagtcggttattaacgtggttatttcgggtattatgttgcggcgtttgtagaagggtaatttgtcggtgcgcgcgttttttacgcgcggcgaggatcgggatcgttttattcggcgttgtggtatcgatatagtggtgttttacgacgagagtagtagcgattggaacgagaatacgggcggcgagtcggtgttcgggttgttgtttaagaagtttaaggacgagggttgtcgggcgttttatttggaaggtacgcgtttagggaatttcgcgcgcggggtagggttaggggcgtagggttgcgggcggggcgcgtggattgaaaatatttttgtttcgtttagttggagtttcggagtcgcgttgttcgtttagggatcggtagtcggcgaggtaggggtcgcgaatcgcgcgtttcgtattagagaatcgggtcggtttagaatttattcgttttcggttgcgggtatcggcggtttttttttaacgggttttgcgtttttttagttagaatattttttattattattttgttttttatcgttcgattttga

SEQ ID NO: 9706 - DNA, 829 bp, Artificial Sequence
  chemically treated genomic DNA (Homo sapiens) CpG-island No: 9706
tcaaaatcgaacgataaaaaacaaaataataataaaaaatattctaactaaaaaaacgcaaaacccgttaaaaaaaaaccgccgatacccgcaaccgaaaacgaataaattctaaaccgacccgattctctaatacgaaacgcgcgattcgcgacccctacctcgccgactaccgatccctaaacgaacaacgcgactccgaaactccaactaaacgaaacaaaaatattttcaatccacgcgccccgcccgcaaccctacgcccctaaccctaccccgcgcgcgaaattccctaaacgcgtaccttccaaataaaacgcccgacaaccctcgtccttaaacttcttaaacaacaacccgaacaccgactcgccgcccgtattctcgttccaatcgctactactctcgtcgtaaaacaccactatatcgataccacaacgccgaataaaacgatcccgatcctcgccgcgcgtaaaaaacgcgcgcaccgacaaattacccttctacaaacgccgcaacataatacccgaaataaccacgttaataaccgactcgatatacgacgactcgtataactcctacgaccgacaatccatcaacaacaaccgctcgttacccaactccaactactcgttaaaccacgccaccgtcttactaatcgccatttccgacgcgaaaaacacgaatctaaacgtatctatcataaaaatcgaactacgaaaaaaaacgaaatacctaccaaacgcccctcgaaacaaacataaaccgaacgcaccgcgcgcgaaactaccgctctcgaaacgaaatttaattccgcctcgccttaccc

SEQ ID NO: 9707 - DNA, 829 bp, Artificial Sequence
  chemically treated genomic DNA (Homo sapiens) CpG-island No: 9707
ttaaaatcgaacgatagaaaatagggtgatggtggaggatgttttggttaagaaggcgtagaattcgttagaaagaaatcgtcggtattcgtagtcggaagcgagtggattttgagtcggttcggttttttggtgcggaacgcgcggttcgcggtttttatttcgtcggttgtcggtttttaggcgggtagcgcggtttcgaagttttagttgagcggagtagaggtatttttaatttacgcgtttcgttcgtagttttgcgtttttagttttgtttcgcgcgcggagttttttgggcgcgtattttttaggtagaacgttcggtagttttcgtttttgagttttttgagtagtagttcgagtatcgattcgtcgttcgtattttcgttttagtcgttgttgttttcgtcgtagagtattattgtgtcggtgttatagcgtcgggtgaagcggtttcggttttcgtcgcgcgtgaagagcgcgcgtatcggtaggttatttttttgtaggcgtcgtagtatgatgttcgggatggttacgttgatggtcgattcgatgtgcgacgattcgtatagtttttgcggtcggtagtttattagtagtagtcgttcgttgtttagttttagttgttcgttgagttacgttatcgttttgttgatcgttattttcgacgcgaagggtacgggtttgagcgtatttattatgggggtcgagttgcgggagagggcggggtgtttattagacgtttttcggggtaggtataggtcgagcgtatcgcgcgcgaagttgtcgttttcggagcggggtttaatttcgtttcgttttattt

SEQ ID NO: 9708 - DNA, 829 bp, Artificial Sequence
  chemically treated genomic DNA (Homo sapiens) CpG-island No: 9708
aaataaaacgaaacgaaattaaaccccgctccgaaaacgacaacttcgcgcgcgatacgctcgacctatacctaccccgaaaaacgtctaataaacaccccgccctctcccgcaactcgacccccataataaatacgctcaaacccgtacccttcgcgtcgaaaataacgatcaacaaaacgataacgtaactcaacgaacaactaaaactaaacaacgaacgactactactaataaactaccgaccgcaaaaactatacgaatcgtcgcacatcgaatcgaccatcaacgtaaccatcccgaacatcatactacgacgcctacaaaaaaataacctaccgatacgcgcgctcttcacgcgcgacgaaaaccgaaaccgcttcacccgacgctataacaccgacacaataatactctacgacgaaaacaacaacgactaaaacgaaaatacgaacgacgaatcgatactcgaactactactcaaaaaactcaaaaacgaaaactaccgaacgttctacctaaaaaatacgcgcccaaaaaactccgcgcgcgaaacaaaactaaaaacgcaaaactacgaacgaaacgcgtaaattaaaaatacctctactccgctcaactaaaacttcgaaaccgcgctacccgcctaaaaaccgacaaccgacgaaataaaaaccgcgaaccgcgcgttccgcaccaaaaaaccgaaccgactcaaaatccactcgcttccgactacgaataccgacgatttctttctaacgaattctacgccttcttaaccaaaacatcctccaccatcaccctattttctatcgttcgattttaa

SEQ ID NO: 9709 - DNA, 574 bp, Artificial Sequence
  chemically treated genomic DNA (Homo sapiens) CpG-island No: 9709
tttcgcgttgcgtatttggaagtgcgtaggttgtttcgtcgtttcgtcggcgcgttggtagttgaagtaggtttttgttatgtttaggtggtcgaggggtagcgggtcgtgggggtttttgaagtagtagaggtagtagcggcgttcgtttaatacgaatcgacggttgcggtagttacgtagtcgcgttggttttcgcgcggtattcgtttcgggttttgtagtttttttatcgtcgtcgttgtttttttttgttcgggtttcggtttcggtatggttgtttgcgcgttaatcgtttgtttttcggttttcgcgttttcgcgttgcggttgttgcgttttttgttttcgcggtgtttttttttcgtcgtttcgttttttttttaggcgtttaaagtggtttggaatttgtagaacgtttttttttaagttcgttggtagttgttttagttcgttggtttttgttttcgttcgttggtcgttgttttcgcgacgtttcggaagttaggttttgtttttcgtatttgttaagttttcgttttgtcggagtttcgttttgtcgtttaggttggagt

SEQ ID NO: 9710 - DNA, 574 bp, Artificial Sequence
  chemically treated genomic DNA (Homo sapiens) CpG-island No: 9710
actccaacctaaacgacaaaacgaaactccgacaaaacgaaaacttaacaaatacgaaaaacaaaacctaacttccgaaacgtcgcgaaaacaacgaccaacgaacgaaaacaaaaaccaacgaactaaaacaactaccaacgaacttaaaaaaaaacgttctacaaattccaaaccactttaaacgcctaaaaaaaaaacgaaacgacgaaaaaaaaacaccgcgaaaacaaaaaacgcaacaaccgcaacgcgaaaacgcgaaaaccgaaaaacaaacgattaacgcgcaaacaaccataccgaaaccgaaacccgaacaaaaaaaaacaacgacgacgataaaaaaactacaaaacccgaaacgaataccgcgcgaaaaccaacgcgactacgtaactaccgcaaccgtcgattcgtattaaacgaacgccgctactacctctactacttcaaaaacccccacgacccgctacccctcgaccacctaaacataacaaaaacctacttcaactaccaacgcgccgacgaaacgacgaaacaacctacgcacttccaaatacgcaacgcgaaa

SEQ ID NO: 9711 - DNA, 574 bp, Artificial Sequence
  chemically treated genomic DNA (Homo sapiens) CpG-island No: 9711
attttagtttgggcgatagagcgagatttcggtagggcggggatttggtaggtgcgggaggtaggatttggttttcggggcgtcgcgggggtaacggttagcgggcgggggtaagggttagcgggttaggataattgttaacgggtttggaggggggcgttttataaattttaggttattttgagcgtttgagagaggagcggggcggcgggaagggggtatcgcgggggtagggagcgtagtagtcgtagcgcgaaggcgcgggggtcggggaataaacggttggcgcgtaggtagttatatcggggtcggaattcgggtagaggagggtagcgacggcgatggggaggttgtagagttcggggcgggtatcgcgcgggaattagcgcgattgcgtggttatcgtagtcgtcggttcgtgttggacgggcgtcgttgttgtttttgttattttaagaatttttacgattcgttgtttttcggttatttggatatagtagaagtttgttttagttattagcgcgtcgacgaggcggcggagtagtttgcgtatttttaggtgcgtagcgcggga

SEQ ID NO: 9712 - DNA, 574 bp, Artificial Sequence
  chemically treated genomic DNA (Homo sapiens) CpG-island No: 9712
tcccgcgctacgcacctaaaaatacgcaaactactccgccgcctcgtcgacgcgctaataactaaaacaaacttctactatatccaaataaccgaaaaacaacgaatcgtaaaaattcttaaaataacaaaaacaacaacgacgcccgtccaacacgaaccgacgactacgataaccacgcaatcgcgctaattcccgcgcgatacccgccccgaactctacaacctccccatcgccgtcgctaccctcctctacccgaattccgaccccgatataactacctacgcgccaaccgtttattccccgacccccgcgccttcgcgctacgactactacgctccctacccccgcgatacccccttcccgccgccccgctcctctctcaaacgctcaaaataacctaaaatttataaaacgcccccctccaaacccgttaacaattatcctaacccgctaacccttacccccgcccgctaaccgttacccccgcgacgccccgaaaaccaaatcctacctcccgcacctaccaaatccccgccctaccgaaatctcgctctatcgcccaaactaaaat

SEQ ID NO: 9713 - DNA, 735 bp, Artificial Sequence
  chemically treated genomic DNA (Homo sapiens) CpG-island No: 9713
ttcgtttcgtttcgtgtcggtttcgtttggagtcgtttcgttttcgttttttatcgagttttttaggtgatgttgtagttaagatggcgttcgcggcggtcgtggcggtttgagcgtgatgtttcgggttttcggcggcggttgtggttttggtcggggttttgggtttttttcggtcgtgagcgattagcgttttttcgtcggtcgggttagtcgggatagagaggagacggttacgaagagaggaggtagtgagtaataggacgagatcgcggcgtttttagtttcggtattatggtcgggattattaagaaataaattttgaagtatttttttaggttagtgagcgtttcggtgtcggcgttagtcggtttttattttagttcgtattggagttagtttgcggtttcgggggcggcggcgtttggcggttgtgcgggaggcgattttcggattttttcgttttggtcggggtagaggtcgcggtttcggattttttgtcgtcggcggcgtcgggggttggttttacgaatcggtttttgacgcgtttttttttagggtgggcgcgcggaggagttcggagtgcggagcgcggcgggttgggatcgttttcggcgcggcgtttgggggcgtttcggttcggttttgtgcggtattgagcggaggttggaggtggtttggcgttatttaagtgtttggttaatgtgttgggttttaattcgagttcggtgtttt
